United States Patent
Masignani et al.

(10) Patent No.: US 7,608,276 B2
(45) Date of Patent: Oct. 27, 2009

(54) STAPHYLOCOCCUS AUREUS PROTEINS AND NUCLEIC ACIDS

(75) Inventors: Vega Masignani, Siena (IT); Marirosa Mora, Siena (IT); Maria Scarselli, Siena (IT)

(73) Assignee: Novartis Vaccines and Diagnostics SRL, Siena (IT)

( * ) Notice: Subject to any disclaimer, the term of this patent is extended or adjusted under 35 U.S.C. 154(b) by 406 days.

(21) Appl. No.: 10/471,571

(22) PCT Filed: Mar. 27, 2002

(86) PCT No.: PCT/IB02/02637

§ 371 (c)(1),
(2), (4) Date: Oct. 20, 2004

(87) PCT Pub. No.: WO02/094868

PCT Pub. Date: Nov. 28, 2002

(65) Prior Publication Data

US 2006/0115490 A1    Jun. 1, 2006

(30) Foreign Application Priority Data

Mar. 27, 2001    (GB)    ................... 0107661.1

(51) Int. Cl.
 A61K 39/085    (2006.01)
 A61K 39/02    (2006.01)
 C12P 21/04    (2006.01)
 C07H 21/04    (2006.01)
 C12N 1/20    (2006.01)
 C07K 14/00    (2006.01)

(52) U.S. Cl. ............... 424/243.1; 424/190.1; 424/184.1; 435/252.3; 435/69.7; 435/69.1; 530/350; 536/23.7

(58) Field of Classification Search .................. None
See application file for complete search history.

(56) References Cited

U.S. PATENT DOCUMENTS

| | | | |
|---|---|---|---|
| 7,101,692 B2 * | 9/2006 | Schneewind et al. | ........ 435/183 |
| 7,410,647 B2 | 8/2008 | Foster | |
| 2006/0140979 A1 | 6/2006 | Foster et al. | |
| 2008/0038287 A1 | 2/2008 | Meinke | |

FOREIGN PATENT DOCUMENTS

| | | |
|---|---|---|
| EP | 0 785 519 A | 7/1997 |
| EP | 0786519 | 7/1997 |
| WO | WO 98/18931 | 5/1998 |
| WO | WO 00/06738 | 2/2000 |
| WO | WO 01/16292 A2 | 3/2001 |
| WO | 01/70955 | 9/2001 |
| WO | WO 01/98499 A1 | 12/2001 |
| WO | WO 02/059148 A2 | 8/2002 |
| WO | 02/077183 | 10/2002 |
| WO | 02/102829 | 12/2002 |
| WO | 03/011899 | 2/2003 |

OTHER PUBLICATIONS

Rudinger et al, in "Peptide Hormones", edited by Parsons, J.A., University Park Press, Jun. 1976,).*
Bowie et al (Science, 1990, 257:1306-1310).*
Feng et al 2004, Biochimie 86; 893-901.*
Camara et al, Infection and Immunity, 62(9):3688-3695 (1994).
Tettelin et al, Science, 293(5529):498-506.
Partial European Search Report, dated Aug. 1, 2007, in Counterpart European Application No. 07075403.1-2405.
Navarre et al., "Surface Proteins of Gram-Positive Bacteria and Mechanisms of Their Targeting to the Cell Wall Envelope," Microbiology and Molecular Biology Reviews, American Society for Microbiology, US, vol. 63, No. 1, Mar. 1999: 174-229; XP002319594.
Cheung et al., "Surface Proteins of *Staphylococcus aureus*," Review of Infectious Diseases, Chicago, IL, US, vol. 10, No. Suppl. 2, Jul. 1988: S351-S355; XP002020048.
Foster, "Potential for Vaccination against Infections Caused by *Staphylococcus aureus*," Vaccine, Butterworth, Scientific. Guildford, GB, vol. 9, No. 4, Apr. 1991: 221-227; XP002020047.
Database Geneseq (Online) Mar. 16, 1999, "*Staphylococcus aureus* contig. Seq ID #205" retrieved from EBI accession No. GSN: AAV74516 Database accession No. AAV74516; XP002443354.
Kunst et al., "The complete genome sequence of the gram-positive bacterium *Bacillus subtilis*," Nature. Nov. 20, 1997;390(6657):249-56.
Kuroda et al., "Whole genome sequencing of meticillin-resistant *Staphylococcus aureus*," Lancet. Apr. 21, 2001;357 (9264):1225-40.
Database EMBL Online Aug. 2, 2000, Kimmerly et al., "*Staphylococcus epidermidis* strain SR1 clone strep. 1052f10 genomic sequence" retrieved from EBI, Database accession No. AF270186; XP002224580.

* cited by examiner

*Primary Examiner*—Robert B Mondesi
*Assistant Examiner*—Padma V Baskar
(74) *Attorney, Agent, or Firm*—Helen Lee; Lisa Hemmendinger

(57) ABSTRACT

The invention provides proteins from *Staphylococcus aureus* including amino acid sequences and the corresponding nucleotide sequences. The proteins are useful for vaccines, immunogenic compositions, diagnostics, enzymatic studies and also as targets for antibiotics.

7 Claims, No Drawings

STAPHYLOCOCCUS AUREUS PROTEINS AND NUCLEIC ACIDS

This application incorporates by reference the contents of each of two duplicate CD-ROMs. Each CD-ROM contains an identical 10.2 MB file labeled "17712-003 Revised Sequence listing—ST25 format .txt" and containing the sequence listing for this application. The CD-ROMs were created on Feb. 8, 2005.

All documents cited herein are incorporated by reference in their entirety.

TECHNICAL FIELD

This invention relates to nucleic acid and proteins from the bacteria *Staphylococcus aureus*.

BACKGROUND ART

*Staphylococcus aureus* is a Gram-positive spherical bacterium which, on microscopic examination, appears in pairs, short chains, or bunched clusters. Some strains are capable of producing a highly heat-stable protein enterotoxin that causes food poisoning (staphyloenterotoxicosis) in humans. Of particular clinical concern are strains which are resistant to a wide range of antibiotics ('MRSA').

There is currently no effective vaccine against *S.aureus*, although a polysaccharide conjugate vaccine is currently undergoing clinical trials (StaphVAX™ from Nabi).

It is an object of the invention to provide proteins which can be used in the development of vaccines. Further objects are to provide proteins and nucleic acid which can be used in the diagnosis of *S.aureus* infection, to provide proteins and nucleic acid which can be used for the detection of *S.aureus*, to provide nucleic acid which is useful for the expression of *S.aureus* proteins, and to provide proteins which are useful targets for antibiotic research.

DISCLOSURE OF THE INVENTION

The invention provides proteins comprising the *S.aureus* amino acid sequences disclosed in the examples. These amino acid sequences are the even SEQ IDs between 2 and 5642.

It also provides proteins comprising amino acid sequences having sequence identity to the *S.aureus* amino acid sequences disclosed in the examples. Depending on the particular sequence, the degree of sequence identity is preferably greater than 50% (e.g. 60%, 70%, 80%, 90%, 95%, 99% or more). These proteins include homologs, orthologs, allelic variants and functional mutants. Typically, 50% identity or more between two proteins is considered to be an indication of functional equivalence. Identity between proteins, is preferably determined by the Smith-Waterman homology search algorithm as implemented in the MPSRCH program (Oxford Molecular), using an affine gap search with parameters gap open penalty=12 and gap extension penalty=1.

The invention further provides proteins comprising fragments of the *S.aureus* amino acid sequences disclosed in the examples. The fragments should comprise at least n consecutive amino acids from the sequences and, depending on the particular sequence, n is 7 or more (e.g. 8, 10, 12, 14, 16, 18, 20, 30, 40, 50, 60, 70, 80, 90, 100 or more). Preferably the fragments comprise one or more epitopes from the sequence. Other preferred fragments are (a) the N-terminal signal peptides of the proteins disclosed in the examples, (b) the proteins disclosed in the examples, but without their N-terminal signal peptides, and (c) the proteins disclosed in the examples, but without their N-terminal amino acid residue.

The proteins of the invention can, of course, be prepared by various means (e.g. recombinant expression, purification from *S.aureus*, chemical synthesis etc.) and in various forms (e.g. native, fusions etc.). They are preferably prepared in substantially pure form (i.e. substantially free from other staphylococcal or host cell proteins). Proteins of the invention are preferably staphylococcal proteins.

Preferred proteins are those which show homology to the 'GBSnnn' antigens listed in Table IV of PCT/GB01/04789 i.e. which are inferred to be useful antigens for immunisation and/or diagnosis. These include SEQ IDs: 1078 (GBS199), 1876 (GBS177), 1946 (GBS311), 2508 (GBS312), 3724 (GBS25), 4600 (GBS90), 4826 (GBS492), and 5360 (GBS114).

According to a further aspect, the invention provides antibodies which bind to these proteins. These may be polyclonal or monoclonal and may be produced by any suitable means. The antibodies may include a detectable label.

According to a further aspect, the invention provides nucleic acid comprising the *S.aureus* nucleotide sequences disclosed in the examples. These sequences are the odd SEQ IDs between 1 and 5641.

In addition, the invention provides nucleic acid comprising nucleotide sequences having sequence identity to the *S.aureus* nucleotide sequences disclosed in the examples. Identity between sequences is preferably determined by the Smith-Waterman homology algorithm as described above.

Furthermore, the invention provides nucleic acid which can hybridise to the *S.aureus* nucleic acid disclosed in the examples, preferably under "high stringency" conditions (e.g. 65° C. in a 0.1×SSC, 0.5% SDS solution).

Nucleic acid comprising fragments of these sequences are also provided. These should comprise at least n consecutive nucleotides from the *S.aureus* sequences and, depending on the particular sequence, n is 10 or more (e.g. 12, 14, 15, 18, 20, 25, 30, 35, 40, 50, 60, 70, 80, 90, 100, 150, 200 or more).

Nucleic acids of the invention can be used in hybridisation reactions (e.g. Northern or Southern blots, or in nucleic acid microarrays or 'gene chips') and amplification reactions (e.g. PCR, SDA, SSSR, LCR, NASBA, TMA) etc.

According to a further aspect, the invention provides nucleic acid encoding the proteins and protein fragments of the invention.

It should also be appreciated that the invention provides nucleic acid comprising sequences complementary to those described above (e.g. for antisense or probing purposes).

Nucleic acid according to the invention can, of course, be prepared in many ways (e.g. by chemical synthesis, from genomic or cDNA libraries, from the organism itself etc.) and can take various forms (e.g. single stranded, double stranded, vectors, primers, probes etc.). The nucleic acid is preferably in substantially isolated form.

Nucleic acid according to the invention may be labelled e.g. with a radioactive or fluorescent label. This is particularly useful where it is to be used as a primer or probe e.g. in PCR, LCR, TMA, NASBA.

In addition, the term "nucleic acid" includes DNA and RNA, and also their analogues, such as those containing modified backbones, and also peptide nucleic acids (PNA) etc.

According to a further aspect, the invention provides vectors comprising nucleotide sequences of the invention (e.g. cloning or expression vectors) and host cells transformed with such vectors.

According to a further aspect, the invention provides compositions comprising protein, antibody, and/or nucleic acid according to the invention. These compositions may be suitable as immunogenic compositions, for instance, or as diagnostic reagents, or as vaccines.

The invention also provides nucleic acid, protein, or antibody according to the invention for use as medicaments (e.g. as immunogenic compositions or vaccines) or as diagnostic reagents. It also provides the use of nucleic acid, protein, or antibody according to the invention in the manufacture of: (i) a medicament for treating or preventing infection due to *staphylococcus*; (ii) a diagnostic reagent for detecting the presence of *staphylococcus* or of antibodies raised against *staphylococcus*; and/or (iii) a reagent which can raise antibodies against *staphylococcus*. Said *staphylococcus* may be any species, group or strain, but is preferably *S.aureus*.

The invention also provides a method of treating a patient, comprising administering to the patient a therapeutically effective amount of nucleic acid, protein, and/or antibody of the invention.

The invention also provides a kit comprising primers (e.g. PCR primers) for amplifying a target sequence contained within a *Staphylococcus* (e.g. *S.aureus*) nucleic acid sequence, the kit comprising a first primer and a second primer, wherein the first primer is substantially complementary to said target sequence and the second primer is substantially complementary to a complement of said target sequence, wherein the parts of said primers which have substantial complementarity define the termini of the target sequence to be amplified. The first primer and/or the second primer may include a detectable label (e.g. a fluorescent label).

The invention also provides a kit comprising first and second single-stranded oligonucleotides which allow amplification of a *Staphylococcus* (e.g. *S.aureus*) template nucleic acid sequence contained in a single- or double-stranded nucleic acid (or mixture thereof), wherein: (a) the first oligonucleotide comprises a primer sequence which is substantially complementary to said template nucleic acid sequence; (b) the second oligonucleotide comprises a primer sequence which is substantially complementary to the complement of said template nucleic acid sequence; (c) the first oligonucleotide and/or the second oligonucleotide comprise(s) sequence which is not complementary to said template nucleic acid; and, (d) said primer sequences define the termini of the template sequence to be amplified. The non-complementary sequence(s) of feature (c) are preferably upstream of (i.e. 5' to) the primer sequences. One or both of these (c) sequences may comprise a restriction site (e.g. EP-B-0509612) or a promoter sequence (e.g. EP-B-0505012). The first oligonucleotide and/or the second oligonucleotide may include a detectable label (e.g. a fluorescent label).

The template sequence may be any part of a genome sequence. For example, it could be a rRNA gene or a protein-coding gene. The template sequence is preferably specific to *S.aureus*.

The invention also provides a hybrid protein represented by the formula $NH_2$-A-[-X-L-]$_n$-B—COOH, wherein X is an amino acid sequence of the invention as described above, L is an optional linker amino acid sequence, A is an optional N-terminal amino acid sequence, B is an optional C-terminal amino acid sequence, and n is an integer greater than 1. The value of n is between 2 and x, and the value of x is typically 3, 4, 5, 6, 7, 8, 9 or 10. Preferably n is 2, 3 or 4; it is more preferably 2 or 3; most preferably, n=2. For each n instances, —X— may be the same or different. For each n instances of [—X-L-], linker amino acid sequence -L- may be present or absent. For instance, when n=2 the hybrid may be $NH_2$—$X_1$-$L_1$-$X_2$-$L_2$-COOH, $NH_2$—$X_1$—$X_2$—COOH, $NH_2$—$X_1$-$L_1$-$X_2$—COOH, $NH_2$—$X_1$—$X_2$-$L_2$-COOH, etc. Linker amino acid sequence(s) -L- will typically be short (e.g. 20 or fewer amino acids i.e. 19, 18, 17, 16, 15, 14, 13, 12, 11, 10, 9, 8, 7, 6, 5, 4, 3, 2, 1). Examples include short peptide sequences which facilitate cloning, poly-glycine linkers (i.e. Gly$_n$ where n=2, 3, 4, 5, 6, 7, 8, 9, 10 or more), and histidine tags (i.e. His$_n$ where n=3, 4, 5, 6, 7, 8, 9, 10 or more). Other suitable linker amino acid sequences will be apparent to those skilled in the art. -A- and —B— are optional sequences which will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. His$_n$ where n=3, 4, 5, 6, 7, 8, 9, 10 or more). Other suitable N-terminal and C-terminal amino acid sequences will be apparent to those skilled in the art.

According to further aspects, the invention provides various processes.

A process for producing proteins of the invention is provided, comprising the step of culturing a host cell of to the invention under conditions which induce protein expression.

A process for producing protein or nucleic acid of the invention is provided, wherein the protein or nucleic acid is synthesised in part or in whole using chemical means.

A process for detecting polynucleotides of the invention is provided, comprising the steps of: (a) contacting a nucleic probe according to the invention with a biological sample under hybridising conditions to form duplexes; and (b) detecting said duplexes.

A process for detecting *Staphylococcus* in a biological sample is also provided, comprising the step of contacting nucleic according to the invention with the biological sample under hybridising conditions. The process may involve nucleic acid amplification (e.g. PCR, SDA, SSSR, NASBA, LCR, TMA etc.) or hybridisation (e.g. microarrays, blots, hybridisation with a probe in solution etc.). PCR detection of *S.aureus* in clinical samples (especially MRSA) has previously been reported [see e.g. Murakami et al. (1991) *J. Clin. Microbiol.*29:2240-2244; Bignardi et al. (1996) *J. Antimicrob. Chemother.* 37:53-63; Kitagawa et al. (1996) *Ann. Surgery* 224:665-671; Vannuffel et al. (1998) *J. Clin. Microbiol.* 36:2366-2368; Jayaratne & Rutherford (1999) *Diagn. Microbiol Infect. Dis.* 35:13-18].

A process for detecting proteins of the invention is provided, comprising the steps of: (a) contacting an antibody of the invention with a biological sample under conditions suitable for the formation of an antibody-antigen complexes; and (b) detecting said complexes.

The invention also provides a process for determining whether a test compound binds to a protein of the invention. If a test compound binds to a protein of the invention and this binding inhibits the life cycle of the *S. aureus* bacterium, then the test compound can be used as an antibiotic or as a lead compound for the design of antibiotics. The process will typically comprise the steps of contacting a test compound with a protein of the invention, and determining whether the test compound binds to said protein. Preferred proteins of the invention for use in these processes are enzymes (e.g. tRNA synthetases), membrane transporters and ribosomal proteins. Suitable test compounds include proteins, polypeptides, carbohydrates, lipids, nucleic acids (e.g. DNA, RNA, and modified forms thereof), as well as small organic compounds (e.g. MW between 200 and 2000 Da). The test compounds may be provided individually, but will typically be part of a library (e.g. a combinatorial library). Methods for detecting a binding interaction include NMR, filter-binding assays, gel-retardation assays, displacement assays, surface plasmon resonance, reverse two-hybrid etc. A compound which binds to a protein of the invention can be tested for antibiotic activity by contacting the compound with *S.aureus* and then monitoring for inhibition of growth. The invention also provides a compound identified using these methods.

The invention also provides a composition comprising a protein or the invention and one or more of the following antigens:

- a protein antigen from *Helicobacter pylori* such as VacA, CagA, NAP, HopX, HopY [e.g. WO98/04702,] and/or urease.
- a protein antigen from *N.meningitidis* serogroup B, such as those in WO99/24578, WO99/36544, WO99/57280, WO00/22430, Tettelin et al. (2000) *Science* 287:1809-1815, Pizza et al. (2000) *Science* 287:1816-1820 and WO96/29412, with protein '287' and derivatives being particularly preferred.
- an outer-membrane vesicle (OMV) preparation from *N.meningitidis* serogroup B, such as those disclosed in WO01/52885; Bjune et al. (1991) Lancet 338(8775): 1093-1096; Fukasawa et al. (1999) *Vaccine* 17:2951-2958; Rosenqvist et al. (1998) *Dev. Biol. Stand.* 92:323-333 etc.
- a saccharide antigen from *N.meningitidis* serogroup A, C, W135 and/or Y, such as the oligosaccharide disclosed in Costantino et al. (1992) *Vaccine* 10:691-698 from serogroup C [see also Costantino et al. (1999) *Vaccine* 17:1251-1263].
- a saccharide antigen from *Streptococcus pneumoniae* [e.g. Watson (2000) *Pediatr Infect Dis J* 19:331-332; Rubin (2000) *Pediatr Clin North Am* 47:269-285, v; Jedrzejas (2001) *Microbiol Mol Biol Rev* 65:187-207].
- an antigen from hepatitis A virus, such as inactivated virus [e.g. Bell (2000) *Pediatr Infect Dis J* 19:1187-1188; Iwarson (1995) *APMIS* 103:321-326].
- an antigen from hepatitis B virus, such as the surface and/or core antigens [e.g. Gerlich et al. (1990) *Vaccine* 8 Suppl: S63-68 & 79-80].
- an antigen from hepatitis C virus [e.g. Hsu et al. (1999) *Clin Liver Dis* 3:901-915].
- an antigen from *Bordetella pertussis*, such as *pertussis* holotoxin (PT) and filamentous haemagglutinin (FHA) from *B.pertussis*, optionally also in combination with pertactin and/or agglutinogens 2 and 3 [e.g. Gustafsson et al. (1996) *N. Engl. J. Med.* 334:349-355; Rappuoli et al. (1991) *TIBTECH* 9:232-238].
- a diphtheria antigen, such as a diphtheria toxoid [e.g. chapter 3 of *Vaccines* (1988) eds. Plotkin & Mortimer. ISBN 0-7216-1946-0] e.g. the CRM$_{197}$ mutant [e.g. Del Guidice et al. (1998) *Molecular Aspects of Medicine* 19:1-70].
- a tetanus antigen, such as a tetanus toxoid [e.g. chapter 4 of Plotkin & Mortimer].
- a saccharide antigen from *Haemophilus influenzae* B.
- an antigen from *N.gonorrhoeae* [e.g. WO99/24578, WO99/36544, WO99/57280].
- an antigen from *Chlamydia pneumoniae* [e.g. WO02/02606; Kalman et al. (1999) *Nature Genetics* 21:385-389; Read et al. (2000) *Nucleic Acids Res* 28:1397-406; Shirai et al. (2000) *J. Infect. Dis.* 181 (Suppl 3):S524-S527; WO99/27105; WO00/27994; WO00/37494].
- an antigen from *S.agalactiae* [e.g. PCT/GB01/04789]
- an antigen from *S.pyogenes* [e.g. PCT/GB01/04789]
- an antigen from *Chlamydia trachomatis* [e.g. WO99/28475].
- an antigen from *Porphyromonas gingivalis* [e.g. Ross et al. (2001) *Vaccine* 19:4135-4142].
- polio antigen(s) [e.g. Sutter et al. (2000) *Pediatr Clin North Am* 47:287-308; Zimmerman & Spann (1999) *Am Fam Physician* 59:113-118, 125-126] such as IPV or OPV.
- rabies antigen(s) [e.g. Dreesen (1997) *Vaccine* 15 Suppl: S2-6] such as lyophilised inactivated virus [e.g. *MMWR Morb Mortal Wkly Rep* 1998 Jan 16;47(1):12, 19; RabAvert™].
- measles, mumps and/or rubella antigens [e.g. chapters 9, 10 & 11 of Plotkin & Mortimer].
- influenza antigen(s) [e.g. chapter 19 of Plotkin & Mortimer], such as the haemagglutinin and/or neuraminidase surface proteins.
- an antigen from *Moraxella catarrhalis* [e.g. McMichael (2000) *Vaccine* 19 Suppl 1:S101-107].

Where a saccharide or carbohydrate antigen is included, it is preferably conjugated to a carrier protein in order to enhance immunogenicity [e.g. Ramsay et al. (2001) *Lancet* 357(9251):195-196; Lindberg (1999) *Vaccine* 17 Suppl 2:S28-36; *Conjugate Vaccines* (eds. Cruse et al.) ISBN 3805549326, particularly vol. 10:48-114 etc.]. Preferred carrier proteins are bacterial toxins or toxoids, such as diphtheria or tetanus toxoids. The CRM$_{197}$ diphtheria toxoid is particularly preferred. Other suitable carrier proteins include the *N.meningitidis* outer membrane protein [e.g. EP-0372501], synthetic peptides [e.g. EP-0378881, EP-0427347], heat shock proteins [e.g. WO93/17712], *pertussis* proteins [e.g. WO98/58668; EP-0471177], protein D from *H.influenzae* [e.g. WO00/56360], toxin A or B from *C.difficile* [e.g. WO00/61761], etc. Any suitable conjugation reaction can be used, with any suitable linker where necessary.

Toxic protein antigens may be detoxified where necessary (e.g. detoxification of *pertussis* toxin by chemical and/or genetic means).

Where a diphtheria antigen is included in the composition it is preferred also to include tetanus antigen and *pertussis* antigens. Similarly, where a tetanus antigen is included it is preferred also to include diphtheria and *pertussis* antigens. Similarly, where a *pertussis* antigen is included it is preferred also to include diphtheria and tetanus antigens.

Antigens are preferably adsorbed to an aluminium salt.

Antigens in the composition will typically be present at a concentration of at least 1 µg/ml each. In general, the concentration of any given antigen will be sufficient to elicit an immune response against that antigen.

The invention also provides compositions comprising two or more (e.g. 3, 4, 5) proteins of the invention.

A summary of standard techniques and procedures which may be employed to perform the invention (e.g. to utilise the disclosed sequences for vaccination or diagnostic purposes) follows. This summary is not a limitation on the invention but, rather, gives examples that may be used, but are not required.

General

The practice of the present invention will employ, unless otherwise indicated, conventional techniques of molecular biology, microbiology, recombinant DNA, and immunology, which are within the skill of the art. Such techniques are explained fully in the literature eg. Sambrook *Molecular Cloning; A Laboratory Manual, Second Edition* (1989); *DNA Cloning, Volumes I and II* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal: Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I-IV* (D. M. Weir and C. C. Blackwell eds 1986).

Standard abbreviations for nucleotides and amino acids are used in this specification.

DEFINITIONS

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "comprising" means "including" as well as "consisting" e.g. a composition "comprising" X may consist exclusively of X or may include something additional e.g. X+Y.

The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a *staphylococcus* sequence is heterologous to a mouse host cell. A further examples would be two epitopes from the same or different proteins which have been assembled in a single protein in an arrangement not found in nature.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as DNA, RNA or amino acid sequence differing from but having sequence identity with the native or disclosed sequence. Depending on the particular sequence, the degree of sequence identity between the native or disclosed sequence and the mutant sequence is preferably greater than 50% (eg. 60%, 70%, 80%, 90%, 95%, 99% or more, calculated using the Smith-Waterman algorithm as described above). As used herein, an "allelic variant" of a nucleic acid molecule, or region, for which nucleic acid sequence is provided herein is a nucleic acid molecule, or region, that occurs essentially at the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions (eg. see U.S. Pat. No. 5,753, 235).

Expression Systems

The *staphylococcus* nucleotide sequences can be expressed in a variety of different expression systems; for example those used with mammalian cells, baculoviruses, plants, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (eg. structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation [Sambrook et al. (1989) "Expression of Cloned Genes in Mammalian Cells." in *Molecular Cloning: A Laboratory Manual, 2nd ed.*].

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter, In addition, sequences derived from non-viral genes, such as the murine metallotheionein gene, also provide useful promoter sequences. Expression may be either constitutive or regulated (inducible), depending on the promoter can be induced with glucocorticoid in hormone-responsive cells.

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter [Maniatis et al. (1987) *Science* 236:1237; Alberts et al. (1989) *Molecular Biology of the Cell*, 2nd ed.]. Enhancer elements derived from viruses may be particularly useful, because they usually have a broader host range. Examples include the SV40 early gene enhancer [Dijkema et al (1985) *EMBO J.* 4:761] and the enhancer/promoters derived from the long terminal repeat (LTR) of the Rous Sarcoma Virus [Gorman et al. (1982b) *Proc. Natl. Acad. Sci.* 79:6777] and from human cytomegalovirus [Boshart et al. (1985) *Cell* 41:521]. Additionally, some enhancers are regulatable and become active only in the presence of an inducer, such as a hormone or metal ion [Sassone-Corsi and Borelli (1986) *Trends Genet.* 2:215; Maniatis et al. (1987) *Science* 236:1237].

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus triparite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polya-denylation [Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105]. These sequences direct the transcription of an mRNA which can be translated into the polypeptide encoded by the DNA. Examples of transcription terminater/polyadenylation signals include those derived from SV40 [Sambrook et al (1989) "Expression of cloned genes in cultured mammalian cells." In *Molecular Cloning: A Laboratory Manual]*.

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (eg. plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 [Gluzman (1981) *Cell* 23:175] or polyomavirus, replicate to extremely high copy number in the presence of the appropriate viral T antigen. Additional examples of mammalian replicons include those derived from bovine papillomavirus and Epstein-Barr virus. Additionally, the replicon may have two replicaton systems, thus allowing it to be maintained, for example, in mammalian cells for expression and in a prokaryotic host for cloning and amplification. Examples of such mammalian-bacteria shuttle vectors include pMT2 [Kaufman et al. (1989) *Mol. Cell. Biol.*9:946] and pHEBO [Shimizu et al. (1986) *Mol. Cell. Biol.* 6:1074].

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (eg. Hep G2), and a number of other cell lines.

ii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The package recombinant virus is expressed and recombinant plaques are identified and purified. Materials and methods for baculovirus/insect cell expression systems are commercially available in kit form from, inter alia, Invitrogen, San Diego, Calif. ("MaxBac" kit). These techniques are generally known to those skilled in the art and fully described in Summers and Smith, *Texas Agricultural Experiment Station Bulletin No. 1555* (1987) (hereinafter "Summers and Smith").

Prior to inserting the DNA sequence encoding the protein into the baculovirus genome, the above described components, comprising a promoter, leader (if desired), coding sequence, and transcription termination sequence, are usually assembled into an intermediate transplacement construct (transfer vector). This may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extra-chromosomal element (e.g. plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.*, 42:177) and a prokaryotic ampicillin-resistance (amp) gene and origin of replication for selection and propagation in *E. coli*.

Baculovirus transfer vectors usually contain a baculovirus promoter. A baculovirus promoter is any DNA sequence capable of binding a baculovirus, RNA polymerase and initiating the downstream (5' to 3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene,* 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA,* 82:8404; mouse IL-3, (Miyajima et al., (1987) *Gene* 58:273; and human glucocerebrosidase, Martin et al. (1988) *DNA,* 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91.The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 μm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. "Current Protocols in Microbiology" Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda,* and *Trichoplusia ni* (WO 89/046699; Carbonell et al., (1985) *J. Viral.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, eg. Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, eg. HPLC, affinity chromatography, ion exchange chromatography, etc.; electrophoresis; density gradient centrifugation; solvent extraction, etc. As appropriate, the product may be further purified, is required, so as to remove substantially any insect proteins which are also present in the medium, so as to provide a product which is at least substantially free of host debris, eg. proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iii. Plant Systems

There are many plant cell culture and whole plant genetic expression systems known in the art. Exemplary plant cellular genetic expression systems include those described in patents, such as: U.S. Pat. Nos. 5,693,506; 5,659,122; and 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology,*. Malcolm B. Wilkins, ed., 1984 Pitman Publishing Limited, London, pp. 21-52 References that describe other metabolically-regulated genes: Sheen, *Plant Cell*, 2:1027-1038(1990); Maas et al., *EMBO J.* 9:3447-3452 (1990); Benkel and Hickey, *Proc. Natl. Acad. Sci.* 84:1337-1339 (1987).

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr*, 11(2):165-185.

Sequences suitable for permitting integration of the heterologous sequence into the plant genome are also recommended. These might include transposon sequences and the like for homologous recombination as well as Ti sequence which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature,* 296, 72-74, 1982. Another method of introduction of nucleic acid segments is high velocity ballistic penetration by small particles with the nucleic acid either within the matrix of small beads or particles, or on the surface, Klein, et al., *Nature,* 327, 70-73, 1987 and Knudsen and Muller, 1991, *Planta,* 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees; legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum*, and *Datura*.

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iv. Bacterial Systems

Bacterial expression techniques are known in the art. A bacterial promoter is any DNA sequence capable of binding bacterial RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) [Raibaud et al. (1984) *Annu. Rev. Genet.* 18:173]. Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) [Chang et al. (1977) *Nature* 198:1056], and maltose. Additional examples include promoter sequences derived from biosynthetic enzymes such as tryptophan (trp) [Goeddel et al. (1980) *Nuc. Acids Res.* 8:4057; Yelverton et al. (1981) *Nucl. Acids Res.* 9:731; U.S. Pat. No. 4,738,921; EP-A-0036776 and EP-A-0121775]. The g-laotamase (bla) promoter system [Weissmann (1981) "The cloning of interferon and other mistakes." In *Interferon* 3 (ed. I. Gresser)], bacteriophage lambda PL [Shimatake et al. (1981) *Nature* 292:128] and T5 [U.S. Pat. No. 4,689,406] promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter [U.S. Pat. No. 4,551,433]. For example, the lac promoter is a hybrid trp-lac promoter comprised of both trp promoter and lac operon sequences that is regulated by the lac repressor [Amann et al. (1983) *Gene* 25:167; de Boer et al. (1983) *Proc. Natl. Acad. Sci.* 80:21]. Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system [Studier et al. (1986) *J. Mol. Biol.* 189:113; Tabor et al. (1985) *Proc Natl. Acad. Sci.* 82:1074]. In addition, a hybrid promoter can also be comprised of a bacteriophage promoter and an *E. coli* operator region (EPO-A-0 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon [Shine et al. (1975) *Nature* 254:34]. The SD sequence is thought to promote binding of mRNA to the ribosome by the pairing of bases between the SD sequence and the 3' and of *E. coli* 16S rRNA [Steitz et al. (1979) "Genetic signals and nucleotide sequences in messenger RNA." In *Biological Regulation and Development: Gene Expression* (ed. R. F. Goldberger)]. To express eukaryotic genes and prokaryotic genes with weak ribosome-binding site [Sambrook et al. (1989) "Expression of cloned genes in *Escherichia coli*." In *Molecular Cloning: A Laboratory Manual*].

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo on in vitro incubation with a bacterial methionine N-terminal peptidase (EPO-A-0 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene [Nagai et al. (1984) *Nature* 309:810]. Fusion proteins can also be made with sequences from the lacZ [Jia et al. (1987) *Gene* 60:197], trpE [Allen et al. (1987) J. Biotechnol. 5:93; Makoff et al. (1989) *J. Gen. Microbial.* 135:11], and Chey [EP-A-0 324 647] genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (eg. ubiquitin specific processing-protease) to cleave the ubiquitin from the foreign protein. Through this method, native foreign protein can be isolated [Miller et al. (1989) *Bio/Technology* 7:698].

Alternatively, foreign proteins can also be secreted from the cell by creating chimeric DNA molecules that encode a fusion protein comprised of a signal peptide sequence fragment that provides for secretion of the foreign protein in bacteria [U.S. Pat. No. 4,336,336]. The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in viva or in vitro encoded between the signal peptide fragment and the foreign gene.

DNA encoding suitable signal sequences can be derived from genes for secreted bacterial proteins, such as the *E. coli* outer membrane protein gene (ompA) [Masui et al. (1983), in: *Experimental Manipulation of Gene Expression*; Ghrayeb et al. (1984) *EMBO J.* 3:2437] and the *E. coli* alkaline phosphatase signal sequence (phoA) [Oka et al. (1985) *Proc. Natl. Acad. Sci.* 82:7212]. As an additional example, the signal sequence of the alpha-amylase gene from various *Bacillus* strains can be used to secrete heterologous proteins from *B. subtilis* [Palva et al. (1982) *Proc. Natl. Acad. Sci. USA* 79:5582; EP-A-0 244 042].

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (eg. plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP-A-0 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline [Davies et al. (1978) *Annu. Rev. Microbiol.* 32:469]. Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* [Palva et al. (1982) *Proc. Natl. Acad. Sci. USA* 79:5582; EP-A-0 036 259 and EP-A-0 063 953; WO 84/04541], *Escherichia coli* [Shimatake et al. (1981) *Nature* 292:128; Amann et al. (1985) *Gene* 40:183; Studier et al. (1986) *J. Mol. Biol.* 189:113; EP-A-0 036 776, EP-A-0 136 829 and EP-A-0 136 907], *Streptococcus cremoris* [Powell et al. (1988) *Appl. Environ. Microbial.* 54:655]; *Streptococcus lividans* [Powell et al. (1988) *Appl. Environ. Microbial.* 54:655], *Streptomyces lividans* [U.S. Pat. No. 4,745,056].

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. See. eg. [Masson et al. (1989) *FEMS Microbiol. Lett.* 60:273; Palva et al. (1982) *Proc. Natl. Acad. Sci. USA* 79:5582; EP-A-0 036 259 and EP-A-0 063 953; WO 84/04541, *Bacillus*], [Miller et al. (1988) *Proc. Natl. Acad. Sci.* 85:856; Wang et al. (1990) *J. Bacteriol.* 172:949, Campylobacter], [Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; *Escherichia*], [Chassy et al. (1987) *FEMS Microbiol. Lett.* 44:173 *Lactobacillus*]; [Fiedler et al. (1988) *Anal. Biochem* 170:38, *Pseudomonas]; [Augustin et al.* (1990) *FEMS Microbiol. Lett.* 66:203, *Staphylococcus]*, [Barany et al. (1980) *J. Bacteriol.* 144:698; Harlander (1987) "Transformation of *Streptococcus lactis* by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc, 4th Evr. Cong. Biotechnology* 1:412, *Streptococcus]*.

v. Yeast Expression

Yeast expression systems are also known to one of ordinary skill in the art. A yeast promoter is any DNA sequence capable of binding yeast RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site (the "DATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EP-A-0 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO-A-0 329 203). The yeast PH05 gene, encoding acid phosphatase, also provides useful promoter sequences [Myanohara et at. (1983) *Proc. Natl. Acad. Sci. USA* 80:1].

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876, 197 and 4,880,734). Other examples of hybrid promoters include promoters which consist of the regulatory sequences of either the ADH2, GAL4, GAL10, OR PH05 genes, combined with the transcriptional activation region of a glycolytic enzyme gene such as GAP or PyK (EP-A-0 164 556). Furthermore, a yeast promoter can include naturally occurring promoters of non-yeast origin that have the ability to bind yeast RNA polymerase and initiate transcription. Examples of such promoters include, inter alia, [Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109;].

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See eg. EP-A-0 196 056. Another example is a ubiquitin fusion protein. Such a fusion protein is made with the ubiquitin region that preferably retains a site for a processing enzyme (eg. ubiquitin-specific processing protease) to cleave the ubiquitin from the foreign protein. Through this method, therefore, native foreign protein can be isolated (eg. WO88/ 024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EP-A-0 012 873; JPO. 62,096,086) and the A-factor gene (U.S. Pat. No. 4,588,684). Alternatively, leaders of non-yeast origin, such as an interferon leader, exist that also provide for secretion in yeast (EP-A-0 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EP-A-0 324 274). Additional leaders employing an alpha-factor leader fragment that provides for secretion include hybrid alpha-factor leaders made with a presequence of a first yeast, but a pro-region from a second yeast alphafactor. (eg. see WO 89/02463)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (eg. plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 [Botstein et al. (1979) *Gene* 8:17-24], pCl/1 [Brake et al. (1984) *Proc. Natl. Acad. Sci USA* 81:4642-4646], and YRp17 [Stinchcomb et al. (1982) *J. Mol. Biol.* 158:157]. In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See eg. Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome [Orr-Weaver et al. (1983) *Methods in Enzymol.* 101:228-245]. An integrating vector may be directed to a specific locus in yeast by selecting the appropriate homologous sequence for inclusion in the vector. See Orr-Weaver et al., supra. One or more expression construct may integrate, possibly affecting levels of recombinant protein produced [Rine et al. (1983) *Proc. Natl. Acad. Sci. USA* 80:6750]. The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions [Butt et al. (1987) *Microbiol, Rev.* 51:351].

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors have been developed for, inter alia, the following yeasts:*Candida albicans* [Kurtz, et al. (1986) *Mol. Cell. Biol.* 6:142], *Candida maltosa* [Kunze, et al. (1985) *J. Basic Microbiol.* 25:141]. *Hansenula polymorpha* [Gleeson, et al. (1986) *J. Gen. Microbiol.* 132:3459; Roggenkamp et al. (1986) *Mol. Gen. Genet.* 202:302], *Kluyveromyces fragilis* [Das, et al. (1984) *J. Bacteriol.* 158:1165], *Kluyveromyces lactis* [De Louvencourt et al. (1983) *J. Bacterial.* 154:737; Van den Berg et al. (1990) *Bio/Technology* 8:135], *Pichia guillerimondii* [Kunze et al. (1985) *J. Basic Microbiol.* 25:141], *Pichia pastoris*[Cregg, et al. (1985) *Mol. Cell. Biol.* 5:3376; U.S. Pat. Nos. 4,837,148 and 4,929,555], *Saccharomyces cerevisiae* [Hinnen et al. (1978) *Proc. Natl. Acad. Sci. USA* 75:1929; Ito et al. (1983) *J. Bacteriol.* 153:163], *Schizosaccharomyces pombe* [Beach and Nurse (1981) *Nature* 300:706], and *Yarrowia lipolytica* [Davidow, et al. (1985) *Curr. Genet.* 10:380471 Gaillardin, et al. (1985) *Curr. Genet.* 10:49].

Methods of introducing exogenous DNA into yeast hosts are well-known in the art, and usually include either the transformation of spheroplasts or of intact yeast cells treated with alkali cations. Transformation procedures usually vary with the yeast species to be transformed. See eg. [Kurtz et al. (1986) *Mol. Cell. Biol.* 6:142; Kunze et al. (1985) *J. Basic Microbiol.* 25:141; *Candida*]; [Gleeson et al. (1986) *J. Gen. Microbiol.* 132:3459; Roggenkamp et al. (1986) *Mol. Gen. Genet.* 202:302; *Hansenula*]; [Das et al. (1984) *J. Bacteriol.* 158:1165; De Louvencourt et al. (1983) *J. Bacteriol.* 154: 1165; Van den Berg et al. (1990) *Bio/Technology* 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75;1929; Ito et al. (1983) *J. Bacteriol.* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia*].

Antibodies

As used-herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanised antibodies, altered antibodies, univalent antibodies, Fab proteins, and single domain antibodies.

Antibodies against the proteins of the invention are useful for affinity chromatography, immunoassays, and distinguishing/identifying *staphylococcus* proteins.

Antibodies to the proteins of the invention, both polyclonal and monoclonal, may be prepared by conventional methods. In general, the protein is first used to immunize a suitable animal, preferably a mouse, rat, rabbit or goat. Rabbits ad goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally, (generally subcutaneously or intramuscularly). A dose of 50-200 μg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (eg. 1,000 g for 10 minutes). About 20-50 ml per bleed may be obtained from rabbits.

Monoclonal antibodies are prepared using the standard method of Kohler & Milstein [*Nature* (1975) 256:495-96], or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells expressing membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (eg. hypoxanthine, aminopterin, thymidine medium, "HAT"). The resulting hybridomas are plated by limiting dilution, and are assayed for production of antibodies which bind specifically to the immunizing antigen (and which do not bind to unrelated antigens). The selected MAb-secreting hybridomas are then cultured either in vitro (eg. in tissue culture bottles or hollow fiber reactors), or in vivo (as ascites in mice).

If desired, the antibodies (whether polyclonal or monoclonal) may be labeled using conventional techniques. Suitable labels include fluoropbores, chromophores, radioactive atoms (particularly $^{32}$P and $^{125}$I), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}$I may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}$I, or with an anti-biotin MAb labeled with HRP. Other permutations and possibilities will be readily apparent to those of ordinary skill in the art, and are considered as equivalents within the scope of the instant invention.

Pharmaceutical Compositions

Pharmaceutical compositions can comprise either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgement of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Vaccines

Vaccines according to the invention may either be prophylactic (ie. to prevent infection) or therapeutic (ie. to treat disease after infection).

Such vaccines comprise immunising antigen(s), immunogen(s), polypeptide(s), protein(s) or nucleic acid, usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylori,* etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59™ (WO 90/14837; Chapter 10 in *Vaccine design: the subunit and adjuvant approach*, eds. Powell & Newman, Plenum Press 1995), containing 5% Squalene, 0.5% Tween 80, and 0.5% Span 85 (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% pluronic-blocked polymer L121, and thr-MDP (see below) either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); (3) saponin adjuvants, such as Stimulon™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (eg. IL-1, IL-2, IL-4, IL-5, IL-6, IL-7, IL-12, etc.), interferons (eg. gamma interferon), macrophage colony stimulating factor (M-CSF), tumor necrosis factor (TNF), etc; and (6) other substances that act as immunostimulating agents to enhance the effectiveness of the composition. Alum and MF59™ are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (MTP-PE), etc.

The immunogenic compositions (eg. the immunising antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles.

Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (eg. nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

The immunogenic compositions are conventionally administered parenterally, eg. by injection, either subcutaneously, intramuscularly, or transdermally/transcutaneously (eg. WO98/20734). Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents.

As an alternative to protein-based vaccines, DNA vaccination may be used [eg. Robinson & Torres (1997) *Seminars in Immunol* 9:271-283; Donnelly et al. (1997) *Annu Rev Immunol* 15:617-648; later herein].

Gene Delivery Vehicles

Gene therapy vehicles for delivery of constructs including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using: endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art and we contemplate that any retroviral gene therapy vector is employable in the invention, including B, C and D type retroviruses, xenotropic retroviruses (for example, NZB-X1, NZB-X2 and NZB9-1 (see O'Neill (1985) *J. Virol.* 53:160) polytropic retroviruses eg. MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (eg. HT1080 cells) or mink parent cell lines, which eliminates inactivation in human serum.

Preferred retroviruses for the construction of retroviral gene therapy vectors include Avian Leukosis Virus, Bovine Leukemia, Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in Rockville, Md. or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. Nos. 5,219,740, 4,405,712, 4,861, 719, 4,980,289, 4,777,127, 5,591,624. See also Vile (1993)

Cancer Res 53:3860-3864; Vile (1993) Cancer Res 53:962-967; Ram (1993) Cancer Res 53 (1993) 83-88; Takamiya (1992) J Neurosci Res 33:493-503; Baba (1993) J Neurosurg 79:729-735; Mann (1983) Cell 33:153; Cane (1984) Proc Natl Acad Sci 81:6349; and Miller (1990) Human Gene Therapy 1.

Human adenoviral gene therapy vectors are also known in the art and employable in this invention. See, for example, Berkner (1988) Biotechniques 6:616 and Rosenfeld (1991) Science 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) Hum. Gene Ther. 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (ie. there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) Gene 124:257-262. Another example of such an AAV vector is psub201 (see Samulski (1987) J. Virol. 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) Human Gene Therapy 7:463-470. Additional AAV gene therapy vectors are described in U.S. Pat. Nos. 5,354,678, 5,173,414, 5,139,941 and 5,252,479.

The gene therapy vectors of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) Science 241:1667-1669 and in WO90/09441 and WO92/07945, HSV Us3::pgC-lacZ described in Fink (1992) Human Gene Therapy 3:11-19 and HSV 7134, 2 RH 105 and GAL4 described in EP 0453242 (Breakefield), and those deposited with the ATCC with accession numbers VR-977 and VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. Nos. 5,091,309 and 5,217,879 are employable. Such alpha viruses may be obtained from depositories or collections such as the ATCC in Rockville, Md. or isolated from known sources using commonly available techniques. Preferably, alphavirus vectors with reduced cytotoxicity are used (see U.S. Ser. No. 08/679640).

DNA vector systems such as eukaryotic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) J. Biol. Standardization 1:115; rhinovirus, for example ATCC VR-1110 and those described in Arnold (1990) J Cell Biochem L401; pox viruses such as canary pox virus or vaccinia virus, for example ATCC VR-111 and ATCC VR-2010 and those described in Fisher-Hoch (1989) Proc Natl Acad Sci 86:317; Flexner (1989) Ann NY Acad Sci 569:86, Flexner (1990) Vaccine 8:17; in U.S. Pat. Nos. 4,603,112 and 4,769,330 and WO89/01973; SV40 virus, for example ATCC VR-305 and those described in Mulligan (1979) Nature 277:108 and Madzak (1992) J Gen Virol 73:1533; influenza virus, for example ATCC VR-797 and recombinant influenza viruses made employing reverse genetics techniques as described in U.S. Pat. No. 5,166,057 and in Enami (1990) Proc Natl Acad Sci 87:3802-3805; Enami & Palese (1991) J Virol 65:2711-2713 and Luytjes (1989) Cell 59:110, (see also McMichael (1983) NEJ Med 309:13, and Yap (1978) Nature 273:238 and Nature (1979) 277:108); human immunodeficiency virus as described in EP-0386882 and in Buchschacher (1992) J. Virol. 662731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed. Exemplary naked DNA introduction methods are described in WO 90/11092 and U.S. Pat. No. 5,580,859. Uptake efficiency maybe improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):1158-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033

Exemplary liposome and polycationic gene delivery vehicles are those described in U.S. Pat. Nos. 5,422,120 and 4,762,915; in WO 95/13796; WO 94/23697; and WO91/14445; in EP-0524968; and in Stryer, Biochemistry, pages 236-240 (1975) W. H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of plasmodium falciparum known as RII.

B. Hormones, Vitamins, etc.

Other groups that can be included are, for example: hormones, steroids, androgens, estrogens, thyroid hormone, or vitamins, folic acid.

C. Polyalkylenes, Polysaccharides, etc.

Also, polyalkylene glycol can be included with the desired polynucleotides/polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide)

D. Lipids, and Liposomes

The desired polynucleotide/polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097:1-17; Straubinger (1983) *Meth. Enzymol.* 101:512-527.

Liposomal preparations for use in the present invention include cationic (positively charged), anionic (negatively charged) and neutral preparations. Cationic liposomes have been shown to mediate intracellular delivery of plasmid DNA (Feigner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) *Proc. Natl. Acad. Sci. USA* 75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide/polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C & E, over time these lipoproteins lose A and acquire C & E. VLDL comprises A, B, C & E apoproteins, LDL comprises apoprotein B; and HDL comprises apoproteins A, C, & E.

The amino acid of these apoproteins are known and are described in, for example, Breslow (1985) *Annu Rev. Biochem* 54:699; Law (1986) *Adv. Exp Med. Biol.* 151:162; Chen (1986) *J Biol Chem* 261:12918; Kane (1980) *Proc Natl Acad Sci USA* 77:2465; and Utermann (1984) *Hum Genet* 65:232.

Lipoproteins contain a variety of lipids including, triglycerides, cholesterol (free and esters), and phospholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30:443. Lipoproteins can also be purchased from commercial suppliers, such as Biomedical Technologies, Inc., Stoughton, Mass., USA. Further description of lipoproteins can be found in WO98106437.

F. Polycationic Agents

Polycationic agents can be included, with or without lipoprotein, in a composition with the desired polynucleotide/polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include bistones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic polycationic agents which are useful include, for example, DEAE-dextran, polybrene. Lipofectin™, and lipofectAMINE™ are monomers that form polycationic complexes when combined with polynucleotides/polypeptides.

Immunodiagnostic Assays

*Staphylococcus* antigens of the invention can be used in immunoassays to detect antibody levels (or, conversely, anti-*staphylococcus* antibodies can be used to detect antigen levels). Immunoassays based on well defined, recombinant antigens can be developed to replace invasive diagnostics methods. Antibodies to *staphylococcus* proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 μg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 μg of least DNA, blotting for two hours, and hybridizing for 4-8 hours with a probe of $10^8$ cpm/μg. For a single-copy mammalian gene a conservative approach would start with 10 μg of DNA, blot overnight, and hybridize overnight in the presence of 10% dextran sulfate using a probe of greater than $10^8$ cpm/μg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm=81+16.6(\log_{10}Ci)+0.4[\%(G+C)]-0.6(\% \text{ formamide})-600/n-1.5(\% \text{ mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the *staphylococcus* nucleotide sequences of the invention (including both sense and antisense strands). Though many different nucleotide sequences will encode the amino acid sequence, the native *staphylococcus* sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the *staphylococcus* sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional *staphylococcus* sequence may also be helpful as a label to detect the formed duplex. For example, a non-complementary nucleotide sequence may be attached to the 5' end of the probe, with the remainder of the probe sequence being complementary to a *staphylococcus* sequence. Alternatively, non-complementary bases or longer sequences can be interspersed into the probe, provided that the probe sequence has sufficient complementarity with the a *staphylococcus* sequence in order to hybridize therewith and thereby form a duplex which can be detected.

The exact length and sequence of the probe will depend on the hybridization conditions (e.g. temperature, salt condition etc.). For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80:7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Iyer (1995) *Curr Opin Biotechnol* 6:12-19; Agrawal (1996) *TIBTECH* 14:376-387]; analogues such as peptide nucleic acids may also be used [eg. see Corey (1997) *TIBTECH* 15:224-229; Buchardt et al. (1993) *TIBTECH* 11:384-386].

Alternatively, the polymerase chain reaction (PCR) is another well-known means for detecting small amounts of target nucleic acid. The assay is described in Mullis et al. [*Meth. Enzymol.* (1987) 155:335-350] & U.S. Pat. Nos. 4,683,195 & 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired *staphylococcus* sequence.

A thermostable polymerase creates copies of target nucleic acids from the primers using the original target nucleic acids as al template. After a threshold amount of target nucleic acids are generated by the polymerase, they can be detected by more traditional methods, such as Southern blots. When using the Southern blot method, the labelled probe will hybridize to the *staphylococcus* sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

MODES FOR CARRYING OUT THE INVENTION 2821 nucleic acid coding sequences were identified in *S.aureus* (stain NCTC 8325), along with their inferred translation products. The nucleic acid sequences are given in the sequence listing with odd numbers (SEQ IDs 1, 3, 5, 7, . . . , 5639, 5641). Each nucleic acid sequence is followed by its inferred translation product (SEQ IDs 2, 4, 6, 8, . . . , 5640, 5642). Inferred functions are given in field <223> of the sequence listing.

Various tests can be used to assess the in vivo immunogenicity of the proteins identified in the examples. For example, the proteins can be expressed recombinantly and used to screen patient sera by immunoblot. A positive reaction between the protein and patient serum indicates that the patient has previously mounted an immune response to the protein in question i.e. the protein is an immunogen. This method can also be used to identify immunodominant proteins.

The recombinant proteins can also be conveniently used to prepare antibodies e.g. in a mouse. These can be used for direct confirmation that a protein is located on the cell-surface. Labelled antibody (e.g. fluorescent labelling for FACS) can be incubated with intact bacteria and the presence of label on the bacterial surface confirms the location of the protein.

It will be understood that the invention has been described by way of example only and modifications may be made whilst remaining within the scope and spirit of the invention.

SEQUENCE LISTING (5642 sequences)

SEQ ID NO: 1 - DNA, 627 bp, Staphylococcus aureus
atgacacaagtattcggagaaaacggtgaattaatccctgtaacagtagtagaagctaaagaaaatgttgtattacaaaagaaaactgtagaagttgatggatacaacgcaatccaagttggatttgaagacaaaaaagcatacaaaaaagatgcaaaatctaataaatatgctaataaaccagctgaaggtcacgctaaaaaagctgacgcagcacctaagcgcttcattcgtgaattccgcaatgtagacgtggatgcttacgaagtaggtcaagaagtctcagtagatacttttgtagctggcgacgttattgacgtaacaggcgtatcaaaaggtaaaggtttccaaggtgcaattaaacgccacggacaatctcgtggacctatgtcacacggttctcatttccacagagcaccaggttctgtaggtatggcttcagatgcttctagagtatttaaaggccaaaaaatgccaggacgtatgggtggaaacactgtaactgttcaaaacttagaagtagttcaagttgacacagaaaacaaagttatcttagtaaaaggtaacgtacctggacctaaaaaaggtttagtagaaatcagaacttcaattaaaaaaggtaataaa

SEQ ID NO: 2 - protein, 209 aa, Staphylococcus aureus
  MISC_FEATURE (1)..(209): 50S ribosomal protein L3
MTQVFGENGELIPVTVVEAKENVVLQKKTVEVDGYNAIQVGFEDKKAYKKDAKSNKYANKPAEGHAKKADAAPKRFIREFRNVDVDAYEVGQEVSVDTFVAGDVIDVTGVSKGKGFQGAIKRHGQSRGPMSHGSHFHRAPGSVGMASDASRVFKGQKMPGRMGGNTVTVQNLEVVQVDTENKVILVKGNVPGPKKGLVEIRTSIKKGNK

SEQ ID NO: 3 - DNA, 966 bp, Staphylococcus aureus
atgaaacatctacttgttattcatactggtggcaccattagtatgtcacaagaccaatctaataaagtagtaacaaatgatatcaaccctatttcaatgcatcaagatgtcataaatcaatatgcacaaatagatgaattaaatccttttaatgtaccatcacctcatatgacaatccaacatgttaaacaattaaaggatattattttagaagcagtaacaaataaatattatgatggtttcgttatcacgcatggtaccgatacgttagaagaaactgcctttttacttgatttaatattaggtatcgagcaacctgttgttattactggcgcaatgcgctcgtctaatgaaattggttctgacggattatataattatatttccgctattcgcgttgcctctgatgaaaaggcccgtcataaaggcgtgatggttgtatttaatgatgaaattcatacggcgcgtaatgttaccaaaacacatacgtctaatacaaacacatttcaaagtccaaatcatggtccgctaggtgtattgacaaaggatcgtgtgcaattccatcatatgccatatcgccaacaagcattggaaaatgtcaatgacaaactaaatgtaccattagtaaaagcatatatgggtatgccaggtgacatttttagtttttatagtcgagaaggtatcgatggtatggttattgaagcgttaggacaaggcaacatacctccaagcgcattagaaggcattcaacaattagtatctttaaatatacctattgtgctagtttcacgttcctttaatggtattgtgagtccaacttacgcatacgatggtggtggttaccaactcgcacaacaaggttttattttttctaacggcttgaatggtccaaaagcaagattaaaattattagtcgcgttaagcaacaatttagataaagctgaaatcaaatcatattttgaatta

SEQ ID NO: 4 - protein, 322 aa, Staphylococcus aureus
  MISC_FEATURE (1)..(322): probable L-asparaginase
MKHLLVIHTGGTISMSQDQSNKVVTNDINPISMHQDVINQYAQIDELNPFNVPSPHMTIQHVKQLKDIILEAVTNKYYDGFVITHGTDTLEETAFLLDLILGIEQPVVITGAMRSSNEIGSDGLYNYISAIRVASDEKARHKGVMVVFNDEIHTARNVTKTHTSNTNTFQSPNHGPLGVLTKDRVQFHHMPYRQQALENVNDKLNVPLVKAYMGMPGDIFSFYSREGIDGMVIEALGQGNIPPSALEGIQQLVSLNIPIVLVSRSFNGIVSPTYAYDGGGYQLAQQGFIFSNGLNGPKARLKLLVALSNNLDKAEIKSYFEL

SEQ ID NO: 5 - DNA, 1125 bp, Staphylococcus aureus
gtgttattcaactccgtagctaacaattctctattcacattaaacaaattgtcaaaaatatatcataaatcttcaagcacagacttagcgcatcaatcactgaactgttataatagtttgggattaaaggaggccgaaacaatgcaaaaagttgaaagtatcataattggtggagggccatgcggattaagtgcggctattgaacaaaaaagaaaaggtattgataccttaattattgaaaagggtaatgtcgttgaatcaatctacaattatcctactcaccaaacatttttctcatcaagtgataaattaagtattggggacgtaccgtttatcgttgaagaaagtaaaccaagacgtaatcaagcgctagtttattaccgagaagttgtaaaacatcatcaattaaaagtaaatgcatttgaagaagtattaactgttaaaaaaatgaataataaatttactattactacgacgaaagatgtttatgaatgtcgatttttaacaatcgcgacaggctattatggtcagcataatacattagaagttgaaggtgcggatttacctaaagtgttccattattttaaagaggcacatccgtattttgatcaagatgttgtaattatcggtggtaagaattcggctatcgatgctgctttggagttggaaaaagctggtgctaacgtgacggttctatatcgtggtggagattattcgccttcaattaaaccgtggatacttccaaatttcacagcattagtaaatcatgaaaaaattgacatggaatttaatgctaatgttacccaaataactgaagatactgtgacttatgaagtaaatggtgaaagtaaaacgatacacaatgattatgtatttgcgatgattggttatcatcccgattatgaatttttaaaatctgtaggcattcaaattaatacaaatgaatttggaacagcgcctatgtataataaagaaacatacgaaacaaatatcgaaaattgctatattgcaggtgtaattgctgcagggaacgatgcgaataccatttttattgaaaatggtaaattccacgggggcattattgctcaaagcatgctagctaagaaacaaacgcccttagaatca

SEQ ID NO: 6 - protein, 375 aa, Staphylococcus aureus
  MISC_FEATURE (1)..(375): hypothetical protein
VLFNSVANNSLFTLNKLSKIYHKSSSTDLAHQSLNCYNSLGLKEAETMQKVESIIIGGGPCGLSAAIEQKRKGIDTLIIEKGNVVESIYNYPTHQTFFSSSDKLSIGDVPFIVEESKPRRNQALVYYREVVKHHQLKVNAFEEVLTVKKMNNKFTITTTKDVYECRFLTIATGYYGQHNTLEVEGADLPKVFHYFKEAHPYFDQDVVIIGGKNSAIDAALELEKAGANVTVLYRGGDYSPSIKPWILPNFTALVNHEKIDMEFNANVTQITEDTVTYEVNGESKTIHNDYVFAMIGYHPDYEFLKSVGIQINTNEFGTAPMYNKETYETNIENCYIAGVIAAGNDANTIFIENGKFHGGIIAQSMLAKKQTPLES

SEQ ID NO: 7 - DNA, 114 bp, Staphylococcus aureus
ttgttatttaacaaggtcttgtctcgaatattggcatatcaatttaactttttaaatagtcatcaaaaagataaaacaccacaatcaacaaatttaacgaggaagaataaaaaa

SEQ ID NO: 8 - protein, 38 aa, Staphylococcus aureus
LLFNKVLSRILAYQFNFLNSHQKDKTPQSTNLTRKNKK

SEQ ID NO: 9 - DNA, 1464 bp, Staphylococcus aureus
atggctatgtctaataattttaaagatgactttgaaaaaaatcgtcaatcgatagacacaaattcacatcaagaccatacggaagatgttgaaaaagaccaatcagaattagaacatcaggatacaatagagaatacggagcaacagtttccgccaagaaatgcccaaagaagaaaaagacgccgtgatttagcaacgaatcataataaacaagttcacaatgaatcacaaacatctgaagacaatgttcaaaatgaggctggcacaatagatgatcgtcaagtcgaatcatcacacagtactgaaagtcaagaacctagccatcaagacagtacacctcaacatgaagaggaatattataataagaatgcttttgcaatggataaatcacatccagaaccaatcgaagacaatgataaacacgatactattaaaaatgcagaaaataacactgagcattcaacagtttctgataagagtgaagctgaacaatctcagcaacctaaaccatattttacaacaggtgctaaccaatcagaaacatcaaaaaatgaacatgataatgattctgtaaaacaagatcaagatgaacctaaagaacatcataatggtaaaaaagcagcagctattggtgctggaacagcaggtgttgcaggtgcagctggtgcaatggctgcttctaaagctaagaaacattcaaatgacgctcaaaacaaaagtaattctggcaaggcgaataactcgactgaggataaagcgtctcaagataagtctaaagatcatcataatggcaaaaaaggtgcagcgatcggtgctggaacagcaggtttggctggaggcgcagcaagtaaaagtgcttctgccgcttcaaaaccacatgcctctaataatgcaagccaaaaccatgatgaacatgacaatcatgacagagataaagaacgtaaaaaaggtggcatggccaaagtattgttaccattaattgcagctgtactaattatcggtgcattagcgatatttggaggcatggcattaaacaatcataataatggtacaaaagaaaataaaatcgcgaatacaaataaaaataatgctgatgaaagtaaagacaaagacacatctaaagacgcttctaaagataaatcaaaatctacagacagtgataaatcaaaagaggatcaagacaaagcgactaaagatgaatctgataatgatcaaaacaacgctaatcaagcgaacaatcaagcacaaaataatcaaaatcaacaacaagctaatcaaaatcaacaacagcaacaacaacgtcaaggtggtggccaaagacatacagtgaatggtcaagaaaacttataccgtatcgcaattcaatactacggttcaggttcaccggaaaatgttgaaaaaattagacgtgccaatggtttaagtggtaacaatattagaaacggtcaacaaatcgttattcca

SEQ ID NO: 10 - protein, 488 aa, Staphylococcus aureus
  MISC_FEATURE (1)..(488): elastin binding protein
MAMSNNFKDDFEKNRQSIDTNSHQDHTEDVEKDQSELEHQDTIENTEQQFPPRNAQRRKRRRDLATNHNKQVHNESQTSEDNVQNEAGTIDDRQVESSHSTESQEPSHQDSTPQHEEEYYNKNAFAMDKSHPEPIEDNDKHDTIKNAENNTEHSTVSDKSEAEQSQQPKPYFTTGANQSETSKNEHDNDSVKQDQDEPKEHHNGKKAAAIGAGTAGVAGAAGAMAASKAKKHSNDAQNKSNSGKANNSTEDKASQDKSKDHHNGKKGAAIGAGTAGLAGGAASKSASAASKPHASNNASQNHDEHDNHDRDKERKKGGMAKVLLPLIAAVLIIGALAIFGGMALNNHNNGTKENKIANTNKNNADESKDKDTSKDASKDKSKSTDSDKSKEDQDKATKDESDNDQNNANQANNQAQNNQNQQQANQNQQQQQQRQGGGQRHTVNGQENLYRIAIQYYGSGSPENVEKIRRANGLSGNNIRNGQQIVIP

SEQ ID NO: 11 - DNA, 1377 bp, Staphylococcus aureus
atgttgcatgatattttacgaaacaaatttggattcgagagttttaaaccgggacaacaggaaattatagaaagtataatgtctcaacaacacactctaggtatacttccaactggaagtggaaagagtttgtgttatcaaatacctacgtatttatcaggtaagccgacattaattatctcaccgttaatatctttaatggatgaccaagttatgcagttgaaaataaatggagaaaaacgtgtaacatgtattcactctggtatggatgaaattgagaaaaagcataatattaaatgtttacgacatagccgcttcatctttctaagtccagaatttctcctgcaaccgtcaaattttaaattaatatctatgatagactttggcatgattgttctagatgaagcacattgcctatctgaatggggatatgatttcagaccacattatgctctaataggaaaagtaacaaagcattttaaagaagcggttgtcttagcattgacagcaactgcaccaccgcatttacaagatgatttgacggaaatgttagcgattcaattcaatgttattaaaactacaatgaatcgcccaaatataagctttaagcatcttaattttcatgatgatgaagataaaattgaatggttgctgccgtttctacaacagtcgggaccaacgattatttatgtctcatcgaaaaagatgtgtctgaatttagcgcaacttatttatgattcaggttttcttacaggtatttatcatggtgatatgaattatcaagagcgacacacagttcaacaacaatttttaaataatgatattccgattatagtcgcaacgagtgcttttggtatgggaattaataaaaaagatattcgcacaatcattcactttcatctttcaacaagtccttctaactacattcaagaaattggccgtgcgggtcgcgatggtgaactaagtcaggcaattagtttattccaaccggacgataaatatattttagaaacgttattatttgcagatatgataacagaagaagatgtacaaaatttcgaaataggagaatttttagctcccgataaacaagccgttttgacaacgttgcaatcattctatagtatcggcgccttgaaacagatatttaagcaatcatttaaacgaaagcaattaggattctttcgcatgattggctattgcaaattggatcaatgtagacggaagtatttattagaatttttcggtgaatatccaccggcacaagatcgatgttgtgacaatgattctaatataactgatatcgcaattttaaataagaagaaggtaattagaagtattggatttgatgaaaagttgcaaaatttatttctcaga

SEQ ID NO: 12 - protein, 459 aa, Staphylococcus aureus
  MISC_FEATURE (1)..(459): probable ATP-dependent DNA
MLHDILRNKFGFESFKPGQQEIIESIMSQQHTLGILPTGSGKSLCYQIPTYLSGKPTLIISPLISLMDDQVMQLKINGEKRVTCIHSGMDEIEKKHNIKCLRHSRFIFLSPEFLLQPSNFKLISMIDFGMIVLDEAHCLSEWGYDFRPHYALIGKVTKHFKEAVVLALTATAPPHLQDDLTEMLAIQFNVIKTTMNRPNISFKHLNFHDDEDKIEWLLPFLQQSGPTIIYVSSKKMCLNLAQLIYDSGFLTGIYHGDMNYQERHTVQQQFLNNDIPIIVATSAFGMGINKKDIRTIIHFHLSTSPSNYIQEIGRAGRDGELSQAISLFQPDDKYILETLLFADMITEEDVQNFEIGEFLAPDKQAVLTTLQSFYSIGALKQIFKQSFKRKQLGFFRMIGYCKLDQCRRKYLLEFFGEYPPAQDRCCDNDSNITDIAILNKKKVIRSIGFDEKLQNLFLR

SEQ ID NO: 13 - DNA, 951 bp, Staphylococcus aureus
ttgcaacacattataaaaacagcattacaacaaacatttaactataaaacaaataaaagtatttacaatatcttagttggtaagaaatctcaccaaaccttttttgacgcttgtagtcaacaacagttgtcattatatcacagtttaccactattaaaatatccgtcttttgagctatttttagaaaaaatcaatgaatttaatgctgaaatggaaatcatgttgcatcctagatatacatttgaaagcatggggcaaacatttcaagcaattcaactattagtgcaaaccatgtctaataccaaacaacatgtttttcattttgtaccaatctctcaaaataataagatacaagaaactgtaaagattgtctataactacattaaagaaaaccaattacaaattgattttgaaaatgaactacataacttgtttaaagcaataactttaaaagggccatgttacttacattattatttgcaaggctatgatgaaccaatgtatacgagacagcaagttagtttaatagaaaagctatctcaacagcaattgtttgaatacgaaatgaataatttagtgacaatgatgtttgaattagaaagtggagaatatactattttatcaaaaataataatgaaacctacattattaaatcaaacttatattacttatacaaaattgcttgaacaattcacgatggaagatatagcggctcaacaacaagttaaaatcaatactatcgaagatcatgtacttgaaatcttaatcaaaggttacatgtctaattacgatgattatgttgaactagaagatcaactccagtttttgaatttttatcaacagcatcgtggcgaacgattaaaattttacaaagaacaatttgacacgttatcatattttcaattaaaagtattaatcgttggatttgaaagaggtgatctgaatgttgca

SEQ ID NO: 14 - protein, 317 aa, Staphylococcus aureus
  MISC_FEATURE (1)..(317): conserved hypothetical
LQHIIKTALQQTFNYKTNKSIYNILVGKKSHQTFFDACSQQQLSLYHSLPLLKYPSFELFLEKINEFNAEMEIMLHPRYTFESMGQTFQAIQLLVQTMSNTKQHVFHFVPISQNNKIQETVKIVYNYIKENQLQIDFENELHNLFKAITLKGPCYLHYYLQGYDEPMYTRQQVSLIEKLSQQQLFEYEMNNLVTMMFELESGEYTILSKIIMKPTLLNQTYITYTKLLEQFTMEDIAAQQQVKINTIEDHVLEILIKGYMSNYDDYVELEDQLQFLNFYQQHRGERLKFYKEQFDTLSYFQLKVLIVGFERGDLNVA

SEQ ID NO: 15 - DNA, 246 bp, Staphylococcus aureus
ttggcaaaatatacaatcgttgatatggatacttgtattgcatgtggtgcatgcggtgcagcagcgccagatatatatgattacgacgacgaaggtattgctttcgtaatccttgacgataaccaaggtactgcagaagtacctgaggaattatatgaagatatggaagatgcaattgatggatgccctacagattctattaaaattgcagacgaatcatttgatggggacgctttaaaatttgaa

SEQ ID NO: 16 - protein, 82 aa, Staphylococcus aureus
  MISC_FEATURE (1)..(82): ferredoxin
LAKYTIVDMDTCIACGACGAAAPDIYDYDDEGIAFVILDDNQGTAEVPEELYEDMEDAIDGCPTDSIKIADESFDGDALKFE

SEQ ID NO: 17 - DNA, 567 bp, Staphylococcus aureus
atgaatggaaggagaaaattgaatatgcaacaaaataaacgtcttatcacaataagtatgttgagcgcgattgcgtttgtgttaacttttatcaagtttcctataccatttttgccaccatacttaactttagattttagtgatgtaccgtcactactagctacatttacgtttggaccagttgccggtatcgtagttgcactggttaaaaatttattgaactacttatttagtatgggcgatccagttggaccatttgctaactttttagcaggcgcaagtttcttattaactgcttacgccatctataaaaataaacgttcaacaaaatctttgattactggattaatcattgcaacaatcgttatgactatcgtgttgagtattttgaactatttcgttctattacctttgtacggtatgatatttaacttagctgatatcgcaaataatcttaaagtaatcattgtttcaggaattataccattcaatattattaaaggtatcgttatttctattgtatttattttactatatagaaggcttgcgaatttcttgaaaagaatt

SEQ ID NO: 18 - protein, 189 aa, Staphylococcus aureus
  MISC_FEATURE (1)..(189): conserved hypothetical
MNGRRKLNMQQNKRLITISMLSAIAFVLTFIKFPIPFLPPYLTLDFSDVPSLLATFTFGPVAGIVVALVKNLLNYLFSMGDPVGPFANFLAGASFLLTAYAIYKNKRSTKSLITGLIIATIVMTIVLSILNYFVLLPLYGMIFNLADIANNLKVIIVSGIIPFNIIKGIVISIVFILLYRRLANFLKRI

SEQ ID NO: 19 - DNA, 117 bp, Staphylococcus aureus
atgacgatttttactcaattgagtgatagaatcaaaaaagccatctcaaaaattaatcaagcaaacaacattccaaacaatgctcgcaaatcaccaatgtatcactctccaattacg

SEQ ID NO: 20 - protein, 39 aa, Staphylococcus aureus
MTIFTQLSDRIKKAISKINQANNIPNNARKSPMYHSPIT

SEQ ID NO: 21 - DNA, 219 bp, Staphylococcus aureus
gtggtgaaacaaatgaaagctaaggaaattagagacttaaccacttcagaaatcgaagaacaaatcaaatcttcaaaagaagagctttttaacctacgctttcagttagctacaggtcaattagaagaaactgcacgtattcgtacagtaagaaaaacgattgcacgtctaaaaactgttgctcgtgaaagagaaattgaacaaagtaaggctaatcaa

SEQ ID NO: 22 - protein, 73 aa, Staphylococcus aureus
  MISC_FEATURE (1)..(73): 50S ribosomal protein L29
VVKQMKAKEIRDLTTSEIEEQIKSSKEELFNLRFQLATGQLEETARIRTVRKTIARLKTVAREREIEQSKANQ

SEQ ID NO: 23 - DNA, 912 bp, Staphylococcus aureus
atgcttaaaaaagcaaaatttatcttaatggcaacgatactactatcaggatgttcaactaccaataacgaatccaacaaagaaacaaaatctgtaccagaagaaatggatgcttcaaaatatgtaggacaaggattccaaccacctgcagaaaaagatgcgattgaatttgcaaagaagcataaagataaaattgctaagcgaggcgaacaattttttatggataacttcggtctaaaagttaaagctacaaatgttataggtagtggcgatggtgtagaagtattcgtgcattgtgatgaccacgacatcgtatttaatgcgagtattccatttgataaatcaattattgacagtgatagctcattaagaagtaaggataaaggtgatgatatgagtactttagttggtgcagtactcagtgggtttgaatatcgagcacaaaaagaaaaatatgataaattatataaatttttcaaagataatgaagagaaatatcaatatacaggatttacaaaagaagcaattaataagacgcaaaatagtggttatgaaaatgaatatttttatatttcggccataccttataatttagctgagtatagagactattttgaaccattgttaaacaaaagtgacagtgaattttcaaaagaattgtcaaatgttaagaagcaattaaaagataagtctaaagtttcggtaactactactctatttagtaaaaaaaagaactatactaaaaaaagtaacagtgaaaatgtaataaaaatggcagaagaaataaaaaaagataaagagataccaaacggtatagagcttagtataaaattttcggacaataaaataaatacggttaaaccaaattttaacggtgaaagcacttcagaatatggtgtgtttgatcaagaa

SEQ ID NO: 24 - protein, 304 aa, Staphylococcus aureus
  MISC_FEATURE (1)..(304): hypothetical protein
MLKKAKFILMATILLSGCSTTNNESNKETKSVPEEMDASKYVGQGFQPPAEKDAIEFAKKHKDKIAKRGEQFFMDNFGLKVKATNVIGSGDGVEVFVHCDDHDIVFNASIPFDKSIIDSDSSLRSKDKGDDMSTLVGAVLSGFEYRAQKEKYDKLYKFFKDNEEKYQYTGFTKEAINKTQNSGYENEYFYISAIPYNLAEYRDYFEPLLNKSDSEFSKELSNVKKQLKDKSKVSVTTTLFSKKKNYTKKSNSENVIKMAEEIKKDKEIPNGIELSIKFSDNKINTVKPNFNGESTSEYGVFDQE

SEQ ID NO: 25 - DNA, 219 bp, Staphylococcus aureus
ttggagcatttgaagatgaataaaataaatgatagagatttaacagaattgagtagctatagggtttatcaagacatcaataaagataatgactttacagttaacgaaaaacgatttaagcaggcagatgtatttgaagatttatatagagagaaactaaaagacacaaataaattaagagagtataattatttacaaaatgaaacttttaaaagcgca

SEQ ID NO: 26 - protein, 73 aa, Staphylococcus aureus
  MISC_FEATURE (1)..(73): hypothetical protein
LEHLKMNKINDRDLTELSSYRVYQDINKDNDFTVNEKRFKQADVFEDLYREKLKDTNKLREYNYLQNETFKSA

SEQ ID NO: 27 - DNA, 948 bp, Staphylococcus aureus
atgtttaaaaaggcgaaattaatcttaatagcaacgctactgttatcaggatgttcagcgatgaataatgaatcaaaaaaagacacaaatacagaaacaaatacagaaacaaatacagaaacaaaatcagtaccagaagaaatggaagcttcaaaatatgtaggacaaggctttcaaccacctgcagaaaaagatgcgattgaatttgtgaagaagcatcgtaaagaatttgaaaaagtaggtgaacaattctttaaagataactttggactaaaagttaaagctacaaatgttgtaggtaaagatgatggtgtagaagtttatgtgcattgcgaagatcatggcattgtatttaatgcaagtctacctttgtacaaagatgccatccatcaaaaaggatcaatgcgtagtaatgacaacggtgatgatatgagtatgatggtgggtacagtgctgagtggctttgaatatcgagcgcaaaaagaaaagtatgataatttatataaatttttaaaagaaaatgaaaagcaatatcaatatacaggttttactaaagaagcaattaacaagacgcaaaacgtcgggtatcaaaatgaatatttttatattacatatttatcaagaaatttaaaagaatatagaaaatattacgaaccattgatacataaaaatgataaagagtttaaagaaggtatgcaacgagctagaaaagagctaaactatactgctaatacaaatactgtagcaacgttgtttagtacgaatgatgaaaggaatagaaaagaaaagataaataatgtaatagatttatccgagaaaattgaaagaacaaaagatatgccaatcaagaatactataactactcaattaggaaataaacttattggcacaaaaaaagctcgttttgatgataagaaagtagtgtcgtttggagcatttgaagatgaa

SEQ ID NO: 28 - protein, 316 aa, Staphylococcus aureus
  MISC_FEATURE (1)..(316): hypothetical protein
MFKKAKLILIATLLLSGCSAMNNESKKDTNTETNTETNTETKSVPEEMEASKYVGQGFQPPAEKDAIEFVKKHRKEFEKVGEQFFKDNFGLKVKATNVVGKDDGVEVYVHCEDHGIVFNASLPLYKDAIHQKGSMRSNDNGDDMSMMVGTVLSGFEYRAQKEKYDNLYKFLKENEKQYQYTGFTKEAINKTQNVGYQNEYFYITYLSRNLKEYRKYYEPLIHKNDKEFKEGMQRARKELNYTANTNTVATLFSTNDERNRKEKINNVIDLSEKIERTKDMPIKNTITTQLGNKLIGTKKARFDDKKVVSFGAFEDE

SEQ ID NO: 29 - DNA, 915 bp, Staphylococcus aureus
atgtttaaaagaactaaactaatcttaatagcaacattactgctatcaggatgttcaactaccaataacgaatctaataaagaaacaaaatcagtgccagaagaaatggaagcttcaaaatatgtaggtcaaggcttccaaccacctgcagaaaaagatgtggttgaatttgcgaaaaagcataaagataaaattgccaaacgaggcgaacaattttttatggataatttcggtctaaaagttaaagctaccaatgttgtaggtagtggaaaaggcgtagaagtattcgtgcattgtgatgaccacgatatcgtatttaatgcgagtattccatttgataaatcaataattgagagtgatagctcattaagaagtgaggacaaaggcgatgatatgagtactttagttggtacagtgttgagtggctttgaatatcgaacacaaaaagaaaagtatgacaatttatataaatttttcaaagataatgaagagaaataccaatatacaggctttacaaaagaagcaataaacaagacgcaaaatgtcggatataaaaatgaatatttttatatcacttactcgtcaagaagcttaaaagaatatcgtaagtattacgaaccattgattcataaaaatgataaagaatttaaagaaggaatggaacaagccagaaaagaagtgaattacgctgctaatacagatacagtaacaacattgtttagtacaaaggaaaattttactaaagacaatacagttgatgatgtaattgaactgagtgataaactatataattttaaaaataagccagaaaaatctacaattacaattcaaataggaaagcctactattaatactaaaaaagccttttatgatgataatgatccaatagaatatggagtgtatcgtaaagatgaa

SEQ ID NO: 30 - protein, 305 aa, Staphylococcus aureus
  MISC_FEATURE (1)..(305): hypothetical protein
MFKRTKLILIATLLLSGCSTTNNESNKETKSVPEEMEASKYVGQGFQPPAEKDVVEFAKKHKDKIAKRGEQFFMDNFGLKVKATNVVGSGKGVEVFVHCDDHDIVFNASIPFDKSIIESDSSLRSEDKGDDMSTLVGTVLSGFEYRTQKEKYDNLYKFFKDNEEKYQYTGFTKEAINKTQNVGYKNEYFYITYSSRSLKEYRKYYEPLIHKNDKEFKEGMEQARKEVNYAANTDTVTTLFSTKENFTKDNTVDDVIELSDKLYNFKNKPEKSTITIQIGKPTINTKKAFYDDNDPIEYGVYRKDE

SEQ ID NO: 31 - DNA, 345 bp, Staphylococcus aureus
gtgtttttttttcggggcgaaaaaagggcaaattatttaaataagggcaaacatgcgtggaaaacacagaggtttaaaaatgccaaaaccgttgatatgacaaggtttttatacgtttgtatacaacgacgaattatctattcgccatcacattatgacgatatgtttattttaaacacacaagctcatgcgcgtcttgatcaaatggcacaacagtttgaagttgtttgtaatggcttgaacgaaaatgaaggacaagcaattcaaacgatggatcaatctgcctctctaatacggtcaaacttaattcaagttaaagaacaattagaaaaactagctgtatac

SEQ ID NO: 32 - protein, 115 aa, Staphylococcus aureus
  MISC_FEATURE (1)..(115): hypothetical protein
VFFFRGEKRANYLNKGKHAWKTQRFKNAKTVDMTRFLYVCIQRRIIYSPSHYDDMFILNTQAHARLDQMAQQFEVVCNGLNENEGQAIQTMDQSASLIRSNLIQVKEQLEKLAVY

SEQ ID NO: 33 - DNA, 885 bp, Staphylococcus aureus
ttgcgcaagttgtgtatcataatacttaattgtgttaaaagaggtggaaatatgaaaggtgatatatacataccgataatatcatctattttatctggtgggatatcgtattatgctgcaacggtggttcataaatttaacaaaaggtataaaaggaaagaaaaggctgttgaaatggcagacgagttttcaaaattaatttcgaaaaggagttttgatataggggagataaacaagaaaattttagaaaatgttggtttgcaagataaaattaatgaattagagaataagatgaatttaagttttgataatcacgaactaagaacagtctttactgataaagagattgcaaaatatcacacttataaaaaagtcaccaataccgaatttataaaaattttgcttcgtactttcaagaacgagaattataaagaagagtgtttacgggctataattttagaatttgacaacaagaaaacaattaaagaaaatataggagataaacagtggactttttcgacaggtgaaaaagaaattgttattaaaagtaatgacgtattgcaaggtataaatacactcattaagaagtataatgaaacccatatatattgcatgaataaattagaatatttttctatgcattttaccaataacatagcagatagtaatacggtttatcagtcgttgcatcaaatctatttaaaaacaatattgagtctttacattgatatctcatcaacaaataaaatagggcatgaaaaattttatgttaatttaatagaattttacaatgaatggaataacaaaaagataaaatttaaaaagaaaacagaaaagcgtataaataaaaacagaaactcatttttaaaaactgaaaaattgaaa

SEQ ID NO: 34 - protein, 295 aa, Staphylococcus aureus
LRKLCIIILNCVKRGGNMKGDIYIPIISSILSGGISYYAATVVHKFNKRYKRKEKAVEMADEFSKLISKRSFDIGEINKKILENVGLQDKINELENKMNLSFDNHELRTVFTDKEIAKYHTYKKVTNTEFIKILLRTFKNENYKEECLRAIILEFDNKKTIKENIGDKQWTFSTGEKEIVIKSNDVLQGINTLIKKYNETHIYCMNKLEYFSMHFTNNIADSNTVYQSLHQIYLKTILSLYIDISSTNKIGHEKFYVNLIEFYNEWNNKKIKFKKKTEKRINKNRNSFLKTEKLK

SEQ ID NO: 35 - DNA, 1452 bp, Staphylococcus aureus
atgttgataacaaaaaaccaagcagaaaaatggtttgataattcattagggaagcagttcaatcctgatttgttttatggatttcagtgttacgattacgcaaatatgttttttatgatagcaacaggcgaaaggttacaaggtttatacgcttataatattccatttgataataaagcaaggattgaaaaatacgggcaaataattaaaaactatgatagctttttaccgcaaaagttggacattgtcgttttcccgtcaaagtatggtggcggagctggacatgttgaaattgttgagagcgctaatctaaacactttcacatcgtttggccaaaattggaatggtaaaggttggacaaatggcgttgcgcaacctggttggggtcccgaaaccgttacaagacatgttcattattacgatgacccaatgtattttattagattaaatttcccagataaagtaagtgttggagataaagctaaaagcgttattaagcaagcaactgccaaaaagcaagcagtaattaaacctaaaaaaattatgcttgtagccggtcatggttataacgatcctggagcagtcggaaacggaacaaatgaacgtgattttatccgtaaatatataacaccaaatatcgctaagtatttaagacatgcaggtcacgaagttgcattatatggtggctcaagtcaatcacaagatatgtatcaagatactgcttacggtgttaatgtaggaaataataaagattatggcttatattgggttaaatcacatgggtatgacattgttctagagattcatttagacgcagcaggagaaagtgcaagtggtgggcatgttattatttcaagtcaattcaatgcagatactattgataaaagtatacaagatgttattaaaaataacttaggacaaataagaggtgtaacacctcgtaatgatttactaaacgttaatgtatcagcagaaataaatataaactatcgtttatctgaattaggttttattactaataaaaatgatatggattggattaagaaaaactatgacttgtattctaaattaatagccggtgcgattcatggtaagcctataggtggtttggtagctggtaatgttaaaacatcagctaaaaaccaaaaaaatccaccagtgccagcaggttatacacttgataaaaacaatgtaccgtataaaaaagagactggttattacacagttgccaatgttaaaggtaataacgtaagggacggctattcaactaattcaagaattacaggtgtattacctaataacgcaacaattaaatatgacggcgcatattgcatcaatggctatagatggattacttatattgctaatagtggacaacgtcgttatatagcgacaggagaggtagacaaggcaggtaatagaataagtagttttggtaagtttagcacgatt

SEQ ID NO: 36 - protein, 484 aa, Staphylococcus aureus
  MISC_FEATURE (1)..(484): truncated amidase
MLITKNQAEKWFDNSLGKQFNPDLFYGFQCYDYANMFFMIATGERLQGLYAYNIPFDNKARIEKYGQIIKNYDSFLPQKLDIVVFPSKYGGGAGHVEIVESANLNTFTSFGQNWNGKGWTNGVAQPGWGPETVTRHVHYYDDPMYFIRLNFPDKVSVGDKAKSVIKQATAKKQAVIKPKKIMLVAGHGYNDPGAVGNGTNERDFIRKYITPNIAKYLRHAGHEVALYGGSSQSQDMYQDTAYGVNVGNNKDYGLYWVKSHGYDIVLEIHLDAAGESASGGHVIISSQFNADTIDKSIQDVIKNNLGQIRGVTPRNDLLNVNVSAEININYRLSELGFITNKNDMDWIKKNYDLYSKLIAGAIHGKPIGGLVAGNVKTSAKNQKNPPVPAGYTLDKNNVPYKKETGYYTVANVKGNNVRDGYSTNSRITGVLPNNATIKYDGAYCINGYRWITYIANSGQRRYIATGEVDKAGNRISSFGKFSTI

SEQ ID NO: 37 - DNA, 345 bp, Staphylococcus aureus
gtgcttcggcactggctttttattttggataaaaggagcaaacaaatggatgcaaaagtaataacaagatacatcgtattgatcttagcattagtcaatcagtttttagcgaataaaggtataagtccgataccagtagatgaagaaagtgtttcatcgattatcttaacagttgttgctttatatactacatataaagataatccaacatctcaagaaggtaaatgggcaaatcaaaagctaaagaaatataaagctgaaaacaagtatagaaaagcaacagggcaagcgccaattaaagaagtaatgacacctacgaatatgaacgacacaaatgatttaggg

SEQ ID NO: 38 - protein, 115 aa, Staphylococcus aureus
VLRHWLFILDKRSKQMDAKVITRYIVLILALVNQFLANKGISPIPVDEESVSSIILTVVALYTTYKDNPTSQEGKWANQKLKKYKAENKYRKATGQAPIKEVMTPTNMNDTNDLG

SEQ ID NO: 39 - DNA, 318 bp, Staphylococcus aureus
ttgaataaagtgggtggtgtaatgtttggatttaccaaacgacacgaacaagattggcgtttaacgcgattagaagaaaatgataagactatgtttgaaaaattcgacagaatagaagacagtctgagaacgcaagaaaaaatttatgacaagttagatagaaatttcgaagaactaaggcgtgacaaagaagaagatgaaaaaaataaagagaaaaatgctaaaaatattagagacatcaagatgtggattctaggattaatagggacgattctaagtacatttgttatagccttgttaaaaactatttttggcatt

SEQ ID NO: 40 - protein, 106 aa, Staphylococcus aureus
  MISC_FEATURE (1)..(106): hypothetical protein
LNKVGGVMFGFTKRHEQDWRLTRLEENDKTMFEKFDRIEDSLRTQEKIYDKLDRNFEELRRDKEEDEKNKEKNAKNIRDIKMWILGLIGTILSTFVIALLKTIFGI

SEQ ID NO: 41 - DNA, 432 bp, Staphylococcus aureus
atgttactaccaaaacgtgtaaaatatcgtcgtcaacatcgtcttaaaacaactggtcgttctaaaggcggtaactacgtaacatttggtgagtttggtttacaagctacaacaacgtcttggatcacatctcgtcaaatcgaatctgctcgtatagcaatgacacgttacatgaaacgtggcgggaaagtttggattaaaatcttcccacatacaccatatactaaaaaacctttagaagtacgtatgggtgctggtaaaggtgcggttgaaggctggatcgcagttgttaaaccaggtagaattttattcgaagttgctggcgtttctgaagaagttgcgcgtgaagcactacgtttagcaagtcacaaacttccagtaaaaactaagtttgtaaaacgtgaggaattgggtggtgaaacaaatgaaagc

SEQ ID NO: 42 - protein, 144 aa, Staphylococcus aureus
  MISC_FEATURE (1)..(144): 50S ribosomal protein L16
MLLPKRVKYRRQHRLKTTGRSKGGNYVTFGEFGLQATTTSWITSRQIESARIAMTRYMKRGGKVWIKIFPHTPYTKKPLEVRMGAGKGAVEGWIAVVKPGRILFEVAGVSEEVAREALRLASHKLPVKTKFVKREELGGETNES

SEQ ID NO: 43 - DNA, 732 bp, Staphylococcus aureus
atgcttattccttcaatggggtatattgttggcttacttatcggtttatatgtatatcgtaaaccacgtgaatatgaaacacgtaaaatttcagatagtgacaatgttacagagttaaaaccatatatcttaatagtaacaattgtagcaatactagctacatttttagtacaaacatttacagattcaatgatttttggtgcactggcaggggtactcgtattctttatttcacgtgcatataattggtatgaattagatgctaagtttgttgaaggtattaaaattatggcttatattggtgtagttattttaacagcaaatggatttgctggtgtaatgaatgctactggtgatatagatgaattagttaaaactttaacaagtattactggtgataataaattatttagcattatcatgatgtatgtgataggtttaattgtcactttaggtattggatcatcatttgcaacaattcctattatcgcatcattattcattccttttggagcgtcaattggactagatacaatggcattaatcgcattgattggaacagcgagtgcattaggtgactcaggttcgcctgcaagtgattcaacattaggaccaactgcgggattaaatgttgatggccaacatgatcatatacgtgatacatgtgtaccaaacttcttgttttataatattcctttaatgattttcggtactattgctgctatggtacta

SEQ ID NO: 44 - protein, 244 aa, Staphylococcus aureus
  MISC_FEATURE (1)..(244): conserved hypothetical
MLIPSMGYIVGLLIGLYVYRKPREYETRKISDSDNVTELKPYILIVTIVAILATFLVQTFTDSMIFGALAGVLVFFISRAYNWYELDAKFVEGIKIMAYIGVVILTANGFAGVMNATGDIDELVKTLTSITGDNKLFSIIMMYVIGLIVTLGIGSSFATIPIIASLFIPFGASIGLDTMALIALIGTASALGDSGSPASDSTLGPTAGLNVDGQHDHIRDTCVPNFLFYNIPLMIFGTIAAMVL

SEQ ID NO: 45 - DNA, 162 bp, Staphylococcus aureus
atgcttaaattaatttcaccaacattcgaagatattaaaacatggtatcaattgaaagaatatagtaaagaagatatagcgtggtatgtagatatggaagttatagataaagaggaatatgcaattattacaggagaaaagtatccagaaaatctagagtca

SEQ ID NO: 46 - protein, 54 aa, Staphylococcus aureus
  MISC_FEATURE (1)..(54): hypothetical protein
MLKLISPTFEDIKTWYQLKEYSKEDIAWYVDMEVIDKEEYAIITGEKYPENLES

SEQ ID NO: 47 - DNA, 387 bp, Staphylococcus aureus
atgcaaatattagttaacaagcgtaatgagataatttcatacgctatcattggtggctttgaagaaggtattgatattgaaaatttaccagaaaatttctctcaagtttttagacctaaagcctttaaatattcaaatggggaaatagtttttaacgaagattattcagaagaaaaagatgacttgcatcaacagattgacagtgaagaacaaaacacagtcgcttctgatgacatcttacgaaaaatggttgctagtatgcagaaacaagttgttcaaagtacaaagttatcgatgcaagttaataagcaaaatgcactaatggcaaaacaacttgtgacacttaataaaaaattagaagaggttaaaggagagactgaaaatgct

SEQ ID NO: 48 - protein, 129 aa, Staphylococcus aureus
  MISC_FEATURE (1)..(129): hypothetical protein
MQILVNKRNEIISYAIIGGFEEGIDIENLPENFSQVFRPKAFKYSNGEIVFNEDYSEEKDDLHQQIDSEEQNTVASDDILRKMVASMQKQVVQSTKLSMQVNKQNALMAKQLVTLNKKLEEVKGETENA

SEQ ID NO: 49 - DNA, 1497 bp, Staphylococcus aureus
atggactttacacgaagggagaattataagttaatgagtaatttagagaaatctgtagctataaatttagaaaacacagcgcattatggaaatatttcaaatctagatataacttttagaacaggagagagtgattcttctgttcttctttttaatatcactaaaaataatcaaccgttattattgagtgaagaaaatatcaaagcacgaatagcgattcgaggtaaaggagtcatggtagttgctccactagaaatattagatccatttaaaggtattttaaaatttcaattacctaatgatgtaattaaacgagatggaagttatcaagctcaagtttcggttgcagaattaggtaattcagacgtggtagttgtcgagagaactatcacatttaacgttgaaaaaagtttgtttagcatgattccatctgaaacaaaattacactatattgttgaatttcaggaattagaaaaaactattatggatcgtgcgaaagcaatggacgaggctataaaaaatggtgaagattatgcgagtctgattgaaaaagctaaagaaaaaggtctatcagatattcaaatagcaaaatcttcaagtatagatgaattaaagcaacttgctaatagccatatatctgatttggaaaataaagcgcaagcatattcaagaacattcgatgagcaaaagcgatatatggatgagaaacatgaagccttcaagcagtcagtgaatagtggtggtttagtcacaagtggttctacttcaaattggcaaaaagctaagattactaaagatgatggtaagataatgcagattactggatttgattttaataatccagaacaaagaataggtgattcaacccaatttatttatgtttcgcaagctataaattatccaagaggtgttagtactaacggtactgtcgaatatttagtagtaacttcagattacaagcgtatgacttatcgaccgaacggtacaaataaagtatttgttaaaagaaaagaagcgggttcatggtctgagtggtcagaattagctattaatgattacaatacaccttttgaaactgttcaaagtgcccaatcaaaagctaatatggccgaaagtaacgctaaattatacgcagatgacaagtttaataaaaggtattcggttatttttgatggaacagcaaatggtgtgggctctacattgtacttaaatgagagtttagaccaatttattttattaattttttatgggacttttccaggtggtgactttacagagtttggcagtccttttggaggaggaaagatttcattgaatccctcaaatcttccagatggtgatggaaatggtggaggtgtttatgagtttggattaactaaatctagtcgtacatctttaactatatcaaacgatgtctatttcgacttaggaagtcaaagaggctctggtgcgaacgcaaatagagggacaattaacaaaattataggagtgagaaaa

SEQ ID NO: 50 - protein, 499 aa, Staphylococcus aureus
  MISC_FEATURE (1)..(499): hypothetical protein
MDFTRRENYKLMSNLEKSVAINLENTAHYGNISNLDITFRTGESDSSVLLFNITKNNQPLLLSEENIKARIAIRGKGVMVVAPLEILDPFKGILKFQLPNDVIKRDGSYQAQVSVAELGNSDVVVVERTITFNVEKSLFSMIPSETKLHYIVEFQELEKTIMDRAKAMDEAIKNGEDYASLIEKAKEKGLSDIQIAKSSSIDELKQLANSHISDLENKAQAYSRTFDEQKRYMDEKHEAFKQSVNSGGLVTSGSTSNWQKAKITKDDGKIMQITGFDFNNPEQRIGDSTQFIYVSQAINYPRGVSTNGTVEYLVVTSDYKRMTYRPNGTNKVFVKRKEAGSWSEWSELAINDYNTPFETVQSAQSKANMAESNAKLYADDKFNKRYSVIFDGTANGVGSTLYLNESLDQFILLIFYGTFPGGDFTEFGSPFGGGKISLNPSNLPDGDGNGGGVYEFGLTKSSRTSLTISNDVYFDLGSQRGSGANANRGTINKIIGVRK

SEQ ID NO: 51 - DNA, 1908 bp, Staphylococcus aureus
atggaaaatttgtatttaataaaggatttgggagctttagcaggtcgagattatagagctaaggaaatacaaaacttacaaagaatagagcaatttgcgcttggcttgacaacagagtttaagttgcatcagaaagctaaaacaattcaacacttcgctgagcaaatttattataatggtagatcgcaagcagcagtaaacaaatctttacaaagtcaaattaacgcacttgttgtggcaccacgtaataacagtgctaatgagattgttcaagctcgagttaatgtaaacggcgaaacctttgacacattaaaagaacatttagacgattgggaaaccaaaactcaaattaataaagaggaaactataagagaattaaataagaccaaacaagaaattcttgatatcgagtatcgttttgaacctgataagcaagaatttttatttgtgacagaacttgcacctcttacaaatgcagtaatgcaatccttctggtttgataatagaacaggcatagtatacatgacacaagctagaaataatggctatatgctaagtcgtctaagacctaatggtcaatttatagacagctcattgattgtaggtgggggtcatggtacacataacggttatagatatattgatgatgagttatggatttatagttttatcttaaatggtaataatgagaatacattagttcgtttcaagtatacgcctaatgtggaaattagctatggcaagtatggtatgcaagatgtatttacaggacacccagaaaaaccctacatcacccctgtcataaatgaaaaagaaaataaaattctatacagaattgagagacctagaagtcagtgggaacttgaaaactcaatgaattatatagagataagaagtttagacgatgttgataaaaatattgataaagttttgcataaaatcagtatccctatgagactaacaaacgaaacccaaccaatgcagggtgtgacttttgatgaaaaatacttgtattggtatacaggagacagtaatccaaataatagaaactatttaacggctttcgatttagaaacaggagaagaagcgtatcaggttaatgctgactatggtggaacactagattcatttcctggcgaatttgcggaagcagaaggtttgcaaatatactatgacaaagatagtggtaaaaaagctttgatgctaggtgttactgtcggtggtgatggaaatagaacacatcgtattttcatgattgggcaaagaggtattttagaaatacttcactcaagaggcgttccttttatcatgagtgacacaggtggtagagttaaacctttaccaatgaggcctgataaacttaagaatcttgggatgttaacagagccaggtctttactatttatacactgatcatacagttcaaatcgatgatttcccattaccaagagaatggcgtgatgcaggttggttcttggaagttaagccaccacaaactggcggtgatgtaattcagatattgacgcgtaatagttatgcaaggaatatgatgacttttgaaagggtgctttctggaagaactggagacatttcggactggaattatgtgcctaaaaatagtggtaaatgggagagagtaccttcattcatcacaaaaatgtcagatattaacatagtaggcatgtcgttttatttaactacggatgatacaaaacgttttacagattttccaactgaacgtaaaggggtagctggttggaacttatatgtagaagcttcaaacacaggtggctttgttcataggctagttcgtaatagtgttacagcatctgctgagatactattgaaaaattatgatagtaaaacaagttcagggccatggactttacacgaagggagaattataagt

SEQ ID NO: 52 - protein, 636 aa, Staphylococcus aureus
  MISC_FEATURE (1)..(636): hypothetical protein
MENLYLIKDLGALAGRDYRAKEIQNLQRIEQFALGLTTEFKLHQKAKTIQHFAEQIYYNGRSQAAVNKSLQSQINALVVAPRNNSANEIVQARVNVNGETFDTLKEHLDDWETKTQINKEETIRELNKTKQEILDIEYRFEPDKQEFLFVTELAPLTNAVMQSFWFDNRTGIVYMTQARNNGYMLSRLRPNGQFIDSSLIVGGGHGTHNGYRYIDDELWIYSFILNGNNENTLVRFKYTPNVEISYGKYGMQDVFTGHPEKPYITPVINEKENKILYRIERPRSQWELENSMNYIEIRSLDDVDKNIDKVLHKISIPMRLTNETQPMQGVTFDEKYLYWYTGDSNPNNRNYLTAFDLETGEEAYQVNADYGGTLDSFPGEFAEAEGLQIYYDKDSGKKALMLGVTVGGDGNRTHRIFMIGQRGILEILHSRGVPFIMSDTGGRVKPLPMRPDKLKNLGMLTEPGLYYLYTDHTVQIDDFPLPREWRDAGWFLEVKPPQTGGDVIQILTRNSYARNMMTFERVLSGRTGDISDWNYVPKNSGKWERVPSFITKMSDINIVGMSFYLTTDDTKRFTDFPTERKGVAGWNLYVEASNTGGFVHRLVRNSVTASAEILLKNYDSKTSSGPWTLHEGRIIS

SEQ ID NO: 53 - DNA, 288 bp, Staphylococcus aureus
atggcaacagaagaagttaaaatcaaagcgctacttgaaaacgataaacagtactttccagctacacattggaaagctataaatgggataccttatgcaggcagtagtgatattgatggattgcctcaagacggtatcatttcggtaaatgataaaaataaattagataatttaaaaataggcgaagcaggaattattcaaaatagcattgtacagaaatccccaaacggtaaattgtggaaaataacagttgacgatagtgggaaacttggtacagtgctattttat

SEQ ID NO: 54 - protein, 96 aa, Staphylococcus aureus
MATEEVKIKALLENDKQYFPATHWKAINGIPYAGSSDIDGLPQDGIISVNDKNKLDNLKIGEAGIIQNSIVQKSPNGKLWKITVDDSGKLGTVLFY

SEQ ID NO: 55 - DNA, 1581 bp, Staphylococcus aureus
atggattatcatgatcatttatcagtaatggattttaatgaattgatttgtgaaaatttactagatgtagattacggttcttttaaagaatattatgaactgaatgaagctaggtacatcacctttacagtttatagaactactcataatagttttgtttttgatttattgatttgtgaaaacttcataatttatcatggtgaaaaatacacaattaagcagacagcgccaaaggttgaaggtgataaagtttttattgaagttacggcatatcacataatgtatgaatttcaaaatcactcagtggaatcaaataagcttgatgacgacagtagcgaaactggtaaaacgccagaatactctttagatgagtacttaagatatggatttgcaaatcaaaaaacgtcagtcaagatgacctataaaataattggagattttaaaagaaaaataccaattgatgaattaggtaataaaaatggcttagaatattgtaaagaagcagtagatttgtttggttgtattatttatccaaatgatacggagatatgtttttattctcctgaaacattctatcaaagaagcgaaaaagtaataaggtatcaatataatactgatactgtgtctgctactgtcagtacgttggaattaagaacagctataaaagtttttgggaaaaagtacacagccgaggaaaagaaaaattataatcctattagaacaactgacattaaatattcaaatggttttataaaagaaggtacttatcgtaccgcaacaattgggtctaaagctactattaactttgattgcaagtatggtaatgaaacagttagatttacaataaaaaagggctctcaaggtggaatatataagttgattttagacggcaagcaaattaagcaaatttcttgttttgctaagtcggttcagtctgaaacaatagatttaataaaaaatattgataaaggcaagcacgttttagaaatgatatttttaggagaagaccccaaaaatagaattgatatatcttcaaataaaaaagctaagccttgtatgtatgttggaactgaaaaatcaacagtcttaaatttaattgctgacaactcaggtcgcaatcaatacaaagcaattgttgactacgtcgcagatagtgcaaagcagtttgggattcgatatgctaatacgcaaacaaatgaagatatcgaaacacaggataagctgttagaatttgcaaaaaagcaaataaatgatactcctaagactgaattagatgttaattatataggttatgaaaaaatagagccaagagatagcgtattctttgttcatgaattaatgggatataacactgaattaaaggttgttaaacttgataggtcacatccatttgtaaacgcaatagatgaagtgtctttcagcaatgaaataaaggatatggtacaaattcaacaagcgcttaacagacgagttattgcacaagataatagatataactatcaagcaaatcgtataaatcatttatacactagtactttgaattctcctttcgagacaatggatatagggagtgtattaata

SEQ ID NO: 56 - protein, 527 aa, Staphylococcus aureus
MDYHDHLSVMDFNELICENLLDVDYGSFKEYYELNEARYITFTVYRTTHNSFVFDLLICENFIIYHGEKYTIKQTAPKVEGDKVFIEVTAYHIMYEFQNHSVESNKLDDDSSETGKTPEYSLDEYLRYGFANQKTSVKMTYKIIGDFKRKIPIDELGNKNGLEYCKEAVDLFGCIIYPNDTEICFYSPETFYQRSEKVIRYQYNTDTVSATVSTLELRTAIKVFGKKYTAEEKKNYNPIRTTDIKYSNGFIKEGTYRTATIGSKATINFDCKYGNETVRFTIKKGSQGGIYKLILDGKQIKQISCFAKSVQSETIDLIKNIDKGKHVLEMIFLGEDPKNRIDISSNKKAKPCMYVGTEKSTVLNLIADNSGRNQYKAIVDYVADSAKQFGIRYANTQTNEDIETQDKLLEFAKKQINDTPKTELDVNYIGYEKIEPRDSVFFVHELMGYNTELKVVKLDRSHPFVNAIDEVSFSNEIKDMVQIQQALNRRVIAQDNRYNYQANRINHLYTSTLNSPFETMDIGSVLI

SEQ ID NO: 57 - DNA, 822 bp, Staphylococcus aureus
atgcaatcttttgtaaaaatcatagatggttacaaggaagaagtaataacagattttaatcagcttatatttttagatgcaagggctgaaagtccaaacaccaatgataacagtgtaactattaacggagtagatggtattttaccgggcgcaattagttttgcgcctttttcattagtattaaggtttggctatgatggtatagatgttatagatttaaatttatttgagcattggtttagatctgtgtttaatcgcagacatccttattatgttattacttctcaaatgcctggtgttaaatatgcagtgaatacagctaatgttacatctaatttaaaagatggttcttcaactgaaattgaagtaagtttaaatgtttataaagggtattctgaatcagttaattggaccgatagcgagttcttattcgactctaattggatgtttgaaaatggaattcctcttgatttcacacctaaatatactcatacatcaaatcaatttactatttggaacggttctactgatacgataaatccacgattcaagcacgatttgaaaatattaattaatttaaatgcgagtggaggatttgaactggttaattatacaacaggtgatatttttaagtacaacaaaagtatagataaaaacactgattttgttttagatggtgtgtatgcatatcgagatataaacagagtgggaattgatacaaatagaggcattataacattagcgccaggtaaaaatgaatttaagattaaaggagacgtcagtgatattaaaactacatttaagtttccttttatttatagg

SEQ ID NO: 58 - protein, 274 aa, Staphylococcus aureus
MQSFVKIIDGYKEEVITDFNQLIFLDARAESPNTNDNSVTINGVDGILPGAISFAPFSLVLRFGYDGIDVIDLNLFEHWFRSVFNRRHPYYVITSQMPGVKYAVNTANVTSNLKDGSSTEIEVSLNVYKGYSESVNWTDSEFLFDSNWMFENGIPLDFTPKYTHTSNQFTIWNGSTDTINPRFKHDLKILINLNASGGFELVNYTTGDIFKYNKSIDKNTDFVLDGVYAYRDINRVGIDTNRGIITLAPGKNEFKIKGDVSDIKTTFKFPFIYR

SEQ ID NO: 59 - DNA, 6222 bp, Staphylococcus aureus
ttggaagctagaaaggaggttaatatgaatgaaaaagtagaaggcatgaccttggagctgaaattagaccatttaggtgtccaagaaggcatgaaaggtttaaagcgacaattaggtgttgttaatagtgaaatgaaagctaatctgtcagcatttgataagtctgaaaaatcaatggaaaaatatcaggcgagaattaaggggttaaatgataggcttaaagttcaaaaaaagatgtattctcaagtagaagatgagcttaaacaagttaacgctaattaccaaaaagctaaatccagtgtaaaagatgttgagaaagcatatttaaagttagtagaagccaataaaaaagaaaaattagctcttgataaatctaaagaagccttaaaatcatcgaatacagaacttaaaaaagctgaaaatcaatataaacgtacaaatcaacgtaaacaagatgcgtatcaaaaacttaaacagttgagagatgcagaacaaaagcttaagaatagtaaccaagctactactgcacaactaaaaagagcaagtgacgcagtacagaagcagtccgctaagcataaagcacttgttgaacaatataaacaagaaggcaatcaagttcaaaaactaaaagtgcaaaatgacaatctttcaaaatcaaatgataaaattgaaagttcttacgctaaaactaatactaaattaaagcaaacagaaaaagaatttaatgatttaaacaatactattaagaatcatagcgctaatgtcgcaaaagctgaaacagctgttaataaagaaaaagctgctttaaataatttggagcgttcaatagataaagcttcatccgaaatgaagacttttaacaaagaacaaatgatagctcaaagtcatttcggtaaacttgcaagtcaagcggatgtcatgtcaaagaaatttagttctattggagacaaaatgacttccctgggacgtacaatgacgatgggcgtatctacaccgattactttaggtttaggtgcagcattaaaaacgagtgcagactttgaagggcaaatgtctcgagttggagcgattgcacaagcaagcagtaaagacttaaaaagcatgtctaatcaagcggttgacttaggagctaaaacaagtaaaagtgctaacgaagttgctaaaggtatggaagaattggcagctttaggctttaatgccaaacaaacaatggaggctatgccaggtgttatcagcgcagcagaagcaagtggtgcagaaatggctacaactgcaactgtaatggcttcagcgattaactctttcggtttaaaagcatctgatgcaaatcatgttgctgatttacttgcgagatcagcaaatgatagtgctgcagatattcaatatatgggagatgcattaaaatatgcaggtactccagcaaaagcattaggagtttcaatagaggacacttctgcagcaattgaagttttatctaactcaggtttagaggggtctcaagcaggtactgcattaagagcttcgtttattaggctagctaatccaagtaaaagtacagctaaggaaatgaaaaaattaggtattcatttgtctgatgctaaaggtgagtttgttggaatgggcgaattgattagacagttccaagataacatgaaaggcatgacgagagaacaaaaattagcaacagtggctacaatagttggcactgaagcagcaagtggatttttagccttgattgaagcgggtccagataaaattaatagctatagcaaatcattgaagaactctaatggtgaaagtaaaaaagcagctgatttgatgaaagataacctcaaaggtgctctggaacaattaggtggcgcttttgaatcgttagcaattgaagttggtaaagatttaacgcctatgattagagcaggtgcggaaggattaacaaaattagttgatggatttacacatcttcctggttgggttagaaaggcttcggtaggcttagcaatttttggtgcatctattggtcctgctgttcttgctggtggcttattaatacgtgcagttgggagcgcggctaaaggctatgcatcattaaatagacgcattgctgaaaatacaattctttctaataccaattcaaaagcaatgaaatctttaggtcttcaaacattatttcttggttctacaacaggaaaaacgtcaaaaggctttaaaggattagccggagctatgttgtttaatttaaaacctataaatgttttgaaaaattctgcaaagctagcaattttaccgttcaaacttttgaaaaacggtttaggattagccgcaaaatccttatttgcagtaagtggaggcgcaagatttgctggtgtagccttaaagtttttaacaggacctataggtgctacaataactgctattacaattgcatataaagtttttaaaaccgcatatgatcgtgtggaatggttcagaaacggtattaacggtttaggagaaactataaagttttttggtggcaaaattattggcggtgctgttaggaagctaggagagtttaaaaattatcttggaagtataggcaaaagcttcaaagaaaagttttcaaaggatatgaaagatggttataaatctttgagtgacgatgaccttctgaaagtaggagtcaacaagtttaaaggatttatgcaaaccatgggcacagcttctaaaaaagcatctgatactgtaaaagtgttggggaaaggtgtttcaaaagaaacagaaaaagctttagaaaaatacgtacactattctgaagagaacaacagaatcatggaaaaagtacgtttaaactcgggtcaaataacagaagacaaagcaaaaaaacttttgaaaattgaagcggatttatctaataaccttatagctgaaatagaaaaaagaaataaaaaggaactcgaaaaaactcaagaacttattgataagtatagtgcattcgatgaacaagaaaagcaaaacattttaactagaactaaagaaaaaaatgacttgcgaattaaaaaagagcaagaactcaatcagaaaatcaaagaattgaaagaaaaagctttaagtgatggtcagatttcagaaaatgaaagaaaagaaattgaaaagcttgaaaatcaaagacgtgacatcactgttaaagaattgagtaagactgaaaaagagcaagagcgtattttagtaagaatgcaaagaaacagaaatgcttattcaatagacgaagcgagcaaagcaattaaagaagcagaaaaagcaagaaaagcaagaaaaaaagaagtggataagcagtatgaagatgatgtcattgctataaaaaataacgtcaacctttctaagtctgaaaaagataaattgttagctattgctgatcaaagacataaggatgaagtaagaaaggcaaaatctaaaaaagatgctgtagtagacgttgttaaaaagcaaaataaagatattgataaagaaatggatttatccagtggacgtgtatataaaaatactgaaaagtggtggaatggtcttaaaagttggtggtctaactttagagaagaccaaaagaagaaaagtgataaatacgctaaagaacaagaagaaacagctcgtagaaacagagaaaatataaagaaatggtttggaaatgcttgggacggcgtaaaaactaaaactggtgaagcctttagtaaaatgggcagaaatgctaatcattttggcggcgaaatgaaaaaaatgtggagtggaatcaaaggaattccaagcaaattaagttcaagttggagctcagccaaaagttctgtaggatatcacactaaggctatagctaatagtactggtaaatggtttggaaaagcttggcaatctgttaaatcgactacaggaagtatttacaatcaaactaagcaaaagtattcagatgcctcagataaagcttgggcgcattcaaaatctatttggagaggcacatcaaaatggtttagcaacgcatataaaagtgcaaagggttggctaatagatatggctaataaatcgcgctcgaaatgggataatatttctagtacagcatggtcgaatgcaaaatccgtttggaaaggaacatcgaaatggtttagtaactcatacaaatctttaaaaggttggactggggatatgtattcaagagcccacgatcgttttgatgcaatttcaagttcggcatggtctaacgctaaatcagtatttaatggttttagaaaatggctatcaaaaacatatgattggattagagatattggtaaagacatgggaagagctgcggctgatttaggtaaaaatgttgctaataaagctattggcggtttgaatagcatgattggcggtattaataaaatatctaaagccattactgataaaaatctcatcaagccaatacctacattgtctactggtactttagcaggaaagggtgtagctaccgataattcaggagcattaacgcaaccgacatttgctgtattaaatgatagaggttctggaaacgccccaggtggtggagttcaagaaataattcacagggctgacggaacattccatgcaccccaaggacgagatgtggttgttccactaggagttggagatagtgtaataaatgccaatgacactctgaagttacagcggatgggtgttttgccaaaattccatggtggtacgaaaaagaaaaaatggatggaacaagttactgaaaatcttggtaaaaaagcaggggacttcggttctaaagctaaaaacacagctcataatatcaaaaaaggtgcagaagaaatggttgaagcggcaggcgataaaatcaaagatggtgcatcttggttaggcgataaaatcggcgatgtgtgggattatgtacaacatccagggaaactagtaaataaagtaatgtcaggtttaaatattaattttggaggcggagctaacgctacagtaaaaattgctaaaggcgcgtactcattgctcaaaaagaaattagtagacaaagtaaaatcgtggtttgaagattttggtggcggaggcgatggaagctatctatttgaccatccaatttggcaaaggtttgggagttacacaggtggacttaactttaatggcggtcgtcactatggtatcgactttggtatgcctacaggaacgaacatttatgctgttaaaggcggtatagctgataaagtatggactgattacggtggcggtaattctatacaaattaagaccggtgctaacgaatggaactggtatatgcatttatctaagcaattagcaagacaaggccaacgtattaaagctggtcaactgatagggaaatcaggtgctacaggtaatttcgttagaggagcacacttacatttccaattgatgcaagggtcgcatccagggaatgatacagctaaagatccagaaaaatggttgaagtcacttaaaggtagtggcgttcgaagtggttcaggtgttaataaggctgcatctgcttgggcaggcgatatacgtcgtgcagcaaaacgaatgggtgttaatgttacttcggctgacgtaggaaatatcattagcttgattcaacacgaatcaggaggaaatgcaggtataactcaatctagttcgcttagagacatcaacgttttacagggcaatccagcaaaaggattgcttcaatatatcccacaaacatttagacattatgctgttagaggtcacaacaatatatatagtggttacgatcagttattagcgttctttaacaacagatattggcgctcacagtttaacccaagaggtggttggtctccaagtggtccaagaagatatgcgaatggtggtttgattacaaagcatcaacttgctgaagtgggtgaaggagataaacaggagatggttatccctttaactagacgtaaacgagcaattcaattaactgaacaggttatgcgcatcatcggtatggatggcaagccaaataacatcactgtaaataatgatacttctacagttgaaaaattgttgaaacaaattgttatgttaagtgataaaggaaataaattaacagatgcgttgattcaaactgtttcttctcaggataataacttaggttctaatgatgcaattagaggtttagaaaaaatattgtcaaaacaaagtgggcatagagcaaatgcaaataattatatgggaggtttgactaat

SEQ ID NO: 60 - protein, 2074 aa, Staphylococcus aureus
  MISC_FEATURE (1)..(2074): phi PVL ORF 15 and 16
LEARKEVNMNEKVEGMTLELKLDHLGVQEGMKGLKRQLGVVNSEMKANLSAFDKSEKSMEKYQARIKGLNDRLKVQKKMYSQVEDELKQVNANYQKAKSSVKDVEKAYLKLVEANKKEKLALDKSKEALKSSNTELKKAENQYKRTNQRKQDAYQKLKQLRDAEQKLKNSNQATTAQLKRASDAVQKQSAKHKALVEQYKQEGNQVQKLKVQNDNLSKSNDKIESSYAKTNTKLKQTEKEFNDLNNTIKNHSANVAKAETAVNKEKAALNNLERSIDKASSEMKTFNKEQMIAQSHFGKLASQADVMSKKFSSIGDKMTSLGRTMTMGVSTPITLGLGAALKTSADFEGQMSRVGAIAQASSKDLKSMSNQAVDLGAKTSKSANEVAKGMEELAALGFNAKQTMEAMPGVISAAEASGAEMATTATVMASAINSFGLKASDANHVADLLARSANDSAADIQYMGDALKYAGTPAKALGVSIEDTSAAIEVLSNSGLEGSQAGTALRASFIRLANPSKSTAKEMKKLGIHLSDAKGEFVGMGELIRQFQDNMKGMTREQKLATVATIVGTEAASGFLALIEAGPDKINSYSKSLKNSNGESKKAADLMKDNLKGALEQLGGAFESLAIEVGKDLTPMIRAGAEGLTKLVDGFTHLPGWVRKASVGLAIFGASIGPAVLAGGLLIRAVGSAAKGYASLNRRIAENTILSNTNSKAMKSLGLQTLFLGSTTGKTSKGFKGLAGAMLFNLKPINVLKNSAKLAILPFKLLKNGLGLAAKSLFAVSGGARFAGVALKFLTGPIGATITAITIAYKVFKTAYDRVEWFRNGINGLGETIKFFGGKIIGGAVRKLGEFKNYLGSIGKSFKEKFSKDMKDGYKSLSDDDLLKVGVNKFKGFMQTMGTASKKASDTVKVLGKGVSKETEKALEKYVHYSEENNRIMEKVRLNSGQITEDKAKKLLKIEADLSNNLIAEIEKRNKKELEKTQELIDKYSAFDEQEKQNILTRTKEKNDLRIKKEQELNQKIKELKEKALSDGQISENERKEIEKLENQRRDITVKELSKTEKEQERILVRMQRNRNAYSIDEASKAIKEAEKARKARKKEVDKQYEDDVIAIKNNVNLSKSEKDKLLAIADQRHKDEVRKAKSKKDAVVDVVKKQNKDIDKEMDLSSGRVYKNTEKWWNGLKSWWSNFREDQKKKSDKYAKEQEETARRNRENIKKWFGNAWDGVKTKTGEAFSKMGRNANHFGGEMKKMWSGIKGIPSKLSSSWSSAKSSVGYHTKAIANSTGKWFGKAWQSVKSTTGSIYNQTKQKYSDASDKAWAHSKSIWRGTSKWFSNAYKSAKGWLIDMANKSRSKWDNISSTAWSNAKSVWKGTSKWFSNSYKSLKGWTGDMYSRAHDRFDAISSSAWSNAKSVFNGFRKWLSKTYDWIRDIGKDMGRAAADLGKNVANKAIGGLNSMIGGINKISKAITDKNLIKPIPTLSTGTLAGKGVATDNSGALTQPTFAVLNDRGSGNAPGGGVQEIIHRADGTFHAPQGRDVVVPLGVGDSVINANDTLKLQRMGVLPKFHGGTKKKKWMEQVTENLGKKAGDFGSKAKNTAHNIKKGAEEMVEAAGDKIKDGASWLGDKIGDVWDYVQHPGKLVNKVMSGLNINFGGGANATVKIAKGAYSLLKKKLVDKVKSWFEDFGGGGDGSYLFDHPIWQRFGSYTGGLNFNGGRHYGIDFGMPTGTNIYAVKGGIADKVWTDYGGGNSIQIKTGANEWNWYMHLSKQLARQGQRIKAGQLIGKSGATGNFVRGAHLHFQLMQGSHPGNDTAKDPEKWLKSLKGSGVRSGSGVNKAASAWAGDIRRAAKRMGVNVTSADVGNIISLIQHESGGNAGITQSSSLRDINVLQGNPAKGLLQYIPQTFRHYAVRGHNNIYSGYDQLLAFFNNRYWRSQFNPRGGWSPSGPRRYANGGLITKHQLAEVGEGDKQEMVIPLTRRKRAIQLTEQVMRIIGMDGKPNNITVNNDTSTVEKLLKQIVMLSDKGNKLTDALIQTVSSQDNNLGSNDAIRGLEKILSKQSGHRANANNYMGGLTN

SEQ ID NO: 61 - DNA, 156 bp, Staphylococcus aureus
atggagcagtatgggtggacattaactgaagtcagaaaacagccgtatgtaaaacttttagaaatacttaatgaagagaataaagaagagactgaagaaaaacaaagtgaacaaaaagtcattacaggtacggatttaagaaaactttttggaagc

SEQ ID NO: 62 - protein, 52 aa, Staphylococcus aureus
MEQYGWTLTEVRKQPYVKLLEILNEENKEETEEKQSEQKVITGTDLRKLFGS

SEQ ID NO: 63 - DNA, 348 bp, Staphylococcus aureus
atgattaaatttgaaattaaagatcgtaaaacaggaaaaacagagagctatacaaaagaagatgtaacaatgggcgaagcagaaaaatgctatgagtatttagaattagtaaatcaagagaataaaaaagaagcacctaacgcaacaaaaatgagacaaaaagagcgacagttattagtagatttatttaaagatgaaggattgactgaagaagatgttctgaacaagatgagtactaaaacttatacaaaagccttacaagatatatttcgagaaatcaatggtgaagatgaagaagattcagaaactgaaccagaagagatgggaaagacagaagaacaatctcaa

SEQ ID NO: 64 - protein, 116 aa, Staphylococcus aureus
MIKFEIKDRKTGKTESYTKEDVTMGEAEKCYEYLELVNQENKKEAPNATKMRQKERQLLVDLFKDEGLTEEDVLNKMSTKTYTKALQDIFREINGEDEEDSETEPEEMGKTEEQSQ

SEQ ID NO: 65 - DNA, 372 bp, Staphylococcus aureus
atgactcatttattagagacatttgagatgtcaatagatcaccaggaagatggtttagttgttatttctatgcctgttactgataaagtaaaacaaccatttggatatttacatggtggggcttcgattgctttaggtgaaacagcatgttcattaggatctgctaatttaattgatacaaccaaatttattccattaggtttagagatgaatgctaaccatattcattctgctaaagatggtcgtgttactgcgacagctgaaattattcatcgaggtaagtcgacacatgtatgggatataaaaattaagaatgacaaagaacaattaattacagttatgcgtggtacagttgctattaaacctttaaaa

SEQ ID NO: 66 - protein, 124 aa, Staphylococcus aureus
  MISC_FEATURE (1)..(124): conserved hypothetical
MTHLLETFEMSIDHQEDGLVVISMPVTDKVKQPFGYLHGGASIALGETACSLGSANLIDTTKFIPLGLEMNANHIHSAKDGRVTATAEIIHRGKSTHVWDIKIKNDKEQLITVMRGTVAIKPLK

SEQ ID NO: 67 - DNA, 453 bp, Staphylococcus aureus
atgactaaaactttaaaggtttataaaggagacgacgtcgtagcttctgaacaaggtgaaggcaaagtgtcagtaactttatctaatttagaagcggatacaacttatccaaaaggtacttaccaagtggcatgggaagaaaatggtaaagaatctagtaaagttgatgtacctcaattcaaaaccaatccaattctagtctcaggcgtatcatttacaccagaaactaaatcaattatggtaaataccgatgacaatgttgagccaaacattgcaccaagcacagcaacgaataaaatattgaaatatacaagtgaacatccagaatttgttactgtagatgaaaatacaggagcaattcacggtgtagctgaaggtacttcagtaatcactgctacgtctactgatggaagcgataagtcaggacaaatttcagtgacagtaacaaacgga

SEQ ID NO: 68 - protein, 151 aa, Staphylococcus aureus
MTKTLKVYKGDDVVASEQGEGKVSVTLSNLEADTTYPKGTYQVAWEENGKESSKVDVPQFKTNPILVSGVSFTPETKSIMVNTDDNVEPNIAPSTATNKILKYTSEHPEFVTVDENTGAIHGVAEGTSVITATSTDGSDKSGQISVTVTNG

SEQ ID NO: 69 - DNA, 639 bp, Staphylococcus aureus
atggcagaaggacaaggttcttataaagtaggttttaaaagattatacgttggagtttttaacccagaagcaacaaaagtagttaaacgcatgacatgggaagatgaaaaaggtggtacagttgacctaaatatcacaggtttagcaccagatttagtagatatgtttgcatctaacaaacgtgtatggatgaaaaaacaaggtactaatgaagttaagtctgacatgagtattttcaatattccaagtgatgatttaaacacagttattggacgtactaaagataaaaatggtacatcttgggtaggagagaatacaagagcaccgtatgtaacagtaattggcgaatcggaagatggtttaacaggtcagccggtatatgtagccttacttaaaggtacttttagtttagattcaattgaatttaaaacacgaggtgaaaaagcagaagccccagaacctacaaaattaacaggtgactggatgaatagaaaagttgatgttgatggaacgtcacaaggtattgtatacggttatcatgaaggtaaagaaggagaagcagaattcttcaaaaaagtattcgttggatacacggacagtgaagatcattcagaggattctgcaggttcgttacccagc

SEQ ID NO: 70 - protein, 213 aa, Staphylococcus aureus
MAEGQGSYKVGFKRLYVGVFNPEATKVVKRMTWEDEKGGTVDLNITGLAPDLVDMFASNKRVWMKKQGTNEVKSDMSIFNIPSDDLNTVIGRTKDKNGTSWVGENTRAPYVTVIGESEDGLTGQPVYVALLKGTFSLDSIEFKTRGEKAEAPEPTKLTGDWMNRKVDVDGTSQGIVYGYHEGKEGEAEFFKKVFVGYTDSEDHSEDSAGSLPS

SEQ ID NO: 71 - DNA, 393 bp, Staphylococcus aureus
atgaatatattaaacaccataaaaggaattttattatctgatgcagagctcaaaacacatataaattctagaatatactattacaaagtcactgaaaacgctgaaacttccaaaccctttgttgttattacacctgtttatgatttgccttcagactttatgtctgataaatatctcagtgaagaatacttaattcaaatagatgtagaatcttcaaataatcagaaaacaattgatataacaaaacgaataagatacctgttatatcaacaaaatttaattcaagcatctagtcagttagatgcttattttgaagaaactaaacgttatgtgatgtcgagacgatatcaaggcatacccaaaaatatatattataaaaatcagcgcatcgaa

SEQ ID NO: 72 - protein, 131 aa, Staphylococcus aureus
MNILNTIKGILLSDAELKTHINSRIYYYKVTENAETSKPFVVITPVYDLPSDFMSDKYLSEEYLIQIDVESSNNQKTIDITKRIRYLLYQQNLIQASSQLDAYFEETKRYVMSRRYQGIPKNIYYKNQRIE

SEQ ID NO: 73 - DNA, 399 bp, Staphylococcus aureus
atgagtgtagaaattaaagggatacctgaagtgttgaataaattagaatcggtatacggtaaacaagcaatgcaggctaagagtgataaagctttaaatgaagcatctgaattttttataaaggctttaaagaaagagttcgagagctttaaagatacgggtgccagtatagaagaaatgactaaatctaagccttatacaaaagttggtagtcaagaaagggctgttttaattgaatgggtaggtcctatgaatcgcaaaaacattattcacttgaatgaacatggttatacaagagatggaaaaaaatatacaccaagaggttttggagttattgcaaaaacattagctgctagcgaacgtaagtatagagaaattataaaaaaggagttggccaga

SEQ ID NO: 74 - protein, 133 aa, Staphylococcus aureus
  MISC_FEATURE (1)..(133): hypothetical protein
MSVEIKGIPEVLNKLESVYGKQAMQAKSDKALNEASEFFIKALKKEFESFKDTGASIEEMTKSKPYTKVGSQERAVLIEWVGPMNRKNIIHLNEHGYTRDGKKYTPRGFGVIAKTLAASERKYREIIKKELAR

SEQ ID NO: 75 - DNA, 330 bp, Staphylococcus aureus
atggaatttaatgaatttaaagatcgcgcgtatttttttcaatatataaacaaaggaccatatccagatgaagaggaaaaaatgaaattgtatagttgcttttgtaaaatttataatccttctatgaaagatagagaaattttaaaagcgactgaatcaaaatcaggattaaccataattgtcaggtcttctaaaactgaatatctaccacaaacaaatcacttagttaaaattgacagtgcattatattccgataaattattcaacattgtagaaataagaattgatacaccagatattggctataatacagtggttttatcagaaaaa

SEQ ID NO: 76 - protein, 110 aa, Staphylococcus aureus
MEFNEFKDRAYFFQYINKGPYPDEEEKMKLYSCFCKIYNPSMKDREILKATESKSGLTIIVRSSKTEYLPQTNHLVKIDSALYSDKLFNIVEIRIDTPDIGYNTVVLSEK

SEQ ID NO: 77 - DNA, 276 bp, Staphylococcus aureus
atgagtttagaagaaattaaattgtggttgagaattgactataatttcgaaaatgatttaattgaaggtctcattcaatcggctaagtctgaattactattaagtggggttccagattatgacaaagatgacttggaatacccgcttttttgtacagcgattaaatatatcattgcaagagattatgaaagtcgtggatactcaaatgaccaatctagaagcaaggtgtttaatgaaaaaggattgcaaaaaatgattttgaaattaaaaaagtgg

SEQ ID NO: 78 - protein, 92 aa, Staphylococcus aureus
MSLEEIKLWLRIDYNFENDLIEGLIQSAKSELLLSGVPDYDKDDLEYPLFCTAIKYIIARDYESRGYSNDQSRSKVFNEKGLQKMILKLKKW

SEQ ID NO: 79 - DNA, 1206 bp, Staphylococcus aureus
atgcgaaattttaaaaatgacaatgaattattaggaggaaatgaaatgccgacattatatgaattaaaacaatccttaggtatgattggacaacaattaaaaaataaaaatgatgaattgagtcagaaagcaacagatccaaatattgatatggaagacatcaaacaactagaaacagaaaaagcaggtttacaacaaagatttaacattgttgaaagacaagtgcaagacattgaagaaaaagaaaaagcgaaagttaaagataaaggagaagcttatcaatctttaagtgataatgagaagatggttaaagctaaggcagagttttatcgtcacgcgattttaccaaatgaatttgaaaaaccttcaatggaggcacaacgtttattacacgctttaccaacaggaaatgattcaggtggagataagctcttaccaaaaacactttctaaagaaattgtttcagaaccatttgctaaaaaccaattacgtgaaaaagctcgtctaactaacattaaaggtttagagattccaagagtttcatacactttagacgatgatgatttcattacagacgtagaaacagcaaaagaattaaaagcaaaaggtgatacagtcaagttcactactaataaattcaaagtatttgctgcaatttcagatactgtaattcatggatcagatgtagatttagtaaactgggttgaaaacgcactacaatcaggattagcagctaaagagcgtaaagatgccttagcagtaagtcctaaatctggattagaacacatgtcattttataatggatctgttaaagaagttgagggagcagacatgtatgatgctattattaacgctttagcagatttacatgaagattatcgtgataacgcaacaatttatatgcgatatgcagattatgtcaaaattattagtgttctttcaaatggaacaacaaatttctttgacacaccagcagaaaaagtatttggcaaaccagtagtatttacagatgcagcagttaaacctattgtgggagatttcaattattttggaattaactatgatggaacaacttatgacactgataaagatgttaaaaaaggcgaatatttgtttgtattaacagcatggtatgatcagcaacgtacattagacagtgcattcagaattgcaaaagcaaaagaaaatacaggtccattacccagc

SEQ ID NO: 80 - protein, 402 aa, Staphylococcus aureus
MRNFKNDNELLGGNEMPTLYELKQSLGMIGQQLKNKNDELSQKATDPNIDMEDIKQLETEKAGLQQRFNIVERQVQDIEEKEKAKVKDKGEAYQSLSDNEKMVKAKAEFYRHAILPNEFEKPSMEAQRLLHALPTGNDSGGDKLLPKTLSKEIVSEPFAKNQLREKARLTNIKGLEIPRVSYTLDDDDFITDVETAKELKAKGDTVKFTTNKFKVFAAISDTVIHGSDVDLVNWVENALQSGLAAKERKDALAVSPKSGLEHMSFYNGSVKEVEGADMYDAIINALADLHEDYRDNATIYMRYADYVKIISVLSNGTTNFFDTPAEKVFGKPVVFTDAAVKPIVGDFNYFGINYDGTTYDTDKDVKKGEYLFVLTAWYDQQRTLDSAFRIAKAKENTGPLPS

SEQ ID NO: 81 - DNA, 783 bp, Staphylococcus aureus
gtggtgataaaaatgtcaatgaaagctaagtattttcaaatgaaaagaaaatcaaaaagtaaaggtgaaatattcatttatggtgatattgtaagtgataaatggtttgaaagtgatgtaactgctacagatttcaaaaataaactagatgaactaggagacatcagtgaaatagatgttcatataaattcatctggaggcagtgtatttgaaggacatgcaatatacaatatgctaaaaatgcatcctgcaaaaattaatatctatgtcgatgccttagcggcatcaattgctagtgttatcgctatgagtggtgacactatttttatgcacaaaaatagttttttaatgattcataattcatgggttatgactgtaggtaatgcagaagaattaagaaagacagcggatttacttgaaaaaacagatgctgttagtaattcagcttatttagataaagcaaaagatttagatcaagaacacttaaaacagatgttagatgcagaaacttggcttactgcagaagaagccttgtctttcggcttgatagatgaaattttaggagctaatgaaatagctgctagtatctctaaagagcaatataagcgtttcgagaacgtcccagaagatttaaagaaagatgtagacaaaatcactaaaattgatgatgtagatacatctgaattggttgaaacacctaaagaaagtatgtcactagaagaaaaagaaaaaagagaaaaaattaaacgcgaatgcgaaattttaaaaatgacaatgaattat

SEQ ID NO: 82 - protein, 261 aa, Staphylococcus aureus
  MISC_FEATURE (1)..(261): hypothetical protein
VVIKMSMKAKYFQMKRKSKSKGEIFIYGDIVSDKWFESDVTATDFKNKLDELGDISEIDVHINSSGGSVFEGHAIYNMLKMHPAKINIYVDALAASIASVIAMSGDTIFMHKNSFLMIHNSWVMTVGNAEELRKTADLLEKTDAVSNSAYLDKAKDLDQEHLKQMLDAETWLTAEEALSFGLIDEILGANEIAASISKEQYKRFENVPEDLKKDVDKITKIDDVDTSELVETPKESMSLEEKEKREKIKRECEILKMTMNY

SEQ ID NO: 83 - DNA, 1236 bp, Staphylococcus aureus
gtgaatgttatcgcaaaagagaatattgtcacacgcataaagaaaaaattgatagacaattggattgatcagtcagcttctaagctttatgactttagcccatggaaaaataaatctttttggggtgtaatcaataatacgcttgaaactaatgaaacgatattttcagctattacaaagttatctaattcgatggctagtttgcccttgaaaatgtatgaagattataaagtagttaatacagaagtatctgatttacttacagtgtcaccgaataattctctgagcagttttgattttattaatcaaattgaaacaatcagaaatgaaaaaggtaatgcatatgtgctaattgaacgagacatctatcatcaaccatcaaagcttttcttattaaatccagatgttgttgaaatgttaattgaaaaccaatcacgtgaactttattattccattcatgctgcaactggaaataaattgattgttcataatatggacatgttgcattttaaacacatcgtggcatctaatatggttcaaggtattagtccgattgatgtgttgaagaatacaactgattttgacaatgcagtaagaacctttaatcttacagaaatgcaaaaaccagattcttttatgcttaaatatggttccaatgtaagtacagaaaaaaggcaacaagtgttagaagatttcaaacagtactatgaagaaaacggtggaatattattccaagagcctggtgttgaaatcgaacctttacctaaaaaatatgtctctgaagatatagtggcaagcgagaatttaacaagagaaagagtagctaacgtttttcaattgccctcaatattcttaaatgcaagatcaaatacaaatttcgcgaaaaatgaagagttaaacagattttacttgcagcataccttattgccaatcgtcaaacagtatgaagaagaatttaatcggaaactacttactaaaacagacagagaaaaaaataggtattttaaatttaacgttaaatcttatttaagggctgatagtgcaacacaagcagaagtgtactttaaagcagttcgtagtggttactacactataaatgacattagagagtgggaagatttaccaccagttgaaggtggagataagccgctaataagcggtgatttatacccaattgacacgccacttgaattaagaaaatctttgaaaggtggtgataaaaatgtcaatgaaagc

SEQ ID NO: 84 - protein, 412 aa, Staphylococcus aureus
VNVIAKENIVTRIKKKLIDNWIDQSASKLYDFSPWKNKSFWGVINNTLETNETIFSAITKLSNSMASLPLKMYEDYKVVNTEVSDLLTVSPNNSLSSFDFINQIETIRNEKGNAYVLIERDIYHQPSKLFLLNPDVVEMLIENQSRELYYSIHAATGNKLIVHNMDMLHFKHIVASNMVQGISPIDVLKNTTDFDNAVRTFNLTEMQKPDSFMLKYGSNVSTEKRQQVLEDFKQYYEENGGILFQEPGVEIEPLPKKYVSEDIVASENLTRERVANVFQLPSIFLNARSNTNFAKNEELNRFYLQHTLLPIVKQYEEEFNRKLLTKTDREKNRYFKFNVKSYLRADSATQAEVYFKAVRSGYYTINDIREWEDLPPVEGGDKPLISGDLYPIDTPLELRKSLKGGDKNVNES

SEQ ID NO: 85 - DNA, 1698 bp, Staphylococcus aureus
gtggattcggtgactattaaagttttaaatgaaccttcaccaaaactattaacaacatggtatgcagagcaagtcactcaagggaaaataaaaacaagcaaatatgttaaaaaagaatgtgagagacaccttagatatctagaaaatggaggtaaatgggtatttgatgaagaattagcgcaccgtcctattcgattcatagaaaagttttgtaaaccttccaaaggatctaaacgtcaacttgtattacaaccatggcaacattttattattggcagtttgtttggttgggttcataaagaaacaaaactgcgcaggtttaaagaagctttgatatttatggggcgaaaaaatggtaaaacaactactatatctggtgttgctaactatgctgtttctcaagatggagaaaacggcgctgaaatccatcttttagcaaacgtaatgaaacaagctaggattctatttgatgaatctaaggcgatgattaaagctagcccaaagcttagagaaaattttagacctttgagagatgaaattcattacgatgcaactatatctaaaattatgccacaggcttcagacagtgataagttggatggtttaaatacacatatgggcatttttgatgaaattcatgaatttaaagattataaattgatttcagttataaaaaactcaagagcggcaaggttacaaccccttcttatctacattacgacagcagggtaccaactagatggaccacttgttaatatggtagaagcgggaagagacaccttagatcgaatcatcgaagatgaaagaactttttactatttagcttctctcgatgatgacgatgatataaatgattcgtcgaattggattaaagcaaatcctaacctaggtgtttctatcgatttagctgaaatgaaagaagagtgggaaaaggctaagagaacaccagatgaacgtggagattttataaccaaaaggtttaacatctttgctaataatgatgagatgagttttattgattatccaacacttcaaaaaaataatgacattatttccttagatgagttggaaggtagaccatgtactataggttatgatttatcagaaacagaggactttacagccgcatgtgccacttttgcattagataatggcaaagttgctgtcttaacacattcttggattcctaagcataaagttgaatattctaacgaaaagataccctatatagaatgggaagaagacggattactaacaatacaagataatccttatatagactaccaagatgttttaaattggataataaagatgaatgagcattatgttgtcgaaaaaatcacttatgatagggcgaatgcttttaaattaaatcaagagttaaagaattatggctttgaaacagaagaaacaagacaaggggctttgaccttgagccctgcattgaaggatctaaaagaaatgtttttagatgggaaaataatatttaataataatcctttaatgaaatggtatatcaataatgttcagctgaaactagacagaaatgggaactggctgccatctaaacaaagcagatatcgtaaaatagatggttttgcagcatttttaaacacatatacagatattatgaataaagttgtttctgacaagggtgaaggaaacatagaatttattagtattaaagatataatgcgt

SEQ ID NO: 86 - protein, 566 aa, Staphylococcus aureus
  MISC_FEATURE (1)..(566): hypothetical protein
VDSVTIKVLNEPSPKLLTTWYAEQVTQGKIKTSKYVKKECERHLRYLENGGKWVFDEELAHRPIRFIEKFCKPSKGSKRQLVLQPWQHFIIGSLFGWVHKETKLRRFKEALIFMGRKNGKTTTISGVANYAVSQDGENGAEIHLLANVMKQARILFDESKAMIKASPKLRENFRPLRDEIHYDATISKIMPQASDSDKLDGLNTHMGIFDEIHEFKDYKLISVIKNSRAARLQPLLIYITTAGYQLDGPLVNMVEAGRDTLDRIIEDERTFYYLASLDDDDDINDSSNWIKANPNLGVSIDLAEMKEEWEKAKRTPDERGDFITKRFNIFANNDEMSFIDYPTLQKNNDIISLDELEGRPCTIGYDLSETEDFTAACATFALDNGKVAVLTHSWIPKHKVEYSNEKIPYIEWEEDGLLTIQDNPYIDYQDVLNWIIKMNEHYVVEKITYDRANAFKLNQELKNYGFETEETRQGALTLSPALKDLKEMFLDGKIIFNNNPLMKWYINNVQLKLDRNGNWLPSKQSRYRKIDGFAAFLNTYTDIMNKVVSDKGEGNIEFISIKDIMR

SEQ ID NO: 87 - DNA, 303 bp, Staphylococcus aureus
atgaaattaacaaaaaaacagctgaaagaatatatagaggattataaaaaatctgatgacatattaattaatttgtatatagaaacgtatgaattttattgtcggttaagagatgaacttaaaaatagtgatttgatgatagagcatacaaacaaggctggtgcgagcaatattgttaagaatccattaagcatagaactgacaaaaacagttcaaacactaaataacttactcaagtctatgggtttaactgcagcacaaagaaaaaagatagttcaagaagaaggtggattcggtgactat

SEQ ID NO: 88 - protein, 101 aa, Staphylococcus aureus
MKLTKKQLKEYIEDYKKSDDILINLYIETYEFYCRLRDELKNSDLMIEHTNKAGASNIVKNPLSIELTKTVQTLNNLLKSMGLTAAQRKKIVQEEGGFGDY

SEQ ID NO: 89 - DNA, 312 bp, Staphylococcus aureus
atgaccaagcataataacatttataagcatggtcgtaagtcatatcaatacgattggttctatcattcaaaagcatggaagaagttaagagagatagcattagatagggataatcatctttgtcaaatgtgtttacgtgaagacatagtaacagatgcaaacatagtgcatcatattatttatgttgatgaagattttaataaagctttagacttagataatttgatgtcagtttgttatagctgtcataacaaaattcatgcaaatgataatgacaaaagtaatcttaagaaaattagagtattaaaaatt

SEQ ID NO: 90 - protein, 104 aa, Staphylococcus aureus
MTKHNNIYKHGRKSYQYDWFYHSKAWKKLREIALDRDNHLCQMCLREDIVTDANIVHHIIYVDEDFNKALDLDNLMSVCYSCHNKIHANDNDKSNLKKIRVLKI

SEQ ID NO: 91 - DNA, 435 bp, Staphylococcus aureus
atgggaaaggcatcatacgatattaagccaggtacatttaaatatattgagtcagagatatataacctacaagagaacaagaaagagataaatagattgagaatggagatacttaacccaacgaaagagctagacactaacattgtgtatggaccgttgcaaaaaggtgaaccagttagaacaactgaactaatggcaacaaggttattgactaataagatgttacgaaacctagaagaaatggtcgaagcagttgaaagtgaatacttaaagttacctgaagatcataagaaagtaattaggctaaagtattggaatagagataagaagctaaagatagagcaaataggagatgcatgtcacatgcatcgtaatacagttactactatacgaaagaactttgttaaagcggtagcgtatcatgcaggtatcaaa

SEQ ID NO: 92 - protein, 145 aa, Staphylococcus aureus
  MISC_FEATURE (1)..(145): hypothetical protein
MGKASYDIKPGTFKYIESEIYNLQENKKEINRLRMEILNPTKELDTNIVYGPLQKGEPVRTTELMATRLLTNKMLRNLEEMVEAVESEYLKLPEDHKKVIRLKYWNRDKKLKIEQIGDACHMHRNTVTTIRKNFVKAVAYHAGIK

SEQ ID NO: 93 - DNA, 1365 bp, Staphylococcus aureus
gtggaacatttggcgattgacttcaaaccacatagctatcaaaagtatgcaatagataaagttattgataatgagaaatacggtttgtttttagatatggggctagggaaaacagtatcaacacttacagcatttagtgaattgcagttgttagacactaaaaaaatgttagtcatagcacctaaacaagttgctaaagatacatgggttgatgaagttgataagtggaaccatttaaatcatctgaaagtgtctttagtcttaggaacacctaaagaaagaaatgatgcattaaacacagaggctgatatctatgtaaccaataaagaaaatactaaatggttatgcgatcaatataaaaaagaatggccatttgatatggttgtaattgatgaactgtctacatttaaaagtcctaagagtcaaaggtttaaatctattaaaaagaaattaccactcattaatagatttataggattaacaggaacacctagcccaaatagtttacaggatttatgggctcaagtttatttgatagacagaggcgaaagacttgagtcttcattcagtcgttatcgagaaaggtactttaaaccaacacatcaagttagcgaacatgtttttaactgggagctaagagacggatctgaagaaaagatatatgaacgaatagaagatatatgtttaagcatgaaagcgaaagattatctagatatgcctgacagagttgatactaaacaaacagtagtcttatctgaaaaagaaagaaaagtatatgcagaattagaaaaaaactatattttagaatcggaagaagaaggaacagttgtagctcagaatggggcatcattaagtcaaaaactacttcaactatctaacggtgcagtttatacagatgatgaagatgtaagacttatacatgataagaagttagataagttagaggaaattatagaggagtctcaaggccaaccaatattattgttttataacttcaaacatgataaagaaagaatacttcaaaggtttaaggaagcaaccacattagaggattcaaactataaagaacgttggaatagtggagacattaagctgcttatagcacatccagcaagtgcagggcatggattaaacttacaacaaggtgggcacattattgtttggtttggacttacatggtcattggaattataccaacaagcaaatgcaagattatatagacaaggacaaaatcatacgactattattcatcacattatgaccgataacacaatagatcaaagagtatataaagctttacaaaataaagaactaacgcaagaagaattgatgaaagctattaaagcaagaatagctaagcataag

SEQ ID NO: 94 - protein, 455 aa, Staphylococcus aureus
VEHLAIDFKPHSYQKYAIDKVIDNEKYGLFLDMGLGKTVSTLTAFSELQLLDTKKMLVIAPKQVAKDTWVDEVDKWNHLNHLKVSLVLGTPKERNDALNTEADIYVTNKENTKWLCDQYKKEWPFDMVVIDELSTFKSPKSQRFKSIKKKLPLINRFIGLTGTPSPNSLQDLWAQVYLIDRGERLESSFSRYRERYFKPTHQVSEHVFNWELRDGSEEKIYERIEDICLSMKAKDYLDMPDRVDTKQTVVLSEKERKVYAELEKNYILESEEEGTVVAQNGASLSQKLLQLSNGAVYTDDEDVRLIHDKKLDKLEEIIEESQGQPILLFYNFKHDKERILQRFKEATTLEDSNYKERWNSGDIKLLIAHPASAGHGLNLQQGGHIIVWFGLTWSLELYQQANARLYRQGQNHTTIIHHIMTDNTIDQRVYKALQNKELTQEELMKAIKARIAKHK

SEQ ID NO: 95 - DNA, 288 bp, Staphylococcus aureus
atgaaagaatcgacattagaaaaatatttagtgaaagagataacaaagctaaacggtttatgtttaaaatgggtcgcacctggaacaagaggtgtgccagatagaattattattatgccagaaggaaaaacatattttgtagaaatgaagcaagaaaaaggaaagttgcatcctttacaaaaatatgtgcatagacaatttgaaaatagagatcataaagtatatgtgttatggaataaagaacaagtaaatacttttatcagaatggtaggtggaacatttggcgat

SEQ ID NO: 96 - protein, 96 aa, Staphylococcus aureus
MKESTLEKYLVKEITKLNGLCLKWVAPGTRGVPDRIIIMPEGKTYFVEMKQEKGKLHPLQKYVHRQFENRDHKVYVLWNKEQVNTFIRMVGGTFGD

SEQ ID NO: 97 - DNA, 102 bp, Staphylococcus aureus
gtgaatttgatgcaacattggaaacaaacagggttgaaccctacagctagaaaggaaagaggtgttgtatcatttgttgcatcaatgttgcatcaccaaaaa

SEQ ID NO: 98 - protein, 34 aa, Staphylococcus aureus
VNLMQHWKQTGLNPTARKERGVVSFVASMLHHQK

SEQ ID NO: 99 - DNA, 147 bp, Staphylococcus aureus
atggaaattagaaagatttcaaacatcttaagacaattagacaattggtctgtatatgatggtaataaaagtgggaaaattcgatttggaaaagattatggtgtacagatagcttatgtaagagatgaaagtttagaggatttaata

SEQ ID NO: 100 - protein, 49 aa, Staphylococcus aureus
MEIRKISNILRQLDNWSVYDGNKSGKIRFGKDYGVQIAYVRDESLEDLI

SEQ ID NO: 101 - DNA, 171 bp, Staphylococcus aureus
atgcgttcaatacaaagcaaacatactgaggaatctccatatacaggcattattgatgaatatcttaacacaccaattcctagcaattgggatgacttaactatctttgaacgaagacgattttatcaaggtgatgttgatatgttaccaacaggcaaatgtagattacgt

SEQ ID NO: 102 - protein, 57 aa, Staphylococcus aureus
MRSIQSKHTEESPYTGIIDEYLNTPIPSNWDDLTIFERRRFYQGDVDMLPTGKCRLR

SEQ ID NO: 103 - DNA, 1929 bp, Staphylococcus aureus
atgttagacaaagtcactcaaatagaaacaattaaatatgatcgtgatgtctcatattcttatgctgctagtcgtttatctacacattggactaatcacaatatggcttggtctgactttatgcagaagctagcacaaacagttagaactaaagaagatttaactgagtacaataaaatgtctaagtctgaacaagccgatataaaagatgttggcggatttgtcggtggatatttaaaagaaggcaaacggcgtgctggtcaagtcatgaatcgttcaatgctaacacttgatatcgattatgcagcccaagatatgactgacatattatctatgttttatgattttgcatattgtttatattcaacacataagcatagagagataagtccaagactgcgtttagtgattcctttaaaacgaaatgtaaatgcagatgagtatgaagctattgggcgtaaagtcgcagatatcgttggcatggattacttcgatgatacaacttatcaaccacataggttaatgtattggccttcaactagtaacgatgcggaatttttctttacctatgaagatttacctttgttagacccagataaaatattaaatgaatatgttgattggactgacacattagaatggccaacgtcttcaagggaagagagtaagactaaaagattagcagataagcaaggcgacccagaagaaaagccgggaattgttggtgcattttgtagagcctatacgatagaagaagctatagaaacttttattcctgatttatacgaaaaacattctactaaccgttatacctatcatgaaggttcaactgcaggtggattggtgttatacgaaaataacaagtttgcctattctcatcataatacggatcccgtaagcggtatgcttgtgaacagttttgatttagtacgcatacacttatatggtgctcaagatgaagaaactaaaacagatactccggttaatcgactacctagttataaagcaatgcagcaaagagcgcaaaatgatgaggttgttaaaaagcaattaattaatgacaaaatgtctgatgcaatgcaggatttcgatgaaatagaaaatagcgatgatgcatggtctgagacgttagaaattacttcgaaaggtactttcaaagctagtatcccaaatatagaaattatattgcgtaatgatccaaatttaaaaggaaaaatagcctttaacgaatttacgaaacaaattgaatgtttagggaaagtgccatggaatactaattttaagacacgtcaatggcaagacggtgatgatagcagtttaagaagttatatcgaaaagatttatgacatacaccattcaggtaaaacaaaagatgccattataagcgtagcaatgcaaaatgcttatcatccagtaagggattatctaaataaaatatcgtgggatggacataaacgccttgaaaagttatttatcaaatacttaggtgttgaagacactgaagtgaatagaacaactaccaaaaaagcattgactgctggaatcgctagagtaatggagcctggatgtaaatttgactatatgcttacactttatggtcctcaaggtgtaggtaaatctgctttgctaaaaaaattaggtggtgcatggttttctgacagtttagtttctgttacaggtaaagaagcttatgaggccttacaaggcgtttggctaatggaaatggcagaacttgcagctacaagaaaagctgaagttgaagctattaagcatttcatatctaaacaagttgaccgatttcgtgttgcttatgggcattatattgaagattttccaaggcaatgtattttcattggtacaactaataaagttgatttcttaagagatgaaactggtcgggaagacagttttatggaccagatgcactgc

SEQ ID NO: 104 - protein, 643 aa, Staphylococcus aureus
  MISC_FEATURE (1)..(643): hypothetical protein
MLDKVTQIETIKYDRDVSYSYAASRLSTHWTNHNMAWSDFMQKLAQTVRTKEDLTEYNKMSKSEQADIKDVGGFVGGYLKEGKRRAGQVMNRSMLTLDIDYAAQDMTDILSMFYDFAYCLYSTHKHREISPRLRLVIPLKRNVNADEYEAIGRKVADIVGMDYFDDTTYQPHRLMYWPSTSNDAEFFFTYEDLPLLDPDKILNEYVDWTDTLEWPTSSREESKTKRLADKQGDPEEKPGIVGAFCRAYTIEEAIETFIPDLYEKHSTNRYTYHEGSTAGGLVLYENNKFAYSHHNTDPVSGMLVNSFDLVRIHLYGAQDEETKTDTPVNRLPSYKAMQQRAQNDEVVKKQLINDKMSDAMQDFDEIENSDDAWSETLEITSKGTFKASIPNIEIILRNDPNLKGKIAFNEFTKQIECLGKVPWNTNFKTRQWQDGDDSSLRSYIEKIYDIHHSGKTKDAIISVAMQNAYHPVRDYLNKISWDGHKRLEKLFIKYLGVEDTEVNRTTTKKALTAGIARVMEPGCKFDYMLTLYGPQGVGKSALLKKLGGAWFSDSLVSVTGKEAYEALQGVWLMEMAELAATRKAEVEAIKHFISKQVDRFRVAYGHYIEDFPRQCIFIGTTNKVDFLRDETGREDSFMDQMHC

SEQ ID NO: 105 - DNA, 1152 bp, Staphylococcus aureus
atgcattggacaattatcggcggtggcatacagggaactgcaatcgcacaaaaactattatcaagcggattaacaacagaccgattaacaatcattgacccacacgaaactttttgccaaaggtttaactcatatacaaatcgaatagaaatgccttatttaagatcaccgattgtacatcacgtacatccacaaccgttccatctaaaacaattcgctaaacagcaccaatatacaaatgctttttatggtccttatcaacgacctgaattgacaatgtttatggatcatattgcacatgcttctaaacaatatcaattagaggattgcttggttcaaggtttagttcaaactttagataaacaagaagacaaatggcatatcaagttagaagatggacaaattatcactacagattgcgtcgttattgcaataggcagtacaaatattccgtttatgcctgacattttaaaagacaaacagaatgtaaatcatatcttcgagaaagaacttgatcaagtagtatatgataagaccgatcatatcgttggtagcggcattactgctgcacatcttgcacttaaattgttaaatcatgataacgataaaaagattcatttatggctaaataaagatattgaaatacatgactttgatgctgatcctggttggttaggtccgaaaaatatgtcttcatttttaagtactaaaagcatgcctgaaagaaatgccattgtacaacgcgaacgtcataaaggatcaatgcctcacgaactgtacttacgccttaaaaaacatattaaaaatggtcgtataaatgtgcataaaacacctatcactcaaattagtggtggtgtaattaacactgaaaatgattctgttccatatcaacagattatggttgcaactggttttgaacaagattttatgtcacaaccacttattaagcaattaatacaaaattatgatgcacctatcaacgaatgtaattaccctgttatttccgaaaaattagaatggataccaaatctatttgtcgcaggatgctttgcagacttagaattaggaccatttggtagaaatgttatgggtggccgtaaagctgccgaacgcattgaacaagcatttctaaaactacaacaatatagcgca

SEQ ID NO: 106 - protein, 384 aa, Staphylococcus aureus
  MISC_FEATURE (1)..(384): hypothetical protein
MHWTIIGGGIQGTAIAQKLLSSGLTTDRLTIIDPHETFCQRFNSYTNRIEMPYLRSPIVHHVHPQPFHLKQFAKQHQYTNAFYGPYQRPELTMFMDHIAHASKQYQLEDCLVQGLVQTLDKQEDKWHIKLEDGQIITTDCVVIAIGSTNIPFMPDILKDKQNVNHIFEKELDQVVYDKTDHIVGSGITAAHLALKLLNHDNDKKIHLWLNKDIEIHDFDADPGWLGPKNMSSFLSTKSMPERNAIVQRERHKGSMPHELYLRLKKHIKNGRINVHKTPITQISGGVINTENDSVPYQQIMVATGFEQDFMSQPLIKQLIQNYDAPINECNYPVISEKLEWIPNLFVAGCFADLELGPFGRNVMGGRKAAERIEQAFLKLQQYSA

SEQ ID NO: 107 - DNA, 231 bp, Staphylococcus aureus
gtgtgtagcaatagcactggaggtgttgtaaatatgtggattgtcatttcaattgttttatctatatttttattgatcttgttaagtagcatttctcataagatgaaaaccatagaagcattggagtatatgaatgcttatcttttcaagcagttagtaaaaaataatggtgttgaaggtttagaagattatgaaaatgaagttgaacgaattagaaaaagattcaaaagc

SEQ ID NO: 108 - protein, 77 aa, Staphylococcus aureus
VCSNSTGGVVNMWIVISIVLSIFLLILLSSISHKMKTIEALEYMNAYLFKQLVKNNGVEGLEDYENEVERIRKRFKS

SEQ ID NO: 109 - DNA, 165 bp, Staphylococcus aureus
atggggtgtttagtggtggttaaagaaattttgagactattattcttactagcgatgtatgagctaggtaagtatgtaactgagcaagtatatattatgatgacggctaatgatgatgtagaggcgccaagtgactttgaaaaaatcagagctgaagtttcatgg

SEQ ID NO: 110 - protein, 55 aa, Staphylococcus aureus
  MISC_FEATURE (1)..(55): int gene activator RinB
MGCLVVVKEILRLLFLLAMYELGKYVTEQVYIMMTANDDVEAPSDFEKIRAEVSW

SEQ ID NO: 111 - DNA, 204 bp, Staphylococcus aureus
atggagatgccaaagaaaacggtaacgattgatgtagatgaaaacttattagtagtagctagtaatgaaatatcagaactattatatgaatatgacagtgagttaatgtcagctgatgaagatggcgataatagagatatcgaagaaaaaagagacgcattaaaacaagctatacaaattatcgataaattaacatggggtgtt

SEQ ID NO: 112 - protein, 68 aa, Staphylococcus aureus
MEMPKKTVTIDVDENLLVVASNEISELLYEYDSELMSADEDGDNRDIEEKRDALKQAIQIIDKLTWGV

SEQ ID NO: 113 - DNA, 186 bp, Staphylococcus aureus
gtgacgcaatacttagtcacaacattcaaagattcaacaggacgaccacatgaacatattactgtggctagagataatcagacgtttacagttattgaggcagagagtaaagaagaagctgagcgcaaatacgaggcacaagttaagataaggagagatggagatgccaaagaaaacggtaacgat

SEQ ID NO: 114 - protein, 62 aa, Staphylococcus aureus
  MISC_FEATURE (1)..(62): hypothetical protein
VTQYLVTTFKDSTGRPHEHITVARDNQTFTVIEAESKEEAERKYEAQVKIRRDGDAKENGND

SEQ ID NO: 115 - DNA, 540 bp, Staphylococcus aureus
atgactaacacattacaagtaaaactattatcaaaaaatgctagaatgcccgaacgaaatcataagacggatgcaggttatgacatattctcagctgaaactgtcgtactcgaaccacaagaaaaagcagtgatcaaaacagatgtagctgtgagtataccagagggctatgtcggactattaactagtcgtagtggtgtaagtagtaaaacgtatttagtgattgaaacaggcaagatagacgcgggatatcatggcaatttagggattaatatcaagaatgatgaagaacgtgatggaataccctttttatatgatgatatagacgctgaattagaagatggattaataagcattttagatataaaaggtaactatgtacaagatggaagaggcataagaagagtttaccaaatcaacaaaggcgataaactagctcaattggttatcgtgcctatatggacaccggaactaaagcaagtggaggaattcgaaagtgtttcagaacgtggagcaaaaggcttcggaagtagcggagtg

SEQ ID NO: 116 - protein, 180 aa, Staphylococcus aureus
  MISC_FEATURE (1)..(180): dUTP pyrophosphatase
MTNTLQVKLLSKNARMPERNHKTDAGYDIFSAETVVLEPQEKAVIKTDVAVSIPEGYVGLLTSRSGVSSKTYLVIETGKIDAGYHGNLGINIKNDEERDGIPFLYDDIDAELEDGLISILDIKGNYVQDGRGIRRVYQINKGDKLAQLVIVPIWTPELKQVEEFESVSERGAKGFGSSGV

SEQ ID NO: 117 - DNA, 243 bp, Staphylococcus aureus
atgacacaaatgaataatcgcgaaaaaatcgaacagtccgttattagtgctagtgcgtataacggtaatgacacagaggggttgctaaaagagattgaggacgtgtataagaaagcgcaagcgtttgatgaaatacttgagggaatgacaaatgctattcaacattcagttaaagaaggtattgaacttgatgaagcagtagggattatggcaggtcaagttgtctataaatatgaggaggaa

SEQ ID NO: 118 - protein, 81 aa, Staphylococcus aureus
  MISC_FEATURE (1)..(81): hypothetical protein
MTQMNNREKIEQSVISASAYNGNDTEGLLKEIEDVYKKAQAFDEILEGMTNAIQHSVKEGIELDEAVGIMAGQVVYKYEEE

SEQ ID NO: 119 - DNA, 306 bp, Staphylococcus aureus
atgacgttcaccttatcagatgaacaatataaaaatctttgtactaactctaacaagttattagataaacttcacaaagcattaaaagatcgtgaagagtacaagaagcaacgagatgagcttattggggatatagcgaagttacgagattgtaacaaagaactggagaagaaagcaagcgcatgggataggtattgcaagagcgttgaaaaagatttaataaacgaattcggtaacgatgatgaaagagttaaattcggaatggaattaaacaataaaatttttatggaggatgacacaaatgaa

SEQ ID NO: 120 - protein, 102 aa, Staphylococcus aureus
MTFTLSDEQYKNLCTNSNKLLDKLHKALKDREEYKKQRDELIGDIAKLRDCNKELEKKASAWDRYCKSVEKDLINEFGNDDERVKFGMELNNKIFMEDDTNE

SEQ ID NO: 121 - DNA, 345 bp, Staphylococcus aureus
atgatgttgaaatttaaagcttgggataaagataaaaaagttatgagtattattgacgaaatcgattttaatagtgggtacattttgatttcaacaggttataaaagtttcaatgaagtaaaactattacaatacacaggatttaaagatgtgcacggtgtggagatttatgaaggggatattgttcaagattgttattcgagagaagtaagttttatcgagtttaaagaaggagccttttatataacttttagcaatgtaactgaattactaagtgaaaatgacgatattattgaaattgttggaaatatttttgaaaatgagatgctattggaggttatgaga

SEQ ID NO: 122 - protein, 115 aa, Staphylococcus aureus
MMLKFKAWDKDKKVMSIIDEIDFNSGYILISTGYKSFNEVKLLQYTGFKDVHGVEIYEGDIVQDCYSREVSFIEFKEGAFYITFSNVTELLSENDDIIEIVGNIFENEMLLEVMR

SEQ ID NO: 123 - DNA, 399 bp, Staphylococcus aureus
atgaaaatcaaagttaaaaaagaaatgagattagatgaattaattaaatgggcgcgagaaaatccggatctatcacaaggaaaaatatttttttcaacaggatttagtgatggattcgttcgttttcatccaaatacaaataagtgttcgacgtcaagttttattccaattgatatccccttcatagttgatattgaaaaagaagtaacggaagagactaaggttgataggttgattgaattattcgagattcaagaaggagactataactctacactatatgagaacactagtataaaagaatgtttatatggcagatgtgtgcctaccaaagcattctacatcttaaacgatgacctaactatgacgttaatctggaaagatggggagttgctagta

SEQ ID NO: 124 - protein, 133 aa, Staphylococcus aureus
MKIKVKKEMRLDELIKWARENPDLSQGKIFFSTGFSDGFVRFHPNTNKCSTSSFIPIDIPFIVDIEKEVTEETKVDRLIELFEIQEGDYNSTLYENTSIKECLYGRCVPTKAFYILNDDLTMTLIWKDGELLV

SEQ ID NO: 125 - DNA, 204 bp, Staphylococcus aureus
atgaaaatcaaaattgaaaaagaaatgaatttacctgaacttatccaatgggcttgggataaccccaagttatcaggtaataaaagattctattcaaatgatgttgaacgcaactgttgtgtgacttttgatgttgatagcatcttatgtaatgtgactggatacgtatcaattaacgataaatttactgttcaagaggagata

SEQ ID NO: 126 - protein, 68 aa, Staphylococcus aureus
MKIKIEKEMNLPELIQWAWDNPKLSGNKRFYSNDVERNCCVTFDVDSILCNVTGYVSINDKFTVQEEI

SEQ ID NO: 127 - DNA, 360 bp, Staphylococcus aureus
ttgaacatgatcaaaatcatactgattagtcttgcacttatctttgttatcatcggtgctttaattagcgccctagcagctataggattattgagacttgaagatgtatattcacgtgcacatgctgccggaaaagcatcaacattaggtgcaatgtcattactatttggtacgtttttatattttattgctactcaaggttttgtaaatatgcaattaatcgttgcgattatctttgtattaattacaggtcctctttcaagtcatatgattatgaaagcagcatataatattaaaacgccttatactaaaaagactaaagtcgatgaaatttcggaagacttaaaagacacaaaattg

SEQ ID NO: 128 - protein, 120 aa, Staphylococcus aureus
  MISC_FEATURE (1)..(120): Na+/H+ antiporter subunit
LNMIKIILISLALIFVIIGALISALAAIGLLRLEDVYSRAHAAGKASTLGAMSLLFGTFLYFIATQGFVNMQLIVAIIFVLITGPLSSHMIMKAAYNIKTPYTKKTKVDEISEDLKDTKL

SEQ ID NO: 129 - DNA, 246 bp, Staphylococcus aureus
atgaccatgacagatagcgcgcgtaaagaatacctaaatcaattctttggatctaagagatatctgtatcaggataacgaacgagtggcacatatccatgtagtaaatggcacttattactttcacggtcatatcgtgccaggttggcaaggtgtgaaaaagacatttgatacagcggaagagcttgaaacatatataaagcaaagtgatttggaatatgaggaacagaagcaactaactttattt

SEQ ID NO: 130 - protein, 82 aa, Staphylococcus aureus
  MISC_FEATURE (1)..(82): hypothetical protein
MTMTDSARKEYLNQFFGSKRYLYQDNERVAHIHVVNGTYYFHGHIVPGWQGVKKTFDTAEELETYIKQSDLEYEEQKQLTLF

SEQ ID NO: 131 - DNA, 213 bp, Staphylococcus aureus
gtgggagggttaacgatggcaacccaaagacaagttgaatatgtgatgtcattacaggagcaactggaattagaagactgcgaaaaatatacagacgaacaagttaaagcaatgagtcataaagaagttagcaatgtgattgaaaactataaggcaagcataagtaatgaagagctatacgacgaatgcatgtcgtttggtctgcctaattgt

SEQ ID NO: 132 - protein, 71 aa, Staphylococcus aureus
VGGLTMATQRQVEYVMSLQEQLELEDCEKYTDEQVKAMSHKEVSNVIENYKASISNEELYDECMSFGLPNC

SEQ ID NO: 133 - DNA, 255 bp, Staphylococcus aureus
atgagcgtaatcagtaacagaaaagtagatatgaacgaagcgcaagacaatgttaagcaaccagcgcactacacatacggcgacattgaaattatagattttatcgaacaggttacggcacagtatccacctcaactagcattcgcaataggtaatgcaatcaaatacatgtctagagcaccgttaaagaatggtcatgaggatttagcaaaggcgaagttttacgtccaaagagcttttgacttgtgggagggt

SEQ ID NO: 134 - protein, 85 aa, Staphylococcus aureus
MSVISNRKVDMNEAQDNVKQPAHYTYGDIEIIDFIEQVTAQYPPQLAFAIGNAIKYMSRAPLKNGHEDLAKAKFYVQRAFDLWEG

SEQ ID NO: 135 - DNA, 402 bp, Staphylococcus aureus
atgatggctagaagaaaagttataagagtgcgtattaaaggaaaactaatgacattgagagaagtttcagaaaaatatcatatatctccagaacttcttagatatagatacaaacataaaatgcgcggcgatgaattattgtgtggaagaaaggactcaaaatctaaagaagaagttgaatatatgaagagtcaaataaaagatgaagaaaaagggagagaaaaaatcagaaaaaaagcgattttgaaccgataccaacgaaatgtgagagcggaatatgaacaggaaagaaagagaagattaagaccatggctttatgatggaacgccacaaaaacattcacgtgatccgtactggttcgatgtcacttataaccaaatgttcaagaaatggagtgaagca

SEQ ID NO: 136 - protein, 134 aa, Staphylococcus aureus
  MISC_FEATURE (1)..(134): hypothetical protein
MMARRKVIRVRIKGKLMTLREVSEKYHISPELLRYRYKHKMRGDELLCGRKDSKSKEEVEYMKSQIKDEEKGREKIRKKAILNRYQRNVRAEYEQERKRRLRPWLYDGTPQKHSRDPYWFDVTYNQMFKKWSEA

SEQ ID NO: 137 - DNA, 183 bp, Staphylococcus aureus
atgcaacatcaagcttatatcaatgcttctgttgacattagaattcctacagaagtcgaaagtgttaattacaatcagattgataaagaaaaagaaaatttggcggactatttatttaataatccaggtgaactattaaaatataacgttataaatatcaaggttttagatttagaggtggaa

SEQ ID NO: 138 - protein, 61 aa, Staphylococcus aureus
MQHQAYINASVDIRIPTEVESVNYNQIDKEKENLADYLFNNPGELLKYNVINIKVLDLEVE

SEQ ID NO: 139 - DNA, 1959 bp, Staphylococcus aureus
ttgaaatttatgaatatagatattgaaacatacagcagtaacgatatttcgaaatgtggtgcctataaatacacagaagctgaagatttcgaaattttaattatagcttattcgatagatggtggagcgattagtgcgattgacatgactaaagtagataatgagcctttccacgctgattatgagacgtttaaaattgctctatttgaccctgctgtaaaaaagtatgcattcaatgctaatttcgaaagaacttgtcttgctaaacattttaataaacagatgccacctgaagaatggatttgcacaatggttaattcaatgcgtattggcttacctgcttcgcttgataaagttggagaagttttaagactacaaagccaaaaagataaagcaggtaaaaatttaattcgttatttctctataccttgtaaaccaacaaaagttaatggaggaagaacaagaaacctacctgaacatgatcttgaaaaatggcaacaatttatagattactgtattcgagatgtagaagtagaaatggcgattgctaataaaattaaagactttccagtaactgcaattgaacaaacatattgggtttttgaccaacatataaacgacagaggtattaagctttctaaatcattgatgttaggagctaatgtgctcgataagcagagtaaagaagaattgcttaaacaagctaaacatataacaggtttagaaaatcctaatagtcctacacagttattggcttggttaaaggatgaacaaggattagatatacctaatttacaaaagaaaacggttcaggagtacttaaaagaagcaacaggaaaagctaaaaaaatgctagaaattagattgcaaatgtctaaaaccagtgtgaaaaaatacaacaaaatgcatgacatgatgtgcagtgatgaacgggtaagaggtctgtttcaattttacggtgccggtactggaagatgggcaggtagaggtgtacaacttcagaatttaacaaagcattatatttcagatactgaattagaaatagcaagagatcttattaaagaacaacgttttgatgatttagatttattactcaatgttcatcctcaagacttattaagtcaattagttaggacgacatttactgctgaagaaggtaatgaactagcagtaagtgatttttctgcaatagaggcaagagtcatagcatggtatgcaaaagaacaatggcgtttagatgtattcaacacacacggaaagatatatgaagcatcggcttctcaaatgtttaatgtaccggtagaaagcataactaaaggcgaccctctcagacaaaaaggaaaagtgtccgaattagctttaggctatcaaggtggcgctggagctttaaaagcaatgggtgcattggaaatgggcattgaagaaaacgagttacaaggtttagttgatagttggcgtaacgcaaatcctaacatagttaatttttggaaggcttgccaagaggctgcaattaatactgtaaaatcccgaaagacgcatcatacacatggacttagattttatatgaaaaaaggttttctaatgattgaactgcctagtggaagagctttagcttatccaaaagctttagttggtgaaaatagttggggtagtcaagttgttgaatttatggggttagatcttaaccgtaaatggtcaaagttaaaaacgtatggtgggaagttagtcgagaatattgttcaagcaactgcaagggatttacttgcgatttctatagcaaggcttgaagcattaggttttaaaatagttggccatgtccatgatgaagtaattgtagaaatacctagaggttcaaatggacttaaggaaatcgaaactatcatgaataagcctgttgattgggcaaaaggattgaatttgaatagtgacgggtttacttctccgttttatatgaaggat

SEQ ID NO: 140 - protein, 653 aa, Staphylococcus aureus
LKFMNIDIETYSSNDISKCGAYKYTEAEDFEILIIAYSIDGGAISAIDMTKVDNEPFHADYETFKIALFDPAVKKYAFNANFERTCLAKHFNKQMPPEEWICTMVNSMRIGLPASLDKVGEVLRLQSQKDKAGKNLIRYFSIPCKPTKVNGGRTRNLPEHDLEKWQQFIDYCIRDVEVEMAIANKIKDFPVTAIEQTYWVFDQHINDRGIKLSKSLMLGANVLDKQSKEELLKQAKHITGLENPNSPTQLLAWLKDEQGLDIPNLQKKTVQEYLKEATGKAKKMLEIRLQMSKTSVKKYNKMHDMMCSDERVRGLFQFYGAGTGRWAGRGVQLQNLTKHYISDTELEIARDLIKEQRFDDLDLLLNVHPQDLLSQLVRTTFTAEEGNELAVSDFSAIEARVIAWYAKEQWRLDVFNTHGKIYEASASQMFNVPVESITKGDPLRQKGKVSELALGYQGGAGALKAMGALEMGIEENELQGLVDSWRNANPNIVNFWKACQEAAINTVKSRKTHHTHGLRFYMKKGFLMIELPSGRALAYPKALVGENSWGSQVVEFMGLDLNRKWSKLKTYGGKLVENIVQATARDLLAISIARLEALGFKIVGHVHDEVIVEIPRGSNGLKEIETIMNKPVDWAKGLNLNSDGFTSPFYMKD

SEQ ID NO: 141 - DNA, 555 bp, Staphylococcus aureus
atgaaagcaaaagtattaaataaaactaaagtgattacaggaaaagtaagagcatcatatgcacatatttttgaacctcacagtatgcaagaagggcaagaagcaaagtattcaatcagtttaatcattcctaaatcagatacaagtacgataaaagccattgaacaagctatagaagctgctaaagaagaaggaaaagttagtaagtttggaggcaaagttcctgcaaatctgaaacttccattacgtgatggagatactgaaagagaagatgatgtgaattatcaagacgcttattttattaacgcatcaagcaaacaagcacctggtattattgaccaaaacaaaattagattaacggattctggaactattgtaagtggtgactatattagagcttcaatcaatttatttccattcaacacaaatggtaataagggtatcgcagttggattgaacaacattcaacttgtagaaaaaggcgaacctcttggcggtgcaagtgcagcagaagatgattttgatgaattagacactgatgatgaggatttctta

SEQ ID NO: 142 - protein, 185 aa, Staphylococcus aureus
MKAKVLNKTKVITGKVRASYAHIFEPHSMQEGQEAKYSISLIIPKSDTSTIKAIEQAIEAAKEEGKVSKFGGKVPANLKLPLRDGDTEREDDVNYQDAYFINASSKQAPGIIDQNKIRLTDSGTIVSGDYIRASINLFPFNTNGNKGIAVGLNNIQLVEKGEPLGGASAAEDDFDELDTDDEDFL

SEQ ID NO: 143 - DNA, 1164 bp, Staphylococcus aureus
atgaagctagatcactcaaatagagctcatgcaaagcttagtgcaagtggagcaaaacaatggctaaactgtccaccgagtattaaggcaagtgaaggtattgcagataaaagttcagtttttgctgaagaaggtacattcgctcatgagttaagtgagttatatttcagtcttaaatatgaaggcctaacacagtttgagtttaataaagcttttcaaaattataagcgaaatcaatattacagtgaagagttgcgcgaatatgttgaagagtacgtagctaatgtagaagaaaagtataacgaggctttgagtagagatgacgatgtaatagctttatttgaaacaaaattggatttaggtaaatacgtccctgaatcttttggtactggtgatgtcattatattttcaggtggtgtacttgaaattattgaccttaaatacggtaaaggcattgaagtttcagctatagataatcctcaacttagattatatggcttgggcgcatatgaactgcttagtttagtgtatgacattcatacagttcgcatgactatcatacaacctcgaatagataacttttctactgaagagttaccaatctcaagattacttcaatggggaaccgattttgttaaacccttagccagacttgcttataacggtgaaggtgagtttaaagcaggtagtcattgtagattctgtaagataaagcattcatgtagaacacgtgcagaatacatgcaaaatgtgcctcaaaagccaccacatttgttgagtgatgaagagattgcagaacttttatataaactgcctgatatcaaaaaatgggctgatgaagtagagaaatatgcgttagaacaagcgaaagagaatgataaaacgtatccaggttggaagctagtcacgggacgttcaaggagagtgataactgatacaaaagcagtccgagacaggttagttgaagcgggttataaacctgaagatattacagaaaccaagttacttagcattacgaatttagaaaaattaatcggcaaaaaagcattttctaaaattgcagaaggctttatagaaaagccgcaaggtaaattaacacttgctaccgagtctgataaacgaccagctataaagcaatctgctgaagatgattttgacaaacta

SEQ ID NO: 144 - protein, 388 aa, Staphylococcus aureus
MKLDHSNRAHAKLSASGAKQWLNCPPSIKASEGIADKSSVFAEEGTFAHELSELYFSLKYEGLTQFEFNKAFQNYKRNQYYSEELREYVEEYVANVEEKYNEALSRDDDVIALFETKLDLGKYVPESFGTGDVIIFSGGVLEIIDLKYGKGIEVSAIDNPQLRLYGLGAYELLSLVYDIHTVRMTIIQPRIDNFSTEELPISRLLQWGTDFVKPLARLAYNGEGEFKAGSHCRFCKIKHSCRTRAEYMQNVPQKPPHLLSDEEIAELLYKLPDIKKWADEVEKYALEQAKENDKTYPGWKLVTGRSRRVITDTKAVRDRLVEAGYKPEDITETKLLSITNLEKLIGKKAFSKIAEGFIEKPQGKLTLATESDKRPAIKQSAEDDFDKL

SEQ ID NO: 145 - DNA, 360 bp, Staphylococcus aureus
atggcagtattagaaggtatttttgaagaattaaaactattaaataagaacttacgtgtgttaaacactgaactatcaactgtagattcatcaattgtacaagagaaagttaaagaagcaccaatgccaaaagaagaaacagctcaactggaatcaattgaagaagttaaggaaacttctgctgatttgactaaagattatgttttatcagtaggaaaagagttccttaaaaaagcagacacttctgataagaaagaatttagaaataaacttaacgaacttggtgcggataagctatctactatcaaagaagagcattatgaaaaaattgttgattttatgaatgcgagaataaatgca

SEQ ID NO: 146 - protein, 120 aa, Staphylococcus aureus
MAVLEGIFEELKLLNKNLRVLNTELSTVDSSIVQEKVKEAPMPKEETAQLESIEEVKETSADLTKDYVLSVGKEFLKKADTSDKKEFRNKLNELGADKLSTIKEEHYEKIVDFMNARINA

SEQ ID NO: 147 - DNA, 291 bp, Staphylococcus aureus
atgaatcataatgttattatcgttattgcattaatcatagttgtcatttctatgttagctatgctcattcgcgttgtgctaggcccatcacttgccgatcgtgttgtcgcattagatgcgattggtcttcaattaatggcagttatagcattattcagtattttattaaatattaaatacatgattgtcgttattatgatgattggtatattagcttttttaggtactgcagtattctctaaatttatggacaaaggtaaggtgattgaacatgatcaaaatcatactgat

SEQ ID NO: 148 - protein, 97 aa, Staphylococcus aureus
  MISC_FEATURE (1)..(97): Na+/H+ antiporter subunit
MNHNVIIVIALIIVVISMLAMLIRVVLGPSLADRVVALDAIGLQLMAVIALFSILLNIKYMIVVIMMIGILAFLGTAVFSKFMDKGKVIEHDQNHTD

SEQ ID NO: 149 - DNA, 321 bp, Staphylococcus aureus
atgaccttacaacaaaaaatactatcacattttgcaacatatgacaatttcaattctgatgatgttgttgaaacttttgggatatctaaaacacatgcaaaatccacactttcaaaacttaagaaaaaaggaaagattgcaatggaaagttggggtgtctggcgtgttattgaatcgcaattgcatttaagtgtagtcgaacgtaaaaaagaaattttagaagaacaatttgaattgttagcaagattaaatgaacaaagtgatgaccctagagaaatagaagaacgtatcaagttaatgattcgtctagctaaccaattt

SEQ ID NO: 150 - protein, 107 aa, Staphylococcus aureus
MTLQQKILSHFATYDNFNSDDVVETFGISKTHAKSTLSKLKKKGKIAMESWGVWRVIESQLHLSVVERKKEILEEQFELLARLNEQSDDPREIEERIKLMIRLANQF

SEQ ID NO: 151 - DNA, 261 bp, Staphylococcus aureus
atgccaaaaatcataataccaccaacaccagaaaacacatatcgaggcgaagaaaaatttgtgaaaaagttatacgcaacacctacacaaatccatcaattgtttggagtatgtagaagtacagtatacaactggttgaaatattaccgtgaagataatttaggtgtagaaaatttatacattgattattcagcaacgggaacattgattaatatttctaaattagaagagtatttgatcagaaagcataaaaaatggtat

SEQ ID NO: 152 - protein, 87 aa, Staphylococcus aureus
MPKIIIPPTPENTYRGEEKFVKKLYATPTQIHQLFGVCRSTVYNWLKYYREDNLGVENLYIDYSATGTLINISKLEEYLIRKHKKWY

SEQ ID NO: 153 - DNA, 213 bp, Staphylococcus aureus
atgaacacaagatcagaaggattgcgtataggcgtcccacaagtttctagcaaagctgatgcttcttcatcctatttaacggaaaaggaacgtaacttaggagcggaaatattagaacttattaaaaaaagtgattacagctacttagaaataaacaaagttttctatgcattagatagagaacttcaatacagggcgaataataacaaactt

SEQ ID NO: 154 - protein, 71 aa, Staphylococcus aureus
MNTRSEGLRIGVPQVSSKADASSSYLTEKERNLGAEILELIKKSDYSYLEINKVFYALDRELQYRANNNKL

SEQ ID NO: 155 - DNA, 363 bp, Staphylococcus aureus
atgcccttgacatctgatgaatttgatacacttactaaagaccaacaatatatcttgtccgtactctacaaagattatttagaatgtgtaaagttaggttcgattaaattaacctgcaataattttggaagtgctaaagatatacatacaaagtattttcaaaaactacatttcgaagatgtaaaatacgatttaaataaacttaaaaactctgggttcctaaacggcgtgtatgctagtaacactatttatcatgtaacaatttcagacaagactgttgtttactttgaaaatgagtttaaaaacaatttaaaaagtatcattgatagcatttctataattgcttcaataattcctggtctc

SEQ ID NO: 156 - protein, 121 aa, Staphylococcus aureus
MPLTSDEFDTLTKDQQYILSVLYKDYLECVKLGSIKLTCNNFGSAKDIHTKYFQKLHFEDVKYDLNKLKNSGFLNGVYASNTIYHVTISDKTVVYFENEFKNNLKSIIDSISIIASIIPGL

SEQ ID NO: 157 - DNA, 243 bp, Staphylococcus aureus
atgaacattcaagaagcaactaagatagctacaaaaaatcttgtctctatgacacggaaagattggaaagaaagtcatcgaactaagatattaccaacaaatgatagttttttacaatgcatcatttcaaatagcgatgggacaaaccttatcagatattggcaaccttcagccgatgacctcatggcaaatgattgggaagttataaacccaactagagaccaggaattattgaagcaatta

SEQ ID NO: 158 - protein, 81 aa, Staphylococcus aureus
MNIQEATKIATKNLVSMTRKDWKESHRTKILPTNDSFLQCIISNSDGTNLIRYWQPSADDLMANDWEVINPTRDQELLKQL

SEQ ID NO: 159 - DNA, 261 bp, Staphylococcus aureus
atgaaaacattaaaagagttgaggactgattacggattgactcaaaaagagttaggagatttatttaaggtctcatcacgtacaattcaaaatatggaaaaagactctacaaacattaaagatagtttactttctaagtatatgagtgcttttaatgttaaatatgatgatatttttttaggtaatgaatacgaaaatttcgtattcacgaatgataaaaagaaatcaattattttagcatttaaagaaaaacaaacatct

SEQ ID NO: 160 - protein, 87 aa, Staphylococcus aureus
MKTLKELRTDYGLTQKELGDLFKVSSRTIQNMEKDSTNIKDSLLSKYMSAFNVKYDDIFLGNEYENFVFTNDKKKSIILAFKEKQTS

SEQ ID NO: 161 - DNA, 711 bp, Staphylococcus aureus
atgaacaaagaaagaaatattattatagccaaaaacattagaaaatttctcaacgattcaaatatgtctcaaaagaaacttgctgaactcattaacataaaaccatctactttaagcgattatttaaatttacgttccaacccctctcacggcgttatacaaaggatagctgatgttttcgaggttggtaaaagcgacatagatactacatacaaagacgataacgacatcacttccatatacaacaaactcacacctccccgccaagaaaacgtacttaactatgcaaatgaacaattggaagaacagaattctaaaggagataacgttgtagatattaattcatataaacaggagaaaactccagttaacgtcaatggttgcgtctctgctggtgtaggagaacgtttacacgatgaaacgctatttactgaaatggttaaaggacctatccccacacacgatttagcgttaaaagtaaatggtgattctatggaacctatgtttaaagatggcgaaatcatatttgtggagaaaactcacaatataaagaatggacaaattggtatattcatcattgaagaagaagcgtacgttaagaaagtctttgttgaagatgatagattgactctagtttcactaaataaagattacgacgatctacacttttatagaaatgaaagtgtgaggttaattggaaaagttatttta

SEQ ID NO: 162 - protein, 237 aa, Staphylococcus aureus
  MISC_FEATURE (1)..(237): repressor homolog
MNKERNIIIAKNIRKFLNDSNMSQKKLAELINIKPSTLSDYLNLRSNPSHGVIQRIADVFEVGKSDIDTTYKDDNDITSIYNKLTPPRQENVLNYANEQLEEQNSKGDNVVDINSYKQEKTPVNVNGCVSAGVGERLHDETLFTEMVKGPIPTHDLALKVNGDSMEPMFKDGEIIFVEKTHNIKNGQIGIFIIEEEAYVKKVFVEDDRLTLVSLNKDYDDLHFYRNESVRLIGKVIL

SEQ ID NO: 163 - DNA, 936 bp, Staphylococcus aureus
ttgcaaatgaaaaaatatgatattgcagtcttagactttgaaactatgaatgaacatatgaacagcccttgcgaagttgctgtatctttaattaaggatttatcaatagtaaaagtttattcatcttatattaatcctcctaataatagatataacttgaaaaacgctaaaatacataaaatacctgaagatgtcatattaaaagcacctaaatatccagatatttaccaagaaattctctatcttttaaaagaatcacatttaattattgctcataatgcactttttgatatttcagtattaaaaaatactaataattattatgacttacctgttccaaacttcatgtatgtcgatagtataaatatctttagaagcttccacgcaatctctagttttaaattagaaaatttgtgtagcttatatgatatcgataaagaaaaattacattctgctaaatttgacgtgctagctttatcgaagatgttgatatcactcgctaaaaacaatcagcattatagtgtattaaaattaatacattatatgcctaagcaatacattagatttagcaaatattctaactctccaactaaacttttcgattcaggatttcaaaaaattcatatgaaaatatctgagattaataaaatagaagtggaaagtgtaatccctattttaaaagataaaaatgttgtttttacaggtaattttgacactgaaaaacaagatttaatgatattaactagaaagaaaggagcttatatcagaagtgacgtaactgcaaaaacagatattttagtcgaaggtgttcaagatgataaatataaagatgtgaacggactagtttcaaaacaacgaaaagctcgagaatatgttggaaatggtgcaaaaattcaatttttaaatgaagaagacttaataaatttaataaaggaa

SEQ ID NO: 164 - protein, 312 aa, Staphylococcus aureus
  MISC_FEATURE (1)..(312): hypothetical protein
LQMKKYDIAVLDFETMNEHMNSPCEVAVSLIKDLSIVKVYSSYINPPNNRYNLKNAKIHKIPEDVILKAPKYPDIYQEILYLLKESHLIIAHNALFDISVLKNTNNYYDLPVPNFMYVDSINIFRSFHAISSFKLENLCSLYDIDKEKLHSAKFDVLALSKMLISLAKNNQHYSVLKLIHYMPKQYIRFSKYSNSPTKLFDSGFQKIHMKISEINKIEVESVIPILKDKNVVFTGNFDTEKQDLMILTRKKGAYIRSDVTAKTDILVEGVQDDKYKDVNGLVSKQRKAREYVGNGAKIQFLNEEDLINLIKE

SEQ ID NO: 165 - DNA, 339 bp, Staphylococcus aureus
atgatcaaaaaaatttttacaaaaaaacatgtattcttagttatagaagatgaaaaccataatcacagtgatgctgtttttggaaaaagtatattactttcaatttacgtcggtgtgaataaaaagactaattctaaatcagggaaatttatataccttgacagatctaaaagaatcgttagacaatctgatatcaccaaaatagaatcagctaacgaaaatgatgtagatttttataatttactgaagaaagaaaaggaaattgtttattccaaaaatatagtagataaatacaatttagcgaactatataatttactacgaagttagtactaaagaa

SEQ ID NO: 166 - protein, 113 aa, Staphylococcus aureus
MIKKIFTKKHVFLVIEDENHNHSDAVFGKSILLSIYVGVNKKTNSKSGKFIYLDRSKRIVRQSDITKIESANENDVDFYNLLKKEKEIVYSKNIVDKYNLANYIIYYEVSTKE

SEQ ID NO: 167 - DNA, 225 bp, Staphylococcus aureus
ttgaaaaagacgtctatttcagcagtgtttgaaaggaagtttataatgaaaataactaattgcaaaataaaaaaagaaactatagtatatgaagttttaactagtggtaatcaaccattcacttatgagttacctaaagatttatcgtcacataatgcgcgtaaatacttggaatttatttcacaaaaaatagatggagataagttaaccaaagaagattcatta

SEQ ID NO: 168 - protein, 75 aa, Staphylococcus aureus
  MISC_FEATURE (1)..(75): hypothetical protein
LKKTSISAVFERKFIMKITNCKIKKETIVYEVLTSGNQPFTYELPKDLSSHNARKYLEFISQKIDGDKLTKEDSL

SEQ ID NO: 169 - DNA, 477 bp, Staphylococcus aureus
atggctgtacaattagtattaaactttattatcgcagtgttttggttgtttgtgacaaatagttacacaacaaataactttgtgttaggtttcatctttggcctagttcttgtttacctcttacacagagtgttaccaggtagattttatgtcatcacgctatatcgtattattaaattagttattattttcttaatcgaactgattaaagctaattttgatgttttgaaaattattattaaaccttcgattaaaaatgaaccaggattctttgtttatcacacagatttaaaaaaagattggcaaattgtcttgctgtctaatttaattacattaacacctggtactgtagtgcttggtgtaagtgacgatcgtacaaaaatttatattcatgccatagatttttcaactaaagagcaagaagtagaaagtattaaaacatcattagagaaaattgtaagagaggtgggcgaaata

SEQ ID NO: 170 - protein, 159 aa, Staphylococcus aureus
  MISC_FEATURE (1)..(159): Na+/H+ antiporter subunit
MAVQLVLNFIIAVFWLFVTNSYTTNNFVLGFIFGLVLVYLLHRVLPGRFYVITLYRIIKLVIIFLIELIKANFDVLKIIIKPSIKNEPGFFVYHTDLKKDWQIVLLSNLITLTPGTVVLGVSDDRTKIYIHAIDFSTKEQEVESIKTSLEKIVREVGEI

SEQ ID NO: 171 - DNA, 144 bp, Staphylococcus aureus
ttgaatggtggtgagaattttatggcggataaaaacaaaaaacaagaagctacccgtagtaacccaataaacaaaagttttgaaaagccgggtgccagcgaaaacttaaaaagcactttatcagaaaaagctaagaaaaaagat

SEQ ID NO: 172 - protein, 48 aa, Staphylococcus aureus
LNGGENFMADKNKKQEATRSNPINKSFEKPGASENLKSTLSEKAKKKD

SEQ ID NO: 173 - DNA, 612 bp, Staphylococcus aureus
atgactcaatttctaggggcgcttcttcttacaggagttttaggttacataccatataaatatctaacaatgataggtttagttagtgaaaaaaacaagattatcaatactcctgtattattgattttttctattgaaacatgtttgatatggttttatacttttataatttttaataatgttgatttaaaaaatttgagtttacttcagttgcttacaggtctaaaagcaaatatttggtttctaattatttttgttttaacagtgcttgtatttaatcctttaattgttaaattcattatctggttaattaatgaaacaagaaagtttatgaatttggattgtataagcttattagacaaaagagacaagttgtttaataacaacggtaaaccagtatttatagttattaaagactttgaaaacagaatcattgaagagggtgaacttaaaacctataattcagctggtagcgatttcgatttactagaggttgagcgacaagatttcaaagtatctgatttaccgtcaaacgatgaattgtatattaaacatacacttgtagaccttaaacaacaaattaaattggatttatatttaatgaatgaatat

SEQ ID NO: 174 - protein, 204 aa, Staphylococcus aureus
MTQFLGALLLTGVLGYIPYKYLTMIGLVSEKNKIINTPVLLIFSIETCLIWFYTFIIFNNVDLKNLSLLQLLTGLKANIWFLIIFVLTVLVFNPLIVKFIIWLINETRKFMNLDCISLLDKRDKLFNNNGKPVFIVIKDFENRIIEEGELKTYNSAGSDFDLLEVERQDFKVSDLPSNDELYIKHTLVDLKQQIKLDLYLMNEY

SEQ ID NO: 175 - DNA, 1059 bp, Staphylococcus aureus
ttgccaattttgaggagggaacgcatgaaaacacgttgttacgatggtaaaaaatggcaatatgaatttaagcatgaaggaaaaagataccgtaagaaaggttttagaacaaagcgtgaagctaattctgctggactagacaagttaaatgagttaagaagtggttttaatatagataactatataactcttgcagaatacttcgaaaattggattaaaacatataaacaacctgttgttaaagaaaatacctaccgtcattatagaaatgcattacaacatatacaaaaacataaaataggtaaaatggagttatcaaagataaatagacaagtttatcagaaattcataaacgactattcaaaagaacacgcaaaagaaactataagaaaaacaaacggtgctattcggtcagctttagatgacgcattatatgatggacttatttttaaaaaccccgcttataaagttaattataaagccggaaaacctacgaagtcagaacaagaaaaattcatctcggtaactgaatatgaaatactaaaagatcacgtcagaaagaagagaactcgttcatcattagcgctattcataatgatttgtacgggttgtcgtgtcagtggtgcaagaaatataaagattgagcatatcaaccaagtgaaaaacactatatttattgacgagcgaaaaaccgatacttcccctagatatatcagtatcgctaaatctgatatgaaacacattatggacgtcataagtacatttgcaattagctatgatggttacattttcaaagaagccggatctataattaaccttcaggctatcaataatgctttgaaatcagcctgtagagtcaataatataccaattattacatcgcacgcattaagacacactcattgttcttatttactagcaaaaggtgtatctatacattacatttctaaaagattaggtcataaaaatatagcaataactacatccgtgtattctcatttgttagaagaaaaatttaatgaagaggacaaaaaaacaactaaaattttagaaagtatg

SEQ ID NO: 176 - protein, 353 aa, Staphylococcus aureus
  MISC_FEATURE (1)..(353): integrase [Staphylococcus
LPILRRERMKTRCYDGKKWQYEFKHEGKRYRKKGFRTKREANSAGLDKLNELRSGFNIDNYITLAEYFENWIKTYKQPVVKENTYRHYRNALQHIQKHKIGKMELSKINRQVYQKFINDYSKEHAKETIRKTNGAIRSALDDALYDGLIFKNPAYKVNYKAGKPTKSEQEKFISVTEYEILKDHVRKKRTRSSLALFIMICTGCRVSGARNIKIEHINQVKNTIFIDERKTDTSPRYISIAKSDMKHIMDVISTFAISYDGYIFKEAGSIINLQAINNALKSACRVNNIPIITSHALRHTHCSYLLAKGVSIHYISKRLGHKNIAITTSVYSHLLEEKFNEEDKKTTKILESM

SEQ ID NO: 177 - DNA, 822 bp, Staphylococcus aureus
atgtatccaaactgggggcaatataaacgcgctgatttaatcggacaatcttcttatattaaaaataatgatgtcgtaatattcaatgaagcatttgataatggtgcatcagacaaattattaagtaatgtgaaaaaagaatatccttatcaaacacctgtactcggccgttctcaatcagggtgggacaaaactgaaggtagctactcatcaactgttgcagaagatggtggcgtagcgattgtaagtaaatatcctattaaagaaaaaatccagcatgttttcaaaagcggttgtggattcgataatgatagcaacaaaggctttgtttatacaaaaatagagaaaaatggtaagaacgttcacgttatcggtacacatacacaatctgaagattcacgttgtggtgctggacatgatcgaaaaattagagctgaacaaatgaaagaaatcagtgattttgttaaaaagaaaaatatccctaaagatgaaacggtatatataggtggcgaccttaatgtcaataaaggcactccagagttcaaagatatgcttaaaaacttgaatgtaaatgatgttctatatgcaggtcataatagcacatgggaccctcaatcaaattcaattgcgaaatataattaccctaatggtaaaccagaacatttagactatatatttacagataaagatcataaacaaccaaaacatttagtcaatgaagttgtgactgaaaaacctaagccatgggatgtatatgcgttcccatattactacgtttacaatgatttttcagatcattacccaatcaaagcctatagtaaa

SEQ ID NO: 178 - protein, 274 aa, Staphylococcus aureus
  MISC_FEATURE (1)..(274): truncated beta-hemplysin
MYPNWGQYKRADLIGQSSYIKNNDVVIFNEAFDNGASDKLLSNVKKEYPYQTPVLGRSQSGWDKTEGSYSSTVAEDGGVAIVSKYPIKEKIQHVFKSGCGFDNDSNKGFVYTKIEKNGKNVHVIGTHTQSEDSRCGAGHDRKIRAEQMKEISDFVKKKNIPKDETVYIGGDLNVNKGTPEFKDMLKNLNVNDVLYAGHNSTWDPQSNSIAKYNYPNGKPEHLDYIFTDKDHKQPKHLVNEVVTEKPKPWDVYAFPYYYVYNDFSDHYPIKAYSK

SEQ ID NO: 179 - DNA, 870 bp, Staphylococcus aureus
atgtatacacgtacagctacaacaagtgatagtcaaaaaaatattactcaaagcttacaatttaatttcttaactgaacctaattatgataaagaaacagtatttattaaagcaaaaggtacaattggtagtggtttgagaattttagacccaaatggttattggaatagtacattaagatggcctggatcttattcagtttcaattcaaaatgttgatgacaacaacaatacaaatgtgactgactttgcaccaaaaaatcaggatgaatcaagagaagttaaatatacgtatggttataaaacaggtggagatttttcgattaatcgtggaggcttaactggaaatattacaaaagagagtaattattcagagacgattagttatcaacaaccatcatatcgtacattacttgatcaatctacgtcacataaaggtgtaggttggaaagtagaagcacatttgataaataatatgggacatgaccatacgagacaattaactaatgatagtgataatagaactaaaagtgaaattttttctttaacacgaaatggaaatttatgggcgaaagataatttcacacctaaagacaaaatgcctgtaactgtgtctgaagggtttaatccagaatttttagctgttatgtcacatgataaaaaagacaaaggtaaatcacaatttgttgttcattataaaagatcaatggatgagtttaaaatagattggaatcgccatggtttctggggctattggtctggtgaaaaccatgtagataaaaaagaagaaaaattatcagcattatatgaagttgattggaagacacataatgtgaagtttgtaaaagtacttaatgataatgaaaagaaa

SEQ ID NO: 180 - protein, 290 aa, Staphylococcus aureus
  MISC_FEATURE (1)..(290): hypothetical protein
MYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 181 - DNA, 141 bp, Staphylococcus aureus
ttgatttcagaattaatctttgcaaatgaagtagctggtaatacagtgaaagtagtcgatagtgctaacgtacaaattgtgatatttttacatagttgtttaatcattagtaatccgccctttcaatattatccttcttta

SEQ ID NO: 182 - protein, 47 aa, Staphylococcus aureus
LISELIFANEVAGNTVKVVDSANVQIVIFLHSCLIISNPPFQYYPSL

SEQ ID NO: 183 - DNA, 1053 bp, Staphylococcus aureus
atgaaaaataaaaaacgtgttttaatagcgtcatcattatcatgtgcaattttattgttatcagcagcaacgactcaagcaaattcagctcataaagactctcaagaccaaaataagaaagaacatgttgataagtctcaacaaaaagacaaacgtaatgttactaataaagataaaaattcaacagcaccggatgatattgggaaaaacggtaaaatcacaaaacgaactgaaacagtatatgatgagaaaacaaatatactccaaaatttacaattcgactttatcgatgatccaacttatgacaagaatgtattacttgttaaaaaacaaggctcaattcattcaaatttaaagtttgaatctcataaagaagaaaaaaattcaaattggttaaagtatccaagtgagtaccatgtagattttcaagtaaaaagaaatcgtaaaactgaaatattagaccaattgccgaaaaataaaatttcaactgcaaaagtagacagtacattttcatatagctcaggtggtaaattcgattcaacaaaaggtattggacgaacttcatcaaatagctactccaaaacgattagttataatcagcaaaattatgacacaattgccagcggtaaaaataataactggcatgtacactggtcagttattgcgaatgacttgaagtatggtggagaagtgaaaaatagaaatgatgaattattattctatagaaatacgagaattgctactgtagaaaaccctgaactaagctttgcttcaaaatatagatacccagcattagtaagaagtggctttaatccagaatttttaacttatttatctaatgaaaagtcaaatgagaaaacgcaatttgaagtaacatacacacgaaatcaagatattttgaaaaacagacctggaatacattatgcacctccaattttagaaaaaaataaagatggtcaaagattaattgtcacttatgaagttgattggaaaaataaaacagttaaagtcgttgataaatattctgatgacaataaaccttataaagaagga

SEQ ID NO: 184 - protein, 351 aa, Staphylococcus aureus
  MISC_FEATURE (1)..(351): hypothetical protein
MKNKKRVLIASSLSCAILLLSAATTQANSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 185 - DNA, 1284 bp, Staphylococcus aureus
atgtttaagaataaaaattatgtttatataaatatatatactactttgaaaggtgtgagcttaatgacaacttttagtgaaaaagaaaaaattcaattactagcagatattgttgaactacaaactgaaaataataatgaaatagacgtttgtaattatttaacagatttattcgacaagtacgatattaaatctgaaattttgaaagttaatgaacaccgcgccaatatcgttgcagaaatcggtaacggctcacctatactcgcattgagtggtcatatggatgttgttgatgcaggaaatcaagataattggtcatatcccccttttcaactgacagaaaaagatggcaaattatatggccgaggcactacagatatgaaaggcggtttaatggctttggtcgtatctctaatcgaattaaaagaacaaaatgaattgcctcatggaacgattagattactggctactgctggcgaagagaaagaacaagaaggtgccaaattattagctgataaaggctatttagacgatgtcgatggcttaattattgctgaaccaactggatctggaatttattatgcacataaggggtctatgtcatgtaaagtaactgcaactggtaaagctgtccatagctcagttccatttattggtgacaatgcaattgatacactgcttgaattttataatctatttaaagaaaaatattcagagcttaaacaacaagatactaaacatgaattagatgttgcgcctatgttcaaatcattgattggaaaagaaatttctgaagaggatgcaaattatgcatctggtcttacagctgtatgttcgattataaatggcggcaaacaatttaactctgtaccagatgaagcttcacttgaatttaacgtaagaccagttcctgagtatgataacgactttatagaatcgtttttccaaaatatcattaatgatgtggatagcaataagctttcactcgatattccaagcaatcaccgacctgtaacaagcgataaaaatagcaaattaattactacgattaaagatgtagcttctagttatgtagaacaagacgaaatatttgtttcagcgcttgtaggcgcaacagatgcctctagtttcttaggagataataaggacaatgttgatttagccatttttggaccaggtaatccattaatggcacatcaaatcgatgaatatattgaaaaagatatgtatctgaaatatattgatatttttaaagaggcttccattcaatatttaaaagaaaaa

SEQ ID NO: 186 - protein, 428 aa, Staphylococcus aureus
  MISC_FEATURE (1)..(428): hypothetical protein
MFKNKNYVYINIYTTLKGVSLMTTFSEKEKIQLLADIVELQTENNNEIDVCNYLTDLFDKYDIKSEILKVNEHRANIVAEIGNGSPILALSGHMDVVDAGNQDNWSYPPFQLTEKDGKLYGRGTTDMKGGLMALVVSLIELKEQNELPHGTIRLLATAGEEKEQEGAKLLADKGYLDDVDGLIIAEPTGSGIYYAHKGSMSCKVTATGKAVHSSVPFIGDNAIDTLLEFYNLFKEKYSELKQQDTKHELDVAPMFKSLIGKEISEEDANYASGLTAVCSIINGGKQFNSVPDEASLEFNVRPVPEYDNDFIESFFQNIINDVDSNKLSLDIPSNHRPVTSDKNSKLITTIKDVASSYVEQDEIFVSALVGATDASSFLGDNKDNVDLAIFGPGNPLMAHQIDEYIEKDMYLKYIDIFKEASIQYLKEK

SEQ ID NO: 187 - DNA, 843 bp, Staphylococcus aureus
atgaagcaactggttggaattcccgaatcaatgttaattcctttgatagctcgagcaaaagagtacgaaaacgaaaaaccaataataaaagacgcactatcaaaaaaaatatttgatggtttagatgatatgtacaaaaatgttacatgtgatgacatgtctcaaattggaattagtatacgtactgtgataatagattgtgttactaagaggcttatcaaggataataaagatttaatcgtggtcaatataggttgtggcttagatacaaggtttcaaagatttaataaagaaaaaatatcatggatagatttagatgtaccagaatcaatagaaatacgaaaaacattttttaaagaaagtaatagttataagatgatatctaaatctatgctagattacagttggattgatgatgtcaaaaattataaattttttaatagtaagtcagatatattgtttattattgaaggtgtattgatgtattttgatgagagtgtaatgactcaattattggacactattatcaaaaagatgggagatcataatttgacatttgcgattgaattttgctcaaaaacaattgcgaataatacaaagagacatcaatcggtatcaaagttatcctcacaacctgtttttaaatatggttacaatgatttaaaaaaattgaatgaaattttaccaaatacaataagagtaatacatgaatataattattttgactattataagaatcgatggggcttatttggatattgtagatttataccttatttaaaaaaaaggttaaacaataaaatagtacttatgaaatataaagttccaaagagacagagacat

SEQ ID NO: 188 - protein, 281 aa, Staphylococcus aureus
  MISC_FEATURE (1)..(281): hypothetical protein
MKQLVGIPESMLIPLIARAKEYENEKPIIKDALSKKIFDGLDDMYKNVTCDDMSQIGISIRTVIIDCVTKRLIKDNKDLIVVNIGCGLDTRFQRFNKEKISWIDLDVPESIEIRKTFFKESNSYKMISKSMLDYSWIDDVKNYKFFNSKSDILFIIEGVLMYFDESVMTQLLDTIIKKMGDHNLTFAIEFCSKTIANNTKRHQSVSKLSSQPVFKYGYNDLKKLNEILPNTIRVIHEYNYFDYYKNRWGLFGYCRFIPYLKKRLNNKIVLMKYKVPKRQRH

SEQ ID NO: 189 - DNA, 909 bp, Staphylococcus aureus
atgaaaagattaattggaattttattatgtaatttatttattttgactgcgtgttcagcatctgtcgataaaacaagtaactcgacaaagactacagactataaaattgaaaatggtgaaacactgaaagtaccagagaaacctaaaagagttgctgtattaactggattttatgttggtgattttataaagttaggaatcaaaccaattgctgtttcagatataactaaagattcttcaattttaaaaccttatttaaaaggggttgattatattggagaaaatgatgttgaaagagttgctaaagcaaaaccagatttaattgttgtagatgctatggataaaaatataaaaaaataccaaaaaatagcgccaacaatcccatatacatacaataaatacaatcataaagaaatattaaaagaaataggcaagttgactaataatgaagataaagctaaaaaatggattgaagagtgggacgataaaactagaaaagataaaaaagaaattcaaagtaaaattggtcaagcaacagcatctgtgtttgaaccagatgaaaagcaaatatacatatataactctacatggggtcgtggtttggatattgttcatgatgcattcggtatgccaatgacaaagcaatataaagataaattacaagaagataaaaaaggctatgcttccatttcaaaagaaaatattagtaaatatgctggtgattatatatttttaagtaaaccttcgtacggaaaatttgattttgaaaaaacacatacatggcagaatattgaagctgtaaaaaaaggacatgtaatttcatataaagcagaagattattggttcacagatcctattacattagaacatttgagaagtaaattaaaaaaagaaattttaaataaaaaa

SEQ ID NO: 190 - protein, 303 aa, Staphylococcus aureus
  MISC_FEATURE (1)..(303): hypothetical protein
MKRLIGILLCNLFILTACSASVDKTSNSTKTTDYKIENGETLKVPEKPKRVAVLTGFYVGDFIKLGIKPIAVSDITKDSSILKPYLKGVDYIGENDVERVAKAKPDLIVVDAMDKNIKKYQKIAPTIPYTYNKYNHKEILKEIGKLTNNEDKAKKWIEEWDDKTRKDKKEIQSKIGQATASVFEPDEKQIYIYNSTWGRGLDIVHDAFGMPMTKQYKDKLQEDKKGYASISKENISKYAGDYIFLSKPSYGKFDFEKTHTWQNIEAVKKGHVISYKAEDYWFTDPITLEHLRSKLKKEILNKK

SEQ ID NO: 191 - DNA, 1494 bp, Staphylococcus aureus
atgattgaaagtaatatgcttgtgttaacgctagttattccagtaattacagccatattacttgtctttattggaaagcgtcctattataaagcgttatgtcgcactaggcggtacattattaaccttggtcgcggcaattatcaatttagcaaatgttgttaaacatggaccaatacgcgtagagctaggttcatggaaagcaccatacagtattgtctttgtattagacatattcagtgccctactaataattactagtattattattacagctattgtgattttatattcataccaaacaattggtattgaacgtgaaagatattattattatttttcagtactatttatgttaataggtatcattggtgcattcacaactggtgacattttcaacctattcgtatttttcgaagtatttttaatgtcatcttatttcttattagtaattggttctacaaaaattcaactacaagaaacaataaaatatgttcttgttaacgttgtatcgtcatccttcttcgtaatgggtgtagcgattttatattcagtagtaggaacattgaatctagcagatataagcaataaattagctaacctttcagcgcatgacagtggcttagtcaatatcgttttcatactatttatctttgtttttgctacaaaagctggcgtattcccaatgtttgtttggttacctagtgcatactatgcaccaccaattccaatcattgcattctttggtgctttgttaacaaaagttggtgtttatgcaatcgctagaacattgagcctattctttagtgataatgtaagcttttcacattatgtcattttattcttagcactattaacgatcatctttggttgtgtcggtgctgttgcatatgccaacattaaaaaaatcatcctatacaatgtcatgattgctgtaggtgtgatcttagtcggcgttgcaatgatgacagagtcaggtatgattggggctatttactatacattgcacgacatgttagtaaaacttgcattattcttgcttatcggaattatgattaaaattacaggcactgctgatttaagacaatttggtggcttaattaaacgatatcctgtacttggttggtcattctttatcgcagcattaagtttagctggcattcccccactcagtggcttttatggaaaattttttattgtccaatcaacatttgaaagaggattttatttaagtggtgtcatcgtcttattatcaagtttagtcgtattatattctgtcattcgcatattcctacaaggctttttcggtcaaccaaaaggatatgatcttaataacaaagtcgacgtcaaatatttaactacgattgcaatcgttgcagttgtgataactgttttatatggattgtcagcagattacttatatccaatggtaaaagctggtgcagaaacattctacaatccatcaacctacgttaaagctgtattaggaggtaaa

SEQ ID NO: 192 - protein, 498 aa, Staphylococcus aureus [sequence omitted]

SEQ ID NO: 193 - DNA, 1305 bp, Staphylococcus aureus
atgaacaaagtccacaaacctttatatttttatttaatgcttttcttctctacaactatcataggtgcacttttattgtatttaccttttactggtaaaaagccaatatcttttttagatgccctatttatagcttcaagtgcatttacagttactggcttgtccccagttgatataggatcacagtttaatatacttggtgagatagtaatactattattaattcaaataggtggtctgggtatcgtgaccgtaaccctattgacactagtatttttaaatagaaagatatcaatgaaaaatagattcttgattatggttacatggaatattgacgaacctggtggtgttattaagctaattaaacacttggctatttatagtttagtcactgaattaattggtatgatttgtttgtgtttatcttttataccaaaatttggtataggcaaaggtttatttttaagcttattcacatcagtatcagcttttaataatgctggatttgccctttttaagaataacttaatagattattctagtgatccaattgtcattattacaatctcaatactcataatatttggaggtattggacattttgtcgtgatagactttattaattgtaaaaaattgagtaaattatctttacattctaaattagtcttaactacaactagtatcctaataattataggagctattacattctttttattagaacagtttaatactatgcaacatatgggactagttgaaaaaatcggaaattcttttttccaatcagtaacaacacgaacagcgggttttaacagtatagatatagcaagcattaacaaatctaccgcattaatgttaatgctacttatgtttattggtggtgcccctctcagtgcagctggaggaattaaaataactacttttgcagttgcgtttatttttgtactaaattatatacgtaaagaaaataatgtttcagtattcaataaagaaatatctgacaaacatataaaactatctattgttaccattaatatctcatttctatttatcagcatcattacttttatattatcgataattaatccgaacatatcattaatcaagttattattcgaagtggtttctgcattcggaacagtagggttaagtatgaaccttaccacagaatatcatggtattactaaaataattattatattcgttatgctttgcggtaaagtaggactattaactttattaagaacatttataccaccaaaaagtcctaaaaattaccgctacactaaaggacaaatttatcta

SEQ ID NO: 194 - protein, 435 aa, Staphylococcus aureus
  MISC_FEATURE (1)..(435): hypothetical protein
MNKVHKPLYFYLMLFFSTTIIGALLLYLPFTGKKPISFLDALFIASSAFTVTGLSPVDIGSQFNILGEIVILLLIQIGGLGIVTVTLLTLVFLNRKISMKNRFLIMVTWNIDEPGGVIKLIKHLAIYSLVTELIGMICLCLSFIPKFGIGKGLFLSLFTSVSAFNNAGFALFKNNLIDYSSDPIVIITISILIIFGGIGHFVVIDFINCKKLSKLSLHSKLVLTTTSILIIIGAITFFLLEQFNTMQHMGLVEKIGNSFFQSVTTRTAGFNSIDIASINKSTALMLMLLMFIGGAPLSAAGGIKITTFAVAFIFVLNYIRKENNVSVFNKEISDKHIKLSIVTINISFLFISIITFILSIINPNISLIKLLFEVVSAFGTVGLSMNLTTEYHGITKIIIIFVMLCGKVGLLTLLRTFIPPKSPKNYRYTKGQIYL

SEQ ID NO: 195 - DNA, 450 bp, Staphylococcus aureus
gtgggttatatgagcataattacaagattgtttaataacagtgattttgaaaaattaaatcaactatgtaaattatatgatgatctaggttatccaacaaatgagaatgatttaaaaaagagactaaagaaaataacgaatcatgatgattacttcctactgcttttgataaaagaaaataaaataattggtttaagtggtatgtgtaaaatgatgttttacgaaaaaaatgcagagtatatgagaatccttgcgtttgttatacattctgaatttaggaaaaaaggttatggaaagagattattagctgattctgaagaattttctaaacggttgaattgtaaagcaataacactaaatagtggtaatagaaatgaaagactatctgcacataaactatatagtgataatgggtatgttagcaatacatctgggtttactaaacaacta

SEQ ID NO: 196 - protein, 150 aa, Staphylococcus aureus
VGYMSIITRLFNNSDFEKLNQLCKLYDDLGYPTNENDLKKRLKKITNHDDYFLLLLIKENKIIGLSGMCKMMFYEKNAEYMRILAFVIHSEFRKKGYGKRLLADSEEFSKRLNCKAITLNSGNRNERLSAHKLYSDNGYVSNTSGFTKQL

SEQ ID NO: 197 - DNA, 435 bp, Staphylococcus aureus
ttgtttatttctctagctatttggtcaataaattcgatgggtaataaacaatgcattagtttgaatttattgctttcggatgatactttcgcagtaatttcagtaatgacaactttgggaactgctattttaggaggtatagcaccttcaatatatggtatttttacatcgcctatagataaaaaaagtagttttagggctattagcgattgggagcaagaacaaagaaataatgttaaagatctgatgatgctattaccatttacattacttagtattttaattgtgatttttatttttcagtttgcatattctaaactatttaatacgatagctattataatatttattataatacttgttgttatgttttttttaattttattaatctgttataaaattactgtgaagatatgcagatatttttcaaaagaa

SEQ ID NO: 198 - protein, 145 aa, Staphylococcus aureus
LFISLAIWSINSMGNKQCISLNLLLSDDTFAVISVMTTLGTAILGGIAPSIYGIFTSPIDKKSSFRAISDWEQEQRNNVKDLMMLLPFTLLSILIVIFIFQFAYSKLFNTIAIIIFIIILVVMFFLILLICYKITVKICRYFSKE

SEQ ID NO: 199 - DNA, 588 bp, Staphylococcus aureus
atgagtgagttaactgcaaagcaagcacgttttgtgaatgagtatattagaacactgaatgtaacacaaagtgccataaaagcaggatataacgcaaatagcgcacatgtgacagcgtgtaggttattgaaaaagccgcacatcaagcaatatatacaagaacaaaaagataagattatagatgagaatgtattaaccgcaaaagagttattacatgtgctaacgaatgcggcagtcggtgatgaaacagaaacgaaagaagttgtagtcaagcgtggagaatataaagaaaatccacaaagtggcaaagtacaattagtctataatgaacatgttgaactgatagaggtaccaataaaacctagtgatcgtttaaaagctcgtgatatgttgggtaaatatcataaattatttacagataagcatgatataaacggtaatgtacctatattcattaatattggtgaatgggacggaggtgatgaggggttagataaggcagtgaaagatgtatctaacgataatcctaatcatactgtgattgtggatgatataccgttagaagattatgagtcaattaggttttta

SEQ ID NO: 200 - protein, 196 aa, Staphylococcus aureus
  MISC_FEATURE (1)..(196): hypothetical protein
MSELTAKQARFVNEYIRTLNVTQSAIKAGYNANSAHVTACRLLKKPHIKQYIQEQKDKIIDENVLTAKELLHVLTNAAVGDETETKEVVVKRGEYKENPQSGKVQLVYNEHVELIEVPIKPSDRLKARDMLGKYHKLFTDKHDINGNVPIFINIGEWDGGDEGLDKAVKDVSNDNPNHTVIVDDIPLEDYESIRFL

SEQ ID NO: 201 - DNA, 345 bp, Staphylococcus aureus
ttgaagtggtctgatattgattttgaaaacaacacgattagtattactaaaacatattacaatccaaataataacaagaagaaatatcagatacttccccctaaaactgaaagttctatcggtaagatttccgttgacccaaatgtaataaaggtgttgcgtgattataagataaacgttcaaaataattggaaaaacgaattatataatgataaccattgtaatgaaaaaactatcaatgtggatacaaaccattatgtcacgtaccagcatactcaaaaatatctctacgcactcattcagatacacacattgcgcattgctcatagaatcaggtgtacacat

SEQ ID NO: 202 - protein, 115 aa, Staphylococcus aureus
  MISC_FEATURE (1)..(115): hypothetical protein
LKWSDIDFENNTISITKTYYNPNNNKKKYQILPPKTESSIGKISVDPNVIKVLRDYKINVQNNWKNELYNDNHCNEKTINVDTNHYVTYQHTQKYLYALIQIHTLRIAHRIRCTH

SEQ ID NO: 203 - DNA, 1614 bp, Staphylococcus aureus
atggttaaacaattgaaattctctgaagatgcacgtcaagcaatgttacgtggtgttgaccaacttgcaaatgcagttaaagtaacgattggtcctaaaggacgtaatgttgtattagataaagagtttacagcacctttaattacgaatgatggtgtgacgattgctaaagaaatcgaattagaagatccatatgaaaatatgggggctaaactagttcaagaagtcgcaaataagacaaatgaaattgctggtgacggtacgacaactgcaacagtattagctcaagcaatgattcaagaaggcttgaaaaatgttacaagtggtgcgaacccagttggtttacgacaaggtatcgacaaagcagttaaagttgctgttgaagcgttacatgaaaattctcaaaaagttgaaaataaaaatgaaattgcgcaagtaggtgcgatttcagcagcagatgaagaaattggacgttatatttctgaagctatggaaaaagtaggtaacgatggtgtcattacaattgaagaatcaaatggactaaacactgaactagaagtggttgaaggtatgcaatttgatcgtggttatcaatcaccgtatatggttactgattcagataaaatggttgctgaattagaacgcccatactttttagtaacagataagaaaatctcgtctttccaagatatcttacctttattagaacaagtggttcaatctaatcgtccaatcttaattgtagctgatgaagttgaaggcgatgcattaacaaatatcgtgctaaaccgtatgcgtggcacatttacagctgttgcagtaaaagcacctggttttggtgatcgtagaaaagcgatgcttgaagatttagctattttaactggtgcgcaagtgattactgatgatttaggcttagatttaaaagatgcatcaattgatatgttaggtactgcaagtaaagtagaagtaactaaagataataccactgttgttgatggtgacggtgacgaaaacagcattgatgcacgtgttagccaattgaaatctcaaattgaagaaactgaatctgactttgatcgtgaaaaattacaagagcgcttagctaaattagcaggtggtgttgcagttatcaaagtaggtgcagcaagtgaaacagagcttaaagaacgtaaattacgtattgaagatgcattaaattctacacgtgcagcagttgaagaaggtattgttgcaggtggtggtactgcattagtaaatgtttaccaaaaagtaagtgaaattgaagctgaaggtgacattgaaacaggtgtaaatattgtacttaaagcattaactgcaccagttcgtcaaattgctgaaaatgcaggattagaaggttctgttattgtagaacgtttgaaaaacgcagagccgggtgttggttttaacgctgctacaaacgagtgggttaatatgttagaagaaggtatcgttgatccaactaaagtaacacgctcagcattacaacatgctgcaagtgttgcagcaatgttcttaacgactgaagcggttgtagcatcaattccagaaaaaaataatgaccaacctaacatgggtggcatgccaggaatgatg

SEQ ID NO: 204 - protein, 538 aa, Staphylococcus aureus
  MISC_FEATURE (1)..(538): GroEL protein
MVKQLKFSEDARQAMLRGVDQLANAVKVTIGPKGRNVVLDKEFTAPLITNDGVTIAKEIELEDPYENMGAKLVQEVANKTNEIAGDGTTTATVLAQAMIQEGLKNVTSGANPVGLRQGIDKAVKVAVEALHENSQKVENKNEIAQVGAISAADEEIGRYISEAMEKVGNDGVITIEESNGLNTELEVVEGMQFDRGYQSPYMVTDSDKMVAELERPYFLVTDKKISSFQDILPLLEQVVQSNRPILIVADEVEGDALTNIVLNRMRGTFTAVAVKAPGFGDRRKAMLEDLAILTGAQVITDDLGLDLKDASIDMLGTASKVEVTKDNTTVVDGDGDENSIDARVSQLKSQIEETESDFDREKLQERLAKLAGGVAVIKVGAASETELKERKLRIEDALNSTRAAVEEGIVAGGGTALVNVYQKVSEIEAEGDIETGVNIVLKALTAPVRQIAENAGLEGSVIVERLKNAEPGVGFNAATNEWVNMLEEGIVDPTKVTRSALQHAASVAAMFLTTEAVVASIPEKNNDQPNMGGMPGMM

SEQ ID NO: 205 - DNA, 282 bp, Staphylococcus aureus
atgctaaaaccaattggaaatcgtgtgattattgagaaaaaagaacaagaacaaacaactaaaagtggtattgttttaactgatagtgctaaagaaaaatcaaacgaaggcgttatcgttgcagtaggaactggacgcctattaaatgatggtacaagagtgactcctgaagtgaaagaaggggaccgtgtcgtgttccaacaatatgctggtacagaagttaaacgagataatgaaacatatctggtattaaatgaagaagatattttagcagttattgaa

SEQ ID NO: 206 - protein, 94 aa, Staphylococcus aureus
  MISC_FEATURE (1)..(94): GroES protein
MLKPIGNRVIIEKKEQEQTTKSGIVLTDSAKEKSNEGVIVAVGTGRLLNDGTRVTPEVKEGDRVVFQQYAGTEVKRDNETYLVLNEEDILAVIE

SEQ ID NO: 207 - DNA, 741 bp, Staphylococcus aureus
atgacaagattatgggcatcattgctaactgttattatttatatattgtctcaatttttaccgcttctcattgtaaaaaaattaccatttgtacaatatagtggcatagaactgactaaagcagtcatttacatacaacttgttctatttttaatcgccgccacgacgattattttaattaatttaaaaattaaaaatccaacaaaattagaattagaagttaaagaacctaaaaaatatatcattccatgggcattgcttggatttgcattggtaatgatttatcaaatggtagtgagcattgtattaacgcaaatttatggtggacaacaagtaagtcctaatacagaaaagctaattattattgctcgaaaaatacctatatttatcttctttgtatctattattggtcctttattagaagaatatgtattcagaaaagtaatctttggagaattatttaatgcgattaaaggtaatcgtatcgtggcatttattattgctacaacagtaagttcattaatatttgcattagcacataatgatttcaaatttattccagtttattttggtatgggtgtcattttttcattagcatatgtttggacaaaacggcttgctgttccaattattatccatatgttacaaaacggatttgtcgttatattccaattacttaatcctgaggctttgaaaaaagccacggaacaagcgaattttatatatcacatttttattcca

SEQ ID NO: 208 - protein, 247 aa, Staphylococcus aureus
  MISC_FEATURE (1)..(247): conserved hypothetical
MTRLWASLLTVIIYILSQFLPLLIVKKLPFVQYSGIELTKAVIYIQLVLFLIAATTIILINLKIKNPTKLELEVKEPKKYIIPWALLGFALVMIYQMVVSIVLTQIYGGQQVSPNTEKLIIIARKIPIFIFFVSIIGPLLEEYVFRKVIFGELFNAIKGNRIVAFIIATTVSSLIFALAHNDFKFIPVYFGMGVIFSLAYVWTKRLAVPIIIHMLQNGFVVIFQLLNPEALKKATEQANFIYHIFIP

SEQ ID NO: 209 - DNA, 1269 bp, Staphylococcus aureus
gtgtctcgtgaaatgtcatatcattggtttaagaaaatgttactttcaacaagtattttaattttaagtagtagtagtttagggcttgcaacgcacacagttgaagcaaaggataacttaaatggagaaaaaccaactactaatttgaatcataatataacttcaccatcagtaaatagtgaaatgaataataatgagactgggacacctcacgaatcaaatcaaacgggtaatgaaggaacaggttcgaatagtcgtgatgctaatcctgattcgaataatgtgaagccagactcaaacaaccaaaacccaagtacagattcaaaaccagacccaaataaccaaaactcaagtccgaatcctaaaccagatccagataacccgaaaccaaaaccggatccaaaaccagacccagataaaccaaagccaaatccggatccaaaaccagatccagataacccgaaaccaaatccagatccaaaaccagacccagataaaccaaagccaaatccggatccaaaaccagatccagataaaccaaagccaaatccgaatccaaaaccagaccctaataagccaaatcctaacccgtcaccagatcccgatcaacctggggattccaatcattctggtggctcgaaaaatggggggacatggaacccaaatgcttcagatggatctaatcaaggtcaatggcaaccaaatgggaatcaaggaaactcacaaaatcctactggtaatgattttgtatcccaacgatttttagccttggcaaatggggcttacaagtataatccgtatattttaaatcaaattaataagttgggcaaagattatggagaagttactgatgaagacatttataatattattcgaaaacaaaatttcagcggaaatgcatatttaaatggattacaacagcaatcgaattactttagattccaatatttcaatccattgaaatcagaaaggtactatcgtaatttagatgaacaagtactcgcattaattactggtgaaattggatcaatgccagatttgaaaaagcccgaagataagccggattcaaaacaacgctcatttgaaccgcatgaaaaagacgattttacagtagttaaaaaacaagaagataataagaaaagtgcgtcaactgcatatagtaaaagttggctagcaattgtatgttctatgatggtggtattttcaatcatgctattcttatttgtaaagcgaaataaaaagaaaaataaaaacgaatcacagcgacga

SEQ ID NO: 210 - protein, 423 aa, Staphylococcus aureus
  MISC_FEATURE (1)..(423): hypothetical protein
VSREMSYHWFKKMLLSTSILILSSSSLGLATHTVEAKDNLNGEKPTTNLNHNITSPSVNSEMNNNETGTPHESNQTGNEGTGSNSRDANPDSNNVKPDSNNQNPSTDSKPDPNNQNSSPNPKPDPDNPKPKPDPKPDPDKPKPNPDPKPDPDNPKPNPDPKPDPDKPKPNPDPKPDPDKPKPNPNPKPDPNKPNPNPSPDPDQPGDSNHSGGSKNGGTWNPNASDGSNQGQWQPNGNQGNSQNPTGNDFVSQRFLALANGAYKYNPYILNQINKLGKDYGEVTDEDIYNIIRKQNFSGNAYLNGLQQQSNYFRFQYFNPLKSERYYRNLDEQVLALITGEIGSMPDLKKPEDKPDSKQRSFEPHEKDDFTVVKKQEDNKKSASTAYSKSWLAIVCSMMVVFSIMLFLFVKRNKKKNKNESQRR

SEQ ID NO: 211 - DNA, 339 bp, Staphylococcus aureus
gtggaaattattatgatttttgttagtggtattctcacagcaattagtgtctatctcgttttgtctaaaagtctgatacgaattgttatgggaactacactattaacacatgcagcaaatttatttttaataactatgggcggacttaaacatggtactgttccaatttatgaagcgaacgtaaaaagctatgttgatcctatcccgcaagcacttattttaacagcaatcgttatcgcctttgcgacaacagcctttttcttagtattagcatttagaacatataaagaattaggcacagataacgttgagagtatgaaaggagttccagaagatgat

SEQ ID NO: 212 - protein, 113 aa, Staphylococcus aureus
  MISC_FEATURE (1)..(113): Na+/H+ antiporter subunit
VEIIMIFVSGILTAISVYLVLSKSLIRIVMGTTLLTHAANLFLITMGGLKHGTVPIYEANVKSYVDPIPQALILTAIVIAFATTAFFLVLAFRTYKELGTDNVESMKGVPEDD

SEQ ID NO: 213 - DNA, 705 bp, Staphylococcus aureus
atgaaaaaaatatttatgatggtacatgagttagatgtgaataaaggtggtatgacctcttcgatgttcaatagaagtaaagagttttatgatgcggacatacctgctgatattgttactttcgattacaaaggaaactatgatgaaattattaaagctttgaaaaaacaaggtaaaatggatcgaagaacgaaaatgtataatgtatttgagtattttaaacaaatttcaaataataaacattttaagtctaataaattgttatataaacatatttcagaaagactaaaaaatacgattgaaattgaagagagtaaaggtatttcaagatattttgatataacgactggtacatatattgcctacattagaaaaagtaaatctgaaaaagtgattgatttctttaaagataataaacgaattgaacggtttagttttatagataataaagtgcatatgaaggaaacatttaatgtagataataaagtttgttatcaagtattttatgatgaaaagggatacccatatatttcaaggaatattaatgctaataatggtgctgtaggtaaaacttatgtgttagttaataaaaaagaatttaaaaacaatttagcactgtgtgtttactatttagaaaaactaataaaagattctaaagatagtattatgatttgtgatggaccagggagttttcccaaaaatgtt

SEQ ID NO: 214 - protein, 235 aa, Staphylococcus aureus
MKKIFMMVHELDVNKGGMTSSMFNRSKEFYDADIPADIVTFDYKGNYDEIIKALKKQGKMDRRTKMYNVFEYFKQISNNKHFKSNKLLYKHISERLKNTIEIEESKGISRYFDITTGTYIAYIRKSKSEKVIDFFKDNKRIERFSFIDNKVHMKETFNVDNKVCYQVFYDEKGYPYISRNINANNGAVGKTYVLVNKKEFKNNLALCVYYLEKLIKDSKDSIMICDGPGSFPKNV

SEQ ID NO: 215 - DNA, 624 bp, Staphylococcus aureus
atgggcttatttaaaaaagataaaaaagcaatgacttttgacaatgcaatggaagaaagacgttcaatatataatttgaaagattcgatatcaattagcgatgacgaattagaatcaatgattgcacatgcagttaaacatgttccttcatcatttaattctcaatcaactagaattgttctcttgttaaatgacaacaataataaattttgggataacacaaaagcaattttaaaagaagtcatgggagagaatcgtgatttcgagccaactgaacaaaaaattgataacttcaaacattcatacggtacaattttgttttatgaagatcaagatgttgtaagtggtttacaagaacaaatgccaaactactatgataattttgcaatatggtcaactcaaacaaatgccatgcatcaatttgcaatttggactgcattagctactaaaggcataggtgcttcattacaacactataatccacttgttgatgagatgacttcaaatgaatttaatattcctaaaagttggaaacttattgctcaaatgccatttggtgatattcgtgaagctgctggcgaaaaaacatttaatccagtggaagatcgtttcgtaataaaaaaa

SEQ ID NO: 216 - protein, 208 aa, Staphylococcus aureus
  MISC_FEATURE (1)..(208): conserved hypothetical
MGLFKKDKKAMTFDNAMEERRSIYNLKDSISISDDELESMIAHAVKHVPSSFNSQSTRIVLLLNDNNNKFWDNTKAILKEVMGENRDFEPTEQKIDNFKHSYGTILFYEDQDVVSGLQEQMPNYYDNFAIWSTQTNAMHQFAIWTALATKGIGASLQHYNPLVDEMTSNEFNIPKSWKLIAQMPFGDIREAAGEKTFNPVEDRFVIKK

SEQ ID NO: 217 - DNA, 783 bp, Staphylococcus aureus
atgaaagtccaaatttatcaattaccgattgtttttggagatagttctaaaaatgaaactcaaataacgcaatggttcgaaaaaaatatgaatgctgaagtagatgtagtcgttttacctgaaatgtggaataatggctatgatttagagcatttaaatgaaaaagcagataataatctaggacaaagtttttcatttattaaacatttagctgaaaaatataaagtcgatatcgtagctgggtcagtttctaacattagaaacaatcaaatatttaatacagcttttagtgtgaataaaagtggccagctgattaatgaatacgacaaagttcatttagttcctatgttaagagagcatgaatttttaaccgctggcgaatacgtagctgaaccctttcaattgtctgacggtacttatgtgacccaacttatctgttatgatttacgttttccagaattattaagatatcctgctcgtagtggtgctaaaattgcattttatgtggcgcaatggcctatgtcacgtcttcaacattggcattcattactaaaggcacgtgcaattgaaaataatatgtttgtcattggaactaatagcactggattcgatggtaacacagaatatgctggtcattcgatagttataaacccaaatggagatttagttggagaattaaatgaatccgcagatattttgactgtagatttaaacttaaatgaagtagaacagcaacgcgaaaatatacctgtatttaaaagtattaaattagatttgtataaa

SEQ ID NO: 218 - protein, 261 aa, Staphylococcus aureus
  MISC_FEATURE (1)..(261): hypothetical protein
MKVQIYQLPIVFGDSSKNETQITQWFEKNMNAEVDVVVLPEMWNNGYDLEHLNEKADNNLGQSFSFIKHLAEKYKVDIVAGSVSNIRNNQIFNTAFSVNKSGQLINEYDKVHLVPMLREHEFLTAGEYVAEPFQLSDGTYVTQLICYDLRFPELLRYPARSGAKIAFYVAQWPMSRLQHWHSLLKARAIENNMFVIGTNSTGFDGNTEYAGHSIVINPNGDLVGELNESADILTVDLNLNEVEQQRENIPVFKSIKLDLYK

SEQ ID NO: 219 - DNA, 99 bp, Staphylococcus aureus
atgttggaaaaggtcaaaaaattaatcaatttaattaagaaaatcattcatttgcaaagggcgaaatgggttcttactgagttatctattataaaaaaa

SEQ ID NO: 220 - protein, 33 aa, Staphylococcus aureus
MLEKVKKLINLIKKIIHLQRAKWVLTELSIIKK

SEQ ID NO: 221 - DNA, 135 bp, Staphylococcus aureus
ttgatgagttgtttaattttaagaatttttatcttaattaaggaaggagtgatttcaatggcacaagatatcatttcaacaatcggtgacttagtaaaatggattatcgacacagtgaacaaattcactaaaaaa

SEQ ID NO: 222 - protein, 45 aa, Staphylococcus aureus
  MISC_FEATURE (1)..(45): delta-hemolysin
LMSCLILRIFILIKEGVISMAQDIISTIGDLVKWIIDTVNKFTKK

SEQ ID NO: 223 - DNA, 621 bp, Staphylococcus aureus
atgataaaagattgtactaaatcgtataatgacagtgaggagagtggtgtaaaattgaattattttgataataaaattgaccagtttgccacgtatcttcaaaagagaaataacttagatcatattcaatttttgcaagtacgattagggatgcaggtcttagctaaaaatataggtaaattaattgttatgtatactattgcctatattttaaacatttttctgtttacgttaattacgaatttaacattttatttaataagaagacatgcacatggtgcacatgcaccttcttctttttggtgttatgtagaaagtattatactatttatacttttacctttagtaatagtaaattttcatattaactttttaattatgattattttaacagttatttctttaggtgtaatctcagtatatgctcctgcagcaactaaaaagaagcccattcctgtgcgacttattaaacgaaaaaaatattatgcgattattgttagtttaacccttttcattatcacacttatcatcaaagagccatttgcccaattcattcaattaggcatcataatagaagctattacattattacctattttctttattaaggaggacttaaaa

SEQ ID NO: 224 - protein, 207 aa, Staphylococcus aureus
  MISC_FEATURE (1)..(207): accessory gene regulator B
MIKDCTKSYNDSEESGVKLNYFDNKIDQFATYLQKRNNLDHIQFLQVRLGMQVLAKNIGKLIVMYTIAYILNIFLFTLITNLTFYLIRRHAHGAHAPSSFWCYVESIILFILLPLVIVNFHINFLIMIILTVISLGVISVYAPAATKKKPIPVRLIKRKKYYAIIVSLTLFIITLIIKEPFAQFIQLGIIIEAITLLPIFFIKEDLK

SEQ ID NO: 225 - DNA, 138 bp, Staphylococcus aureus
atgaatacattatttaacttattttttgattttattactgggattttaaaaaacattggtaacatcgcagcttatagtacttgtgacttcataatggatgaagttgaagtaccaaaagaattaacacaattacacgaa

SEQ ID NO: 226 - protein, 46 aa, Staphylococcus aureus
MNTLFNLFFDFITGILKNIGNIAAYSTCDFIMDEVEVPKELTQLHE

SEQ ID NO: 227 - DNA, 114 bp, Staphylococcus aureus
ttgattttgacaaaatacattataataataaatgaagttaatatgattaaggacgcgctatcaaacattttaaatagaaataacgataatgtcgaaattactatgatgaaaaaa

SEQ ID NO: 228 - protein, 38 aa, Staphylococcus aureus
LILTKYIIIINEVNMIKDALSNILNRNNDNVEITMMKK

SEQ ID NO: 229 - DNA, 1290 bp, Staphylococcus aureus
gtggaattattaaatagttataattttgttttattcgtattaactcaaatgatattaatgtttacaataccagctataattagtggtattaagtacagtaaacttgattattttttcatcatagtaatttcgacattatcgttatttctatttaaaatgtttgatagcgcgtccttaatcatattaacttcatttattattataatgtattttgtcaaaatcaaatggtattctattttgttgattatgacttcgcagattattctatactgtgctaactacatgtatatagttatatatgcatatatcaccaaaatttctgatagtatatttgtaatattccctagcttttttgtagtttatgtgactattagtatactattctcatatataataaatagagttctcaaaaaaattagcacaccatatctaatactaaacaaaggatttttaatagttatttcgactatcttactgcttactttttcattatttttcttttattcacaaataaactcggatgaagctaaagtaataaggcagtattcttttatttttattggtatcactatatttttaagtatattaacatttgttatttctcaatttctccttaaagagatgaaatataaacgtaatcaagaagaaattgaaacctattatgaatatacattgaagattgaagctatcaacaacgaaatgcgcaagttccgtcatgattatgtcaatatcttaacgacactttcagaatacattcgagaagatgacatgcctggcctacgtgattatttcaataaaaatattgtacctatgaaagacaatttacaaatgaatgctataaaattaaatggtatcgagaatcttaaagtacgtgaaattaaaggcttaattactgcgaaaattttacgtgcacaagaaatgaatattccgattagtatcgaaatacccgatgaagtaagtagcattaacttgaatatgatcgatttaagtcgcagtattggtattattcttgataatgcaattgaggcatcaactgaaattgatgaccctatcattcgcgttgcatttattgaaagtgaaaattcagtaacgtttattgttatgaataaatgcgctgatgatataccacgcattcatgaattgttccaagaaagtttttctactaaaggtgaaggtcgtggtttaggtctatcaactttaaaagaaattgctgataatgcagacaatgtcttattagatacaattatcgaaaatggtttctttattcaaaaagttgaaattattaacaac

SEQ ID NO: 230 - protein, 430 aa, Staphylococcus aureus
  MISC_FEATURE (1)..(430): accessory gene regulator C
VELLNSYNFVLFVLTQMILMFTIPAIISGIKYSKLDYFFIIVISTLSLFLFKMFDSASLIILTSFIIIMYFVKIKWYSILLIMTSQIILYCANYMYIVIYAYITKISDSIFVIFPSFFVVYVTISILFSYIINRVLKKISTPYLILNKGFLIVISTILLLTFSLFFFYSQINSDEAKVIRQYSFIFIGITIFLSILTFVISQFLLKEMKYKRNQEEIETYYEYTLKIEAINNEMRKFRHDYVNILTTLSEYIREDDMPGLRDYFNKNIVPMKDNLQMNAIKLNGIENLKVREIKGLITAKILRAQEMNIPISIEIPDEVSSINLNMIDLSRSIGIILDNAIEASTEIDDPIIRVAFIESENSVTFIVMNKCADDIPRIHELFQESFSTKGEGRGLGLSTLKEIADNADNVLLDTIIENGFFIQKVEIINN

SEQ ID NO: 231 - DNA, 714 bp, Staphylococcus aureus
atgaaaattttcatttgcgaagacgatccaaaacaaagagaaaacatggttaccattattaaaaattatataatgatagaagaaaagcctatggaaattgccctcgcaactgataatccttatgaggtgcttgagcaagctaaaaatatgaatgacataggctgttactttttagatattcaactttcaactgatattaatggtatcaaattaggcagtgaaattcgtaagcatgacccagttggtaacattattttcgttacgagtcacagtgaacttacctatttaacatttgtctacaaagttgcagcgatggattttatttttaaagatgatccagctgaattaagaactcgaattatagactgtttagaaactgcacatacacgcttacaattgttgtctaaagataatagcgttgaaacgattgaattaaaacgtggcagtaattcagtgtatgttcaatatgatgatattatgttttttgaatcatcaacaaaatctcacagactcattgcccatttagataaccgtcaaattgaattttatggtaatttaaaagaactgagtcaattagatgatcgtttctttagatgtcataatagctttgtcgtcaatcgccataatattgaatctatagattcgaaagagcgaattgtctattttaaaaataaagaacactgctatgcatcggtgagaaacgttaaaaaaata

SEQ ID NO: 232 - protein, 238 aa, Staphylococcus aureus
  MISC_FEATURE (1)..(238): accessory gene regulator A
MKIFICEDDPKQRENMVTIIKNYIMIEEKPMEIALATDNPYEVLEQAKNMNDIGCYFLDIQLSTDINGIKLGSEIRKHDPVGNIIFVTSHSELTYLTFVYKVAAMDFIFKDDPAELRTRIIDCLETAHTRLQLLSKDNSVETIELKRGSNSVYVQYDDIMFFESSTKSHRLIAHLDNRQIEFYGNLKELSQLDDRFFRCHNSFVVNRHNIESIDSKERIVYFKNKEHCYASVRNVKKI

SEQ ID NO: 233 - DNA, 105 bp, Staphylococcus aureus
atgcactgtatagctggctttttaattttattaacaaaattaaatatgacgcgtgaattaaaaaatgatgtaacgtctctttgtatacctattcctattactaca

SEQ ID NO: 234 - protein, 35 aa, Staphylococcus aureus
MHCIAGFLILLTKLNMTRELKNDVTSLCIPIPITT

SEQ ID NO: 235 - DNA, 426 bp, Staphylococcus aureus
atgaatagacaacaaaatgatctaattttgcaatttgctgcagttattatctttttcatggtaatggtctttggtttttcacttttcttagcaggacattatacacctggtggcggtttcgtcggcggattattattcgcaagttcacttgttatcattacgattgcatttgatatagaaacaatgcgtaaaattttcccattagattttaaaatcttgataggtatcggattagttttttgtattgcgacgcctatcgcaagttggtttttaggcaaaaatttctttacgcatgtcacatttgatataccgttatttatattagaacctgttcatatgacaacagcagtattctttgatttcggtgttttatgtgcagtagttggtactgtcatgacaattattatttcgattggagagaacgaa

SEQ ID NO: 236 - protein, 142 aa, Staphylococcus aureus
  MISC_FEATURE (1)..(142): Na+/H+ antiporter subunit
MNRQQNDLILQFAAVIIFFMVMVFGFSLFLAGHYTPGGGFVGGLLFASSLVIITIAFDIETMRKIFPLDFKILIGIGLVFCIATPIASWFLGKNFFTHVTFDIPLFILEPVHMTTAVFFDFGVLCAVVGTVMTIIISIGENE

SEQ ID NO: 237 - DNA, 957 bp, Staphylococcus aureus
atgagacgtctattttcaataggagaagcgttaattgattttattccaaatgttacaaatgcgaatttaaaagatgttcaaacatttacgaagcaaattggtggcgcgccatgcaatgtagcttgtacagttcaaaagttaggacaacaagcgtatatgattacacaattaggtaatgatgcatttggagatagcattattgaaacgatatcaagtattggtgtagatgtatcaaaagtgtatcgcacgaatgaagcaaacactgcgttagcttttgtgagtttgactgaagcgggcgagcgagatttttctttttatcgtaagccctctgctgatatgttatttgaaccaagttttgtgaatgatattgatgtgaatgaaaatgatgtagtacatttttgttctgttgatttggtcgatagtccgatgagagatgcacattatcaattgattaccaaaacattaaatgcaaatggtactgtcgtatttgatcctaatgtaagattgccattatgggataacgctgaagatttaagacaaactattcatacctttttgccattggcgcatattgtaaaagtttcagatgaagaattagaatttattacaggtattcatgatgaaaatgaagccattcaatcattatttacaggtaatgttactgtagtcatttatacgaagggagcagatggtgctgccgtatatttgaaaaatggtattaatcattatcatagtggctataaggtaaaacctgttgatacaactggggcaggggatgcatttattggtgcagttattagcaggattttagcaaccgatgtgttaaatttaactcagttatttgaaaatgaaggtgaggaaattttagcgtttagcaatcgcgttgctgcaatagtgacaacgaagtatggtgctattaatagtttgccaacattacaagaggttgaacaagcattt

SEQ ID NO: 238 - protein, 319 aa, Staphylococcus aureus
  MISC_FEATURE (1)..(319): hypothetical protein
MRRLFSIGEALIDFIPNVTNANLKDVQTFTKQIGGAPCNVACTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 239 - DNA, 1482 bp, Staphylococcus aureus
atgaccgaatggactagagaagaacgttatcaacgaatcgaggacgttgatactgagtattttaaaacattaaaacaacaagttgatcaatcaaaatttcgtcaacaatttcatatacaaccagaaacaggcttattaaatgaccccaacggacttattttttataaagggaagtattatgtttcacatcaatggttcccattaggcgcagtacatggcttaaagtattggtataactacacgagtgatgacttaataaactttaaagctgaagggccaattttaaatccagatactaaatatgacagccatggtgtatatagcggtagcgcttttgaatataacgggcatttatattatatgtacacaggaaatcatcgagataatcattggcaacgacatgcgagtcagatgatcgcacgattgaaagaagacggttcagttgaaaagtttccaaagccagtaattagccaacaaccagaaggatatacgagtcattttagagatcctaaagtttttaaatatgatgagaaatattatgcaatcattggtgcacaaaataatgatcagcaaggtcgattattactttataatactgaagatataattaattggcattatttaggtgaaataaatacagagttggatgattttggatatatgtgggaatgcccagattactttaatgtagataatcaagatgtcatacttatttgtccacaaggtattgaaccaaaaggcgatcagttcaaaaatatttatcaaagtggttatatacttggaaagtttgatattgaaaagttaacatatgaacatgaaaattttgtcgagcttgataatggttttgatttctatgcacctcaaacatttttagatgaaaaaggccgacgagtactaattggatggatggggttaccggaaatcgaatatcctactgataatgaaggatgggcccattgcttaacaattcctcgtgtattaaatgtagaaaatggtcaacttaagcaacgtccatatccagcgttggaaaaattacgtcacaataaagagacagcattaggctacgcaaataaatttactcgaaaattacatccgtatgaaggtaaacagtatgaattaatcatagatattttggataatgatgctaccgaagtgtactttgaattacgtacatctaagacttcttcaacattaattgcttataacaagcgtgaaaataaaataacattagatcgcagcgacagtggtttattgccgacaaatgttgaaggtacgacgcgtagtacgatattagacacgccattaaagcaattacaaatttttgttgatacatctagtatagaaattttctgtaatgatggagaacgtgttttgacatctcgaattttcccgacagaagacgcactaggtattaaaacatcaacagaatcagggcaagtatatttacaatttactaaatatgatttaaaggatgaacataaa

SEQ ID NO: 240 - protein, 494 aa, Staphylococcus aureus
  MISC_FEATURE (1)..(494): sucrose-6-phosphate
MTEWTREERYQRIEDVDTEYFKTLKQQVDQSKFRQQFHIQPETGLLNDPNGLIFYKGKYYVSHQWFPLGAVHGLKYWYNYTSDDLINFKAEGPILNPDTKYDSHGVYSGSAFEYNGHLYYMYTGNHRDNHWQRHASQMIARLKEDGSVEKFPKPVISQQPEGYTSHFRDPKVFKYDEKYYAIIGAQNNDQQGRLLLYNTEDIINWHYLGEINTELDDFGYMWECPDYFNVDNQDVILICPQGIEPKGDQFKNIYQSGYILGKFDIEKLTYEHENFVELDNGFDFYAPQTFLDEKGRRVLIGWMGLPEIEYPTDNEGWAHCLTIPRVLNVENGQLKQRPYPALEKLRHNKETALGYANKFTRKLHPYEGKQYELIIDILDNDATEVYFELRTSKTSSTLIAYNKRENKITLDRSDSGLLPTNVEGTTRSTILDTPLKQLQIFVDTSSIEIFCNDGERVLTSRIFPTEDALGIKTSTESGQVYLQFTKYDLKDEHK

SEQ ID NO: 241 - DNA, 948 bp, Staphylococcus aureus
atgaaaaatatatctgatattgccaaattggcaggcgtttcaaaaagtacagtatctagatttttaaataatggatctgtcagtaaaaaaacaagtgaaaaattaacaagaattatagcagaacatgactatcaaccgaatcaatttgctcaaagtttaagagcgagacaaacacaccttattggtgccattatacctagaatgaattcatatgcagtagatgaaacaatcaaaggattggcaaaacaatgccaaaaatatgaatcacaattaattttaaattacacaggtttaaatatcgaagcagaaatacaagcgcttgaaacattagcacgcagtaaagtagatggtattgttttaatggctacagacataacagagagacatattgaagtcattaataaaatgaatgtaccaatcgttattgttggtcaacaacatgaacaacttcatagtattgtgcatgatgattataaagcaggtcaaattataggcgaatggattggtcaacagggatatcaacaagttgaagtgtttagtgtaagtgaaaaagatattgcagttggtatacatagaaaacgtggtttacttgaccagttagctaaataccaaattaaacctaatatacatgaaacaaattttacttatgtggaagcacaaaaagatgttgcaaatgttttggaaaatgtggagcaagtagatgcggttgttggagcaactgatacgattgcattagctgcctataaatattattctgataaaaaagatgttatgaaaccacatcaaatatatggttttggtggtgacccaatgacacaattagtgtctccatcgataaaaacaattcattataattattttgaagctggccaatgcgcgatggaagagatacaacagatgcttaaaaagcaagatatgccatatagcgtcacagtagatgttaatatt

SEQ ID NO: 242 - protein, 316 aa, Staphylococcus aureus
  MISC_FEATURE (1)..(316): sucrose operon repressor
MKNISDIAKLAGVSKSTVSRFLNNGSVSKKTSEKLTRIIAEHDYQPNQFAQSLRARQTHLIGAIIPRMNSYAVDETIKGLAKQCQKYESQLILNYTGLNIEAEIQALETLARSKVDGIVLMATDITERHIEVINKMNVPIVIVGQQHEQLHSIVHDDYKAGQIIGEWIGQQGYQQVEVFSVSEKDIAVGIHRKRGLLDQLAKYQIKPNIHETNFTYVEAQKDVANVLENVEQVDAVVGATDTIALAAYKYYSDKKDVMKPHQIYGFGGDPMTQLVSPSIKTIHYNYFEAGQCAMEEIQQMLKKQDMPYSVTVDVNI

SEQ ID NO: 243 - DNA, 1284 bp, Staphylococcus aureus
ttgtcagattattatgaaaaaaagggagtggtaagtatgaatcttaacgatacgatatttatgtttttgtgtacattattagtttggttaatgacaccaggattaagtttattttatggtgggttagttcaatctaaaaatgcgcttaatactgtcatgcaaagtatggcagcaattgtgcttgttacatttgtatggataacagttggttttacaattagttttgggaatgggaatttatggttcggaaattgggaatatacttttcttaatcatgtaggttttgcgactcaagaagatattagcccacatattcctttcgctttgtttatgttatttcaaatgatgttttgtacgattgcaatttctattttatctggttcaatcgctgagaaaatgaagtttattccttatttattattcgtagtaatatggactgctcttgtatacagtccagtagcacattgggtttggggcggcggttggattaacaaactcggtgtattagatttcgctggaggtacggttgttcatattacatcaggtgtttctggtttagtattagctattatgattggaaaaggaaacaaacattctgaatcaacaccacataatcttatcattacgttgattggcggtatattcgtgtggattggttggtatggatttaatgtaggtagtgcttttacatttgataatattgcgatgcttgcatttacaaatactgtcatttcagccagtgcaggtgctataggttggttaattttagaatatatttttaaaaagacgacaagtttacttggacttttactcggtgcattagcaggattagttgtcattactcctgcagcaggatatgtaacatatcttagtgcaacaataatggctttaataggaggtatctgttgttatattgtcattaattacatcaaggtaaaactaaaatatcatgatgcattagatgcatttggtattcatggtgttggtggtattattggtgctgttttaacagcagttttccaaagtaaaaaagccaatcctgacattgagaatggctttatttatactggtgacatacatattatacttgtacaaatattatgtgtaacagcagttgtaatttttagtatagtcatgacgtttattattgcgaaagtaattaaattaattacaccattatctgttacggaacaagaaacgaatataggattagacaagattgttcacggtgaacatgcttactttgaaggtgagctaaatagattcaataaacatattcgatat

SEQ ID NO: 244 - protein, 428 aa, Staphylococcus aureus
  MISC_FEATURE (1)..(428): probabale ammonium
LSDYYEKKGVVSMNLNDTIFMFLCTLLVWLMTPGLSLFYGGLVQSKNALNTVMQSMAAIVLVTFVWITVGFTISFGNGNLWFGNWEYTFLNHVGFATQEDISPHIPFALFMLFQMMFCTIAISILSGSIAEKMKFIPYLLFVVIWTALVYSPVAHWVWGGGWINKLGVLDFAGGTVVHITSGVSGLVLAIMIGKGNKHSESTPHNLIITLIGGIFVWIGWYGFNVGSAFTFDNIAMLAFTNTVISASAGAIGWLILEYIFKKTTSLLGLLLGALAGLVVITPAAGYVTYLSATIMALIGGICCYIVINYIKVKLKYHDALDAFGIHGVGGIIGAVLTAVFQSKKANPDIENGFIYTGDIHIILVQILCVTAVVIFSIVMTFIIAKVIKLITPLSVTEQETNIGLDKIVHGEHAYFEGELNRFNKHIRY

SEQ ID NO: 245 - DNA, 246 bp, Staphylococcus aureus
gtgattggaaaaggagaaataattatgatacacgaattaggtacagtaggaatggtatgtccatttccgttaattgaagcgcaaaagaaaatggcaacattgcaatctggagatgaattaaaaattgattttgattgcacgcaagcgacggaagccattccaaattgggctgcagaaaatggttatcctgtaacaaactatgaacaaattgataatgcttcatggacaattacaattcaaaaagtt

SEQ ID NO: 246 - protein, 82 aa, Staphylococcus aureus
  MISC_FEATURE (1)..(82): conserved hypothetical
VIGKGEIIMIHELGTVGMVCPFPLIEAQKKMATLQSGDELKIDFDCTQATEAIPNWAAENGYPVTNYEQIDNASWTITIQKV

SEQ ID NO: 247 - DNA, 1077 bp, Staphylococcus aureus
atgtggatgatttttagtggcttaattgtcgggggactcttaggttttgtcatgcaaagaacaagattttgtttaacaggtggctttcgagatatgtatgtgcaaaagaataataagatgttctatgcattattaatcgctattactattcaaagtataggattattgattttgacggcaacagatattttacaaattcctgcacatagttttccaatattgggaacaattataggttcttttatttttggaattggaatagtattggctggaggatgtgcaacaggtacttggtatcgcgctggtgaagggctaattggtagttggattgcattagtattatatgctgttactgcagcaatcactaaaacagggattttaaagccagtaatggataaaattaatcaaccaacgaatgtaaatagtgatatgtctcaaacaactggcattccgttttggggattagtcgttatattaactataatcaccatttttctagttgtaagaacactcaataataagaaagttcgagttgctgttccaaaactaaagcaacgttatacaggtattagatattaccttttcgaaaaacgataccatccatttattgcagcaattgtaattggacttatcgcactcttagcttggccaatgagtgcatcaactggaagaaatgacggtttaggtataacaacgccttcagcaaatttagtacactttttgattacaggtgaaactaaatttattgattggggtgtctttttagttctaggaattttcattggttcatatattgcagctagaggatcaagagaatttaaatggcgattgccagacaagattacaatacgaaacagtgccattggtggcatatgtatgggatttggtgcgtcagttgctggtggttgttctatcggtaacggtttggttgaaacggcaacgatgacttggcaaggatggattgcgctagcatcgatgatagttggtgtatggacaatgagtcattttatctttgttcgtccaatgaaaaaagtacaccaacaatctgcaaaggttaaacagcaaacgcaaatagta

SEQ ID NO: 248 - protein, 359 aa, Staphylococcus aureus
  MISC_FEATURE (1)..(359): conserved hypothetical
MWMIFSGLIVGGLLGFVMQRTRFCLTGGFRDMYVQKNNKMFYALLIAITIQSIGLLILTATDILQIPAHSFPILGTIIGSFIFGIGIVLAGGCATGTWYRAGEGLIGSWIALVLYAVTAAITKTGILKPVMDKINQPTNVNSDMSQTTGIPFWGLVVILTIITIFLVVRTLNNKKVRVAVPKLKQRYTGIRYYLFEKRYHPFIAAIVIGLIALLAWPMSASTGRNDGLGITTPSANLVHFLITGETKFIDWGVFLVLGIFIGSYIAARGSREFKWRLPDKITIRNSAIGGICMGFGASVAGGCSIGNGLVETATMTWQGWIALASMIVGVWTMSHFIFVRPMKKVHQQSAKVKQQTQIV

SEQ ID NO: 249 - DNA, 633 bp, Staphylococcus aureus
atgagtgaccaagttaaaattcctcgagcaactttaaaacgtttgccgttatattatagatttgtcagttcattaaaatctaaaggtatagatcgtgtaaattcaaaagcgattagcgatgcgttacaaattgactcggcaacaattcgtcgtgacttttcatattttggcgaattaggtaaaaaagggtacggatataatatagatagtttattggatttctttaaatctgaactaagcgagagtgacatgatcaaaatcgcaattgtcggagttgggaacctagggaaagctttgctcacatataacttttcaatacatgacgatatgacgattacagaagcgtttgacgtaaaagaagatgttattggccagaaaatagggaacgttattgttaaagataacgatgaattaataacaacattgaagaaggaagaaatagatgttgtgattctaactacaccagaaagagttgcacagaaagttgcagatgaactcgtccaagctggtgtgaaaggtattttaaacttcactcctggtagaattaatacgccttcagatgtgcaagtacatcaaattgacttaggtatagaattacagtcattattattctttatgaaaaattacagtgaa

SEQ ID NO: 250 - protein, 211 aa, Staphylococcus aureus
  MISC_FEATURE (1)..(211): conserved hypothetical
MSDQVKIPRATLKRLPLYYRFVSSLKSKGIDRVNSKAISDALQIDSATIRRDFSYFGELGKKGYGYNIDSLLDFFKSELSESDMIKIAIVGVGNLGKALLTYNFSIHDDMTITEAFDVKEDVIGQKIGNVIVKDNDELITTLKKEEIDVVILTTPERVAQKVADELVQAGVKGILNFTPGRINTPSDVQVHQIDLGIELQSLLFFMKNYSE

SEQ ID NO: 251 - DNA, 1953 bp, Staphylococcus aureus
ttgagaaagacgaaaggtgaagatcgaatgatacttttacaactcaatcatatatcaaaatcgttcgatggtgaagatatatttactgatgttgattttgaagtaaaaactggtgaacgaattggtatcgtaggaagaaatggcgccggtaaatcaacattgatgaaaattatagctggcgtagaaaactatgattctggaaatgtgtcaaaaattaaaaacttaaaactaggttatttaactcaacaaatgactttaaattctaatgcaacagtttttgaagaaatgtcaaaaccatttgaacatattaaacgaatggaaagcttaatcaaagaagaaacagattggttatcaaaacatgcaaatgattacgatagtgatacatataaaacacatatgtcccgttatgaatctttatcgaatcaatttgaacaattagaaggatatcaatatgaaagtaaaattaaaacagtactttacgggttaaattttagtgaagaagatttcaataaacctatcaatgattttagcggtggccaaaaaacacgtttatctttagctcaaatgctattaaacgaacctgatttattacttttagatgaacctactaaccacttagatttagaaacgacaaagtggcttgaagattatctacgttattttaaaggtgcaatcgtcatcatcagccatgatcgttactttttagataaaatagttactcaaatttatgatgtggctttaggtgatgtcaaacgctatgttggtaattacgaggaatttatacagcaacgggatttatattatcaaaaacgaatgcaagaatatgaaagtcaacaagcagaaataaaacgattagaaacttttgttgagaaaaatattacccgtgcttcaacaagtggaatggcaaaaagtagacgtaagattttagaaaaaatggaacgcattgataaaccaatgttagatgccaaaagtgcaaatattcaatttggctttgaccggaatacaggtaatgacgtcatgcatgtaaaaaatttagaaatcggttatcaaactgcaattaccaaacctatgagtatagaggtctctaaaggcgatcatatagcaatcattgggccaaatggtattggaaaatcgaccttaattaaaactattgctaatcaacaaaaagcgcttaatggcgatattactttcggcgcaaatttacaaattggttattatgatcaaaagcaagcagaatttaaatctagtaaaacgattttagattatgtgtgggatcaatatccgttaatgaatgaaaaagatattcgagcagttcttggacgtttcttatttgtacaagacgatgttaaaaagataattaatgatttatctggtggtgaaaaagcacgtttacaactagcactacttatgttgcaacgtgacaatgtacttattttagatgaacctaccaaccacctcgatatagattcaaaagaaatgttagagcaagcactccaacattttgaaggaacaatactatttgtttcccatgatcgttactttattaaccaattagcaaacaaggtatttgatttaacaattgatggcggaaagatgtatttaggagattatcaatattacattgaaaaagttgaggaagcggaagcgttgaaagcgcaccaagaagaacagtcagttaacgtacaagcacataaaaagtctatggaacaatcgtcgtatcataaccaaaaagaacaaagacgtgaacaacgcaaacttgaacgacaaatatccgagtgtgaaaatgaaatagaaactttagagactactatcttacaaatagacgagcaattaacccaaccagaagtgtataacaatccacaaaaagcaaacgaattagctatccaaaaacaagatagcgaacaaaaattagaacacgctatgtctaaatgggaagaattacaacaaaaacta

SEQ ID NO: 252 - protein, 651 aa, Staphylococcus aureus
  MISC_FEATURE (1)..(651): hypothetical ABC
LRKTKGEDRMILLQLNHISKSFDGEDIFTDVDFEVKTGERIGIVGRNGAGKSTLMKIIAGVENYDSGNVSKIKNLKLGYLTQQMTLNSNATVFEEMSKPFEHIKRMESLIKEETDWLSKHANDYDSDTYKTHMSRYESLSNQFEQLEGYQYESKIKTVLYGLNFSEEDFNKPINDFSGGQKTRLSLAQMLLNEPDLLLLDEPTNHLDLETTKWLEDYLRYFKGAIVIISHDRYFLDKIVTQIYDVALGDVKRYVGNYEEFIQQRDLYYQKRMQEYESQQAEIKRLETFVEKNITRASTSGMAKSRRKILEKMERIDKPMLDAKSANIQFGFDRNTGNDVMHVKNLEIGYQTAITKPMSIEVSKGDHIAIIGPNGIGKSTLIKTIANQQKALNGDITFGANLQIGYYDQKQAEFKSSKTILDYVWDQYPLMNEKDIRAVLGRFLFVQDDVKKIINDLSGGEKARLQLALLMLQRDNVLILDEPTNHLDIDSKEMLEQALQHFEGTILFVSHDRYFINQLANKVFDLTIDGGKMYLGDYQYYIEKVEEAEALKAHQEEQSVNVQAHKKSMEQSSYHNQKEQRREQRKLERQISECENEIETLETTILQIDEQLTQPEVYNNPQKANELAIQKQDSEQKLEHAMSKWEELQQKL

SEQ ID NO: 253 - DNA, 1608 bp, Staphylococcus aureus
atgagcacaaatcaaacatttttaatatttgttatagcaattattctacttacatctgtaataggaattgttggacgatacatgagtcgtcaacgtctattaaaatctatggaaacattatggcaaacgatttctccattagaagcttttatcagaccgaactcacatttcgactatgagtataagctctacaaggaaaaatttgaatcacattcattagttgatgataaaacttggtccgacttaaatatgaatgcaatctttcataagatgaattataatttaacagctattggtgaaatgaagctatatgcctgtttacgtggaatgctttcaattacgaacaaatcattacttagtttatttaatgataatgctgaatttagaaaaaacgtaacatatcatttagctttgattggtaaaactgtttatccaacatttccagaccaaatcacaccggtaaaacgtcaaaatatattgtttctatgcccgtttttaccagttatctcatttgcagttatatttattaattcacaagttggtattttattatttcttatgagttgcctatttaatatcattttatcagcaactttaaagcgtacatatgaggatgacttaaaatctatcttttatgcatccaatgttttaaaacaaggctatactatctcaaaaattaaacatgctccacaacctgaagtcaattttaagcaatttagaacagcacgtcatttaacgagtgttttagctgaagttaatgatgaagatatcggagctatggtaattaaactagttaaacttattttcatgcttgattatgttttatttcattcaattcaaaaaagctatacaacacatatgaatgagcttaaaaattgtttcgattacatagctgaattagataatcattatgcattagcaatgtatcgtagaacgctagaatgttatactgaaccacaaattgatgattcaaatgatggcatagtattctctgagttaacacatccactcatagcagatgcagtagccaatgatttctcactatcacaaaatatactgttaactgggtctaatgcttcgggtaaatcaacatttatgaaatccatagcaataaacattattcttgcatcggctatacaaacagttaccgcaagcaaatttgtatatcaacctggaattgtgttcacgtcaatggcaaatgccgatgatgtgttatcaggcgatagttattttatggctgaattaaaatctattaagcgtattgttgaaattccagataatcaaaaaatatactgctttatagatgaaatttttaaaggtaccaacacaactgaacgaattgccgcttcagaatcagtactatcatttttacatgaaaaatctaactttagagttattgcagcaacacatgatattgagttagctgaactcttaaaacaacgttatgaaaattaccatttcaatgaggtaatagaaaataataacatacattttgattacaaaattaagcctggcaaagcaaatacacgtaatgccatcgaattattaaaaatcacttcatttccagcaaaaatatatgaacgagcaaaagataatgtcccgaaaatt

SEQ ID NO: 254 - protein, 536 aa, Staphylococcus aureus
  MISC_FEATURE (1)..(536): hypothetical protein
MSTNQTFLIFVIAIILLTSVIGIVGRYMSRQRLLKSMETLWQTISPLEAFIRPNSHFDYEYKLYKEKFESHSLVDDKTWSDLNMNAIFHKMNYNLTAIGEMKLYACLRGMLSITNKSLLSLFNDNAEFRKNVTYHLALIGKTVYPTFPDQITPVKRQNILFLCPFLPVISFAVIFINSQVGILLFLMSCLFNIILSATLKRTYEDDLKSIFYASNVLKQGYTISKIKHAPQPEVNFKQFRTARHLTSVLAEVNDEDIGAMVIKLVKLIFMLDYVLFHSIQKSYTTHMNELKNCFDYIAELDNHYALAMYRRTLECYTEPQIDDSNDGIVFSELTHPLIADAVANDFSLSQNILLTGSNASGKSTFMKSIAINIILASAIQTVTASKFVYQPGIVFTSMANADDVLSGDSYFMAELKSIKRIVEIPDNQKIYCFIDEIFKGTNTTERIAASESVLSFLHEKSNFRVIAATHDIELAELLKQRYENYHFNEVIENNNIHFDYKIKPGKANTRNAIELLKITSFPAKIYERAKDNVPKI

SEQ ID NO: 255 - DNA, 1023 bp, Staphylococcus aureus
atgactaaagatatattaatactagctgttgaaacaagttgtgatgaaacaagcgttagtgttataaaaaatggcagagatattttatcaaatacagttttaagtcagattgaaagtcataaacgatttggcggtgtcgttcccgaagtggcaagtagacatcacgttgaaggtataacagcaacaataaacgaggctctaggggatgccgatgtatcaatagaagatattgatgccatagcggttacagaaggccctggactaattggtgcgttactaataggtgttaatgcagccaaagcattggcatttgcttacgataagccacttattcctgttcatcatattgcaggacatatatatgctaatcacatagaagagccattaacattcccgctaattgcacttattgtttcaggtggacatactgaattagtttatatgaaggatcatttatcatttgaagtcattggtgaaacacgagatgacgcagtaggtgaggcttatgataaagtggcacgaacaattggtttaaattatccaggtggtccacaagttgatcggttggctgctgaaggtgaagatacttattcattccctcgtgtttggttggataaagatagttatgattttagttttagtgggttgaaaagtgccgtaatcaatcaacttcacaatcaacgacaaaaaaatattccaatcattgaagctaacgtagcaacgagctttcaaaacagtgttgtagaggtgctcacgtttaaagctattcaagcttgtaaagaatatggtgttcagcgattaattgttgctggtggcgtggcgagtaataaaggattacgtcaatctttagcggatcaatgcaaagtcaatgacattcaattaactatcccaagtcctaaattatgcacagataatgctgcaatgataggcgttgccggccactatttgtatcagcaaggtcgatttgctgatttagcattaaatgggcacagcaatatagatttagaagagtattctgcagaa

SEQ ID NO: 256 - protein, 341 aa, Staphylococcus aureus
  MISC_FEATURE (1)..(341): hypothetical protein
MTKDILILAVETSCDETSVSVIKNGRDILSNTVLSQIESHKRFGGVVPEVASRHHVEGITATINEALGDADVSIEDIDAIAVTEGPGLIGALLIGVNAAKALAFAYDKPLIPVHHIAGHIYANHIEEPLTFPLIALIVSGGHTELVYMKDHLSFEVIGETRDDAVGEAYDKVARTIGLNYPGGPQVDRLAAEGEDTYSFPRVWLDKDSYDFSFSGLKSAVINQLHNQRQKNIPIIEANVATSFQNSVVEVLTFKAIQACKEYGVQRLIVAGGVASNKGLRQSLADQCKVNDIQLTIPSPKLCTDNAAMIGVAGHYLYQQGRFADLALNGHSNIDLEEYSAE

SEQ ID NO: 257 - DNA, 2403 bp, Staphylococcus aureus
gtgagtttgttacatattgcggtgatattaccgttaatattcgcactcattattcctatcctgtatagattttttaaacgtatacatttaggatggttcgtattacctgtccctatcgtcatatttatttatatgcttacattaattaaaacgacgatgtcaggtaatactgtaatgaaaaccttaaattggatgcctcattttggtatgaactttgatttatatcttgatggcttaggtttactctttagtttgcttatttcaggaatcggcagtttagtagtattatattcaatcggctacttaagtaagtcagaacaactagggaatttttattgttatttattactatttatgggtgcaatgttaggtgtcgtactttcagataatgttattattctatatttattctgggagctaacgtcattttctagttttttacttatttcattctggcgcgaacgacaagcatctatatatggtgctcaaaaatcgctcataatcacagtatttggtggtctatcattattaggtggtatcatcttactcgctataccaacacaatcatttagcattcagtacatgattcaacatgcttctgaaattcaaaatagcccattcttcatttttgcgatgattttaatcatgattggtgcttttacaaaatctgctcagtttccattttatatttggctaccagatgcaatggaagcacctacaccagtcagtgcttatcttcattcagcaacaatggttaaagcagggttatatttaatcgctcgaatgacaccaatcttcgcagcatcgcaaggttgggtatggactgtcacactcgttggtttaattacattattctgggcttcgctaaacgcaacaaaacaacaagacttgaaaggtatactggcattttcaacagtatcccaattaggtatgattatggcgatgcttggaatcggtgccattagttatcactatcaaggcgatgatagcaaaatatatgctgctgcatttacggctgcaatattccatttaatcaaccatgcaacatttaaaggtgccctatttatgattacaggtgcagtggatcattctactggtacacgtgatgttaagaaattaggtggcttactaacaattatgcctatttcatttacaatcactgttattacagcattaagtatggctggtgtaccaccgttcaatggtttcttatcaaaagaatcatttttagaaacaacatttacagcaagccaagcaaatttattcagtgttgatacattaggctacctattcccaatcattggtatagtgggcagtgtcttcacatttgtatattcaattaaatttataatgcatatatttttcggacaatataaacctgaacaattacctaaaaaagcacacgaagtatcaatattaatgcttttatcaccagctattttagctacattagtaattgtatttggtttattccctggcattttaactaattcgattattgaaccagctacatcttcgattaatcatacggtaattgatgatgttgaattccatatgttccatggattaacgcctgcctttttatcaacattagtgatttatattttaggtatcttactaattgtgacatttagttattgggtgaaattgttgcaacgacaacctggtaaactaacattcaattattggtacaacagaagtgcaaatgttattccaaactactctgaaaagatgacgaatagctatgttaccgattattcacgtaataatttagttatcatttttggtgcattaattttattaacatttgtcactatattctcagtacctttcaacattaattttaaagacgttagtccgattagaattttcgaagtttgtatcgtaattttattattaagtgctgcctttttaattcttttcgctaaatcaagattatttagcatcattatgttaagtgcagttggatatgctgtgtctgtattgtttatattctttaaagcacccgacttagcattgacacagtttgtcgttgaatctatttcaacagcattgttcttattatgcttctaccacttaccaaatttaaatcgttataatgaaaagcgctcattccagcttactaatgctttaattgctggtggtgttggtttgtccgtcattattatcggtttaattgcatacggaaatagacattttgaatcgatatctaagttttatcaagagcacgtttatgatttagctcacggtaaaaacatggtaaacgtcatacttgttgatttccgtggtatggatactttattcgagtcatctgtgcttggtatcgcaggattagctgtatatacaatgattaaattacgtaaaaagcgtcaaacgcaaggtaacgaggtgaaaaatcatgaa

SEQ ID NO: 258 - protein, 801 aa, Staphylococcus aureus
  MISC_FEATURE (1)..(801): Na+/H+ antiporter subunit
VSLLHIAVILPLIFALIIPILYRFFKRIHLGWFVLPVPIVIFIYMLTLIKTTMSGNTVMKTLNWMPHFGMNFDLYLDGLGLLFSLLISGIGSLVVLYSIGYLSKSEQLGNFYCYLLLFMGAMLGVVLSDNVIILYLFWELTSFSSFLLISFWRERQASIYGAQKSLIITVFGGLSLLGGIILLAIPTQSFSIQYMIQHASEIQNSPFFIFAMILIMIGAFTKSAQFPFYIWLPDAMEAPTPVSAYLHSATMVKAGLYLIARMTPIFAASQGWVWTVTLVGLITLFWASLNATKQQDLKGILAFSTVSQLGMIMAMLGIGAISYHYQGDDSKIYAAAFTAAIFHLINHATFKGALFMITGAVDHSTGTRDVKKLGGLLTIMPISFTITVITALSMAGVPPFNGFLSKESFLETTFTASQANLFSVDTLGYLFPIIGIVGSVFTFVYSIKFIMHIFFGQYKPEQLPKKAHEVSILMLLSPAILATLVIVFGLFPGILTNSIIEPATSSINHTVIDDVEFHMFHGLTPAFLSTLVIYILGILLIVTFSYWVKLLQRQPGKLTFNYWYNRSANVIPNYSEKMTNSYVTDYSRNNLVIIFGALILLTFVTIFSVPFNINFKDVSPIRIFEVCIVILLLSAAFLILFAKSRLFSIIMLSAVGYAVSVLFIFFKAPDLALTQFVVESISTALFLLCFYHLPNLNRYNEKRSFQLTNALIAGGVGLSVIIIGLIAYGNRHFESISKFYQEHVYDLAHGKNMVNVILVDFRGMDTLFESSVLGIAGLAVYTMIKLRKKRQTQGNEVKNHE

SEQ ID NO: 259 - DNA, 462 bp, Staphylococcus aureus
ttggatcaacagtcaaaagaacaattaaacattagagagatgactaaagaagatgtgccacaagtctttgatcttgagcgtcggagtttcaatgacagttcttggacaattgacgcattttatcatgaaatagagcaaaataactttgcgaaatattttgtcttagaatttgaacaacaaattattggttatttaggtttatggattgttatcgatcaagctcaaattacaacagttgcaatcgatgataattatagaggctatggtttaggtcaaatgcttttaaaatacggaataaactatgcaagtcacacttgtgatgtgatgagtttagaagtaagagttaataataaagtggcacaacatgtatatgaaaatttaggatttcaatatggtggtaaacgtaaaaattattatggtgaaggtgaggacgcaatggttatgtgggtgaatttaaatgac

SEQ ID NO: 260 - protein, 154 aa, Staphylococcus aureus
  MISC_FEATURE (1)..(154): hypothetical protein
LDQQSKEQLNIREMTKEDVPQVFDLERRSFNDSSWTIDAFYHEIEQNNFAKYFVLEFEQQIIGYLGLWIVIDQAQITTVAIDDNYRGYGLGQMLLKYGINYASHTCDVMSLEVRVNNKVAQHVYENLGFQYGGKRKNYYGEGEDAMVMWVNLND

SEQ ID NO: 261 - DNA, 687 bp, Staphylococcus aureus
atgaacaaattaaggaggcaattatccatgaattcgctgctcattgatacatcgaatcaaccattatcagtagcattgatgcaaaacgatgaagttttagctgaaataactacggattctaaacaaaatcattcagtgcaattaatgcctgcgattagtcagctatttgagcagagcaaaatagctaaacagcaattagatgcgattattgttgctgaaggtcctggttcatatactggcttacgtatcggtgttactgttgctaaaacattagcgtatgcgttagatgttaaattatatggtgtttcatcattaaaggcattggcagcaacaatcgatcatactgataaattattggttcctgtgtttgatgcaagacgacaagcagtttatacaggcatattccagtggcaaaatggtcaattagtgactattttagaagatcaatatatgtcgatagaggcattgcgagcttttttagaagatttaaaccaaccatttatttatattgggaaagatactgtaaaattacaagatgaattacaaggtgaagtgattgcgcagctaccaaatgcatcagtcatgtatcaattgctagataaaccttcagacgtacatacatttactcctaaataccataaattagctgaggcggaacgaaattggatcaacagtcaaaagaacaat

SEQ ID NO: 262 - protein, 229 aa, Staphylococcus aureus
  MISC_FEATURE (1)..(229): hypothetical protein
MNKLRRQLSMNSLLIDTSNQPLSVALMQNDEVLAEITTDSKQNHSVQLMPAISQLFEQSKIAKQQLDAIIVAEGPGSYTGLRIGVTVAKTLAYALDVKLYGVSSLKALAATIDHTDKLLVPVFDARRQAVYTGIFQWQNGQLVTILEDQYMSIEALRAFLEDLNQPFIYIGKDTVKLQDELQGEVIAQLPNASVMYQLLDKPSDVHTFTPKYHKLAEAERNWINSQKNN

SEQ ID NO: 263 - DNA, 492 bp, Staphylococcus aureus
atgaatgaaaagcataatataggagaatcaacattgataaagataaataatttagatgaaatgaatcaatttgctatatttttagttgagcaattgaaaagtggtgatttgattttacttaacggagatttaggagcaggtaaaacaacgttaacgcaatttataggaaaagctcttggtgtaagacgtacgattaattccccgacatttaacatcattaaatcatataggggtaaaaatttaaaattgcatcatatggattgttatcgcttagaagattctgatgaagatttaggatttgatgaatttttcgaagatcaggcaattactgttattgaatggagtcaatttataaaagatttacttccagcgacgcatttatctattaacatttcaacaatatctgaaaatacaagacaaattgagttgttcgcgcaaggagaacattatgaacaaattaaggaggcaattatccatgaattcgctgctcat

SEQ ID NO: 264 - protein, 164 aa, Staphylococcus aureus
  MISC_FEATURE (1)..(164): conserved hypothetical
MNEKHNIGESTLIKINNLDEMNQFAIFLVEQLKSGDLILLNGDLGAGKTTLTQFIGKALGVRRTINSPTFNIIKSYRGKNLKLHHMDCYRLEDSDEDLGFDEFFEDQAITVIEWSQFIKDLLPATHLSINISTISENTRQIELFAQGEHYEQIKEAIIHEFAAH

SEQ ID NO: 265 - DNA, 1686 bp, Staphylococcus aureus
atgcgaagcgacatgatcaaaaaaggagatcaccaagcaccagcaagaagtcttttacatgccacgggcgcgctaaaaagtccaactgatatgaacaaaccatttgtagctatttgtaactcttatattgatattgttcctggacatgttcacttgagagagcttgcagatatagctaaagaagcaattagagaagccggtgccattccatttgaattcaatacaattggtgttgatgatggaatagctatgggacatatcggaatgcgatattctctaccatcacgtgaaattattgcagatgcagctgaaactgtaattaacgctcattggtttgacggcgtattttacattcctaattgtgacaagattacacccggtatgattttagcagccatgaggacaaacgtaccagctatcttttgctctggtggaccaatgaaagctggcttatctgcacatggaaaagcattaacactttcatcaatgtttgaagcagtcggcgcatttaaagaaggatcgatttctaaagaagaatttttagatatggaacaaaatgcctgccctacttgtggttcatgtgctgggatgtttactgcaaattcaatgaactgtttgatggaagttttaggtctagcattaccatacaacggtactgcacttgcagtcagtgatcagcgacgagaaatgattcgccaagcagcttttaaattagttgaaaatattaaaaatgatttaaaaccacgtgatatcgttactcgcgaagcaattgatgatgcatttgcacttgatatggctatgggtggttcaacaaacacggtactgcatacgttagccattgccaatgaagctggtattgattatgacttagagcgcattaatgctattgccaaacgcacgccatatttatcaaaaatagcacctagttcatcgtattcaatgcatgatgtgcatgaagctggtggcgtcccagcaattattaatgaattgatgaagaaagatggcacgttacacccagatagaatcacagttactggcaaaacgttacgtgaaaataacgaaggcaaagaaattaagaactttgatgtcattcaccctcttgatgcaccatatgatgcacaaggcggtttatctatcttatttggtaatatcgcccctaaaggcgcagttattaaagttggcggcgttgatccatctatcaaaacatttactgggaaagcaatttgtttcaattcgcatgatgaagctgttgaagcaatagacaatcgtaccgttcgtgcaggccacgtcgttgtcattagatatgaaggacctaaaggtggaccaggtatgcctgaaatgttagcacctacttcctctattgttggtcgcggcttaggtaaagatgttgcattaattactgatgggcgtttttccggtgccacaagaggtattgcagttggtcatatttcccctgaagctgcatctggtggaccaattgccttaattgaagatggtgatgagattactattgatttaacaaatcgtacattaaacgtaaaccagcctgaagatgttctagcgcgtcgccgagaatctttaacaccatttaaagcgaaagtaaaaacaggttatctagctcgttatactgccctagtaactagcgcaaatacaggtggcgtcatgcaagtccctgagaatttaatt

SEQ ID NO: 266 - protein, 562 aa, Staphylococcus aureus
  MISC_FEATURE (1)..(562): dihydroxy-acid dehydratase
MRSDMIKKGDHQAPARSLLHATGALKSPTDMNKPFVAICNSYIDIVPGHVHLRELADIAKEAIREAGAIPFEFNTIGVDDGIAMGHIGMRYSLPSREIIADAAETVINAHWFDGVFYIPNCDKITPGMILAAMRTNVPAIFCSGGPMKAGLSAHGKALTLSSMFEAVGAFKEGSISKEEFLDMEQNACPTCGSCAGMFTANSMNCLMEVLGLALPYNGTALAVSDQRREMIRQAAFKLVENIKNDLKPRDIVTREAIDDAFALDMAMGGSTNTVLHTLAIANEAGIDYDLERINAIAKRTPYLSKIAPSSSYSMHDVHEAGGVPAIINELMKKDGTLHPDRITVTGKTLRENNEGKEIKNFDVIHPLDAPYDAQGGLSILFGNIAPKGAVIKVGGVDPSIKTFTGKAICFNSHDEAVEAIDNRTVRAGHVVVIRYEGPKGGPGMPEMLAPTSSIVGRGLGKDVALITDGRFSGATRGIAVGHISPEAASGGPIALIEDGDEITIDLTNRTLNVNQPEDVLARRRESLTPFKAKVKTGYLARYTALVTSANTGGVMQVPENLI

SEQ ID NO: 267 - DNA, 1782 bp, Staphylococcus aureus
ttggagatggttaaaatgtctaaaactcaacatgaagtaaaccaaaatattgaccctttaaaaatggctgaatcacttgaacctgaacaactaaatgaaaaaactttaaatgatatgcgttcaggatcagaagtgctagtagaagctctacttaaagaaaatgtggattatttattcggttatcctggtggtgccgtactacctttatatgacacgttttatgatggtaaaatcaaacatattttagcaagacacgaacaaggtgctgttcatgctgcagaaggttatgcacgtgtatctggtaaaactggcgtcgttgtagttacaagcggtccaggtgcaactaatgtaatgacaggtattacggatgcacattgcgactctttacctctagttgtattcactggacaagttgctacaccaggcattggtaaagatgcattccaagaagcggatattctatctatgacttcaccaattacaaaacaaaattatcaagtgaaacgtgttgaagatatccctaaaatcgtacacgaagctttccatgtagctaattctggacgcaaaggtcctgtagtgattgattttccaaaagatatgggtgttttagctacaaatgtggatttatgcgacgaaatcaatattccaggttatgaagttgttacagaaccagaaaataaagacattgacactttcatctcacttttaaaagaagcgaaaaagcctgtcgtattagccggcgcaggtattaatcaatcaaaatcaaatcaattattaacacagtttgttaataaacatcaaatcccaacagttactactttactaggtctaggtgctgtaccttatgaggatacactatttttaggtatgggaggaatgcatggttcttatgctagtaacatggcattaactgagtgtgatttactcattaatttaggtagccgcttcgatgatagattagcaagcaaacctgatgcctttgcacctaacgccaaaattgtacatgtagatattgatccttcagaaatcaataaagttattcatgtagatttaggtattattgcagactgtaaaagatttttagaatgtttaaatgataaaaatgttgagactatagaacacagtgactgggttaaacattgtcaaaataataagcagaaacacccatttaaacttggtgaagaagatcaagtattttgtaagccacaacaaacaatcgaatatatcggcaaaattacaaatggtgaagcaattgttactacagacgtgggacaacatcaaatgtgggcagctcaattttatccatttaaaaatcacggacaatgggttacaagcggtggtttaggaacaatgggattcggtattccttcgtcaattggtgccaaattagctaatcctgataaaacagtcgtatgtttcgtcggtgacggtggtttccaaatgacaaaccaagaaatggcacttttacccgaatatggtttagatgtcaaaatcgtactaatcaataatggaacattaggtatggttaaacaatggcaagataagttctttaatcaacgcttctcacactcagtatttaatggtcaacctgattttatgaaaatggcagaagcatatggcgtcaaaggtttcttaatcgataagccagaacaactggaagaacaattagatgcagcgtttgcttatcaaggaccagctttaattgaggttcgtatttcccctactgaagctgtaaccccaatggttccgagtggcaaatcaaatcatgaaatggagggctta

SEQ ID NO: 268 - protein, 594 aa, Staphylococcus aureus
  MISC_FEATURE (1)..(594): acetolactate synthase large
LEMVKMSKTQHEVNQNIDPLKMAESLEPEQLNEKTLNDMRSGSEVLVEALLKENVDYLFGYPGGAVLPLYDTFYDGKIKHILARHEQGAVHAAEGYARVSGKTGVVVVTSGPGATNVMTGITDAHCDSLPLVVFTGQVATPGIGKDAFQEADILSMTSPITKQNYQVKRVEDIPKIVHEAFHVANSGRKGPVVIDFPKDMGVLATNVDLCDEINIPGYEVVTEPENKDIDTFISLLKEAKKPVVLAGAGINQSKSNQLLTQFVNKHQIPTVTTLLGLGAVPYEDTLFLGMGGMHGSYASNMALTECDLLINLGSRFDDRLASKPDAFAPNAKIVHVDIDPSEINKVIHVDLGIIADCKRFLECLNDKNVETIEHSDWVKHCQNNKQKHPFKLGEEDQVFCKPQQTIEYIGKITNGEAIVTTDVGQHQMWAAQFYPFKNHGQWVTSGGLGTMGFGIPSSIGAKLANPDKTVVCFVGDGGFQMTNQEMALLPEYGLDVKIVLINNGTLGMVKQWQDKFFNQRFSHSVFNGQPDFMKMAEAYGVKGFLIDKPEQLEEQLDAAFAYQGPALIEVRISPTEAVTPMVPSGKSNHEMEGL

SEQ ID NO: 269 - DNA, 252 bp, Staphylococcus aureus
atgacaagaattcttaaattacaagttgcggatcaagtcagcacgctaaatcgaattacaagtgcttttgttcgcctacaatataatatcgatacattacatgttacacattctgaacaacctgggatttctaacatggaaattcaagtcgatattcaagatgatacatcacttcatatattaattaaaaaattaaaacaacaaattaatgttttaacggttgaatgctacgaccttgttgataacgaagct

SEQ ID NO: 270 - protein, 84 aa, Staphylococcus aureus
  MISC_FEATURE (1)..(84): hypothetical protein
MTRILKLQVADQVSTLNRITSAFVRLQYNIDTLHVTHSEQPGISNMEIQVDIQDDTSLHILIKKLKQQINVLTVECYDLVDNEA

SEQ ID NO: 271 - DNA, 1017 bp, Staphylococcus aureus
ttggaggaatttattatgacaacagtttattatgatcaagatgtaaaaacggacgctttacaaggcaaaaaaattgcagtagtaggttatggatcacaaggtcacgcgcatgcacaaaacttaaaagacaatggatatgatgtagtcatcggcattcgcccaggtcgttcttttgacaaagctaaagaagatggatttgatgtgttccctgttgcagaagcagttaagcaagctgatgtaattatggtgctattacctgatgaaattcaaggtgatgtatacaaaaacgaaattgaaccaaatttagaaaaacataatgcgcttgcatttgctcatggctttaacattcattttggtgttattcaaccaccagctgatgttgatgtatttttagtagctcctaaaggaccgggtcatttagttagacgtacatttgttgaaggttctgctgtaccatcactatttggtattcaacaaggcgcttcaggtcaagcacgtaatattgctttaagttatgcaaaaggtattggtgcaactcgtgcaggtgttattgaaacaacatttaaagaagaaactgagacagatttatttggtgaacaagcagtactttgcggtggtgtatcgaaattaattcaaagtggctttgaaacattagtagaagcgggttatcaaccagaattagcttattttgaagtattacatgaaatgaaattaatcgttgatttgatgtatgaaggcggtatggaaaatgtacgttactcaatttcaaatactgctgaatttggtgactatgtttcaggaccacgtgttatcacaccagatgttaaagaaaatatgaaagctgtattaactgatatccaaaatggtaacttcagtaatcgctttatcgaagacaataaaaatggattcaaagaattttataaattacgcgaagaacaacatggtcatcaaattgaaaaagttggtcgtgaattacgcgaaatgatgccttttattaaatctaaaagcattgaaaaa

SEQ ID NO: 272 - protein, 339 aa, Staphylococcus aureus
LEEFIMTTVYYDQDVKTDALQGKKIAVVGYGSQGHAHAQNLKDNGYDVVIGIRPGRSFDKAKEDGFDVFPVAEAVKQADVIMVLLPDEIQGDVYKNEIEPNLEKHNALAFAHGFNIHFGVIQPPADVDVFLVAPKGPGHLVRRTFVEGSAVPSLFGIQQGASGQARNIALSYAKGIGATRAGVIETTFKEETETDLFGEQAVLCGGVSKLIQSGFETLVEAGYQPELAYFEVLHEMKLIVDLMYEGGMENVRYSISNTAEFGDYVSGPRVITPDVKENMKAVLTDIQNGNFSNRFIEDNKNGFKEFYKLREEQHGHQIEKVGRELREMMPFIKSKSIEK

SEQ ID NO: 273 - DNA, 1536 bp, Staphylococcus aureus
ttgttaaatatgagtagtcatattcaaatttttgatacgacactaagagacggtgaacaaacaccaggagtgaattttacttttgatgaacgcttgcgtattgcattgcaattagaaaaatggggtgtagatgttattgaagctggatttcctgcttcaagtacaggtagctttaaatctgttcaagcaattgcacaaacattaacaacaacggctgtatgtggtttagctagatgtaaaaaatctgacatcgatgctgtatatgaagcaacaaaagatgcagcgaagccggtcgtgcatgtttttatagcaacatcacctattcatcttgaacataaacttaaaatgtctcaagaagacgttttagcatctattaaagaacatgtcacatacgcgaaacaattatttgacgttgttcaattttcacctgaagatgcaacgcgtactgaattaccattcttagtgaaatgtgtacaaactgccgttgacgctggagctacagttattaatattcctgatacagtcggctacagttaccatgatgaatatgcacatattttcaaaaccttaacagaatctgtaacatcttcaaatgaaattatttatagtgctcattgccatgacgatttaggaatggctgtttcaaatagtttagctgcaattgaaggcggtgcgagacgaattgaaggcactgtaaatggtattggtgaacgagcaggtaatgcagcacttgaagaagtcgcgcttgcactatacgttcgaaatgatcattatggtgctcaaactgctcttaatctcgaagaaactaaaaaaacatcggatttaatttcaagatatgcaggtattcgagtgcctagaaataaagcaattgttggccaaaatgcatttagtcatgaatcaggtattcaccaagatggcgtattaaaacatcgtgaaacatatgaaattatgacacctcaacttgttggtgtaagcacgactgaacttccattaggaaaattatctggtaaacacgccttctcagagaagttaaaagcattaggttatgacattgataaagaagcgcaaatagatttatttaaacaattcaaggccattgcggacaaaaagaaatctgtttcagatagagatattcatgcgattattcaaggttctgagcatgagcatcaagcactttataaattggaaacactgcaactacaatatgtctctagcggccttcaaagtgctgttgttgttgttaaagataaagagggtcatatttaccaggattcaagtattggtactggttcaatcgtagcaatttacaatgcagttgatcgtattttccagaaagaaacagaattaattgattatcgtattaattctgtcactgaaggtactgatgcccaagcagaagtacatgtaaatttattgattgaaggtaagactgtcaatggctttggtattgatcatgatattttacaagcctcttgtaaagcatacgtagaagcacatgctaaatttgcagctgaaaatgttgagaaggtaggtaat

SEQ ID NO: 274 - protein, 512 aa, Staphylococcus aureus
  MISC_FEATURE (1)..(512): 2-isopropylmalate synthase
LLNMSSHIQIFDTTLRDGEQTPGVNFTFDERLRIALQLEKWGVDVIEAGFPASSTGSFKSVQAIAQTLTTTAVCGLARCKKSDIDAVYEATKDAAKPVVHVFIATSPIHLEHKLKMSQEDVLASIKEHVTYAKQLFDVVQFSPEDATRTELPFLVKCVQTAVDAGATVINIPDTVGYSYHDEYAHIFKTLTESVTSSNEIIYSAHCHDDLGMAVSNSLAAIEGGARRIEGTVNGIGERAGNAALEEVALALYVRNDHYGAQTALNLEETKKTSDLISRYAGIRVPRNKAIVGQNAFSHESGIHQDGVLKHRETYEIMTPQLVGVSTTELPLGKLSGKHAFSEKLKALGYDIDKEAQIDLFKQFKAIADKKKSVSDRDIHAIIQGSEHEHQALYKLETLQLQYVSSGLQSAVVVVKDKEGHIYQDSSIGTGSIVAIYNAVDRIFQKETELIDYRINSVTEGTDAQAEVHVNLLIEGKTVNGFGIDHDILQASCKAYVEAHAKFAAENVEKVGN

SEQ ID NO: 275 - DNA, 1044 bp, Staphylococcus aureus
atgacttataacattgttgccctacctggtgatggaatcggtccagaaattttgaacggatctctatcattgcttgaaattataagtaataaatataactttaattatcaaatagagcaccacgaatttggtggtgcctctattgatacattcggcgagcctttaactgagaaaaccttaaatgcgtgtaaaagagcagatgctattttactgggtgcaatcggtggacctaaatggacagatcctaacaatcgaccagaacaaggattattaaaattgcgtaaatccttaaatttatttgtaaatatacgccccactaccgttgtcaaaggcgctagttctttatcacctttaaaggaagaacgcgttgaaggcacagatttagttatagtccgtgaattgacaagtggtatttattttggagaacctagacattttaataatcacgaggccttagattctcttacttatacaagagaagaaatagaacgcattgttcacgtagcatttaaattggccgcttcaagacgaggaaaactaacatcagttgataaagaaaatgtattagcttctagtaaattgtggcgcaaagtcgtaaatgaagtaagtcaattatatccagaagtaacagtaaatcacttatttgttgatgcttgtagtatgcatttaatcacaaatccaaaacaatttgacgtcatcgtatgtgaaaacttatttggcgatattttaagtgatgaagcttcagtgattcctggttcacttggtttatcaccttctgctagttttagtaacgatggtccaagattgtatgagcctattcatggatcagcaccagatattgcaggtaaaaacgttgccaatccatttggaatgattctatctttagcgatgtgtttacgtgaaagcttaaatcaaccagatgctgcagatgaattagaacaacatatttatagcatgattgaacatgggcaaacgacagcagatttaggcggcaaattgaatactactgatattttcgaaattctatctcaaaaattgaatcac

SEQ ID NO: 276 - protein, 348 aa, Staphylococcus aureus
  MISC_FEATURE (1)..(348): 3-isopropylmalate
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFVNIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLFVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYSMIEHGQTTADLGGKLNTTDIFEILSQKLNH

SEQ ID NO: 277 - DNA, 1368 bp, Staphylococcus aureus
atgggtcaaacattatttgacaaggtgtggaacagacatgtgttatacgggaaattgggcgaaccgcaactattatacattgatttacaccttatacatgaagttacttctcctcaagcatttgaaggacttaggcttcaaaacagaaaattaagacgcccagatttaacatttgcaacactcgatcacaatgttcctactattgatatattcaatattaaagatgaaattgcaaacaaacaaatcacaacattacaaaaaaacgccatagattttggggtgcatatttttgatatgggttctgatgaacaaggtattgttcacatggtaggacctgagacaggacttacacagcctggcaagacaatcgtttgtggtgactctcacacagcaacacatggagcatttggtgctattgcatttggaattggaacaagtgaagttgaacatgttttcgcaactcaaacgctatggcaaacaaaacccaaaaacttaaaaatcgatattaatggtaccttaccaacaggcgtctatgctaaggacattattctgcatttaattaaaacgtatggtgttgactttggtacaggctatgctttggaatttactggcgaaacaattaaaaacctttcaatggatggtcgaatgactatttgtaacatggctatcgaaggtggtgccaaatacggcataatccaacctgatgatataacatttgaatatgttaaagggagaccatttgccgataacttcgctaaatcagttgataagtggcgtgagctatattctgatgacgacgcgatatttgatcgtgtaattgaacttgatgtttcaacattagaaccacaagtgacatggggaactaatcctgaaatgggtgttaatttcagtgaaccattccctgaaatcaatgatatcaacgatcaacgtgcgtatgattatatggggttagaaccaggtcaaaaagctgaagacatcgacttagggtatgtttttctcggttcatgtacaaatgctagactatcagatttgattgaagctagtcatattgttaaaggaaataaagttcatccaaatattacagctattgtcgtaccaggttctcgtacagtaaaaaaagaagcagaaaaattaggtctagatactatctttaaaaatgcaggatttgaatggcgtgaaccaggatgttcaatgtgtttaggcatgaatcctgaccaagtacctgagggcgtacattgtgcatctacaagtaatcgaaactttgaaggacgacaaggcaaaggtgcaagaacacatttagtatcccctgctatggcagcagcagcagctattcatggtaaatttgtggacgtaagaaaggtggttgtt

SEQ ID NO: 278 - protein, 456 aa, Staphylococcus aureus
  MISC_FEATURE (1)..(456): 3-isopropylmalate
MGQTLFDKVWNRHVLYGKLGEPQLLYIDLHLIHEVTSPQAFEGLRLQNRKLRRPDLTFATLDHNVPTIDIFNIKDEIANKQITTLQKNAIDFGVHIFDMGSDEQGIVHMVGPETGLTQPGKTIVCGDSHTATHGAFGAIAFGIGTSEVEHVFATQTLWQTKPKNLKIDINGTLPTGVYAKDIILHLIKTYGVDFGTGYALEFTGETIKNLSMDGRMTICNMAIEGGAKYGIIQPDDITFEYVKGRPFADNFAKSVDKWRELYSDDDAIFDRVIELDVSTLEPQVTWGTNPEMGVNFSEPFPEINDINDQRAYDYMGLEPGQKAEDIDLGYVFLGSCTNARLSDLIEASHIVKGNKVHPNITAIVVPGSRTVKKEAEKLGLDTIFKNAGFEWREPGCSMCLGMNPDQVPEGVHCASTSNRNFEGRQGKGARTHLVSPAMAAAAAIHGKFVDVRKVVV

SEQ ID NO: 279 - DNA, 381 bp, Staphylococcus aureus
atgaagctatatcgattttcacacaaaacaggtagctatggtgtcacgattgttgaagaaaatggagacgatgtccttgttaaagttgaacaagttatcaaacacccgaaacaaggtgatttacataaccctactgaaactgaaggtgtatttttccatgaccgcaaagcattaagccattttgaaaaacgctatacgaaacgttcacaattacgcgacttcaatgttgatgtattgcgctatgaagattcacttcaacaagcaattacagatttagaaactaaacttaaagctcagcaaacaaaacatgctgaaatgtctttagctagtttagcacgcttaaaagaagattattcacttcaatacaaagaaaattttaaa

SEQ ID NO: 280 - protein, 127 aa, Staphylococcus aureus
  MISC_FEATURE (1)..(127): conserved hypothetical
MKLYRFSHKTGSYGVTIVEENGDDVLVKVEQVIKHPKQGDLHNPTETEGVFFHDRKALSHFEKRYTKRSQLRDFNVDVLRYEDSLQQAITDLETKLKAQQTKHAEMSLASLARLKEDYSLQYKENFK

SEQ ID NO: 281 - DNA, 591 bp, Staphylococcus aureus
atggctaactatccacagttaaacaaagaagtacaacaaggtgaaatcaaagtggttatgcacacaaataaaggtgacatgacattcaaattatttccaaatattgcaccaaaaacagttgaaaattttgtgacacatgcaaaaaatggttattatgatggaatcacattccaccgtgtcattaatgacttcatgattcaaggtggcgatccaacagctactggtatgggtggcgaaagtatttatggcggtgcttttgaagatgaattttcattaaatgcatttaacttatatggcgcattatcaatggctaactcaggacctaatactaatggttcacaatttttcattgttcaaatgaaagaagtacctcaaaatatgttaagtcaacttgcagatggtggctggcctcaaccaatcgttgatgcatatggcgaaaagggtggtacaccatggttagatcaaaaacatacagtattcggtcaaatcattgatggtgaaactacattagaagatattgcaaatacaaaagtgggaccacaagataaaccacttcatgatgttgtaattgaatctattgatgttgaagaa

SEQ ID NO: 282 - protein, 197 aa, Staphylococcus aureus
  MISC_FEATURE (1)..(197): peptidyl-prolyl cis-trans
MANYPQLNKEVQQGEIKVVMHTNKGDMTFKLFPNIAPKTVENFVTHAKNGYYDGITFHRVINDFMIQGGDPTATGMGGESIYGGAFEDEFSLNAFNLYGALSMANSGPNTNGSQFFIVQMKEVPQNMLSQLADGGWPQPIVDAYGEKGGTPWLDQKHTVFGQIIDGETTLEDIANTKVGPQDKPLHDVVIESIDVEE

SEQ ID NO: 283 - DNA, 570 bp, Staphylococcus aureus
atggcagcaatcaaacctattacaacatataaaggtaaaatagtccctctcttcaacgacaatatcgatacagaccaaatcattcctaaggtacacttaaagcgtatttcaaaaagtggctttggtccatttgcttttgatgaatggcggtacttacctgatggttcagataatcctgatttcaatcctaacaaaccacaatataaaggggcttctattttaattactggagataattttggatgtggttcaagtcgtgaacatgctgcttgggctcttaaggactatggttttcatattattattgcaggaagtttcagtgacatattttatatgaattgcactaaaaatgcgatgttgcctatcgttttagaaaaaagtgcccgtgaacatcttgcacaatatgttgaaattgaggtcgatttaccaaatcaaactgtgtcatcaccagacaagcgtttccattttgaaattgatgaaacttggaagaataaacttgtaaatggcttagatgacattgcaatcaccctacaatatgaatcattaatagaaaaatatgaaaaatcactt

SEQ ID NO: 284 - protein, 190 aa, Staphylococcus aureus
  MISC_FEATURE (1)..(190): 3-isopropylmalate
MAAIKPITTYKGKIVPLFNDNIDTDQIIPKVHLKRISKSGFGPFAFDEWRYLPDGSDNPDFNPNKPQYKGASILITGDNFGCGSSREHAAWALKDYGFHIIIAGSFSDIFYMNCTKNAMLPIVLEKSAREHLAQYVEIEVDLPNQTVSSPDKRFHFEIDETWKNKLVNGLDDIAITLQYESLIEKYEKSL

SEQ ID NO: 285 - DNA, 1275 bp, Staphylococcus aureus
ttgaatattatgacagtcaaaacaacagtttctacgaaagatatcgatgaggcatttttaagacttaaagatattgtcaaagaaacacctttacaattagaccattacttatctcaaaagtatgattgtaaagtctatttaaaacgagaagatttacaatgggtacgttcttttaaattaagaggtgcttacaacgctatttctgttttatcagatgaagctaaaagtaaaggtattacatgtgcaagtgcaggtaatcatgctcaaggtgttgcctatacagctaaaaaacttaatttaaacgctgttatctttatgccagtcactacacctttacaaaaggtaaatcaagtaaagttctttggaaatagtaacgttgaagttgtactcactggtgatacatttgatcactgtttagctgaagctttaacttatacaagtgaacatcaaatgaactttatagatccattcaataatgttcatacaatttctggacaaggtacgcttgctaaagaaatgctagaacaagcaaagtctgacaatgttaactttgattatctatttgccgcaattggtggtggcggtttaatttcaggtattagtacttactttaaaacctattcacctaccacgaaaattataggtgttgaaccttcaggtgcaagtagtatgtatgaatctgttgtggtaaataatcaggtagtcacattgcctaatatcgataaatttgtggacggtgcatctgtagctagagttggcgatattacatttgaaattgcaaaagaaaatgtagatgattacgttcaagtagatgaaggtgcagtttgttctacgattttagatatgtattcaaaacaagcaattgtagcagaacctgctggcgcattaagtgtaagtgcgcttgaaaactataaagatcatattaaaggtaaaacagtggtttgtgtcattagtggtggtaataatgatattaatcgaatgaaagaaattgaagaacgttcattactatacgaagaaatgaagcattactttatcttaaatttccctcaacgtccaggtgcattgagagaatttgtaaatgacgtattaggacctcaagacgatattactaaatttgaatacttaaaaaaatcttctcaaaatacaggtactgtcattattggtattcaacttaaagatcatgatgatttaatacaactcaaacaacgtgtaaatcatttcgatccttccaatatttatattaatgaaaataagatgttatattcattgttaatt

SEQ ID NO: 286 - protein, 425 aa, Staphylococcus aureus
  MISC_FEATURE (1)..(425): thereonine dehydratase
LNIMTVKTTVSTKDIDEAFLRLKDIVKETPLQLDHYLSQKYDCKVYLKREDLQWVRSFKLRGAYNAISVLSDEAKSKGITCASAGNHAQGVAYTAKKLNLNAVIFMPVTTPLQKVNQVKFFGNSNVEVVLTGDTFDHCLAEALTYTSEHQMNFIDPFNNVHTISGQGTLAKEMLEQAKSDNVNFDYLFAAIGGGGLISGISTYFKTYSPTTKIIGVEPSGASSMYESVVVNNQVVTLPNIDKFVDGASVARVGDITFEIAKENVDDYVQVDEGAVCSTILDMYSKQAIVAEPAGALSVSALENYKDHIKGKTVVCVISGGNNDINRMKEIEERSLLYEEMKHYFILNFPQRPGALREFVNDVLGPQDDITKFEYLKKSSQNTGTVIIGIQLKDHDDLIQLKQRVNHFDPSNIYINENKMLYSLLI

SEQ ID NO: 287 - DNA, 153 bp, Staphylococcus aureus
gtggatgcgatgagccgcattgagaccgcaaggtctctttttttatgtctaaaacgtcaaaataaaagcaaacacaaagaaagatggcttggcgaagtgaaaacgtttgaatctgacgaaacgagaaatgtaaagtataataaaaagcagtca

SEQ ID NO: 288 - protein, 51 aa, Staphylococcus aureus
VDAMSRIETARSLFLCLKRQNKSKHKERWLGEVKTFESDETRNVKYNKKQS

SEQ ID NO: 289 - DNA, 99 bp, Staphylococcus aureus
gtgtcaggggggcagtttgtttggggcggtcgcctcctaaaaggtaacggaggcgctcaaaggttccctcagaatggtgtggaaatcattcatagagtg

SEQ ID NO: 290 - protein, 33 aa, Staphylococcus aureus
VSGGQFVWGGRLLKGNGGAQRFPQNGVEIIHRV

SEQ ID NO: 291 - DNA, 315 bp, Staphylococcus aureus
gtgcaaagtatgtttgctattattgaaacaggtggaaaacaaatcaaagtagaagaaggtcaagaaatcttcgttgaaaaattagacgtaaacgaaggagatacttttacatttgataaagtattatttgtaggtggagattcagttaaagttggagcgccaacagttgaaggtgcaacagttactgctactgttaataaacaaggtcgcggtaaaaaaatcactgtattcacatacaaacgtcgtaaaaattcaaaacgtaaaaaaggccatcgtcaaccatacactaaattaacaatcgataaaatcaacgcg

SEQ ID NO: 292 - protein, 105 aa, Staphylococcus aureus
  MISC_FEATURE (1)..(105): 50S ribosomal protein L21
VQSMFAIIETGGKQIKVEEGQEIFVEKLDVNEGDTFTFDKVLFVGGDSVKVGAPTVEGATVTATVNKQGRGKKITVFTYKRRKNSKRKKGHRQPYTKLTIDKINA

SEQ ID NO: 293 - DNA, 318 bp, Staphylococcus aureus
atgattactgttgatattacagttaatgatgaaggcaaagtaacagacgttattatggatggccatgctgaccatggtgaatatggtcatgatatcgtttgtgctggagcttcagctgtattgtttggtagtgttaatgcgattataggattgacatctgagagaccagatatcaattatgacgacaatggtggtcattttcatataagaagcgttgatacaaacaacgatgaagcgcaactaattcttcaaacaatgcttgtgtctttacaaactattgaagaagaatataatgagaatattagattaaattataag

SEQ ID NO: 294 - protein, 106 aa, Staphylococcus aureus
  MISC_FEATURE (1)..(106): conserved hypothetical
MITVDITVNDEGKVTDVIMDGHADHGEYGHDIVCAGASAVLFGSVNAIIGLTSERPDINYDDNGGHFHIRSVDTNNDEAQLILQTMLVSLQTIEEEYNENIRLNYK

SEQ ID NO: 295 - DNA, 297 bp, Staphylococcus aureus
gtgaggtgcattccgatgttaaaattaaacttacaattcttcgcatctaaaaaaggggtaagttctacaaaaaacggacgtgactctgaatcaaaacgcttaggtgctaaacgtgctgacggtcaattcgtaacaggtggttcaattttatatcgccaacgtggtactaaaatttaccctggtgaaaatgtaggtcgtggtggcgatgatacattattcgctaaaatcgacggcgttgttaaattcgaacgtaaaggtcgcgacaaaaaacaagtttctgtatatgcagtagctgaa

SEQ ID NO: 296 - protein, 99 aa, Staphylococcus aureus
  MISC_FEATURE (1)..(99): 50S ribosomal protei L27
VRCIPMLKLNLQFFASKKGVSSTKNGRDSESKRLGAKRADGQFVTGGSILYRQRGTKIYPGENVGRGGDDTLFAKIDGVVKFERKGRDKKQVSVYAVAE

SEQ ID NO: 297 - DNA, 1299 bp, Staphylococcus aureus
gtgagatatatgtttgtcgatcaagtcaaaatatctcttaaagccggtgatggtggtaatggtattaccgcatacagaagagaaaaatatgtaccatttggtggaccagctggcggtgacggtggtaaaggtgcttcagtcgtatttgaagtggatgaaggtttaagaacgttattagattttagatatcaacgtcattttaaagcaagcaaaggtgaaaatggccaaagtagtaatatgcatggtaaaaatgcggaagatttagtattaaaagttccacctggtacaattattaaaaatgttgaaacagacgaagtgttagcagatcttgttgaagatggtcaaagagctgtagtagcgaagggcggtcgaggtggccgaggtaattcacgttttgcaacacctagaaaccctgcacctgacttcagtgaaaaaggtgaaccaggtgaggaattagatgtatctttagaattgaaattattagctgatgtaggattagtaggtttccctagtgtgggtaaatcgactttattatctatcgtttcaaaagctaagcctaaaattggggcatatcattttacaacgattaaaccaaatctaggtgttgtttcaacgcctgatcaacgtagttttgttatggcagatttaccaggtttaattgaaggtgcatctgatggcgttggattaggacatcaatttttaagacatgtagagagaacaaaagttattgttcacatgattgatatgagcggttctgaaggtagagaacctattgaagattataaagtcattaatcaagaattagctgcgtacgagcaacgtttagaagatagacctcaaatcgtagtagctaacaagatggatttacctgaatcacaagataatttaaacttgtttaaagaagaaattggcgaagatgtgccagttattccagtttcaacaataacgcgtgataatattgatcaattattatatgcaatagcagataaattagaagaatataaagatgttgacttcacagttgaagaagaggagtcagttggcattaaccgagtattatataaacatacaccgtcacaagataaatttacaatttcaagagatgatgatggtgcttatgtggtaagtggtaatgctattgaaagaatgtttaaaatgactgactttaacagtgatccagcagtacgtcgatttgctcgtcaaatgcgttcgatgggtattgatgatgcgcttagagaacgtggttgtaaaaatggtgatatcgttagaattcttggcggagaatttgaattcgttgaa

SEQ ID NO: 298 - protein, 433 aa, Staphylococcus aureus
  MISC_FEATURE (1)..(433): Spo0B-associated
VRYMFVDQVKISLKAGDGGNGITAYRREKYVPFGGPAGGDGGKGASVVFEVDEGLRTLLDFRYQRHFKASKGENGQSSNMHGKNAEDLVLKVPPGTIIKNVETDEVLADLVEDGQRAVVAKGGRGGRGNSRFATPRNPAPDFSEKGEPGEELDVSLELKLLADVGLVGFPSVGKSTLLSIVSKAKPKIGAYHFTTIKPNLGVVSTPDQRSFVMADLPGLIEGASDGVGLGHQFLRHVERTKVIVHMIDMSGSEGREPIEDYKVINQELAAYEQRLEDRPQIVVANKMDLPESQDNLNLFKEEIGEDVPVIPVSTITRDNIDQLLYAIADKLEEYKDVDFTVEEEESVGINRVLYKHTPSQDKFTISRDDDGAYVVSGNAIERMFKMTDFNSDPAVRRFARQMRSMGIDDALRERGCKNGDIVRILGGEFEFVE

SEQ ID NO: 299 - DNA, 456 bp, Staphylococcus aureus
atgatggacaataaagattataaaaagttttatttaattagagaagatgtcttgcctgaatccgtggttaaaacattgaagattaaagatgccttaaaaagtgatccgacattgtccatttatgatgccgttaaacagtttgatctatctagaagtgctttttataaatatagagaaacgatatttccagtagacgataaaatgcttgaccatcgagaatttacattaattttatatgtaactgatattgttggtatgttggcacgtgtactagatgttatatcaaagttagaactatctgtattaacgattcatcaaagtattccaatggaagaaaaagcaacaataacattatcactgaatgctaaatctaaagaaacttcagtagaagatgttattggcgctttgagaaatttagattatgtatcaaaagtagaattaattagtatgagtatg

SEQ ID NO: 300 - protein, 152 aa, Staphylococcus aureus
  MISC_FEATURE (1)..(152): hypothetical protein
MMDNKDYKKFYLIREDVLPESVVKTLKIKDALKSDPTLSIYDAVKQFDLSRSAFYKYRETIFPVDDKMLDHREFTLILYVTDIVGMLARVLDVISKLELSVLTIHQSIPMEEKATITLSLNAKSKETSVEDVIGALRNLDYVSKVELISMSM

SEQ ID NO: 301 - DNA, 609 bp, Staphylococcus aureus
gtgcctataatgtacgcgtatgtcaaaggtaagttaacacatttatatcctacacacgtagttgttgaaactgctggtgttggttatgaaattcaaacaccaaattcttatcgttttcaaaagcatctagatcatgaagttttaattcatacatctttaattgttcgtgaagatgcacaattattgtatggatttagtagtgaagaagagaaagatatgttcttgagtttaattaaagttactggtattggtccgaaatcagctttagctattttagcgacaagtacgcctaatgaagtaaaacgtgccattgaaaatgaaaatgatacgtatttaactaaattcccaggaattggtaagaaaacggcaagacagattgtcttagatttaaaaggtaaagtgaaaattactgaagaagatagcgattcattattacaagtagacgctacttcgacggtgcaagatcaattcgtgcaagaagcaatgttagcgttagaagcattaggttattctaaacgagagcttgcaaaagttgagaaaacgttaaataaaaataaatatgactcagttgatgaagctgttaaggcaggtcttcaattagttgtatct

SEQ ID NO: 302 - protein, 203 aa, Staphylococcus aureus
  MISC_FEATURE (1)..(203): holliday junction DNA
VPIMYAYVKGKLTHLYPTHVVVETAGVGYEIQTPNSYRFQKHLDHEVLIHTSLIVREDAQLLYGFSSEEEKDMFLSLIKVTGIGPKSALAILATSTPNEVKRAIENENDTYLTKFPGIGKKTARQIVLDLKGKVKITEEDSDSLLQVDATSTVQDQFVQEAMLALEALGYSKRELAKVEKTLNKNKYDSVDEAVKAGLQLVVS

SEQ ID NO: 303 - DNA, 375 bp, Staphylococcus aureus
ttgaataactacaaaattggccaacatatcaaggtgcgtgtaactggtattcaaccatacggtgcgtttgttgagacccctaatcatactgaaggactgattcatatatcagaaattatggatgactacgttcataatttgaagaaatttctatcagaaggccaaattgttaaagctaaaattttgtctatagatgatgaaggaaagcttaatctatcattaaaggataatgattacttcaaaaattatgagcgtaagaaggaaaaacaatcagtattagatgaaatcagagaaacagaaaaatatgggtttcaaacacttaaagaacgcttaccaatctggataaaacagtcaaagcgagcaattcgaaacgac

SEQ ID NO: 304 - protein, 125 aa, Staphylococcus aureus
  MISC_FEATURE (1)..(125): hypothetical protein
LNNYKIGQHIKVRVTGIQPYGAFVETPNHTEGLIHISEIMDDYVHNLKKFLSEGQIVKAKILSIDDEGKLNLSLKDNDYFKNYERKKEKQSVLDEIRETEKYGFQTLKERLPIWIKQSKRAIRND

SEQ ID NO: 305 - DNA, 1002 bp, Staphylococcus aureus
atgaatgagcgtatggttgatcaatcaatgcatagtgaagaaactgatttcgaattgtcgcttagacctacgagattacgacaatatattggtcaaaattcaataaaaagtaatttagaagtatttattaaagcggctaaacttcgtcatgaaccattagatcatgtattgctttttggcccccctggattaggtaagacaacattatctaatatcattgccaatgaaatggaagttaatatacgtacagtatcagggccttcattagaaagacctggtgatttggctgcaattttatcaggacttcaacctggagatgttttgtttattgatgaaatacacagactgagtagtgttgttgaagaagtgttataccctgcaatggaagatttctttttagatattatcattggtaaaggcgatgaggctagaagtatccgtatcgacttacctccattcactttggtaggtgcaacaacgcgagctggcagcttaacaggtccactaagggatcgatttggtgtgcacttaagattagaatattataacgaatcagatttaaaagaaatcattattagaacagctgaggttttaggcacaggtattgatgaagaaagtgccattgaacttgctaaacgttctagagggactccaagagtagcaaatcgactattgaagcgggtaagagacttccagcaagtgaatgaagatgaacaaatatacattgaaacaacgaagcacgcattaggtttacttcaagttgatcaacacggactagattacattgatcataaaatgatgaactgtattattaagcagtataatggcggacctgttggtttagatacgattgccgtaacaattggtgaagaacgtattacaattgaggacgtttatgagccatttcttattcagaaaggctttttagaacgtacgccacgtggcagaaaagcaacaccattagcttatgaacattttgcaaagtcgaatgaggagagagaa

SEQ ID NO: 306 - protein, 334 aa, Staphylococcus aureus
  MISC_FEATURE (1)..(334): holliday junction DNA
MNERMVDQSMHSEETDFELSLRPTRLRQYIGQNSIKSNLEVFIKAAKLRHEPLDHVLLFGPPGLGKTTLSNIIANEMEVNIRTVSGPSLERPGDLAAILSGLQPGDVLFIDEIHRLSSVVEEVLYPAMEDFFLDIIIGKGDEARSIRIDLPPFTLVGATTRAGSLTGPLRDRFGVHLRLEYYNESDLKEIIIRTAEVLGTGIDEESAIELAKRSRGTPRVANRLLKRVRDFQQVNEDEQIYIETTKHALGLLQVDQHGLDYIDHKMMNCIIKQYNGGPVGLDTIAVTIGEERITIEDVYEPFLIQKGFLERTPRGRKATPLAYEHFAKSNEERE

SEQ ID NO: 307 - DNA, 1062 bp, Staphylococcus aureus
atgaacattttgcaaagtcgaatgaggagagagaataacgtgaatattgaagaatttgactatgacttaccagaatcattaattgctcaaacgcctttaaaagatcgtgatcatagtcgtttattagtcatggatagagaaactggtgaaatgaaacatttacatttcaaagatatcattgagtattttagacctggtgatacattagtgcttaacgatacgcgagtaatgccagctagactttttggtttaaaagaagaaactggtgcaaaagttgaaatgttaatgttaactcaaattgaaggtaatgattgggaagtcttactgaaaccagctaagcgtattaaagttggtaataaattgaattttggtaatggcaaaattatagctgaatgcataaaagaaatggatcaaggtggacgcatcatgcgtttacattatgaaggtattttacaagaaagattagatgaattaggggaaatgccactgccaccatacatcaaagaacgtttagatgatccagatcgttatcaaacagtttacgctaaagaaagtggttcagcggcagcaccaacagcaggattacattttactgatgagttattaattgaaattaaaaataaaggtgttaatatcgcatttgttacattacatgttgggttaggtacgtttagaccggtgagcgtagacgatgtgaatgaccacgaaatgcatagtgaatattatcaaatgacacaagaaacagctgatttattaaatgatactaagtccaaaggacatcgcattatatcagttggtacaacttcaacacgtacacttgaaacaattcgacgcgatcatgataaatttgttgaaacgagtggctggactaatatatttatttatccaggatttgattttaaagcaattgatggccagattactaattttcatttaccaaaatcaacattagttatgctagtatcagcgtttagtagtcgtgaaaatgttctgaatgcttataaaacggcagtaaatttagaatatagattctttagttttggcgatgcaatgttaattata

SEQ ID NO: 308 - protein, 354 aa, Staphylococcus aureus
  MISC_FEATURE (1)..(354): S-adenosylmethionine tRNA
MNILQSRMRRENNVNIEEFDYDLPESLIAQTPLKDRDHSRLLVMDRETGEMKHLHFKDIIEYFRPGDTLVLNDTRVMPARLFGLKEETGAKVEMLMLTQIEGNDWEVLLKPAKRIKVGNKLNFGNGKIIAECIKEMDQGGRIMRLHYEGILQERLDELGEMPLPPYIKERLDDPDRYQTVYAKESGSAAAPTAGLHFTDELLIEIKNKGVNIAFVTLHVGLGTFRPVSVDDVNDHEMHSEYYQMTQETADLLNDTKSKGHRIISVGTTSTRTLETIRRDHDKFVETSGWTNIFIYPGFDFKAIDGQITNFHLPKSTLVMLVSAFSSRENVLNAYKTAVNLEYRFFSFGDAMLII

SEQ ID NO: 309 - DNA, 1152 bp, Staphylococcus aureus
gtgaggattttgaatatgcctgcagtaacatacgaacacattaaaacttgtaaacaatcaggtgcgcgtttaggtatcgtgcacacaccacacggttcatttgaaacacctatgtttatgccagttggtactaaagcaaccgttaaaacaatgagtccagaagagttaagacaaattgaagcaaaaatcattttgggcaacacatatcatttgtggttacaacccggaaatgatattatcaaacacgctgggggattacataaattcatgaattgggatggtccgatccttacagattcaggcggtttccaagtgtttagtttaagtaatttacgtaaaattacagaagaaggcgtggaatttagacatcatactaatgggtctaaattatttttgagtcctgagaaatcaatgcaaattcaaaatgatttaggatctgatattatgatggcatttgatgaatgtccaccgatgcctgctgaatatgattatgtaaaaaaatctattgaacgtacaacacgttgggcgaaaagatgtctagatgcacaccaaagacctgaagatcaagcattgttcggcattatacaaggtggcgaatatgaagatttaagagaacaaagtgcaaaggatttagtagaattagattttcctggttatgcaatcggcggtttgtcagttggtgaacctaaaccggttatgtataaaatggttgaacatacagagcagtttatgcctaaagataaaccaagatatttaatgggtgtaggatctccagatgcgttaatcgaatgtagtattcgcggcatggatatgtttgattgtgtcttaccgacacgtattgccagaaatggtacttgtatgacatcgcaaggtcgtttagttattaaaaatgcaaaatttgcagatgatttaagaccgttagatgagaattgtgactgttatacatgtcaaaactattcaagagcgtatatacgtcatttaatcaaggcagaggaaacttttggtattcgtcttactactattcataatttacattttctgctaaaattaatggaagatataagacaagccattcgagaagatcgtcttttagatttcaaagaagaattcttcgagcaatatggattaaatgttgagaacccaaaaaacttt

SEQ ID NO: 310 - protein, 384 aa, Staphylococcus aureus
  MISC_FEATURE (1)..(384): tRNA-guanine
VRILNMPAVTYEHIKTCKQSGARLGIVHTPHGSFETPMFMPVGTKATVKTMSPEELRQIEAKIILGNTYHLWLQPGNDIIKHAGGLHKFMNWDGPILTDSGGFQVFSLSNLRKITEEGVEFRHHTNGSKLFLSPEKSMQIQNDLGSDIMMAFDECPPMPAEYDYVKKSIERTTRWAKRCLDAHQRPEDQALFGIIQGGEYEDLREQSAKDLVELDFPGYAIGGLSVGEPKPVMYKMVEHTEQFMPKDKPRYLMGVGSPDALIECSIRGMDMFDCVLPTRIARNGTCMTSQGRLVIKNAKFADDLRPLDENCDCYTCQNYSRAYIRHLIKAEETFGIRLTTIHNLHFLLKLMEDIRQAIREDRLLDFKEEFFEQYGLNVENPKNF

SEQ ID NO: 311 - DNA, 258 bp, Staphylococcus aureus
atgcaattttcattactaatatatatagtcgtaatttttgcggttatgtatttcttgatgatcagaccacaacaaaaacgtgcgaaacagcatcgtgagttgattaataacattcaatctggtcaaagaattacaactattggtggtattaaaggtactgttaaagcagtagatgaaacaactgttgttattacagttaatggtcatggtactgaattaactttcgaaaaacctgctattaaacaagttgacccttca

SEQ ID NO: 312 - protein, 86 aa, Staphylococcus aureus
  MISC_FEATURE (1)..(86): conserved hypothetical
MQFSLLIYIVVIFAVMYFLMIRPQQKRAKQHRELINNIQSGQRITTIGGIKGTVKAVDETTVVITVNGHGTELTFEKPAIKQVDPS

SEQ ID NO: 313 - DNA, 2277 bp, Staphylococcus aureus
gtgaagaaaagtagtagaataattgcgttcttgcttttagtcgtattgttgtttgccggaatggctgcaacttataaaagtgttataaagaatgtcaatttaggacttgatttgcaaggtggatttgaggtgctttatcaagtcgatcctttaaataaaggcgacaaaatagataaaaaagccttacaatcaacagcgcaaacattagaaaatcgtgttaacgttttaggtgtttcggaacctaaaattcaagttgaagaacctaatagaattagagtacaacttgctggtgtaacagaccagaatgaagcacgtaaaattttatcttctcaagctaatttaacaattcgcgatgcagaagataaagtaaaattaagcggttctgatattaaacagggatctgccaaacaagaatttaaacaggaaacaaaccagcctacagttacttttaaagtaaaagacaaaaacaaatttaaaaaagtaacggaagaaatctctaagaaacgtgataatgtcatggttgtttggttagatttcaaaaaaggtgacagctataaaaaagaagcacaaaagaaaaaccctaaatttatttctgcagcaagtgttgatcaaccaatcaattctgatagcgtagaaatctcgggtggatttaaaggacaagaaggcgttaaaaaagcaaaacaaatcgccgaattgttaaatgcaggttctttaccagttgacttgaaagaaatttattcaaactcagtaggtgcccaatttggtcaagatgcattagataaaactgtgtttgcatcgtttattggtgtagcattaatttatttattcatgcttggattctaccgattacctggtttagtagcgattattgcattgacaacttatatctatctaacgttagtagcatttaatttcatttccggggttctaactttaccaggattagcggcgttggtattaggtgtaggtatggctgtagatgccaatattatcatgtatgagcgtattaaggatgaacttcgaataggtagaacgataaagcaagccttttctaaagcaaacaaaagttcattcctaacaatttttgattctaacttaacaacagttatcgccgcagcagtattattcttcttcggtgaaagttcagttaaaggtttcgcgacaatgttattattaggtattctaatgatctttgttacagccgtgttcttatcaagattcttattatcattacttgtttcatcaaatatattcaaaaatcaattttggttatttggtgttaaaaagaataaacgacatgatattaatgaaggtgtagatgttcatgaccttaaaacttcattcgagaaatggaattttgttaaattagctaagccattaattggagtaagtattttaattgtagttgtcggtttagttattctttatatcttcaagttaaacttaggaattgatttctcaagtggtacacgcgtagatttccaatctaaacaagcaattactcaacaaaaggtagagcaagttgtaaaagatagtggacttaaagcggatcaaattcagatcaatggtaaagacaataaagtagcaactgttcaatttaaagacgatttaacgcgtgctcaagataataaattgagtgataatattaaatcgaaattcggtgacacacctcaaattaacactgtatcaccaattattggacaggaattagcaaaaaatgcaatgcttgcattaatctatgcatcgataggtatcatcatctatgtatcattacgatttgaatggcgcatgggtctttcatctgtattggcattattacatgatgtattcattatagtagcgattttcagtttatttagaattgaagtagatttaacatttatcgccgctgtattaacaattgtcggttattcaattaatgatacaatcgtaacgtttgaccgtgtacgtgaaaacttacaaaaggttaaagtgattacgacaacagaacaaattgatgatatcgttaatagatcaattagacagacaatgacacgttcaattaatacagtattaacagttattgtagtagtagttgctatactattcttcggtgctcctacgatattcaactttactttagcattatttatcggattgatttctggtgtattctcttcaatcttcattgccgttccgctatggggaataatgaaaaaacgtcagttgaaaaaatcgccgaaacacaaattagttgtatataaagaaaagaaatcgaacgatgaaaagattttagtt

SEQ ID NO: 314 - protein, 759 aa, Staphylococcus aureus
  MISC_FEATURE (1)..(759): protein-export membrane
VKKSSRIIAFLLLVVLLFAGMAATYKSVIKNVNLGLDLQGGFEVLYQVDPLNKGDKIDKKALQSTAQTLENRVNVLGVSEPKIQVEEPNRIRVQLAGVTDQNEARKILSSQANLTIRDAEDKVKLSGSDIKQGSAKQEFKQETNQPTVTFKVKDKNKFKKVTEEISKKRDNVMVVWLDFKKGDSYKKEAQKKNPKFISAASVDQPINSDSVEISGGFKGQEGVKKAKQIAELLNAGSLPVDLKEIYSNSVGAQFGQDALDKTVFASFIGVALIYLFMLGFYRLPGLVAIIALTTYIYLTLVAFNFISGVLTLPGLAALVLGVGMAVDANIIMYERIKDELRIGRTIKQAFSKANKSSFLTIFDSNLTTVIAAAVLFFFGESSVKGFATMLLLGILMIFVTAVFLSRFLLSLLVSSNIFKNQFWLFGVKKNKRHDINEGVDVHDLKTSFEKWNFVKLAKPLIGVSILIVVVGLVILYIFKLNLGIDFSSGTRVDFQSKQAITQQKVEQVVKDSGLKADQIQINGKDNKVATVQFKDDLTRAQDNKLSDNIKSKFGDTPQINTVSPIIGQELAKNAMLALIYASIGIIIYVSLRFEWRMGLSSVLALLHDVFIIVAIFSLFRIEVDLTFIAAVLTIVGYSINDTIVTFDRVRENLQKVKVITTTEQIDDIVNRSIRQTMTRSINTVLTVIVVVVAILFFGAPTIFNFTLALFIGLISGVFSSIFIAVPLWGIMKKRQLKKSPKHKLVVYKEKKSNDEKILV

SEQ ID NO: 315 - DNA, 2271 bp, Staphylococcus aureus
atgattaaaccgaagtataagtggaaattaactaaaccagctgaatacataagtgatgaattaacatcaaaattaaagttaacgccaatcgtaaaaaaaatattagaaagtaaatcgattattgatgaacaagcaatagaatccatcatttcagatacagatatcaatcatgatgcactgcaattgagcgatatgactaagactattgaaagaattaaaagagcgatagcgaatgatgagaaaatcctagtttatggtgattacgatgccgacggtgttaccgcaactacaattttagtgataacattacaacttttaggtgcacaagtaggatggcatattcctaaccgctttaccgaaggatatggaccaaacgaactagcatttagaaatgctcatgatgaaggcataacattaatcataactgttgataatggcatacaaggtcataatgaaattaaaatggttcaagatttaggagttgatgtcattgtaactgatcatcatgaaattggtagtacattaccagaagcatatgcaatcgtacatccaatgcatccatcgtttaattatccgttccaacaattgtgtggtgcaggtgttgcatacaaattagcacaagcattgattgaaaatgtacctgattattttaaagcattagttgcgataggtaccattgcggatttagtatccttaactgatgaaaatcgatcattagtgaaacaaggattaaaagtcttaaatgatcaatgtccgacctctgttaaagcattgctaaaagaagcgggatacaatgacaatattgatgaagaaacaattggttttattattggacctagacttaatgctgtaggtcgtttagatgacgcatcattagcttgcgaattgttgatgactgacgtcgaagaagaagctgcatttttagcagaacaagttgaacattttaaccgtgaaagaaaagatattgtagcaactatcacagaagaagcaatggctatggcagaaacgaaagttaaaaagggagatttatttttacttttagcaaaagaaaattggcatgaaggtgtcttaggtattgttgcttcgaaaattgtcgaaacatttgctttgccaacattaattttaaatattgatagggagcaaaatcatgcaaaaggctccgccagatcaattgatcaagtgtcgatgtttgaaatactatcagcacatcaagagttaatcgctaaatttggcggccatcatatggctgcaggtatgacgatggatattgaaaatatagaatcgttagctgaaggtttaaataaatggatgaaagaattatctaaaacaacttcgttagatcccgtaaagcaagtagatgtattattaacagaaaatgatataacgattaaaaatattcgtgatatgaatcgtttaagacccttcggaacagatttttctagacctatttttgaaatggatgatttatcagtttcttcagttaaggcgataggtcaacaaaaaaatcatctaaaattgacacttggtgaaagtaatatcgccgcgctattttggcaaaatggacacttagaacctgagttacaagatgaacagccaattaatatattaggatctgttcaaatcaacgaatggaatggtaatcaatcaccgcaaataattattcaagatattgcgatgaatgaacagcaaatattagattatagaagtaagcgaaaaagtttaccttttacagaaaatgatgaaaatattgtcgtgcttattcatcctaaaagtgataaagtaaatgcgaatgaatattattatggtgaagaaattaaacaacaaactgataaagtagtattaagagatttaccaacgtcaatggaagacttgtctaattccttgcaacaactgcaattttctcaactttatatagttttgcaacataatcattcgatttacttcgatggtatacctaatatggatatttttaaaaagtgttataaagcattaataactaaacaagaaacaaatatccagaaagagggtatgttattgtgtcaacatttaagtgtgaaaccagatacacttaaattcatgttgaaagttttcttagacttaaaatttgtaacacaagaagatggtttaattcgaatcaatcaacaacctgataaaagatcgattgattccagcaaagtatatcaattaagacaacaacgtatggatgttgaaaagcaattattatatcaagatttttcagaaataaaaaattggataaagtcacaattgtcg

SEQ ID NO: 316 - protein, 757 aa, Staphylococcus aureus
  MISC_FEATURE (1)..(757): hypothetical protein
MIKPKYKWKLTKPAEYISDELTSKLKLTPIVKKILESKSIIDEQAIESIISDTDINHDALQLSDMTKTIERIKRAIANDEKILVYGDYDADGVTATTILVITLQLLGAQVGWHIPNRFTEGYGPNELAFRNAHDEGITLIITVDNGIQGHNEIKMVQDLGVDVIVTDHHEIGSTLPEAYAIVHPMHPSFNYPFQQLCGAGVAYKLAQALIENVPDYFKALVAIGTIADLVSLTDENRSLVKQGLKVLNDQCPTSVKALLKEAGYNDNIDEETIGFIIGPRLNAVGRLDDASLACELLMTDVEEEAAFLAEQVEHFNRERKDIVATITEEAMAMAETKVKKGDLFLLLAKENWHEGVLGIVASKIVETFALPTLILNIDREQNHAKGSARSIDQVSMFEILSAHQELIAKFGGHHMAAGMTMDIENIESLAEGLNKWMKELSKTTSLDPVKQVDVLLTENDITIKNIRDMNRLRPFGTDFSRPIFEMDDLSVSSVKAIGQQKNHLKLTLGESNIAALFWQNGHLEPELQDEQPINILGSVQINEWNGNQSPQIIIQDIAMNEQQILDYRSKRKSLPFTENDENIVVLIHPKSDKVNANEYYYGEEIKQQTDKVVLRDLPTSMEDLSNSLQQLQFSQLYIVLQHNHSIYFDGIPNMDIFKKCYKALITKQETNIQKEGMLLCQHLSVKPDTLKFMLKVFLDLKFVTQEDGLIRINQQPDKRSIDSSKVYQLRQQRMDVEKQLLYQDFSEIKNWIKSQLS

SEQ ID NO: 317 - DNA, 516 bp, Staphylococcus aureus
atggatttaaagcaatacgtatcagaagttcaagattggccgaaaccaggtgttagtttcaaggatattactacaattatggataatggtgaagcatatggctatgcaacagataaaattgtagaatacgcaaaagacagagatgttgatatcgttgtaggacctgaagcgcgtggctttatcattggctgtcctgtagcttattcaatggggattggctttgcacctgttagaaaagaagggaaattacctcgtgaagtcattcgttatgagtatgacctagaatatggtacaaatgttttaacaatgcacaaagatgcaattaaaccaggtcaacgtgtgttaattacagatgatttattagctactggtggtacgattgaagcagcaataaaattagttgaaaaattaggcggtatcgtagtaggtattgcatttataattgaattgaaatatttaaatggtattgaaaaaattaaagattacgatgttatgagtttaatctcatacgacgaa

SEQ ID NO: 318 - protein, 172 aa, Staphylococcus aureus
  MISC_FEATURE (1)..(172): adenine phosphoribosyl
MDLKQYVSEVQDWPKPGVSFKDITTIMDNGEAYGYATDKIVEYAKDRDVDIVVGPEARGFIIGCPVAYSMGIGFAPVRKEGKLPREVIRYEYDLEYGTNVLTMHKDAIKPGQRVLITDDLLATGGTIEAAIKLVEKLGGIVVGIAFIIELKYLNGIEKIKDYDVMSLISYDE

SEQ ID NO: 319 - DNA, 2208 bp, Staphylococcus aureus
atgaatggggtgtatcatataatgaacaacgaatatccatatagtgcagacgaagttcttcacaaagcaaaatcatatttgtcagcagatgaatatgagtatgttttaaaaagctatcatattgcttatgaagcacataaaggtcagttccgaaaaaacggattaccatacattatgcatcctatacaagttgcaggtattttaacagaaatgcgattagacggaccgacgattgtcgcaggttttttgcatgatgtaattgaagatacaccgtatacatttgaagatgtaaaagaaatgttcaatgaagaagttgctcgaattgttgatggtgtgacgaagcttaaaaaagtaaaataccgctcaaaagaagaacaacaagctgaaaatcatcgcaagttatttattgcgattgccaaagatgtacgcgtaattttggtgaaattagcagacagattacataatatgcgtaccttgaaagccatgccgcgcgaaaaacaaattagaatttctcgagaaacattagaaatttatgcaccattagcacatcgtcttggtattaatacaatcaaatgggaactagaagatacggctcttcgttatattgataatgtgcaatattttagaatagtcaatttaatgaagaagaaacgtagtgaacgtgaagcgtatatcgaaacggctattgatagaatacgtactgaaatggaccgaatgaatatcgaaggcgatataaatggtagacctaaacatatttacagtatttatcggaaaatgatgaagcagaaaaaacaatttgatcaaatttttgatttgttggcgatacgtgttattgtcaattctattaatgattgttatgcgatacttgggttggtgcatacgttatggaaaccgatgccaggacgttttaaagattatattgcaatgcctaaacaaaatttgtatcagtcattgcatactacagtagtaggcccaaatggagacccgctcgaaatccaaatacgaacgtttgatatgcacgaaattgctgagcatggtgttgcagcacactgggcttacaaagaaggtaaaaaagtaagtgaaaaagatcaaacttatcaaaataagttaaattggttaaaagaattagctgaagcggatcatacatcgtctgacgctcaagaatttatggaaaccttaaaatatgacttacagagtgacaaagtatacgcatttaccccagcgagtgatgttattgagttgccatatggtgctgtgccgattgattttgcttatgcgattcacagtgaagtaggtaataagatgattggtgccaaggtgaatggcaaaattgtaccaattgactatattttacaaacaggcgatattgttgaaatacgtactagtaaacattcatatggaccaagtcgtgattggttgaaaattgttaaatcgtctagtgccaaaggtaaaattaaaagtttcttcaaaaaacaagatcgttcatctaatattgaaaaaggccgaatgatggttgaagctgaaataaaagagcaaggatttagagtcgaagatattttgacagagaaaaatattcaggttgttaatgaaaaatataactttgcaaatgaagatgatttattcgcagctgtaggatttggcggcgtgacatccttacagattgttaataaattaactgaaagacaacgtattttagataaacaacgtgctttaaatgaagcacaagaagttacgaaatcattgcctattaaagacaacatcattactgatagtggtgtctatgtagaaggtttagaaaatgtacttatcaagttgtcaaaatgttgtaatcctataccaggtgatgatattgtaggttatatcaccaaaggtcacggtattaaagtacatcgcactgattgcccaaatattaagaacgaaactgaacgactaattaatgttgaatgggtaaaatcaaaagacgcaactcaaaaatatcaggttgatttagaggtaactgcgtatgaccgaaatggcttgttgaatgaagtactacaagctgttagctcgacagccggcaatttaattaaagtttcaggacgttcagatattgataaaaatgcaataataaatattagtgtcatggtgaaaaacgtgaatgatgtttatcgtgtggtagaaaagatcaaacaacttggtgatgtttatacagtaacaagagtttggaac

SEQ ID NO: 320 - protein, 736 aa, Staphylococcus aureus
  MISC_FEATURE (1)..(736): GTP pyrophosphokinase
MNGVYHIMNNEYPYSADEVLHKAKSYLSADEYEYVLKSYHIAYEAHKGQFRKNGLPYIMHPIQVAGILTEMRLDGPTIVAGFLHDVIEDTPYTFEDVKEMFNEEVARIVDGVTKLKKVKYRSKEEQQAENHRKLFIAIAKDVRVILVKLADRLHNMRTLKAMPREKQIRISRETLEIYAPLAHRLGINTIKWELEDTALRYIDNVQYFRIVNLMKKKRSEREAYIETAIDRIRTEMDRMNIEGDINGRPKHIYSIYRKMMKQKKQFDQIFDLLAIRVIVNSINDCYAILGLVHTLWKPMPGRFKDYIAMPKQNLYQSLHTTVVGPNGDPLEIQIRTFDMHEIAEHGVAAHWAYKEGKKVSEKDQTYQNKLNWLKELAEADHTSSDAQEFMETLKYDLQSDKVYAFTPASDVIELPYGAVPIDFAYAIHSEVGNKMIGAKVNGKIVPIDYILQTGDIVEIRTSKHSYGPSRDWLKIVKSSSAKGKIKSFFKKQDRSSNIEKGRMMVEAEIKEQGFRVEDILTEKNIQVVNEKYNFANEDDLFAAVGFGGVTSLQIVNKLTERQRILDKQRALNEAQEVTKSLPIKDNIITDSGVYVEGLENVLIKLSKCCNPIPGDDIVGYITKGHGIKVHRTDCPNIKNETERLINVEWVKSKDATQKYQVDLEVTAYDRNGLLNEVLQAVSSTAGNLIKVSGRSDIDKNAIINISVMVKNVNDVYRVVEKIKQLGDVYTVTRVWN

SEQ ID NO: 321 - DNA, 471 bp, Staphylococcus aureus
ttggaactagaggtgcaaaatatgaaagtagttgtacaaagagttaaagaagcatcggtgacgaatgatacattaaataatcaaatcaaaaaaggatattgtttattagtcggtatcggtcagaactctacagagcaagatgcagatgtaattgcaaagaaaattgctaatgcaagattatttgaagatgacaataataaattaaactttaatatccaacaaatgaatggtgaaatactatcagtttcacaatttactctctatgcagatgtaaaaaaaggtaaccgtccaggtttctcaaattctaaaaatcctgatcaagcggtaaaaatttatgagtattttaatgatgcgctacgagcgtatggtcttactgtgaaaacaggtgaatttggaacacacatgaatgttagcataaataatgatggtccagtcactattatttatgaaagtcaggacggcaaaattcaa

SEQ ID NO: 322 - protein, 157 aa, Staphylococcus aureus
  MISC_FEATURE (1)..(157): conserved hypothetical
LELEVQNMKVVVQRVKEASVTNDTLNNQIKKGYCLLVGIGQNSTEQDADVIAKKIANARLFEDDNNKLNFNIQQMNGEILSVSQFTLYADVKKGNRPGFSNSKNPDQAVKIYEYFNDALRAYGLTVKTGEFGTHMNVSINNDGPVTIIYESQDGKIQ

SEQ ID NO: 323 - DNA, 1125 bp, Staphylococcus aureus
atgaaaagtaaatacgaaccattgtttgataaagtagaattaccaaatggagtagagttgagaaatcgatttgtgttagcccctttaacacatatttcttcaaatgatgatggtactatttcagatgtagaacttccttatattgaaaagcgttcacaagatgttggtattacaattaatgctgcgagtaatgtgagtgatgtcggaaaagcatttccaggacagccatcaatcgcgcatgacagtaatattgaaggactaaaacgattagctacagcaatgaagaaaaacggtgccaaagcactcgtacaaatacatcatggcggtgcacaagcattgcctgaattaacacctgatggagacgtcgtagcaccaagtccaatttctttaaaaagttttggtcagaaacaagaacatagtgctagagaaatgacgaatgaagagattgaacaagcaatcaaggattttggtgaagcaacgcgacgtgcaattgaagcagggtttgatggtgttgaaatacatggcgcgaatcattacttaattcatcaatttgtatcaccatactataatagaagaaatgatgtatgggcaaatcaatataaattcccggtcgctgtgattgaagaagtacttaaagcgaaagaagcgtatggcaataaagactttatagttggatacagattatctccagaggaagcggagtctccaggaatcacaatggaaattacagaggaactcgttaataaaattagccatatgccaatcgactatattcatgtttcaatgatggatacgcatgcaacgacacgtgaaggtaaatacgctggacaagaaagactgcctttaattcacaaatggataaatggtcgtatgccacttatcggtattggttcaattttcacagctgacgaagctttagatgcagttgaaaatgttggtgttgacttagtagccattggtagagagctactactggattatcaatttgttgaaaaaattaaagatggacgggaagatgaaattattaattactttgatccagagagagaagataatcatcacttaactcctaatttatggcatcaatttaatgaagggttttatccattaccacgtaaagataaa

SEQ ID NO: 324 - protein, 375 aa, Staphylococcus aureus
  MISC_FEATURE (1)..(375): hypothetical protein
MKSKYEPLFDKVELPNGVELRNRFVLAPLTHISSNDDGTISDVELPYIEKRSQDVGITINAASNVSDVGKAFPGQPSIAHDSNIEGLKRLATAMKKNGAKALVQIHHGGAQALPELTPDGDVVAPSPISLKSFGQKQEHSAREMTNEEIEQAIKDFGEATRRAIEAGFDGVEIHGANHYLIHQFVSPYYNRRNDVWANQYKFPVAVIEEVLKAKEAYGNKDFIVGYRLSPEEAESPGITMEITEELVNKISHMPIDYIHVSMMDTHATTREGKYAGQERLPLIHKWINGRMPLIGIGSIFTADEALDAVENVGVDLVAIGRELLLDYQFVEKIKDGREDEIINYFDPEREDNHHLTPNLWHQFNEGFYPLPRKDK

SEQ ID NO: 325 - DNA, 873 bp, Staphylococcus aureus
atgaaaaaaatagaggcatggttatctaaaaagggtcttaaaaataaacgtactctaatagtagtgattgcctttgtcttatttatcatctttttatttttattgctgaatagcaatagtgaagatagtgggaacatcacgataactgaaaatgctgaattacgtacaggtccaaacgctgcgtatccagtcatatataaagttgaaaaaggtgaccattttaaaaagattggtaaagtaggtaaatggattgaagttgaagatacatccagtaatgaaaaaggttggatagctggatggcacacaaatttagatattgtcgcggataatacgaaggagaaaaatcctttgcaaggtaaaacaatagtgcttgatcctggtcatggaggtagtgaccagggtgcttcaagcaatactaaatataaaagtttagaaaaagattatacgttgaaaacagcaaaagaattgcagcgtactttagaaaaagaaggcgcaactgttaagatgacaagaacagacgatacatatgtttcactagaaaatcgtgatatcaaaggcgatgcctatttgagtatacataatgatgcgttagaatcatctaatgcaaatggaatgacagtttattggtatcatgataatcaaagagctttagcagatacgttagacgctacgattcagaagaaaggtctactttctaatcgcggttcaagacaagaaaattatcaagtgttaagacaaacaaaagttcctgctgttttattagaattaggttatattagtaacccaactgatgaaacgatgattaaagatcaattacatagacaaattttagaacaagcaattgttgatggccttaaaatttatttttctgcg

SEQ ID NO: 326 - protein, 291 aa, Staphylococcus aureus
  MISC_FEATURE (1)..(291): N-acetylmuramoyl-L-alanine
MKKIEAWLSKKGLKNKRTLIVVIAFVLFIIFLFLLLNSNSEDSGNITITENAELRTGPNAAYPVIYKVEKGDHFKKIGKVGKWIEVEDTSSNEKGWIAGWHTNLDIVADNTKEKNPLQGKTIVLDPGHGGSDQGASSNTKYKSLEKDYTLKTAKELQRTLEKEGATVKMTRTDDTYVSLENRDIKGDAYLSIHNDALESSNANGMTVYWYHDNQRALADTLDATIQKKGLLSNRGSRQENYQVLRQTKVPAVLLELGYISNPTDETMIKDQLHRQILEQAIVDGLKIYFSA

SEQ ID NO: 327 - DNA, 1260 bp, Staphylococcus aureus
atgattaaaatacctagagggacgcaggatattttacctgaagattcaaagaaatggcgttacattgaaaatcaattagatgaattaatgacattttataattataaagaaataagaacaccaatttttgaaagtacagatctttttgcaagaggtgttggtgattcaaccgatgtcgtacaaaaagaaatgtatacatttaaagataaaggcgatagaagtattacattaagacctgagggaacagctgcagttgtgcgttcatatattgaacataaaatgcaaggtaatccaaaccaaccaattaaactttattacaatggaccgatgtttagatatgaacgtaagcaaaaaggacgctatcgtcaatttaatcaatttggtgtagaagctattggtgctgaaaatcctagcgtagatgcagaagtattagctatggttatgcatatttatcaatcatttggattaaaacatttaaagcttgttattaatagtgtaggggatatggcgtctcgaaaagaatataacgaagcgttagtgaaacactttgaaccagtaattcatgaattttgttcagattgtcaatcacgtttgcatacaaatccgatgcgaattttggattgtaaagtagaccgtgataaagaagcgattaagactgcacctagaatcactgatttcttaaatgaggaatctaaggcatattatgaacaagtaaaagcttatttagatgatttaggtattccatatattgaagatcctaacttagttcgtggattggattattatacacatacagcatttgaattaatgatggataaccctaactatgatggtgccattacaacgctttgtggtggtggccgttataatggtttattagaattgctagatggtccaagtgaaacaggtattggttttgcgctaagtatagaacgattattgcttgcacttgaagaagaaggtatcgaattagatattgaagaaaacttagatttattcattgttacaatgggtgatcaagcagatcgatatgctgtgaagctattaaatcatttgagacataatggtattaaagcagataaagactatttacagcgtaaaattaaaggacaaatgaaacaagcagaccgtttaggtgccaagtttacaatcgttattggtgatcaagaattagaaaataataaaatcgatgttaaaaatatgacaactggtgaatctgaaacaattgaattagacgcattagtcgaatattttaagaag

SEQ ID NO: 328 - protein, 420 aa, Staphylococcus aureus
  MISC_FEATURE (1)..(420): histidyl-tRNA synthetase
MIKIPRGTQDILPEDSKKWRYIENQLDELMTFYNYKEIRTPIFESTDLFARGVGDSTDVVQKEMYTFKDKGDRSITLRPEGTAAVVRSYIEHKMQGNPNQPIKLYYNGPMFRYERKQKGRYRQFNQFGVEAIGAENPSVDAEVLAMVMHIYQSFGLKHLKLVINSVGDMASRKEYNEALVKHFEPVIHEFCSDCQSRLHTNPMRILDCKVDRDKEAIKTAPRITDFLNEESKAYYEQVKAYLDDLGIPYIEDPNLVRGLDYYTHTAFELMMDNPNYDGAITTLCGGGRYNGLLELLDGPSETGIGFALSIERLLLALEEEGIELDIEENLDLFIVTMGDQADRYAVKLLNHLRHNGIKADKDYLQRKIKGQMKQADRLGAKFTIVIGDQELENNKIDVKNMTTGESETIELDALVEYFKK

SEQ ID NO: 329 - DNA, 1764 bp, Staphylococcus aureus
atgagtaagagaacaacttattgtggattagttactgaggcatttttaggacaagaaattacattaaaaggatgggttaacaatcgtcgtgaccttggtggattgattttcgttgatttaagagatagagaaggaattgtacaagtcgtgtttaatcctgcattttcagaagaggcattgaaaattgctgaaacagtacgttctgaatatgttgtagaagttcaaggtacagttacgaagcgtgaccctgaaacagttaatcctaaaattaaaactggccaagttgaagtacaagttacaaatattaaagtgattaataaatctgagacaccaccattttctataaatgaagaaaatgttaacgttgatgaaaatattcgattaaaataccgttatttagatttacgtcgtcaagagttagcgcaaacatttaaaatgagacatcaaattacacgttctattcgtcaatatttggatgatgaagggttctttgacatcgaaacaccagtactaacgaagtcaacacctgagggtgcacgtgactatttagtaccatctcgtgttcatgatggtgaattttatgcattaccacaatcaccacaattatttaagcaattattgatgattagtggatttgacaaatactaccaaatcgtaaaatgcttccgtgacgaagatttacgtgcagatcgtcaacctgaatttacacaagtcgatattgaaatgagttttgtagaccaagaagatgtgatgcaaatgggtgaagaaatgcttaaaaaagttgttaaagaagttaaaggcgttgaaattaatggcgctttcccacgcatgacatataaagaagcgatgcgtcgctatggttctgataaaccagatacacgttttgaaatggaattaattgacgtttctcaattaggacgtgatatggactttaaagtatttaaagatactgttgaaaatgatggtgaaattaaagcaattgtcgctaaaggtgcagctgaacaatatactcgtaaagatatggatgctttaacagaatttgtaaacatctatggtgctaaaggattagcgtgggttaaagttgtggaagatggtttgacaggtccaattggacgtttctttgaaacagaaaatgttgaaacattacttacattaactggtgctgaagctggtgacttagtaatgtttgttgcagacaaaccaaatgtcgttgcacaaagtttaggtgcattacgtgtcaaattagctaaagaattaggtttaatcgatgaaacaaaattaaacttcttatgggtgacagattggccattattagaatatgatgaagatgcgaaacgttacgttgcagcacatcatccatttacatctccaaaagaagctgatattgctaagcttggcactgcgccagaagaagctgaggcaaatgcttatgacatagtattaaatggttatgaattaggtggcggttcaatcagaattcatgatggtgagttacaagaaaaaatgttcgaagttcttggatttactaaagaacaagcacaagaacagttcggcttcttactagatgcatttaaatatggtgcaccaccacatggcggtattgcattaggattagaccgattagtcatgttattgactaatagaacaaacttgagagatacaatcgcattccctaaaacagcatctgctacatgtttattaacgaatgcgcctagtgaagtttctgataaacaattagaagaactttctttgcgaattcgtcac

SEQ ID NO: 330 - protein, 588 aa, Staphylococcus aureus
  MISC_FEATURE (1)..(588): aspartyl-tRNA synthetase
MSKRTTYCGLVTEAFLGQEITLKGWVNNRRDLGGLIFVDLRDREGIVQVVFNPAFSEEALKIAETVRSEYVVEVQGTVTKRDPETVNPKIKTGQVEVQVTNIKVINKSETPPFSINEENVNVDENIRLKYRYLDLRRQELAQTFKMRHQITRSIRQYLDDEGFFDIETPVLTKSTPEGARDYLVPSRVHDGEFYALPQSPQLFKQLLMISGFDKYYQIVKCFRDEDLRADRQPEFTQVDIEMSFVDQEDVMQMGEEMLKKVVKEVKGVEINGAFPRMTYKEAMRRYGSDKPDTRFEMELIDVSQLGRDMDFKVFKDTVENDGEIKAIVAKGAAEQYTRKDMDALTEFVNIYGAKGLAWVKVVEDGLTGPIGRFFETENVETLLTLTGAEAGDLVMFVADKPNVVAQSLGALRVKLAKELGLIDETKLNFLWVTDWPLLEYDEDAKRYVAAHHPFTSPKEADIAKLGTAPEEAEANAYDIVLNGYELGGGSIRIHDGELQEKMFEVLGFTKEQAQEQFGFLLDAFKYGAPPHGGIALGLDRLVMLLTNRTNLRDTIAFPKTASATCLLTNAPSEVSDKQLEELSLRIRH

SEQ ID NO: 331 - DNA, 126 bp, Staphylococcus aureus
ttgggttttatagcgtttaataaatgtttcctcgttgaattttgggaaaataatcaaagtgataatgctaaatataaaattttaagttactatgtacttatgtataaatcagtgaaagaggtaaaa

SEQ ID NO: 332 - protein, 42 aa, Staphylococcus aureus
LGFIAFNKCFLVEFWENNQSDNAKYKILSYYVLMYKSVKEVK

SEQ ID NO: 333 - DNA, 771 bp, Staphylococcus aureus
atgaaacatcaattttcaagaaatgaactagcgattggacaacaaggtttagatttattgaagcaacaaactgttgtcatacttggcgttggaggtgttggttcatttgctgctgaagcattagcaagaacgaatattggtcatattatattaatagataaagatgatgttgatattacaaatgtaaacagacaattacacgctttaactacaacggtaggacaaagtaaagtttctttgatggaagaacgtattaaattaattaatccagattgtaaagtcacgcccttacatatgttttatacagaagagacatatgaagaaattttcgataactacgatatagattattttgtagatgcaagtgatacaataatgtacaaagtacacttaatgaaagagtgtcttgaccgagggattaaagtgatttccagtatgggtgctgcaaataaaacagatccaacacgttttacaatttcagatatctctaaaacacataccgatccaatggccaaaattattcgtcaaaaattgaaaaaactaggaattcgtaaagggattccagttgtattttcagatgaaagtccaattgtcataagagaagatgtaaaagatatagttggagataaaaatgctatcaatcgaaaaggacaaatgccaccttcttcaaatgcctttgtgccaagtgttgttggattaatttgtgcaagttatgtggtgaatgacgtattaaaagatattccagttcgtcgcattaaagacaaagggcaa

SEQ ID NO: 334 - protein, 257 aa, Staphylococcus aureus
  MISC_FEATURE (1)..(257): conserved hypothetical
MKHQFSRNELAIGQQGLDLLKQQTVVILGVGGVGSFAAEALARTNIGHIILIDKDDVDITNVNRQLHALTTTVGQSKVSLMEERIKLINPDCKVTPLHMFYTEETYEEIFDNYDIDYFVDASDTIMYKVHLMKECLDRGIKVISSMGAANKTDPTRFTISDISKTHTDPMAKIIRQKLKKLGIRKGIPVVFSDESPIVIREDVKDIVGDKNAINRKGQMPPSSNAFVPSVVGLICASYVVNDVLKDIPVRRIKDKGQ

SEQ ID NO: 335 - DNA, 1281 bp, Staphylococcus aureus
gtgacaaatgtgagtacagaaccattagcatcgagaatgcgcccaaaaaatatagatgaaatcatttcccaacaacatttagttggaccaagaggcattatcagaagaatggttgatacaaaaaaattaacttcaatgattttttatggtccacctggtataggcaaaacaagtattgccaaagcaatttcgggcagtacgcaatataaattcagacaattgaatgctgtaactaacactaaaaaagatatgcaacttgttgttgaagaagctaaaatgtctggtcaagttatcttgttattagatgaaatacatcgactagataaagctaaacaagactttttattacctcatttagaaaatggcaaaatcgtcttgatcggtgctacaacttcaaatccttatcatgctatcaatccagcgattcgttcaagagcgcaaattttcgagttatatcctttaaatgacgaagatgtgcgccaagcgttaactcgtgcaatagaagatgatgagaatggtttgaaaacatatcaacccaaaattgatgaagatgccatgacctacttttctacacaaagccaaggtgatgttcgtagtgcgttaaatgcattggaattagctgtattaagcgcagataatgacaaagacggttatcgacatgttacattgcaagatgctaaagactgtttacaaaaaggtgcatttgtaagtgacaaggatggtgacatgcattacgatgttatgagcgctttccaaaaatctatccgtggtagcgacgtcaatgccgctttacattatttagcacgattaattgaagctggagatttacctacaatagttcgacgattacttgtaattagctatgaggatataggcttagcctcacctaatgctggtcagagaacacttgctgctattgaatcagcagaacgtctaggtttaccagaagctagaattccactaagccaagcagtaatcgaactatgcttatcacctaagtcaaattcagcaatgagtgccattgatagtgcattgtccgatattagaaacggtcatgtgggccaaattccaaaccatttaaaagatggacattatcaaggtgctaaagatctaggccgatctattggttacaaatatccacaccaatatgttaatggctatgtttcacagcaatatttacctgataaactaaaaaacaaaatttattacgaaccaaaaacgacatctaaaagtgaacaacaactcaaagaaatatataacaacttacttaaacaaaggccg

SEQ ID NO: 336 - protein, 427 aa, Staphylococcus aureus
  MISC_FEATURE (1)..(427): conserved hypothetical
VTNVSTEPLASRMRPKNIDEIISQQHLVGPRGIIRRMVDTKKLTSMIFYGPPGIGKTSIAKAISGSTQYKFRQLNAVTNTKKDMQLVVEEAKMSGQVILLLDEIHRLDKAKQDFLLPHLENGKIVLIGATTSNPYHAINPAIRSRAQIFELYPLNDEDVRQALTRAIEDDENGLKTYQPKIDEDAMTYFSTQSQGDVRSALNALELAVLSADNDKDGYRHVTLQDAKDCLQKGAFVSDKDGDMHYDVMSAFQKSIRGSDVNAALHYLARLIEAGDLPTIVRRLLVISYEDIGLASPNAGQRTLAAIESAERLGLPEARIPLSQAVIELCLSPKSNSAMSAIDSALSDIRNGHVGQIPNHLKDGHYQGAKDLGRSIGYKYPHQYVNGYVSQQYLPDKLKNKIYYEPKTTSKSEQQLKEIYNNLLKQRP

SEQ ID NO: 337 - DNA, 348 bp, Staphylococcus aureus
atgaaaatttctactaaagggagatatggacttacattgatgatttctcttgctaaaaaagaggggcaaggatgtatatcattaaagtcaattgctgaagaaaataatttgagtgatttatatttagaacagcttgtaggtcctttaagaaatgcggggttaattcgaagtgtacgcggtgctaaaggtggataccaattaagagtgccagcggaagaaatctcagcaggggatattataagactgttagaaggtccaattacatttgttgaaagtattgaatcagaaccacctgcgcaaaaaacaactatggattcgcatgagagatgcagtgagagatgttttaga

SEQ ID NO: 338 - protein, 116 aa, Staphylococcus aureus
  MISC_FEATURE (1)..(116): conserved hypothetical
MKISTKGRYGLTLMISLAKKEGQGCISLKSIAEENNLSDLYLEQLVGPLRNAGLIRSVRGAKGGYQLRVPAEEISAGDIIRLLEGPITFVESIESEPPAQKTTMDSHERCSERCFR

SEQ ID NO: 339 - DNA, 156 bp, Staphylococcus aureus
ttgttgaaagtattgaatcagaaccacctgcgcaaaaaacaactatggattcgcatgagagatgcagtgagagatgttttagataatacaacattgaaatatttagcggaatatgtagatacaagtgaagatttagacggatacatgttttatatt

SEQ ID NO: 340 - protein, 52 aa, Staphylococcus aureus
  MISC_FEATURE (1)..(52): conserved hypothetical
LLKVLNQNHLRKKQLWIRMRDAVRDVLDNTTLKYLAEYVDTSEDLDGYMFYI

SEQ ID NO: 341 - DNA, 1209 bp, Staphylococcus aureus
atgatgaaaaggggagatatgatgactaaatctgaaaaaattattgagttaacaaatcattacggagcacataattatttaccattgccaattgtcatttcagaagctgaaggggtatgggttaaagatcctgaaggcaataaatatatggatatgttatctgcatattccgctgttaaccaaggtcatagacatccgaaaattattcaagcattaaaagatcaagctgataaagtgactttagtttcacgtgcttttcatagtgataacttaggtgaatggtacgaaaaaatttgtaaactggcaggtaaagataaagctttaccaatgaatacaggtgctgaagcagtagaaacagctttgaaagcagcacgacgctgggcatacgatgttaaaggaattgagccaaataaagcagaaatcattgcatttaatggtaacttccatggtcgaacaatggcgccagtttcattatcttcagaagcagaataccaacgtggttatggtccgttattagatggatttagaaaagttgattttggagatgtagatgcattgaaagctgcaattaatgaaaatactgcagcagttttagtagaaccaattcaaggtgaagcgggtataaatataccgccagaaggatatttgaaagcaattagagaattatgtgatgaacataatgtcttatttattgctgacgaaatccaagcaggattaggtcgttcgggtaaattatttgctacggattgggataatgtaaaacctgatgtctatattttaggtaaagcactaggtggtggagtcttcccaatttctgttgtattagcagataaagaagtattagatgtctttacacctggctcacatggttcaacatttggtggtaatccacttgcttgtgctgcatcaattgctgcattagatgttatcgttgatgaggatttaccaggccgctctttagaattaggagattattttaaagaacaattaaagcaaattgatcatccatcaattaaagaagtccgtggacgtggtttgtttataggtgtggaacttaatgaaagtgctagaccatattgtgaagctttgaaagaagaaggcttattatgtaaagaaacgcatgatactgtcattcgttttgcaccaccattaattattactaaagaagaattggaccttgcacttgaaaaaataagacatgtatttcaa

SEQ ID NO: 342 - protein, 403 aa, Staphylococcus aureus
  MISC_FEATURE (1)..(403): ornithine aminotransferase
MMKRGDMMTKSEKIIELTNHYGAHNYLPLPIVISEAEGVWVKDPEGNKYMDMLSAYSAVNQGHRHPKIIQALKDQADKVTLVSRAFHSDNLGEWYEKICKLAGKDKALPMNTGAEAVETALKAARRWAYDVKGIEPNKAEIIAFNGNFHGRTMAPVSLSSEAEYQRGYGPLLDGFRKVDFGDVDALKAAINENTAAVLVEPIQGEAGINIPPEGYLKAIRELCDEHNVLFIADEIQAGLGRSGKLFATDWDNVKPDVYILGKALGGGVFPISVVLADKEVLDVFTPGSHGSTFGGNPLACAASIAALDVIVDEDLPGRSLELGDYFKEQLKQIDHPSIKEVRGRGLFIGVELNESARPYCEALKEEGLLCKETHDTVIRFAPPLIITKEELDLALEKIRHVFQ

SEQ ID NO: 343 - DNA, 393 bp, Staphylococcus aureus
ttgtatctacatattccgctaaatatttcaatgttgtattatctaaaacatctctcactgcatctctcatgcgaatccatagttgttttttgcgcaggtggttctgattcaatactttcaacaaatgtaattggaccttctaacagtcttataatatcccctgctgagatttcttccgctggcactcttaattggtatccacctttagcaccgcgtacacttcgaattaaccccgcatttcttaaaggacctacaagctgttctaaatataaatcactcaaattattttcttcagcaattgactttaatgatatacatccttgcccctcttttttagcaagagaaatcatcaatgtaagtccatatctccctttagtagaaattttcattgta

SEQ ID NO: 344 - protein, 131 aa, Staphylococcus aureus
LYLHIPLNISMLYYLKHLSLHLSCESIVVFCAGGSDSILSTNVIGPSNSLIISPAEISSAGTLNWYPPLAPRTLRINPAFLKGPTSCSKYKSLKLFSSAIDFNDIHPCPSFLAREIINVSPYLPLVEIFIV

SEQ ID NO: 345 - DNA, 180 bp, Staphylococcus aureus
atggcagacgaaagtaagttcgatcaatttaaaggaaatgttaaagaaacagtaggtaacgttactgataacaaagaattagaaaaagaaggtcagcaagataaagcgactggtaaagcaaaagaagttgttgaaaatgctaaaaacaaaataactgatgcaattgataaacttaaaaaa

SEQ ID NO: 346 - protein, 60 aa, Staphylococcus aureus
  MISC_FEATURE (1)..(60): sigmaB-controlled gene
MADESKFDQFKGNVKETVGNVTDNKELEKEGQQDKATGKAKEVVENAKNKITDAIDKLKK

SEQ ID NO: 347 - DNA, 144 bp, Staphylococcus aureus
atgagttttatggataaagctaaagacgcagtagaaaaatttaaaaatagcgataatgaacaagttaaaaatgtaaaagataagataaatgaatatacaggatcgaataacgaagagaaaaaagaaaatgaagataaagagaaa

SEQ ID NO: 348 - protein, 48 aa, Staphylococcus aureus
  MISC_FEATURE (1)..(48): hypothetical protein
MSFMDKAKDAVEKFKNSDNEQVKNVKDKINEYTGSNNEEKKENEDKEK

SEQ ID NO: 349 - DNA, 1011 bp, Staphylococcus aureus
atggcgattaaatattcagcattaaaccttgtccctattcgagaaggtgaagatgaacaaacagcaattaataatatggttaatctcgcacaacatttagacgaattatcatatgaaagatattggattgctgaacaccataacgctcccaacctagtaagttcagcaactgctttattaattcaacatacgttagaacatacgaaacacatacgtgtaggttctggaggcatcatgttacctaatcatgctccattaatcgttgcggaacaatttggcacgatggcaacattatttccaaatcgtgtcgatttaggattaggacgtgcacctggaacagatatgatgaccgcaagtgcattaagacgagatcaacatgatggtgtttataaatttccagaagaggtttcattattacaacaatatttcggccctgctcaccaacaagcatatgttcgtgcttatccagcagtaggtaaaaatgtgcctttatacattcttggttcttcaacagattctgcacatttagctgctcgcaaagggcttccatatgtgttcgctggacattttgcacctcaacaaatgaaagaagctatcgaaatttacaaaacgttatttgaaccttctgatgtattagacgaaccttatgttattgtatgtttaaatacaatcgttgctgaaaatgatgacgaagcacaatatttagcttcatctatggcacaagtaatggttagtatcactcgtggcagaatgcagcccgttcaaccgccaacacatgaactacaaaatatattaacgccgagagaatacgcgatggctatggaaagacagaaaatatcattaataggttcagaaaatactgttcaacaaaaaattcaagattttatggaaacttatggtgaagtcaacgaaattatggcaataagttatatttatgataaagatatgcaattagactcttatcgtcggttcaagaatgttataaatcagataaatgaaaaaaacacttta

SEQ ID NO: 350 - protein, 337 aa, Staphylococcus aureus
  MISC_FEATURE (1)..(337): conserved hypothetical
MAIKYSALNLVPIREGEDEQTAINNMVNLAQHLDELSYERYWIAEHHNAPNLVSSATALLIQHTLEHTKHIRVGSGGIMLPNHAPLIVAEQFGTMATLFPNRVDLGLGRAPGTDMMTASALRRDQHDGVYKFPEEVSLLQQYFGPAHQQAYVRAYPAVGKNVPLYILGSSTDSAHLAARKGLPYVFAGHFAPQQMKEAIEIYKTLFEPSDVLDEPYVIVCLNTIVAENDDEAQYLASSMAQVMVSITRGRMQPVQPPTHELQNILTPREYAMAMERQKISLIGSENTVQQKIQDFMETYGEVNEIMAISYIYDKDMQLDSYRRFKNVINQINEKNTL

SEQ ID NO: 351 - DNA, 1140 bp, Staphylococcus aureus
atggaaatttatgcagattatgctgcgaccacaccagtaaaacctgaagtagtagatgcgatgatgacgatttacaattcgcattatggtaatccatcatcaatacatgctaagggaagagatgcgcgtaaatatttagatgagtcaagacgtcaaattgcacaattacttggtgcagatacacatgaaattatatttacgagtggcgcaacagaatcgaataatacggcaattaaaggcatagtaaaagcaaatgaacaattgggtaatcacattatcacatcgaagattgaacatcattctgtgttacatgtttttgaacaattagagcgagaaggttttgatgtaacatatctagatgttgatgatacaggtgctattgatttagatcaacttgaagaaacaattacagataagacgattttagtatctattatgtttgtaaataatgaagttggcacagtgcaacaaatttatgatattcaagatattattgctgagacaaatgcatatttccatgttgatgcggttcaagcaattggacatcttgatgttaagtttgacgaatttgagatcgacgcaatgagtattactgctcataagtttggcggaccaaaaggtgtcggtgcattactagttaaagaccatgttacactagattatcctcaacttggcggtgaacaagaattgaaacgccgtgcaggcactgaaaatcttgcgcaaattgttgggatggctaaagcattacaattagcagaaaagaatcgagacgataacaatattcatttaatgaatttaaaagaacaatttttagttaaattacaagaaagagcgattccatttgaattaaatggttcaatgacggatgctacaggccatattgtaaatctatattttccgtttgttgaagttgaaacgatgttaacattgttggatatggcacaaatctatgtgtcgtctggatctgcatgtacagcaggctctacacaaccgtcgcatgttttagatgcaatgttcgaagatgaggagcgatcaaatcattcgattcgatttagttttaacgaattgactactgaaaatgaaattaatgcaattgtagctgaaattcataaaatatattttaaatttaaggaggagtca

SEQ ID NO: 352 - protein, 380 aa, Staphylococcus aureus
  MISC_FEATURE (1)..(380): iron-sulfur cofactor
MEIYADYAATTPVKPEVVDAMMTIYNSHYGNPSSIHAKGRDARKYLDESRRQIAQLLGADTHEIIFTSGATESNNTAIKGIVKANEQLGNHIITSKIEHHSVLHVFEQLEREGFDVTYLDVDDTGAIDLDQLEETITDKTILVSIMFVNNEVGTVQQIYDIQDIIAETNAYFHVDAVQAIGHLDVKFDEFEIDAMSITAHKFGGPKGVGALLVKDHVTLDYPQLGGEQELKRRAGTENLAQIVGMAKALQLAEKNRDDNNIHLMNLKEQFLVKLQERAIPFELNGSMTDATGHIVNLYFPFVEVETMLTLLDMAQIYVSSGSACTAGSTQPSHVLDAMFEDEERSNHSIRFSFNELTTENEINAIVAEIHKIYFKFKEES

SEQ ID NO: 353 - DNA, 333 bp, Staphylococcus aureus
ttgtcaaataaagatatacgtgttgtcgttggtatgtcaggcggtgtagatagttctgtaacagcccacgtcttaaaagaacaaggttatgatgtcattggcatatttatgaaaaactgggatgacactgacgaaaatggcgtatgtactgcaactgaagattacaacgatgttattgaagtgtgtaatcaaattggcattccgtattacgctgttaattttgaaaaagaatattgggataaagtctttacgtatttcttagatgaatacaaaaaaggtcgtactccaaatccagacgttatgtgtaataaagaaattaagtttaaagccttt

SEQ ID NO: 354 - protein, 111 aa, Staphylococcus aureus
LSNKDIRVVVGMSGGVDSSVTAHVLKEQGYDVIGIFMKNWDDTDENGVCTATEDYNDVIEVCNQIGIPYYAVNFEKEYWDKVFTYFLDEYKKGRTPNPDVMCNKEIKFKAF

SEQ ID NO: 355 - DNA, 771 bp, Staphylococcus aureus
atgaatttaggtgcagattatgtagcaacaggacattacgcacgcatacatcgtcatgaagatggtcatgttgaaatgttacgtggtgtagataataataaagatcaaacatacttcttgaatcaattatctcaacaacaactttcaaaagtgatgttcccaattggcgacatcgaaaagagtgaagtgcgtcgaattgctgaagaacaaggacttgttactgctaagaaaaaagattctacaggcatttgttttatcggcgaaaaaaactttaaaacatttttatcacaatatttacctgcacaaccgggtgatatgataacacttgatggtaagaaaatgggtaaacatagtggtttgatgtattacacaataggacaaagacatggattaggtataggtggagatggcgatccttggtttgttgtcggtaaaaacctaaaagataatgttttatatgtagaacaaggattccatcacgatgcattatacagtgattacttaattgcttcagactattcatttgtaaatccagaagataatgacttagatcaaggttttgaatgtacagctaaatttagatatcgccaaaaagatacgaaagtttttgtgaaacgtgaaaacgaccatgcactacgtgttacttttgctgagccagtaagagcaatcacacctggacaagcagttgttttttatcaaggtgatgtgtgtcttggtggtgcaacaattgacgatgtgttcaaaaatgaaggtcaattaaattatgttgta

SEQ ID NO: 356 - protein, 257 aa, Staphylococcus aureus
MNLGADYVATGHYARIHRHEDGHVEMLRGVDNNKDQTYFLNQLSQQQLSKVMFPIGDIEKSEVRRIAEEQGLVTAKKKDSTGICFIGEKNFKTFLSQYLPAQPGDMITLDGKKMGKHSGLMYYTIGQRHGLGIGGDGDPWFVVGKNLKDNVLYVEQGFHHDALYSDYLIASDYSFVNPEDNDLDQGFECTAKFRYRQKDTKVFVKRENDHALRVTFAEPVRAITPGQAVVFYQGDVCLGGATIDDVFKNEGQLNYVV

SEQ ID NO: 357 - DNA, 666 bp, Staphylococcus aureus
atgatagatcaacaaacaatttatcaatacatacaaaatggaaaaatagaagaagcgttacaagcattgttcggaaatatcgaagaaaatcctacaattattgaaaattatattaatgctggtatcgtacttgctgatgcgaatgagattgaaaaggcagagcgttttttccaaaaagctttaacaatagatccgaagaatggcgtcgtattttttaatctagcaaatgtatattataatcagcaacgttatcaagaagctattaaattatatcaacaagcattacaaacagagattgaacaagttgattgtaattatatgatcggtatggcgtttaatcagttagaatcatttaagctggcattgccgtatttaatgactgctgcggaactagataaagacaaagatgcagaagttcaatttcaatatggtcttgtattatgtcaattagaaatgtttaatgaagccataactcaacttaaacatgtattaacgattgataaaaatcatgttgatgcaagatacaatttgggcttagcgttatttatgaaaaatgaagatattgatgaagcaataactcattttaaagaagctgtgactatcgaccctaaacacttattaagtcagcatgcgctgaaaacattcactaaaatgaaagaggaggag

SEQ ID NO: 358 - protein, 222 aa, Staphylococcus aureus
  MISC_FEATURE (1)..(222): conserved hypothetical
MIDQQTIYQYIQNGKIEEALQALFGNIEENPTIIENYINAGIVLADANEIEKAERFFQKALTIDPKNGVVFFNLANVYYNQQRYQEAIKLYQQALQTEIEQVDCNYMIGMAFNQLESFKLALPYLMTAAELDKDKDAEVQFQYGLVLCQLEMFNEAITQLKHVLTIDKNHVDARYNLGLALFMKNEDIDEAITHFKEAVTIDPKHLLSQHALKTFTKMKEEE

SEQ ID NO: 359 - DNA, 2475 bp, Staphylococcus aureus
atgtcagaccctacactatttgattattcaatgatcaaaggtactgttgaagcgatattgtttcaaaacagtgataatttttatacagtgcttaaagtagatactattgaaacaaatgaagactttgatacaatgccaactgttgtagggtttcttccgaatattgttgaaggcgatgtctacacatttaaagggcaagttgttgatcatccacgttatggtaaacaattaaaagcagagacttttgaaaaagaaatgccacaaacgaaagaagcaattataagttatttatctagtgatttgtttaaaggtgtaggtaaaaagacagctcaaaatattgttaatacattaggtgacaatgcgataaatgatatattagatgaccattcagtgctagaaaaagtttcgggattatctaaaaagaaacagaaacaaattgcagaacaaatttcagcaaatcaagaatctgaaaaaataatgattcgtttacatgatttagggtttggtcctaaactttcaatggcaatttatcagttttatctcggcgatacactgactattttagatcgaaatccatatcaattgatttatgatattaaaggtattggttttaataaagcagatcaacttgctagaaatattggtatcgcttataacgataatgaacgattaaaagctgcgttgctctatacgttagaagaagaatgtattaaacagggacatacatatttgcctatcaatgttgttatagatttaacggttgatgtattaaattatcaagatgaagaggtcatcgaacctgaaaaattagacgaaatgttgcaatacttaaatgaggaaaaacgactaattattgacaatgaacaagttgcaattccaagtttgtattattctgaaatcaaaagtgttcaaaacttattcagaataaagacgcatacaaataaacttacagaaattgaacagtcagatttacaaatgcatattggtgaaatagaagatgcgaatcaagtgaactatgcagcttcacaaaaagaagctttgcaaacggctatcaattctaaggtgatgctattaaccggtggaccgggaacaggaaaaacgacagtaattaaaggtattgttgaattatatgctgagattcatggcttatcattagattatgatgattatgtcaatgatgattatccagttgtattagcagcgccaacaggaagagcgtctaagagactacaagagtcaactggattagaagcaatgacgattcatcgtttaataggttggaatcaagacacaaagccagaggatatattagaaaatgaaataaacgcacgactcataatcattgatgagatgtctatggtagatacttggttgttccaccaatttttaagtgcagttcctttagatgcacaattgatatttgtaggtgatgaggaccaattgccttctgtaggtcctggtcaagtatttaaagatttaattgaatcgaaagctataccacgagtaaatctgactgaagtatatcgtcaacaagatggttcaagcattatagaattagcacatcgaatgaagttgggtcagaaaattgatattacacagcgttttcatgatagaagttttattaactgtcaggcaaaccaaataccaacagttgttgagaaggtagttactagtgctgttaataaagggtatactatggctgatattcaagtgcttgcaccaatgtataaaggaaatgccggtattaaacgtttaaatcaagttttacaagatattttaaaccctaaaaagaaagacacacgagaaattgagtttggtgatgtagtctttagaaaaggtgacaaagtattacaacttgttaataggccaaatgataacatattcaatggtgacataggagttattgttggtattttttgggcgaaagaaaatgcccttaataaagatgtacttgttgtggattttgaaggtaatgaaattacatttacgaaacaagatatgatggaattaacacatgcttattgtacatcaatccataaatcacaaggttcagaatttcctattgttatcatgcctattgttaaacagtattttagaatgttacaaagaccgatattatatactggtttaactagagcgaaaacgagtttagttttacttggtgatccggaagcatttgatattggattgaaaacaaatggtcaagcgcgtttaacacaattatgtacattgttgaaaaattattttaattcagaagatgaagaaatgctggaaaacacagcaactaatgatacaggagcttcacaaacgacaatagatgatcaagtagaagcgccaatgtcatcgaatgatagtgaagaagttatgtctgattcaacaaaaacagatacaaatgtattaacggaagctacaatgtttaaaattgacccaatgattaatatgggagaaatcacgccgtatgactttatagaacgt

SEQ ID NO: 360 - protein, 825 aa, Staphylococcus aureus
  MISC_FEATURE (1)..(825): hypothetical protein
MSDPTLFDYSMIKGTVEAILFQNSDNFYTVLKVDTIETNEDFDTMPTVVGFLPNIVEGDVYTFKGQVVDHPRYGKQLKAETFEKEMPQTKEAIISYLSSDLFKGVGKKTAQNIVNTLGDNAINDILDDHSVLEKVSGLSKKKQKQIAEQISANQESEKIMIRLHDLGFGPKLSMAIYQFYLGDTLTILDRNPYQLIYDIKGIGFNKADQLARNIGIAYNDNERLKAALLYTLEEECIKQGHTYLPINVVIDLTVDVLNYQDEEVIEPEKLDEMLQYLNEEKRLIIDNEQVAIPSLYYSEIKSVQNLFRIKTHTNKLTEIEQSDLQMHIGEIEDANQVNYAASQKEALQTAINSKVMLLTGGPGTGKTTVIKGIVELYAEIHGLSLDYDDYVNDDYPVVLAAPTGRASKRLQESTGLEAMTIHRLIGWNQDTKPEDILENEINARLIIIDEMSMVDTWLFHQFLSAVPLDAQLIFVGDEDQLPSVGPGQVFKDLIESKAIPRVNLTEVYRQQDGSSIIELAHRMKLGQKIDITQRFHDRSFINCQANQIPTVVEKVVTSAVNKGYTMADIQVLAPMYKGNAGIKRLNQVLQDILNPKKKDTREIEFGDVVFRKGDKVLQLVNRPNDNIFNGDIGVIVGIFWAKENALNKDVLVVDFEGNEITFTKQDMMELTHAYCTSIHKSQGSEFPIVIMPIVKQYFRMLQRPILYTGLTRAKTSLVLLGDPEAFDIGLKTNGQARLTQLCTLLKNYFNSEDEEMLENTATNDTGASQTTIDDQVEAPMSSNDSEEVMSDSTKTDTNVLTEATMFKIDPMINMGEITPYDFIER

SEQ ID NO: 361 - DNA, 2631 bp, Staphylococcus aureus
atgatgaaaaagttaaaagcgagtgaaattagacaaaaatatctagatttctttgttgaaaaaggacatatggttgaaccttctgcaccattagtgccaattgatgatgatacattattatggattaattcaggtgtagcaacattaaagaaatattttgatggacgtgaaacacctaaaaagccaagaattgtaaactctcaaaaagctattcgtacaaatgatattgaaaatgttggtttcacagcgcgtcaccatacattctttgaaatgttaggtaacttctcaattggtgattattttaaacaagaagcgattgaatttgcttgggaatttttaacgagtgataaatggatgggtatggagccagataaattgtacgttacgattcatccggaagatatggaagcatacaacatttggcataaagatattgggcttgaagaaagtcgtattattcgcattgaaggtaacttctgggatattggtgaagggccttcaggaccgaacactgagattttctatgatcgcggagaagcatatggacaagacgatccggcagaagaaatgtatccaggtggagaaaatgaacgctatcttgaagtatggaacttagtatttagtgaattcaatcataataaagatcatagttacacaccattacctaataaaaatattgatactggcatggggcttgagcgtatggcctcagtttctcaaaatgtacgtactaactatgaaacagatttatttatgcctataatgaatgaaatcgaaaaagtatcaggtaaacaatatttagtaaacaacgaacaagatgtggcatttaaagtaattgctgaccacattcgtacgattgcatttgcaatttctgatggtgcattacctgccaatgaaggtagagggtatgtattacgtcgattgttacgtcgtgccgttcgttttagtcaaacgttaggaatcaatgagccatttatgtacaaacttgttgatattgttgcagacattatggaaccatattatccaaatgttaaggaaaaagcagatttcattaagcgtgttataaagtctgaagaagaacgattccatgaaacattagaagatggtttagcgattttaaatgaattaattaaaaaagctaaagcgacaacaaatgaaattaatgggaaagatgcatttaaattgtatgatacgtatgggttcccaattgaattaactgaagaaatagcagtgcaagcaggattgaaagttgatatgacaacattcgagtcagaaatgcaacaacaacgtgatcgtgcacgtcaagcacgtcaaaattctcaatcaatgcaagttcaaagtgaagtattgaaaaatattacatctgcaagtacttttgttggttatgatactgcgacagctcaaacaacactaacacacttgatatacaatggtgaagaagtttcacaagttgaagcgggtgaaacagtatacttcatgttaacggaaacaccattttatgcaatcagtggtggacaagttgcggatacaggtattgtttataatgacaattttgaaattgctgttagtgaagtaaccaaagcaccaaatggtcaaaacttgcataaaggagtagtacaatttggccaagtaaatgttggcgctacagtgtctgctgaagtgaaccaaaatgatcgacgtgacattcaaaagaaccatagtgcaacacatttattacatgcagcgttgaaatcagtactgggtgatcatgttaaccaagctggttcactagtagaagcagatcgtttacgttttgatttctctcattttggtccaatgactaatgatgaaattgatcaagttgaacgcttagtaaatgaagaaatttggaaaggtattgacgttaacattcaagaaatggatattgcttcagctaaagaaatgggcgcaatggcattattcggtgaaaaatatggtgatgttgtgcgtgtagtaaatatggcaccattttcaattgaattatgtggtggtattcatgtccgcaatacttctgaaattggcttattcaaaatagtaagtgagtcaggtacaggagctggtgtgcgtcgtattgaagcattaacaggtaaagcagctttcttatatttagaagatattcaagagaaatttaatacgatgaaatcacagctgaaagtgaaatctgatgatcaagtagtcgataagttaacacaattacaagatgaagaaaaagcattattaaaacaattagagcaacgtgacaaagaaatcacatcacttaaaatgggtaatattgaagatcaagttgaagaaatcaatggctataaagtattggttactgaagtggatgtaccaaatgcgaaagcaattcgctcgacaatggacgattttaaatctaaactacaagatacaattatcattcttgcaagtaatgttgatgataaagtatcgatggttgcaactgtccctaaatctttaacaaataacgttaaagccggtgatcttatcaaacaaatggcaccaatcgttggtggtaaaggtggcggtcgtccagatatggctcaaggtggcggtacacaacctgaaaatatctcaaaatcattaagctttattaaagattacattaaaaatcta

SEQ ID NO: 362 - protein, 877 aa, Staphylococcus aureus
  MISC_FEATURE (1)..(877): alanyl-tRNA synthetase
MMKKLKASEIRQKYLDFFVEKGHMVEPSAPLVPIDDDTLLWINSGVATLKKYFDGRETPKKPRIVNSQKAIRTNDIENVGFTARHHTFFEMLGNFSIGDYFKQEAIEFAWEFLTSDKWMGMEPDKLYVTIHPEDMEAYNIWHKDIGLEESRIIRIEGNFWDIGEGPSGPNTEIFYDRGEAYGQDDPAEEMYPGGENERYLEVWNLVFSEFNHNKDHSYTPLPNKNIDTGMGLERMASVSQNVRTNYETDLFMPIMNEIEKVSGKQYLVNNEQDVAFKVIADHIRTIAFAISDGALPANEGRGYVLRRLLRRAVRFSQTLGINEPFMYKLVDIVADIMEPYYPNVKEKADFIKRVIKSEEERFHETLEDGLAILNELIKKAKATTNEINGKDAFKLYDTYGFPIELTEEIAVQAGLKVDMTTFESEMQQQRDRARQARQNSQSMQVQSEVLKNITSASTFVGYDTATAQTTLTHLIYNGEEVSQVEAGETVYFMLTETPFYAISGGQVADTGIVYNDNFEIAVSEVTKAPNGQNLHKGVVQFGQVNVGATVSAEVNQNDRRDIQKNHSATHLLHAALKSVLGDHVNQAGSLVEADRLRFDFSHFGPMTNDEIDQVERLVNEEIWKGIDVNIQEMDIASAKEMGAMALFGEKYGDVVRVVNMAPFSIELCGGIHVRNTSEIGLFKIVSESGTGAGVRRIEALTGKAAFLYLEDIQEKFNTMKSQLKVKSDDQVVDKLTQLQDEEKALLKQLEQRDKEITSLKMGNIEDQVEEINGYKVLVTEVDVPNAKAIRSTMDDFKSKLQDTIIILASNVDDKVSMVATVPKSLTNNVKAGDLIKQMAPIVGGKGGGRPDMAQGGGTQPENISKSLSFIKDYIKNL

SEQ ID NO: 363 - DNA, 1188 bp, Staphylococcus aureus
ttgcataaattgggatttgacgaaggaatgtacgatttaattaaagaacctttaagaatgttacaagtgcgtatccctgtacgaatggatgatggcacagtaaaaacattcacaggttaccgtgcgcaacataatgatgctgttggaccaacaaaagggggcgtgcgtttccacccagatgttgatgaagaagaagtaaaagcattatcaatgtggatgactttgaaatgtggcattgtaaacttaccatacggtggtggtaagggtggtatcgtttgtgatccacgtcaaatgagcattcatgaagttgaacgtttatcacgcggatatgtaagagcaatttcacaattcgtaggtccgaacaaagatattccagcaccagatgtatttacaaactcacaaattatggcttggatgatggatgaatatagtgcattagataaatttaattcaccaggtttcatcacaggtaaaccaattgtattgggtggttctcatggacgcgacagatcaactgcactaggtgtagttattgcaattgaacaagctgcaaaacgtcgtaatatgcaaattgaaggtgccaaggttgttattcaaggtttcggtaatgccggaagtttcttagctaaattcttatatgatttaggtgcaaaaattgtaggtatctctgatgcttacggtgcattacacgatccaaatggcttagatatagattatttattagaccgtcgtgatagttttggtacggtaacaaatttatttgaagaaacaatctcaaataaagaattgtttgaattagattgtgacattttagtaccagcggctatttcaaaccaaattacagaagacaatgcacatgatattaaagctagtatcgttgttgaagctgctaatggacctacaacaccagaagcaacacgtattttaactgaacgtggtatattattagttccagacgtattagcaagtgctggtggtgtaacggtttcttacttcgaatgggtacaaaataatcaaggttattattggtctgaagaagaagttaatgaaaagctacgtgaaaaattagaagcggcatttgatacgatttacgaattgtctcaaaaccgaaaaatagatatgagacttgcagcatatatcataggtattaaacgtacagcagaagcagctagatatcgtggttgggca

SEQ ID NO: 364 - protein, 396 aa, Staphylococcus aureus
  MISC_FEATURE (1)..(396): NAD-specific glutamate
LHKLGFDEGMYDLIKEPLRMLQVRIPVRMDDGTVKTFTGYRAQHNDAVGPTKGGVRFHPDVDEEEVKALSMWMTLKCGIVNLPYGGGKGGIVCDPRQMSIHEVERLSRGYVRAISQFVGPNKDIPAPDVFTNSQIMAWMMDEYSALDKFNSPGFITGKPIVLGGSHGRDRSTALGVVIAIEQAAKRRNMQIEGAKVVIQGFGNAGSFLAKFLYDLGAKIVGISDAYGALHDPNGLDIDYLLDRRDSFGTVTNLFEETISNKELFELDCDILVPAAISNQITEDNAHDIKASIVVEAANGPTTPEATRILTERGILLVPDVLASAGGVTVSYFEWVQNNQGYYWSEEEVNEKLREKLEAAFDTIYELSQNRKIDMRLAAYIIGIKRTAEAARYRGWA

SEQ ID NO: 365 - DNA, 267 bp, Staphylococcus aureus
gtgtcgcaaatggaaaactttgataaaacaatgaaattcgactatgaagaacttccaacgcaagatgtaagagatgttttaaataatgtttatcgaacattagatgaacgaggatataatgccgtaaaccaaattgtaggttatttattatcaggtgaccctgcgtatattccacgccaaaatgaagcaagaaatcaaattcgtcatattgatagagatgttattatggaagagcttgtttcttactatttaaaagagcaaaataaa

SEQ ID NO: 366 - protein, 89 aa, Staphylococcus aureus
  MISC_FEATURE (1)..(89): conserved hypothetical
VSQMENFDKTMKFDYEELPTQDVRDVLNNVYRTLDERGYNAVNQIVGYLLSGDPAYIPRQNEARNQIRHIDRDVIMEELVSYYLKEQNK

SEQ ID NO: 367 - DNA, 426 bp, Staphylococcus aureus
atgttacaacataaaattttaggactcgatgtcggtagtagaacggtaggaattgcaattagtgatataatgggttggacggcacaaggattagacacactccgaatcaatgaagaaaataatgaattaggtattgaccaattagtagacattattaaaaaacataatgtgggtacagtcgtaataggactacctaaaaacatgaataattcaataggatttcgaggcgaagcttcgttaacatataaagaaaaattattagaagcttatccttctattgagattgtgatgtgggatgaaagattaagcacaatggctgctgaacgatcattattagaagcagatgtttcaagacaaaaaagaaaacaagtgattgataaaatggcagcggtatttattttacaaggctatttagattcactacat

SEQ ID NO: 368 - protein, 142 aa, Staphylococcus aureus
  MISC_FEATURE (1)..(142): conserved hypothetical
MLQHKILGLDVGSRTVGIAISDIMGWTAQGLDTLRINEENNELGIDQLVDIIKKHNVGTVVIGLPKNMNNSIGFRGEASLTYKEKLLEAYPSIEIVMWDERLSTMAAERSLLEADVSRQKRKQVIDKMAAVFILQGYLDSLH

SEQ ID NO: 369 - DNA, 306 bp, Staphylococcus aureus
atgactgaacataatcatgattcacaactagaaattaataacgaagaagaattattaactttattcgatgaagagggaaatgaagttttataccgaaaagttttagaattttatcatcctgaattcaaaaaagagtatgttatcttagctgaagaaggtgctcaatcagatgaagacgatatgattgagcttgtaccaatgatcaatgaaccagatgagtcaggtgacggtggtaagttagtaccaatcgaaactgatgaagaatgggacatgattgaagaagttgtaaatactgaaatggaagaa

SEQ ID NO: 370 - protein, 102 aa, Staphylococcus aureus
  MISC_FEATURE (1)..(102): conserved hypothetical
MTEHNHDSQLEINNEEELLTLFDEEGNEVLYRKVLEFYHPEFKKEYVILAEEGAQSDEDDMIELVPMINEPDESGDGGKLVPIETDEEWDMIEEVVNTEMEE

SEQ ID NO: 371 - DNA, 636 bp, Staphylococcus aureus
atggatgacctaaataaaaaatatttaatagatttacatcaacatcaaaatagttcaatcgaagttttgcgtgaatttgccgaggtaaatgaagtgccaattgtagatcgtttaacattagatttaattaagcaattaattcgtatgaataatgttaaaaatattttagaaattggtacagcaatcggctatagttctatgcaattcgcttctatatctgatgacattcatgtcacaacgatagagcgtaatgaaacgatgattcaatatgctaaacaaaatttagctacttatcattttgaaaaccaggttcgaattattgaaggtaatgctttagagcaatttgaaaatgtaaatgacaaagtttatgatatgatatttattgatgcagcaaaagcgcaatcaaagaaattttttgaaatatatacaccacttttaaagcaccaaggtctcgtaattacagataatgttttatatcacggttttgtatcggatattgggattgttagatcgagaaatgtaagacaaatggttaaaaaggttcaagattataatgagtggttaataaagcaaccaggatatacaacgaattttttaaatatagacgatggattagcgatttcaattaaaggagaa

SEQ ID NO: 372 - protein, 212 aa, Staphylococcus aureus
  MISC_FEATURE (1)..(212): hypothetical protein
MDDLNKKYLIDLHQHQNSSIEVLREFAEVNEVPIVDRLTLDLIKQLIRMNNVKNILEIGTAIGYSSMQFASISDDIHVTTIERNETMIQYAKQNLATYHFENQVRIIEGNALEQFENVNDKVYDMIFIDAAKAQSKKFFEIYTPLLKHQGLVITDNVLYHGFVSDIGIVRSRNVRQMVKKVQDYNEWLIKQPGYTTNFLNIDDGLAISIKGE

SEQ ID NO: 373 - DNA, 927 bp, Staphylococcus aureus
atgactatgacagaattacttgtcacacccaagtcattaagccatatggaaacacttattgatttaggtgcagatgcttttgtaattggcgagcaaaagtttggtttaagacttccaggggaattcaatagacaacaaatgacagaggctgtcgcattagctcacaaaaacgataaaaaagtatatgcggcagtgaatggattatttcataattatcatttagatgctgtagaagattatattaattttttacatgaaatacgagttgacagaattattttcggggatccagcagtagtaatgtatgtgaaggcgcaagaaaatccaataccacttcattggaatgcagagacgttagtaactaatcattttcaatgtaattactggggtaaaagaggcgcatcaagagctgtcttagcacgtgagctgaatttggatgaaattattaatataaaagaaaattcaaatgtggaaattgaggtgcaagttcaaggaatgacttgtatgtttcaatcaaagcgtatgctactaggcaattattatacgttccaagatcgccaaatgaaaattgaacgtcgcaatgatgaacaatctttattactttatgatgaagaaagacaaaataattacccagtttacgaagattacaatggtacgcacattatgtcaccaaacgacatttgtttaattgaagaattagcaccattttttgaggcgggtatagattcatttaaaatcgatggtattctacaaacggaagaatatattaatgtggtaacggaacagtatcgtcaagcgatagatttgtacaatgaagatcctgaaatctatgaagatgagaaatttatgttgatggatccaattgaagaaattcaacctgatcatcgaccatttgacgaaggtttcttatataaacaaacagtatat

SEQ ID NO: 374 - protein, 309 aa, Staphylococcus aureus
  MISC_FEATURE (1)..(309): hypothetical protein
MTMTELLVTPKSLSHMETLIDLGADAFVIGEQKFGLRLPGEFNRQQMTEAVALAHKNDKKVYAAVNGLFHNYHLDAVEDYINFLHEIRVDRIIFGDPAVVMYVKAQENPIPLHWNAETLVTNHFQCNYWGKRGASRAVLARELNLDEIINIKENSNVEIEVQVQGMTCMFQSKRMLLGNYYTFQDRQMKIERRNDEQSLLLYDEERQNNYPVYEDYNGTHIMSPNDICLIEELAPFFEAGIDSFKIDGILQTEEYINVVTEQYRQAIDLYNEDPEIYEDEKFMLMDPIEEIQPDHRPFDEGFLYKQTVY

SEQ ID NO: 375 - DNA, 1266 bp, Staphylococcus aureus
atgaagacaatagaagagattaaatcaactcctaaaacagttatgaagaaaccagaattattagcacctgctggaaacttagaaaagttaaaaatagcagtacattatggcgctgatgccgtatttttaggtggtcaagaatatggattacgttcaaatgctgataatttcacgatggaagaaatagctgaaggtgttgaatttgcgaaccgttacggtgccaaaatttatgttacgacaaatattattgcacatgatgagaatattgaaggtctagaatcatatttgcgtaatttggaaaagactggtgcgacaggtatcattgttgcagatcctttaattatcgaaacatgtaaagaagttgcgccaaaacttgaaattcatttatctactcaacaatcactttctaattacaaagctgtagaatattggaaagaagaaggattggatcgtgttgtattagcacgtgagaccggcgcgatggaaatgcgtgaaatgaaggaaaaagtagatattgaaatcgaagcatttattcatggtgctatgtgtatcgcctattcaggtagatgtacattaagtaatcatatgactgcaagggattccaacagaggcggttgctgtcaaagttgccgttgggattatgaattattagaagttgatgataatggtgaacttgatgttttttataatcaaggtgaagttacaccgtttgcgatgagtcctaaagatttaaaattaatcgaatcaattcctcaaatgatggatattggtgtggactcattaaaaattgaaggacgtatgaagtcaattcattatattgcaacagttgtctcagtatatcgtaaagtcattgatgcgtatgcggcagatcctgacaactttaagattaatccggaatggttaatagagttagataaatgtgcaaatagagacactgcaccagcattctttgagggaacacctggttatgaagaacagatgtttggtcaacaacaatctaaaaaatcaccatttgatttttgtggtttggtattagactataatgaagatacaaaaattgcgactattcaacaacgaaataactttaaaccaggtcaagaaatagaattctttggtccagaaattgaaacatttacacaagtagtagaagcaatttatgatgaagaaggtaacagcttagacgcggcgcgccatccattacaaatcgttcaaattaaagtggatcgcccgatatatccaaacaacatgatgagaaaggaaattggc

SEQ ID NO: 376 - protein, 422 aa, Staphylococcus aureus
  MISC_FEATURE (1)..(422): hypothetical protein
MKTIEEIKSTPKTVMKKPELLAPAGNLEKLKIAVHYGADAVFLGGQEYGLRSNADNFTMEEIAEGVEFANRYGAKIYVTTNIIAHDENIEGLESYLRNLEKTGATGIIVADPLIIETCKEVAPKLEIHLSTQQSLSNYKAVEYWKEEGLDRVVLARETGAMEMREMKEKVDIEIEAFIHGAMCIAYSGRCTLSNHMTARDSNRGGCCQSCRWDYELLEVDDNGELDVFYNQGEVTPFAMSPKDLKLIESIPQMMDIGVDSLKIEGRMKSIHYIATVVSVYRKVIDAYAADPDNFKINPEWLIELDKCANRDTAPAFFEGTPGYEEQMFGQQQSKKSPFDFCGLVLDYNEDTKIATIQQRNNFKPGQEIEFFGPEIETFTQVVEAIYDEEGNSLDAARHPLQIVQIKVDRPIYPNNMMRKEIG

SEQ ID NO: 377 - DNA, 621 bp, Staphylococcus aureus
atgaaagctactacaatcattggcatagctggtggatctggctcaggaaaaacaactgtaactaacgaaattatgaaaaacttagaaggtcatagtgtcgctttacttgctcaagattactattataaagatcaaaagcacttgactttcgacgagcgcctagaaaccaattatgaccatccatttgcattcgataatgatttattaattgaaaatcttaaagacttgaaaaatggtaaagcagtagaagtaccgacatatgattatgctagtcatacaagaagtgacattaccattgattttaaacctaaagatgttattatcgtagaaggcattttcgctttagaaaataaggtattacgtgatatgatggatgttaaaatatatgttgatacagatgcagacttgagaatattacgccgtttaacacgagatactaaagagcgtgggcgttcaatggactctgttatcaatcaatatttaagtgttgttagacctatgcatgaccaatttattgaaccgactaagaaatatgctgatataattattcctgaaggtgggagcaataaagttgcaatagatattatgacaacaaaaattcagtctttagttagcaagcaa

SEQ ID NO: 378 - protein, 207 aa, Staphylococcus aureus
  MISC_FEATURE (1)..(207): uridine kinase
MKATTIIGIAGGSGSGKTTVTNEIMKNLEGHSVALLAQDYYYKDQKHLTFDERLETNYDHPFAFDNDLLIENLKDLKNGKAVEVPTYDYASHTRSDITIDFKPKDVIIVEGIFALENKVLRDMMDVKIYVDTDADLRILRRLTRDTKERGRSMDSVINQYLSVVRPMHDQFIEPTKKYADIIIPEGGSNKVAIDIMTTKIQSLVSKQ

SEQ ID NO: 379 - DNA, 474 bp, Staphylococcus aureus
atggaaaatcaaaagcaatatccaatgactcaagaaggttttgaaaaattagagcgtgaacttgaagaattaaaaacagttaagcgtcctgaagttgtagagaaaattaaagttgcacgttcatttggtgacttatcagagaactctgagtatgatgcagcaaaagatgaacaaggattcatcgaacaagatattcaaagaattgagcatatgttaagaaatgcattaatcattgaagatactggagataacaacgttgttaaaattggtaaaacagtaacgtttgtagaattaccaggtgatgaagaggaaagttatcaaatcgttggttcagctgaatcagatgcatttaatggtaagatttcaaatgaatcaccaatggctaaagcgttaattggtaaaggtttagatgatgaagttcgtgttccactacctaatggtggcgaaatgaacgtaaaaattgttaatatccaa

SEQ ID NO: 380 - protein, 158 aa, Staphylococcus aureus
  MISC_FEATURE (1)..(158): transcription elongation
MENQKQYPMTQEGFEKLERELEELKTVKRPEVVEKIKVARSFGDLSENSEYDAAKDEQGFIEQDIQRIEHMLRNALIIEDTGDNNVVKIGKTVTFVELPGDEEESYQIVGSAESDAFNGKISNESPMAKALIGKGLDDEVRVPLPNGGEMNVKIVNIQ

SEQ ID NO: 381 - DNA, 699 bp, Staphylococcus aureus
atgatttattttgaaaataaaatatccgaagagacatatcgtaatgtcacagcaatggtacggtggatacgagaaaaagaaatattagaaattcaagatattgtcccttcgtatcgagcagttctaatatattttgatgaacaagctataacatcttctaaattaattgaaaatttagaacttaacaaatttaatgaaaaaaatgttcatgctgtgaatcaaaccaatcgtattattaaaatacctgttcaatatggtggtacatatggaccagatattgaagaagtagcaaagcataatcgaataactgttgagcaagttattgaaaaacatacaagtaaaccttatttaatatatatgctaggatttatgccaggatttccatacttaggcggacttgatgaacaactacatacacctagacgtaatcagccaaggttaaaaattcatgcaggttctgtaggtattgcgaataatcaaacaggactatatccatcagattctcctggcggatggcaaattattggacgcacaccgttaaaagtatttagcagcgagcgtgaaccaatgtcaatgtacgaagcaggagaatggatacaattttatgcaatagatgaacagaaatttatacaaatcgaaagagatatatcagatggcaactttaatgttgatgactgggtggtgattgaaaatgtcaat

SEQ ID NO: 382 - protein, 233 aa, Staphylococcus aureus
  MISC_FEATURE (1)..(233): conserved hypothetical
MIYFENKISEETYRNVTAMVRWIREKEILEIQDIVPSYRAVLIYFDEQAITSSKLIENLELNKFNEKNVHAVNQTNRIIKIPVQYGGTYGPDIEEVAKHNRITVEQVIEKHTSKPYLIYMLGFMPGFPYLGGLDEQLHTPRRNQPRLKIHAGSVGIANNQTGLYPSDSPGGWQIIGRTPLKVFSSEREPMSMYEAGEWIQFYAIDEQKFIQIERDISDGNFNVDDWVVIENVN

SEQ ID NO: 383 - DNA, 1008 bp, Staphylococcus aureus
atgtcaattaagattttacaaccaggtctcttttcaacggtacaagatctaggaagaataggttatgaacatattggattttcaggcgcaggtgccatggatcaatttagttttaaggttgcgcagtcattaattaacaatgatggtccagcgattgaatatactttgattggtcctaccattcaatttaatacgcaaaatacatttgttataaccggtggtagtattaatgcttcgctaaataataaaactatatcaatgaattctgtcatattagctgagaaaggtgacattttaaaaataggtgctataaccaaaggtgcacgcggttatcttacttttggtcattctatcaacgtaccttctattgctgaaagttatgcaacacatacccgaagcagtataggaggattcaaaggtagaaagttattagctgatgatgtaataacagtgaaaataaataatgactttaaagaaaacattggaaagacgattcatttacaggacgatttattgccagaaaataatattatacacattcttcaaggacctcaattcgaggcattttctgaagaggctagagcgaaaattgtaaatcatccatatttaattactgaacaatcagaccgtatgggctatcgtttggaaggtgacagcgttgcaccaattaatcaagcagatatcatttctgaaccggttgctcttggtagtgttcaggtaccaaatgatggtcaacctattattctgcttaatgataaacaaacgataggtggttataccaaaattgcaactgtatgcaaatttgatctgccaaagttagcacagatgaaaccacaagatacaattcaatttaaatggatatcattccaagaagctgtagataagaatcgggaacaaatgtctctgtttaatgaaattcttaagagtcatcaaaagactccaatttttgatacatctagcttgcgacatacttcgaaaaaattagcaacaattttaaaaggggatttg

SEQ ID NO: 384 - protein, 336 aa, Staphylococcus aureus
  MISC_FEATURE (1)..(336): conserved hypothetical
MSIKILQPGLFSTVQDLGRIGYEHIGFSGAGAMDQFSFKVAQSLINNDGPAIEYTLIGPTIQFNTQNTFVITGGSINASLNNKTISMNSVILAEKGDILKIGAITKGARGYLTFGHSINVPSIAESYATHTRSSIGGFKGRKLLADDVITVKINNDFKENIGKTIHLQDDLLPENNIIHILQGPQFEAFSEEARAKIVNHPYLITEQSDRMGYRLEGDSVAPINQADIISEPVALGSVQVPNDGQPIILLNDKQTIGGYTKIATVCKFDLPKLAQMKPQDTIQFKWISFQEAVDKNREQMSLFNEILKSHQKTPIFDTSSLRHTSKKLATILKGDL

SEQ ID NO: 385 - DNA, 447 bp, Staphylococcus aureus
atgaatattgaaaaaatcgaacaaataatcaaattagtgaaggaaaatgatgttaagaaatttaaatataaaaattttgaagatgaaatagaaattgacttcactgactcgaatcatttggctgcacacagtaatcaatcaaatcaaagtatgaacaataatgatttgacagcttcaaaagcgaatgataactccgatgtttcgacaaatgattatcatgacattaaatcaccaatgataggtacattctttttacaagatagtaaagaattaactgaaccaattgtgaatgtcggtgacaaagttaacaagggagatattataggatatgttgaagcgatgaaagtattaaacgaggtaacaacagatgttgctggagaaattactgaaatagtagctgatcatggcacaaatgttgaatacgaccaagttttggtacgtattaag

SEQ ID NO: 386 - protein, 149 aa, Staphylococcus aureus
  MISC_FEATURE (1)..(149): hypothetical protein
MNIEKIEQIIKLVKENDVKKFKYKNFEDEIEIDFTDSNHLAAHSNQSNQSMNNNDLTASKANDNSDVSTNDYHDIKSPMIGTFFLQDSKELTEPIVNVGDKVNKGDIIGYVEAMKVLNEVTTDVAGEITEIVADHGTNVEYDQVLVRIK

SEQ ID NO: 387 - DNA, 1359 bp, Staphylococcus aureus
atgcttcgttgtttaattgcgaacagaggtgaaattgctgtaaggattataagagcttgcagagaatatgggattgaaactgtagcagtttatgcaaaaggggacgagcaaagcttgcatgtacatttagcagatcaagctatatgtattggggaagctaatgctttagatagttatttaaatattgaccgcatcatatctgctgcacaaatcactggtgctaatgcaattcacccaggatatggctttttatcagaatcaacaaaatttgctcaaaccgttgaggaacaaggcatagcgtttatagggcctactaaaaaaacgatggaaatgatgggggataaaataacagcaagacaaacagttcatcatgcaggtgttcctgtgattccaggatcaaatggtgctgtgaatcatgtgtctgaaattgagaatcttgccaaagacatcggttatccagttgttatcaaagctgccagtggcggtggtggtaaaggtatacgtattgtaaagaaagctgaagatttagaaaaggcatttaaagaagctaaaagtgaaggaaaaaaatactttgatgatgatcgtgtttatgttgaggcttttatacctgttgcaaaacatgttgaagttcaagttatgggagatgggcaggataattatgtacatttaggggaacgtgattgttctgtacaacgtaaaaatcaaaaattaatcgaagaatctccttgtgcagcattaactgaagaaagacgacaacaaatatgtaacgatgctgttaaagttgcacgtgcagcaaattatagaagtgcaggtacgattgaatttttagtaactgataccgcacattactttattgaaatgaatgctcgaatacaagttgaacatactgttacagagatgcgagcagaacgtgatttggttgcagcacaactgtatttattggaacataatcatttacctttttcacaaagcgatattcaatttaatggtcatgtgatagaagcgagaataaatgccgaaaatcctgaaaagaaatttcaaccaacaccaggtaaagtgacagcgttacatttacctcaaggctttaatgtgcgagtcgattctttactatatcacggttatcaagtttcaccatattatgattctttagtagctaaagtaattgtaaaatctcatgatagagcttcagcaattgataagttgaaagtcaccttagatgaaatggtgatagatggattttctacaactgccgattttttatatgcagttttaaattatccactatatcgtgatggagatgcaaaagatgttgatattaaatttttagaaaaacatcaaattgttaaaggggtggaatta

SEQ ID NO: 388 - protein, 453 aa, Staphylococcus aureus
  MISC_FEATURE (1)..(453): acetyl-CoA carboxylase
MLRCLIANRGEIAVRIIRACREYGIETVAVYAKGDEQSLHVHLADQAICIGEANALDSYLNIDRIISAAQITGANAIHPGYGFLSESTKFAQTVEEQGIAFIGPTKKTMEMMGDKITARQTVHHAGVPVIPGSNGAVNHVSEIENLAKDIGYPVVIKAASGGGGKGIRIVKKAEDLEKAFKEAKSEGKKYFDDDRVYVEAFIPVAKHVEVQVMGDGQDNYVHLGERDCSVQRKNQKLIEESPCAALTEERRQQICNDAVKVARAANYRSAGTIEFLVTDTAHYFIEMNARIQVEHTVTEMRAERDLVAAQLYLLEHNHLPFSQSDIQFNGHVIEARINAENPEKKFQPTPGKVTALHLPQGFNVRVDSLLYHGYQVSPYYDSLVAKVIVKSHDRASAIDKLKVTLDEMVIDGFSTTADFLYAVLNYPLYRDGDAKDVDIKFLEKHQIVKGVEL

SEQ ID NO: 389 - DNA, 750 bp, Staphylococcus aureus
atgcgagttgatttgaattgtgatttaggcgaagcatttggaaattattcctttggtggtgatcatcaaattattccgttaattacaagtgcgaatgttgcttgtggttttcacgctggtgatgaaaatgtaatgaatgaaacggtaaaacttgccaaagcacataatgttgcagtaggtgcacatcctggtttacctgatttgaaaggctttggcagacgaaatatagatatctctaacgacgagatttataatttgatgatttatcaattaggtgcattacaagggttttgtcgcattcatcaagttaaaattaatcatgttaaaccgcatggtgcattgtatcagatgggtgcaaaagacagagaaatagcaaacgttatagcacaagctgtttatgactttgatccatcactagtgttagtaggattagcaaattcatatctaatttcagaagcaaagaatgtcggattaattacagcttctgaagtgtttgctgatagacgatacgaagatgatgggcagctcgttagtagaaaagaaagtgatgctgtgattactgatactgacgaagcacttaagcaggttttaaagatggtgaaggaaaataaagttatttcaaaaaacaataaggaagtaacgttacaagcagatacaatttgtgtgcatggtgatggagaacatgcattattatttgtttcgaaaattagagaaattttaatgaaagaaggcattgatattcaatcctta

SEQ ID NO: 390 - protein, 250 aa, Staphylococcus aureus
  MISC_FEATURE (1)..(250): conserved hypothetical
MRVDLNCDLGEAFGNYSFGGDHQIIPLITSANVACGFHAGDENVMNETVKLAKAHNVAVGAHPGLPDLKGFGRRNIDISNDEIYNLMIYQLGALQGFCRIHQVKINHVKPHGALYQMGAKDREIANVIAQAVYDFDPSLVLVGLANSYLISEAKNVGLITASEVFADRRYEDDGQLVSRKESDAVITDTDEALKQVLKMVKENKVISKNNKEVTLQADTICVHGDGEHALLFVSKIREILMKEGIDIQSL

SEQ ID NO: 391 - DNA, 1227 bp, Staphylococcus aureus
atggggagaaatttaaagcttaaaaaagaaagtgactttgaattcacaaaaaatcataaaaggttattattaggttctgtatttttgatggcaacttctgcaattgggccagcatttttaacgcaaacagcagtatttacatcacaattttttgcaagtttcgcatttgccatattactgtctatcatcattgacattggtgcacaaattaatatatggcgcatattagttgtaactggtttaagaggtcaagaaatatcaaataaagttgttcctgggcttggtactgttatctcaatattgattgcatttggtggtctagcttttaatattggtaatattgctggtgccggtttaggtttaaatgcaatttttggattagatgtaaaatggggcgcagctattactgcaatctttgcaatattaatctttgtaagtaaaagtggccaaaaaattatggacgttgtttcaatgattcttggtattgtgatgattttagttgtggcatatgtgatgtttgtttctaatccaccttatggtgatgcttttgtgcatacatttgcgccagaacatccaatgaaattagtcttgcccatcattacgttagttggtggaactgtaggtggttatattacctttgcaggtgcacatcgtatattagactctggcattaaaggtaagcaatatttaccatttgtaaatcaatcagcaattgctggtattttaactacaggtattatgagaacgttactattcctagcggtattaggagttgttgtaacaggtgtgacactaagttctgaaaatccaccagcgtcagtttttgaacacgcaattggaccaattggaaagaatatttttggtattgtgttatttgctgcagctatgtcatcagtaattggctcagcatacacaagcgcaacatttttaaaaacacttcataaatcacttaacgaaagaagtaatttaattgtgattgtgtttatcgttatttcaacaatgattttcttatttattggaaaaccaatcagccttttaattatagcaggcgcgataaatggatggattttacctattacgttaggtgcaattttgattgcaagtaaaaagaaatcaattgttggtgattataaacacccaaattggatgttcatctttggtatcgttgcagtacttgttacaatattgacaggtatattctcattcaaagaagtacttcagttattt

SEQ ID NO: 392 - protein, 409 aa, Staphylococcus aureus
  MISC_FEATURE (1)..(409): conserved hypothetical
MGRNLKLKKESDFEFTKNHKRLLLGSVFLMATSAIGPAFLTQTAVFTSQFFASFAFAILLSIIIDIGAQINIWRILVVTGLRGQEISNKVVPGLGTVISILIAFGGLAFNIGNIAGAGLGLNAIFGLDVKWGAAITAIFAILIFVSKSGQKIMDVVSMILGIVMILVVAYVMFVSNPPYGDAFVHTFAPEHPMKLVLPIITLVGGTVGGYITFAGAHRILDSGIKGKQYLPFVNQSAIAGILTTGIMRTLLFLAVLGVVVTGVTLSSENPPASVFEHAIGPIGKNIFGIVLFAAAMSSVIGSAYTSATFLKTLHKSLNERSNLIVIVFIVISTMIFLFIGKPISLLIIAGAINGWILPITLGAILIASKKKSIVGDYKHPNWMFIFGIVAVLVTILTGIFSFKEVLQLF

SEQ ID NO: 393 - DNA, 1218 bp, Staphylococcus aureus
atgggttacagaactttaaaaagtatttttcatgaacacaatgaaagtaaaatgaaggaagagtatattaaaagatttaattctttagcttctttcaatactaatattaatatcatacctatggaaaatggaaaaaaagttaatgatttggaatatcctctattctttatggtgactaaaaatctatcaaaaaaacaagaattaatatcaattaatagtagaaaaattgatagagcacttaattctttaccatatgcagctagagaacaatattttaatgatttattaatcgatgaattacaaagtactaatgaaattgaaaatgtatttagtactaaacaagagattgcacatgcgttaaataaccaagcatcagaatttcttaagttcagaggcctcgtggatcaatataaagagatagaacttaataaaaaaattaaagttgataatgtaagagacattagagcgatttatgataaattagtttcaaatgaaattaacgaacaagataagttagatggagagctatttcgtaaaaattttgtcggtgtgcatgatgggtcaacgaataaatatatacatgttgggttacaacctgaaaccaaaattgttgaatttataggtgaaatgctaacatttttaaaatattttgatgcgcctcagccgttcaaaatcatggctagtcattatctgtttgaatatatacatcctttttatgatggcaatggtagagttggaagatttataattgccaagctcttgagtgattattatgataattatactgctttgacattttcatatgttataaatagaaataaatcgaaatattacaaggcgtttatgactgcttcaaatcatttgaattgtggtgatttgacggaatttattgacacaatgcttgagctattgatagcaggacaagaaagaatacttgatgagttaataccaaaaatggatgcgactgaaaaattaacgctttatttaactagtcattataaacagatagattatgaatttttgtatctcctttcaatggataaattgtttggaaataaaagaaatagattaacattaattgatttagaaaacatattgggagtaggaagagtaaaaattaataatacaattaaaaaatatgataactacttagttaaaattaaaagtagaccaacaatttatgagataagtgatgaatttctaaattcgattataaaa

SEQ ID NO: 394 - protein, 406 aa, Staphylococcus aureus
  MISC_FEATURE (1)..(406): conserved hypothetical
MGYRTLKSIFHEHNESKMKEEYIKRFNSLASFNTNINIIPMENGKKVNDLEYPLFFMVTKNLSKKQELISINSRKIDRALNSLPYAAREQYFNDLLIDELQSTNEIENVFSTKQEIAHALNNQASEFLKFRGLVDQYKEIELNKKIKVDNVRDIRAIYDKLVSNEINEQDKLDGELFRKNFVGVHDGSTNKYIHVGLQPETKIVEFIGEMLTFLKYFDAPQPFKIMASHYLFEYIHPFYDGNGRVGRFIIAKLLSDYYDNYTALTFSYVINRNKSKYYKAFMTASNHLNCGDLTEFIDTMLELLIAGQERILDELIPKMDATEKLTLYLTSHYKQIDYEFLYLLSMDKLFGNKRNRLTLIDLENILGVGRVKINNTIKKYDNYLVKIKSRPTIYEISDEFLNSIIK

SEQ ID NO: 395 - DNA, 750 bp, Staphylococcus aureus
ttgggggagtttgaagttaaatatttaacaggatttattttaatattattgttagaaggaatttttacaaattcagcgagtgcaatcgaatattcagacttacatcataaaagtaagtttgattcaaagcgtctaagtaatgctaagatgtcattcatcaatccaactcagcttgaaaataaaaacacaaacgatagactgttgaagcatgatttgttatttcatgacatgttcgtaaatgatgattggaaaaaggattttaaagttgaatttgaaaatgaggcactttcaaagaaatttataaataaggatatcgatatatttgctggaaattatggatacggatgtcatgggggagcaaccaataaaacgcaatgtagttatggtggtgttactttaagtgacaataataaatacgatgattataagaatataccttgtaatttatggattgacggacatcaaacagaaatagaactaactgcagtaaaaacgaaaaagaaaattgttactattcaagaattagaggttcaattaagaaattatttgaatgagaagtataagttgtacgaacaaggtggcgacattgttaaagggtatgttaaatattataatgatgatgaacaaaatgtagaatatgatttttataatttaaatggtgagtatggtcgtgaggtattaaaaatgtatgctgataataaaactatcaatagtgacaaattgcatttagatatctatttattcaaatca

SEQ ID NO: 396 - protein, 250 aa, Staphylococcus aureus
  MISC_FEATURE (1)..(250): hypothetical protein
LGEFEVKYLTGFILILLLEGIFTNSASAIEYSDLHHKSKFDSKRLSNAKMSFINPTQLENKNTNDRLLKHDLLFHDMFVNDDWKKDFKVEFENEALSKKFINKDIDIFAGNYGYGCHGGATNKTQCSYGGVTLSDNNKYDDYKNIPCNLWIDGHQTEIELTAVKTKKKIVTIQELEVQLRNYLNEKYKLYEQGGDIVKGYVKYYNDDEQNVEYDFYNLNGEYGREVLKMYADNKTINSDKLHLDIYLFKS

SEQ ID NO: 397 - DNA, 267 bp, Staphylococcus aureus
atggctgaaaataatcaaaatagtctcgtaacaaagatagctacatacggcagttttattgcaattgcgtcgtttgtcattttatttataagtatatttttaaagttttcatttaatatcgagtttacagcaacaattatgaacatatgtcgctacactctaattctaggatttatacttatgtccttacctgatgttgttgataaaaacatcaagaaaattatattcgatgcatttattatcatcgtctttatcttctttttacta

SEQ ID NO: 398 - protein, 89 aa, Staphylococcus aureus
  MISC_FEATURE (1)..(89): hypothetical protein
MAENNQNSLVTKIATYGSFIAIASFVILFISIFLKFSFNIEFTATIMNICRYTLILGFILMSLPDVVDKNIKKIIFDAFIIIVFIFFLL

SEQ ID NO: 399 - DNA, 696 bp, Staphylococcus aureus
gtgaatcaaaagatgattggtataattggtgccatggaagaagaagtaacaatattaaaaaataaattaacacaattaagcgaaatttcagttgcacatgttaaattttatactggcattttaaaagatagagaagtagtgattacccaaagtggcattggaaaagttaatgctgcaatttctacgacattattaattaataagtttaaaccggacgtcattattaatacaggttctgctggagctttagatgaaagtttaaatgtaggtgacgttcttataagtgatgatgtaaaatatcatgatgcagacgcaacagcatttggttatgaatatggacaaataccacagatgccggtagcatttcaatcaagtaaacctttaatagaaaaagtatctcaagttgtacaacaacaacaattaacagctaaagtaggcttaattgtaagtggtgatagctttatcggtagtgttgaacaacgccaaaaaattaaaaaagcatttccaaatgcgatggcggttgaaatggaagcaactgcaattgcacaaacatgttatcaatttaatgtaccatttgttgtagttcgtgcagtttcagacttagcaaatggagaagcggaaatgagcttcgaagcatttttagaaaaagcagctgtatcatcaagtcaaactgttgaagcattagtgtctcaatta

SEQ ID NO: 400 - protein, 232 aa, Staphylococcus aureus
  MISC_FEATURE (1)..(232): 5'-methylthioadenosine
VNQKMIGIIGAMEEEVTILKNKLTQLSEISVAHVKFYTGILKDREVVITQSGIGKVNAAISTTLLINKFKPDVIINTGSAGALDESLNVGDVLISDDVKYHDADATAFGYEYGQIPQMPVAFQSSKPLIEKVSQVVQQQQLTAKVGLIVSGDSFIGSVEQRQKIKKAFPNAMAVEMEATAIAQTCYQFNVPFVVVRAVSDLANGEAEMSFEAFLEKAAVSSSQTVEALVSQL

SEQ ID NO: 401 - DNA, 525 bp, Staphylococcus aureus
atgggtttagttcgcaagttttttatgccgaattcatatgttcaatcaatatttcaaattgatttagacaagttagtggacaaaggcgttaaaggtattattacagatttagataatacgctagtaggttgggatgttaaagaacctacagaacgtgttaaagcatggtttaaggaagctaatgaaaaaggaatcactattacaatcgtgtctaataataatgagtctcgtgttgctagttttagtcagcatttagacatcgattttatttttaaagcgagaaagccaatggggaaagcgtttgataaagcaataactaagatgaatatcagaccagatcaaactgttgttataggtgaccaaatgcttactgatgtatttggtggtaatcgtcgaggtctatatacaattatggttgttccagttaaacgaactgatggctttattactaagtttaatagattaattgaaagacgattattacgtcatttcagtaaaaaaggttatatcacatgggaggaaaat

SEQ ID NO: 402 - protein, 175 aa, Staphylococcus aureus
  MISC_FEATURE (1)..(175): conserved hypothetical
MGLVRKFFMPNSYVQSIFQIDLDKLVDKGVKGIITDLDNTLVGWDVKEPTERVKAWFKEANEKGITITIVSNNNESRVASFSQHLDIDFIFKARKPMGKAFDKAITKMNIRPDQTVVIGDQMLTDVFGGNRRGLYTIMVVPVKRTDGFITKFNRLIERRLLRHFSKKGYITWEEN

SEQ ID NO: 403 - DNA, 1098 bp, Staphylococcus aureus
ttgtctgacattttaaaatgtatcggttgtggtgcgccacttcaatctgaagataaaaataaacctggttttgtaccagagcataatatgtttcgtgatgacgtgatttgcagacgttgtttccgcttgaaaaattataacgaagttcaagatgtaggattagaaagtgaagactttttaaaattattatcaggacttgcggataaaaagggtattgtcgtcaatgtcgtggatgtatttgactttgaaggatcatttattaatgcagttaaacgtattgtcggaaacaaaaaaatcattttagcagcaaataaattggatttattgccgaaacaaattaataaacgtcgagttaaagaatggttaaaacgaacagcaagaaaatatggtttggaagctgacgatgtcgtattaatttcagctgaaaaaggctggggcatagacgacttattatcatcaattgcgaatattcgagaaaatgaagatgtgtatattgtagggacaacgaatgttgggaaatctacattgattaataaactgattgaagctagtgttggtgaaaaagatgtagtaacaacttcaagattccctggaacaactttagatatgatagatattcctttagatgaaacatcatttatgtatgatacaccaggtattattcaagatcaccaaatgacgcatttagttagtgaaaaagaattgaaaattattatgcctaagaaagaaataaaacaacgcgtatatcaattaaatgaggcgcagacattattcttcggcggtctagcgcgcatagattatgtatcaggtggtaaacgtccgttagtttgtttcttttctaatgacttgaatatacatcgtactaaaacggagaaggctaatgatttatggcgtaatcaacttggcgatttattaacgccacctggaaatccacaaaattttgatcttaatgaggtaaaggctgttagacttgaaacaggcaaagagaaacgcgatgttatgatctctggtctaggctttataactataggaccaggggctaaagtaatcgttcgtgttcctaaaaatgttgatgttgtattaagaaattctatttta

SEQ ID NO: 404 - protein, 366 aa, Staphylococcus aureus
  MISC_FEATURE (1)..(366): conserved hypothetical
LSDILKCIGCGAPLQSEDKNKPGFVPEHNMFRDDVICRRCFRLKNYNEVQDVGLESEDFLKLLSGLADKKGIVVNVVDVFDFEGSFINAVKRIVGNKKIILAANKLDLLPKQINKRRVKEWLKRTARKYGLEADDVVLISAEKGWGIDDLLSSIANIRENEDVYIVGTTNVGKSTLINKLIEASVGEKDVVTTSRFPGTTLDMIDIPLDETSFMYDTPGIIQDHQMTHLVSEKELKIIMPKKEIKQRVYQLNEAQTLFFGGLARIDYVSGGKRPLVCFFSNDLNIHRTKTEKANDLWRNQLGDLLTPPGNPQNFDLNEVKAVRLETGKEKRDVMISGLGFITIGPGAKVIVRVPKNVDVVLRNSIL

SEQ ID NO: 405 - DNA, 816 bp, Staphylococcus aureus
gtgattaaaaaaatgaaatttgcagttataggaaatcctatttcacattccttgtcgcccgttatgcatagagcaaattttaattctttaggattagatgatacttatgaagctttaaatattccaattgaagattttcatttaattaaagaaattatttcgaaaaaagaattagaaggctttaatatcacaattcctcataaagaacgtatcataccgtatttagattatgttgatgaacaagcgattaatgcaggtgcagttaacactgttttgataaaagatggcaagtggatagggtataatacagatggtattggttatgttaaaggattgcacagcgtttatccagatttagaaaatgcatacattttaattttgggcgcaggtggtgcaagtaaaggtattgcttatgaattagcaaaatttgtaaagcccaaattaactgttgcgaatagaacgatggctcgttttgaatcttggaatttaaatataaaccaaatttcattagcagatgctgaaaagtatttagctgaattcgatatcgttattaatacaacaccagcgggtatggctggaaataacgaaagtattattaatttaaagcatctttctcccaatactttaatgagtgatattgtttatataccgtataaaacacctattttagaggaagcagagcgcaagggaaaccatatttataatggcttagatatgtttgtttaccagggtgcggaaagctttaaaatttggactaataaagatgctgatattaattctatgaaaacagcagttttacaacaattaaaaggagaa

SEQ ID NO: 406 - protein, 272 aa, Staphylococcus aureus
  MISC_FEATURE (1)..(272): shikimate dehydrogenease
VIKKMKFAVIGNPISHSLSPVMHRANFNSLGLDDTYEALNIPIEDFHLIKEIISKKELEGFNITIPHKERIIPYLDYVDEQAINAGAVNTVLIKDGKWIGYNTDGIGYVKGLHSVYPDLENAYILILGAGGASKGIAYELAKFVKPKLTVANRTMARFESWNLNINQISLADAEKYLAEFDIVINTTPAGMAGNNESIINLKHLSPNTLMSDIVYIPYKTPILEEAERKGNHIYNGLDMFVYQGAESFKIWTNKDADINSMKTAVLQQLKGE

SEQ ID NO: 407 - DNA, 288 bp, Staphylococcus aureus
atgcttactggcaaacaaaaaagatacttaagaagtttagcacacaatattgatccgatttttcaaattggaaaaggcggtatcaacgaaaatatgattaaacaaatagatgatacgttagaaaacagagaattgattaaagtacatgtactacaaaataactttgatgataaaaaagaattagctgaaacattaagcgaagctactcatagtgaattagtgcaagtgattggatctatgatagtgatttatagagaatctaaagataataaagaaattgaattgcca

SEQ ID NO: 408 - protein, 96 aa, Staphylococcus aureus
  MISC_FEATURE (1)..(96): conserved hypothetical
MLTGKQKRYLRSLAHNIDPIFQIGKGGINENMIKQIDDTLENRELIKVHVLQNNFDDKKELAETLSEATHSELVQVIGSMIVIYRESKDNKEIELP

SEQ ID NO: 409 - DNA, 567 bp, Staphylococcus aureus
atgaaaaagatagtactttacggcggtcagtttaaccctatccatactgcacatatgatagtagctagcgaagtatttcatgaattacagccagatgaattttattttttacctagttttatgtctccattgaaaaagcaccatgattttatagacgttcagcacagattaacaatgatacagatgattatcgacgagcttggttttggagatatttgtgacgatgaaattaaacgtggtggtcaaagttatacctatgacacgatcaaggcattcaaggagcaacacaaagacagtgagttgtactttgttattgggacggatcagtataaccaactagagaaatggtatcaaattgaatacttaaaagaaatggttacttttgtagttgtaaatcgagacaaaaatagtcaaaatgttgaaaatgctatgattgcaattcagatacctagggtagatataagttcgacaatgattcgacaaagagttagtgaagggaaatctatccaagttcttgttcctaaatccgttgaaaactatattaagggggaaggattatatgaacat

SEQ ID NO: 410 - protein, 189 aa, Staphylococcus aureus
  MISC_FEATURE (1)..(189): conserved hypothetical
MKKIVLYGGQFNPIHTAHMIVASEVFHELQPDEFYFLPSFMSPLKKHHDFIDVQHRLTMIQMIIDELGFGDICDDEIKRGGQSYTYDTIKAFKEQHKDSELYFVIGTDQYNQLEKWYQIEYLKEMVTFVVVNRDKNSQNVENAMIAIQIPRVDISSTMIRQRVSEGKSIQVLVPKSVENYIKGEGLYEH

SEQ ID NO: 411 - DNA, 627 bp, Staphylococcus aureus
ttgttcctaaatccgttgaaaactatattaagggggaaggattatatgaacattgaaaaagcaaaacggcttgcaaaagagaaactgccagagaaacgttataatcattctttaagagttgcagaaacagcgattaaattggcagaaatttatgatggagacactagtaaagtagaattagcaggtgtattacatgatttctgtaaatatgatgatttaggtaaaatgtatcaaattgttcgacaatacgaattaggtaatgatctactgagttatggtagtgaaatattgcatggccctgtgtgtgcagcaatcatggaacatgaatatggtatcaatgatgaggaagtattaatggctatcaaataccatactactggacgtcaacaaatgacaaaaactgaaaaactgatttttattgcagattacatcgaacctggaagaacaatcccaggagttgatgatattcgagatatggcatacaatcaaggtagtttagataagacaatttatgaaatttctaaacgcacagtactatttttaatacagaaagatattacggtatataataagacgattgactgtttaaattattataactatagtgacgaaagaataaaggatgat

SEQ ID NO: 412 - protein, 209 aa, Staphylococcus aureus
  MISC_FEATURE (1)..(209): conserved hypothetical
LFLNPLKTILRGKDYMNIEKAKRLAKEKLPEKRYNHSLRVAETAIKLAEIYDGDTSKVELAGVLHDFCKYDDLGKMYQIVRQYELGNDLLSYGSEILHGPVCAAIMEHEYGINDEEVLMAIKYHTTGRQQMTKTEKLIFIADYIEPGRTIPGVDDIRDMAYNQGSLDKTIYEISKRTVLFLIQKDITVYNKTIDCLNYYNYSDERIKDD

SEQ ID NO: 413 - DNA, 351 bp, Staphylococcus aureus
atgaattcacaagaattattagcaattgctgtggatgcaattgacaataaaaaaggcgaagatacgatttctttagaaatgaaaggtatcagcgatatgacagattattttgttgtaacgcacggaaataatgaacgacaagttcaagcgattgctagagcggtgaaagaagtagccaatgaacaaaatatagaagtaaaacgtatggaaggatacaatgaagcgcgttggatattaattgacttagctgatgttgtggtacatgttttccataaagacgaaagaaattattataatattgaaaagttatatcaagatgcaccattagaatcatatagtcaggttgcgtat

SEQ ID NO: 414 - protein, 117 aa, Staphylococcus aureus
  MISC_FEATURE (1)..(117): conserved hypothetical
MNSQELLAIAVDAIDNKKGEDTISLEMKGISDMTDYFVVTHGNNERQVQAIARAVKEVANEQNIEVKRMEGYNEARWILIDLADVVVHVFHKDERNYYNIEKLYQDAPLESYSQVAY

SEQ ID NO: 415 - DNA, 714 bp, Staphylococcus aureus
atgtcgcaatatgcagaaatgagcctagtgtacgatcaattgactcaagatcaaccatatgaaaaatggtttgaaattgtaaaaaatcactgcaaagatgaatcaaatattttagatattggatgcggtactggtagtttaacagttcaattagaagctttaggtaatgttactggtatggatttaagtgttgatatgttgactgttgcagctcaaaaatcagcaaatgtaaattggcttgaaggagatatgacatcttttgatttgcaacaacaatttgatatcatcactattttttgtgactctctaaattatttgcaagatgaaactgcagtgattgaaacattcatcaatgtttatcatcatctgactgattcaggtgtatttatttttgatgtacatactgtttataaaatgatgactttgtttaataatcaaagttatattgatgataaaggggacatttttttagcatgggatgctgtgcaaggagatttacctttaagtgtttatcatgatatgacatttttcattcgacatgaagatgaaacatattcaagatttgatgagtctcattttcagagaacatttgatgaaaagacatatttgtcttggttagctcaagttggttttaaacatgttgaaacatttactgattttaatatagatgaacataatgaagatgcagaaagattgtttttcattgcgaaaaaa

SEQ ID NO: 416 - protein, 238 aa, Staphylococcus aureus
  MISC_FEATURE (1)..(238): conserved hypothetical
MSQYAEMSLVYDQLTQDQPYEKWFEIVKNHCKDESNILDIGCGTGSLTVQLEALGNVTGMDLSVDMLTVAAQKSANVNWLEGDMTSFDLQQQFDIITIFCDSLNYLQDETAVIETFINVYHHLTDSGVFIFDVHTVYKMMTLFNNQSYIDDKGDIFLAWDAVQGDLPLSVYHDMTFFIRHEDETYSRFDESHFQRTFDEKTYLSWLAQVGFKHVETFTDFNIDEHNEDAERLFFIAKK

SEQ ID NO: 417 - DNA, 684 bp, Staphylococcus aureus
gtggttttattgtatcaatttttattacgctataaagattttttaactcaatggaagttatatattctaagtgctgttgttttaattatggtattaattggttttatattctggagacaagatgattatacttcaagaaattttgaaaataaagatactgctctgaaacaaagcactagtgaaaatagtagtttgtccaaagtagaagatgtccaggtcaaagatggagataattccaaaaataagggtcctgtatatgtcgatgtaaaaggtgctgttaaacatcctaatgtttataaaatgacatctaaggatagagtagttgatttacttgataaagcacaattattggaggatgcagatgtaagtcaaattaatttgtctgaaaaattaacagatcaaaaaatgattttcatacctcataaaggacaaaagaatgttgaaccacaaattgaagtaaacagtgtgcacgaaaaaaatgggaacacaaataatactaaagtaaatttaaatacggcatctgtatcagaattgatgtctgttcctggagttgggcaagctaaagctaatgcaattgttgaatatcgcaaccaacaaggtgcatttcaagaaattgacgatttgaaaaaagtaaaaggttttggaagtaaaacttttgataaactgaaatcttatttcacgaca

SEQ ID NO: 418 - protein, 228 aa, Staphylococcus aureus
  MISC_FEATURE (1)..(228): hypothetical protein
VVLLYQFLLRYKDFLTQWKLYILSAVVLIMVLIGFIFWRQDDYTSRNFENKDTALKQSTSENSSLSKVEDVQVKDGDNSKNKGPVYVDVKGAVKHPNVYKMTSKDRVVDLLDKAQLLEDADVSQINLSEKLTDQKMIFIPHKGQKNVEPQIEVNSVHEKNGNTNNTKVNLNTASVSELMSVPGVGQAKANAIVEYRNQQGAFQEIDDLKKVKGFGSKTFDKLKSYFTT

SEQ ID NO: 419 - DNA, 468 bp, Staphylococcus aureus
gtgaacatcttggaaagaatcaaatgggaagaatattttatggcacaaagtcatttgctagcattacgttcaacttgtcaaagattatctgtaggtgcaacgattgttaaggataatcgtattattgctggtggttataatggctctgtagctggcgaggtgcattgtatagatgaaggatgtttaattgaagatggacattgtatcagaacgatacatgcagaaatgaatgctttattacaatgtgcaaaacaaggtgtatctactgaaggtgcaacaatctatgttactcattttccatgcctaaattgtacaaagtcaattattcaagcaggtataaagcgtatctactatgcagaagattatcataaccatgaatatgcaactaaattactcaaacaatctggtattgaatttaaaaaaattccattttcaccagaatatgttgctaaatatctgactaaaggt

SEQ ID NO: 420 - protein, 156 aa, Staphylococcus aureus
  MISC_FEATURE (1)..(156): late competence operon
VNILERIKWEEYFMAQSHLLALRSTCQRLSVGATIVKDNRIIAGGYNGSVAGEVHCIDEGCLIEDGHCIRTIHAEMNALLQCAKQGVSTEGATIYVTHFPCLNCTKSIIQAGIKRIYYAEDYHNHEYATKLLKQSGIEFKKIPFSPEYVAKYLTKG

SEQ ID NO: 421 - DNA, 2199 bp, Staphylococcus aureus
ttgctgtttgtcgcgttatcaatgattgtaggagtgctttggaattctagcaaagtgctctctacatttcttttcattttacttttgtatattacttatcgtaaaaataaaatcgtttatgcccctatttctctctttttaatcattttctccgcatggtatttacattattcacaacaagcaatatttaattatatcaattatattgaacgtaattctcagtttaatgagcgtgctcaagtaatccaaattcaacgtcaaggtagtgacacatataaaggtaggttgagtttaaaaaatgaaatatatcctttctttttaacagataaaaagaattttgatttaaagaaaattgaaagtcgtaattgtattgttaaaggacaattcaaagttaatgacaataagtttgtaactcttaaattacaaagtatagttgtacaaagctgcctagaatcgaaccggtctaatttaattgagaaacataaacagtttataatgaatcgaatttatgattcgggtattaagtttccggatcgtattatggcattgattactggtgacgtaaaagaagttaatgagcaatttaaggaacgtgttaaagagataggtatatatcatttgctggcagttagtggctcgcatatagctgcaattgtatttttaatttaccaacctttaaaacgattaaatttacctttatttgtcattaaaggaattacaatcattgtattagctttatttgctcaatacacaaattatgcacctagtgctgtaagagctataataatgacaactcttgtactggttattactaagcaaattaaaataaagggtattcagctattagcatttgcatttataattatgtttattttaaatccactagttgtttatgatattggatttcaattttcattcatcatttcattttttattatgctactttttccttttttacagcaattgtcaaagttacaatcattattcataattacgtttattgcacaattagcttcatttatcgttgccattccaagctttcatcaacttcaatgggtgggatttttatctaatttgatttttgtaccgtactattcgattatattgtttccgctatctattttattctttattacaagtcattttattgtgggattaacgccgctaaattacttggttgacctaagttttaattttcatgactggttactagacctattcacaagaatcaagcaatcacatttttctgttcccaagtttaatgattggatatttatagtatttataatttctgtttattacatattttggttattggctaaacgtaaatatatattggttacgttttggactataattattctgacattattaataacgtttccaacaaattcacatcacaaaattacaatgttaaatgtggggcagggagacagtattttatatgaaggcggtaagaaccaaaatgtcttgattgatacaggtgggaaagtgattgatgatactaaacaacctagttattcaatttctaaatatcatattttaccaacgctaaatgaaagagggataaatgaattagagtatctaattttaacacatccacacaatgaccatattggtgaagtggaatatattattagtcatattaaaattaaacatatagtgatatacaataagggatatagtagtaatacattgatgttattatcgaaattaagccataagtacaacattaaacttatggatgtaagacaagttagtagttttaaacttggagatagtagttttctattttttgatagttttattccaaatagccgagataaaaatgagtattcgattattactatgattacatatcaaaataaaaaagttttattaatgggcgatgctagtaaaaataatgaatctttactactaaaaaaatataacttgccggagattgatattttaaaagtaggacatcatgggagcaagacaagtagttctaaagaatttatagagatgattaagcctaaaataagtttgatttcttctgggaagaacaatatgtatcatcttcctaatatagaagttgttaaacgattgcaaaggattcgcagtcgcatttacaatagtcaacaaaacggtcaagttacaattgacttagatgataatttaaaagttgattcaagctcttatggaaatgcaagtggttta

SEQ ID NO: 422 - protein, 733 aa, Staphylococcus aureus
  MISC_FEATURE (1)..(733): hypothetical protein
LLFVALSMIVGVLWNSSKVLSTFLFILLLYITYRKNKIVYAPISLFLIIFSAWYLHYSQQAIFNYINYIERNSQFNERAQVIQIQRQGSDTYKGRLSLKNEIYPFFLTDKKNFDLKKIESRNCIVKGQFKVNDNKFVTLKLQSIVVQSCLESNRSNLIEKHKQFIMNRIYDSGIKFPDRIMALITGDVKEVNEQFKERVKEIGIYHLLAVSGSHIAAIVFLIYQPLKRLNLPLFVIKGITIIVLALFAQYTNYAPSAVRAIIMTTLVLVITKQIKIKGIQLLAFAFIIMFILNPLVVYDIGFQFSFIISFFIMLLFPFLQQLSKLQSLFIITFIAQLASFIVAIPSFHQLQWVGFLSNLIFVPYYSIILFPLSILFFITSHFIVGLTPLNYLVDLSFNFHDWLLDLFTRIKQSHFSVPKFNDWIFIVFIISVYYIFWLLAKRKYILVTFWTIIILTLLITFPTNSHHKITMLNVGQGDSILYEGGKNQNVLIDTGGKVIDDTKQPSYSISKYHILPTLNERGINELEYLILTHPHNDHIGEVEYIISHIKIKHIVIYNKGYSSNTLMLLSKLSHKYNIKLMDVRQVSSFKLGDSSFLFFDSFIPNSRDKNEYSIITMITYQNKKVLLMGDASKNNESLLLKKYNLPEIDILKVGHHGSKTSSSKEFIEMIKPKISLISSGKNNMYHLPNIEVVKRLQRIRSRIYNSQQNGQVTIDLDDNLKVDSSSYGNASGL

SEQ ID NO: 423 - DNA, 927 bp, Staphylococcus aureus
atgactaactcttcgaaaagcttcactaaatttatggctgcttctgctgtttttactatgggatttttatcagtacctactgctggcgctgaacaaacaaatcaaattgcaaataaacctcaggctattcaatggcatacaaatttaacgaatgagcgattcactactatcgcacatcgtggcgcaagtggctatgcacccgagcatacgtttcaagcatatgataagagtcataatgagttaaaagcatcttatatcgaaattgatttacaacgtaccaaagatggccatttagttgctatgcatgatgaaactgttaaccgtacaacaaatggacacggtaaagttgaggattatacccttgatgaattaaaacagttagatgcaggaagttggtttaataaaaaatatccaaaatacgcaagagcaagttataaaaatgctaaagtacccactttagatgaaattttagaacgttatggcccgaatgcaaactattatattgaaacaaagtcacctgatgtatacccaggaatggaagaacaattattagcttcattgaaaaagcatcaccttttaaataacaataaattaaaaaatggacatgtaatgattcaatcattttctgacgaaagtttaaagaaaattcatcgtcaaaataagcatgtgccattagtaaaattagttgataaaggtgaactacaacaatttaacgaccaacgcttaaaagagatacgctcttatgcgattggattaggtcctgattatacagatttaactgaacaaaatacccatcatttaaaagacttaggatttatagtacatccttatacagtgaatgaaaaagctgatatgttacgattaaataaatatggcgttgatggtgtctttacaaatttcgctgataaatataaagaagtcattaag

SEQ ID NO: 424 - protein, 309 aa, Staphylococcus aureus
  MISC_FEATURE (1)..(309): glycerophosphoryl diester
MTNSSKSFTKFMAASAVFTMGFLSVPTAGAEQTNQIANKPQAIQWHTNLTNERFTTIAHRGASGYAPEHTFQAYDKSHNELKASYIEIDLQRTKDGHLVAMHDETVNRTTNGHGKVEDYTLDELKQLDAGSWFNKKYPKYARASYKNAKVPTLDEILERYGPNANYYIETKSPDVYPGMEEQLLASLKKHHLLNNNKLKNGHVMIQSFSDESLKKIHRQNKHVPLVKLVDKGELQQFNDQRLKEIRSYAIGLGPDYTDLTEQNTHHLKDLGFIVHPYTVNEKADMLRLNKYGVDGVFTNFADKYKEVIK

SEQ ID NO: 425 - DNA, 285 bp, Staphylococcus aureus
atggaaaaggggattttcaattacgataatgcgaatgtattaaaattagatactaatcagttaaatgaaaacataaaagtcattgacgatatatttaaaaattatgagcagatagagccaactatagaagtcgaaaatggaaatacaaaattaaaattaaatggatattttattgcgtcaattataagcccattaaatttaaataaacttaataatttatatgttgaagaagaattttatcatacatataacgaattaattgttaaatatactgaggtaaaggaa

SEQ ID NO: 426 - protein, 95 aa, Staphylococcus aureus
MEKGIFNYDNANVLKLDTNQLNENIKVIDDIFKNYEQIEPTIEVENGNTKLKLNGYFIASIISPLNLNKLNNLYVEEEFYHTYNELIVKYTEVKE

SEQ ID NO: 427 - DNA, 288 bp, Staphylococcus aureus
ttgttttacgcatgtcattttaaagtgaaaattggaggtgtaattttgactagaacttataatattattggtatcctttcttgtcttatatcttttattattatggcgttaccaatgatttggtacacagcttcagcattatggttcttcccaggtgcaatcatgatattgttgttatctttagtcattgttttttgctatattaaaacgaaaaatcaattacatttattactaatcgtattaaatattattatattgctttttttcagtttgccgttgttactttca

SEQ ID NO: 428 - protein, 96 aa, Staphylococcus aureus
  MISC_FEATURE (1)..(96): hypothetical protein
LFYACHFKVKIGGVILTRTYNIIGILSCLISFIIMALPMIWYTASALWFFPGAIMILLLSLVIVFCYIKTKNQLHLLLIVLNIIILLFFSLPLLLS

SEQ ID NO: 429 - DNA, 972 bp, Staphylococcus aureus
atgagcgacaatattgtagctatttatggagatgtgcctgaattggttgaaaaacaaagtgcagaaatcatatcacaatttttgaaaagtgatagagatgactttaactttgtgaaatataatttatacgaaacagagattgcaccaattgttgaagaaacattaacattgcctttcttttcagataaaaaagcaattttggttaaaaatgcatatatatttacaggtgaaaaagcgccaaaagatatggctcataatgtagatcaattaatagaatttattgaaaaatatgatggcgaaaatttgattgtctttgagatatatcaaaataaacttgatgaaagaaaaaagttaactaaaactctaaaaaagcatgcaaggcttaaaaaaatagagcaaatgtctgaagaagaaataaaaaaatggattcaaagtaaattaaatgagaatttcaaagatatcaaaagagatgcattagatttatttattgagttgacaggtattaactttaatattgtctcacaagagatagaaaagttgattttatttttaggcgatagaccaacaattaataagcaggatgttaaccaaattattaatagaagtttagagcaaaatgtatttttactgactgaatacattcagaaaagaaagaaagaacaagcaattcatttagtaaaagatttaataactatgaaagaagaaccaattaaattacttgcactaattacaagtaattaccgattattttatcaatgtaagattctgagtcaaaaaggatatagtggacagcaaattgctaaaacaataggagtacatccatacagagtaaaattagcgttaggacaagtaagacattatcaacttgatgaattattgaatattatagatgcttgtgcggaaactgattataaacttaaatcatcatatatggataaacagttaatactggaattattcattctatcttta

SEQ ID NO: 430 - protein, 324 aa, Staphylococcus aureus
  MISC_FEATURE (1)..(324): conserved hypothetical
MSDNIVAIYGDVPELVEKQSAEIISQFLKSDRDDFNFVKYNLYETEIAPIVEETLTLPFFSDKKAILVKNAYIFTGEKAPKDMAHNVDQLIEFIEKYDGENLIVFEIYQNKLDERKKLTKTLKKHARLKKIEQMSEEEIKKWIQSKLNENFKDIKRDALDLFIELTGINFNIVSQEIEKLILFLGDRPTINKQDVNQIINRSLEQNVFLLTEYIQKRKKEQAIHLVKDLITMKEEPIKLLALITSNYRLFYQCKILSQKGYSGQQIAKTIGVHPYRVKLALGQVRHYQLDELLNIIDACAETDYKLKSSYMDKQLILELFILSL

SEQ ID NO: 431 - DNA, 258 bp, Staphylococcus aureus
gtgacagaaatggcaaatatcaaatctgcaattaaacgtgtaaaaacaactgaaaaagctgaagcacgcaacatttcacaaaagagtgcaatgcgtacagcagttaaaaacgctaaaacagctgtttcaaataacgctgataataaaaatgaattagtaagcttagcagttaagttagtagacaaagctgctcaaagtaatttaatacattcaaacaaagctgaccgtattaaatcacaattaatgactgcaaataaa

SEQ ID NO: 432 - protein, 86 aa, Staphylococcus aureus
  MISC_FEATURE (1)..(86): 30S ribosomal protein S20
VTEMANIKSAIKRVKTTEKAEARNISQKSAMRTAVKNAKTAVSNNADNKNELVSLAVKLVDKAAQSNLIHSNKADRIKSQLMTANK

SEQ ID NO: 433 - DNA, 1821 bp, Staphylococcus aureus
atggataatgagcaacgcttaaaaagaagagagaatataaggaatttctcgattatagcacatattgaccacggaaaatctacattggctgatagaattttagaaaataccaaatcagttgaaacaagagatatgcaagatcagttactagattcaatggatttagaaagagaacgtggtattacaatcaaattaaacgcagtacgtttaaagtacgaagctaaagatggaaatacttatacattccatttaatcgatacgcctggacacgtcgattttacatatgaagtgtcacgttctttggcagcttgtgagggcgcgattttagtagtagatgcggctcaaggtatcgaagcacaaacattagcaaatgtttatttagcattagataatgagttagagttattgcctgttattaacaaaattgatttacctgctgcagaacctgaacgcgtgaaacaagaaattgaagatatgataggtttagaccaagacgatgttgttttagcaagtgctaaatctaacattggaattgaagagatactagagaaaatagttgaagttgtgccagctccagatggtgacccagaagcaccactaaaagcgttaatatttgattctgagtatgatccatatagaggggtaatttcatcgataagaattgtggacggtgttgttaaagccggagataaaattcgaatgatggccactggtaaagagttcgaagtaacagaagttggaattaatacacctaagcagcttccagttgatgaattaacagttggtgatgttggttatattattgcaagtattaaaaatgttgatgattctagggttggtgacaccatcacattagctagtagacctgcatcagaaccattgcaaggttataagaaaatgaatccaatggtatattgcggactgttcccaatagataacaaaaattataatgatttaagagaagcattagaaaaattacaattgaatgatgcatcattagaatttgagcctgaatcgtcacaagcattaggttttggttatagaactggtttcttaggtatgttacacatggaaataattcaagaaagaattgaaagagaatttggtattgaattaattgcaactgcaccatctgtaatttatcaatgtgttttaagggacggttcagaagtgacggttgataacccagcacaaatgccagatcgtgataaaattgataaaatatttgagccatatgttcgtgcaactatgatggttccaaatgactatgtcggtgcagtaatggaattatgtcaacgtaaacgtggacaatttataaatatggactatttagatgatattcgtgtaaatattgtttatgaattacctttagctgaagttgtatttgatttcttcgatcaacttaaatctaatactaaaggatatgcatcatttgattatgaattcatcgaaaataaagaaagtaatttagtcaagatggatattttattaaatggtgataaagtggatgcgctaagcttcatagttcatagagattttgcatatgaacgtggtaaagcattagttgaaaaacttaaaacgttaattccaagacagcaatttgaagtacctgtacaggctgcaataggacaaaaaattgtagcgcgtacaaatattaaatcaatgggtaaaaacgttttagctaaatgttatggcggtgacataagccgtaaacgtaaattacttgaaaaacaaaaagcaggtaaagctaagatgaaagcagttggtaatgttgaaattccacaagatgctttcttggctgtattgaaaatggatgatgaa

SEQ ID NO: 434 - protein, 607 aa, Staphylococcus aureus
  MISC_FEATURE (1)..(607): GTP-binding protein
MDNEQRLKRRENIRNFSIIAHIDHGKSTLADRILENTKSVETRDMQDQLLDSMDLERERGITIKLNAVRLKYEAKDGNTYTFHLIDTPGHVDFTYEVSRSLAACEGAILVVDAAQGIEAQTLANVYLALDNELELLPVINKIDLPAAEPERVKQEIEDMIGLDQDDVVLASAKSNIGIEEILEKIVEVVPAPDGDPEAPLKALIFDSEYDPYRGVISSIRIVDGVVKAGDKIRMMATGKEFEVTEVGINTPKQLPVDELTVGDVGYIIASIKNVDDSRVGDTITLASRPASEPLQGYKKMNPMVYCGLFPIDNKNYNDLREALEKLQLNDASLEFEPESSQALGFGYRTGFLGMLHMEIIQERIEREFGIELIATAPSVIYQCVLRDGSEVTVDNPAQMPDRDKIDKIFEPYVRATMMVPNDYVGAVMELCQRKRGQFINMDYLDDIRVNIVYELPLAEVVFDFFDQLKSNTKGYASFDYEFIENKESNLVKMDILLNGDKVDALSFIVHRDFAYERGKALVEKLKTLIPRQQFEVPVQAAIGQKIVARTNIKSMGKNVLAKCYGGDISRKRKLLEKQKAGKAKMKAVGNVEIPQDAFLAVLKMDDE

SEQ ID NO: 435 - DNA, 1155 bp, Staphylococcus aureus
ttggataaaaagtctgagaagcggggcattaaaatgacggtacaaagtgcatatatacatattccattttgtgtaagaatatgtacatattgtgatttcaataaatattttatacagaatcaacctgtagatgagtacttagatgcactaatcacagaaatgtctacagcaaaatataggatcttaaagaccatgtatgtaggtggcggcacaccaacggccctttctattaatcagttggaaagattacttaaagcaatacgtgatacgtttacaatcacaggcgagtatacatttgaagcaaatcctgatgagttaactaaagagaaagtccaactattagagaaatatggagtaaaaaggatttcaatgggcgttcaaacattcaagccggagttattgtctgttttaggtagaacgcacaatactgaagatatttacacttcggtgttaaatgctaaaaacgcaggtattaaatcaatcagtttagatttaatgtatcatttaccgaaacagacgattgaagattttgaacaaagtttagatctagctttagatatggatattcaacatatttcgagttacggcttaatacttgaacctaaaacccaattttataatatgtatagaaaaggcttgctcaaacttgctaatgaggatttaggtgctgacatgtatcagttgctgatgtctaagatagaacaatctcctttccatcaatacgaaatatctaattttgcattagatggccatgaatcagaacataataaggtttactggtttaatgaggaatattatggatttggagcaggtgcaagtggttatgtagatggtgtgcgttatacgaatatcaatccagtgaatcattatatcaaagctataaataaagaaagtaaagcaattttagtatcaaataaaccttctttgactgagagaatggaagaagaaatgtttcttgggttgcgtttaaatgaaggtgtgagtagtagtaggttcaaaaagaagtttgaccaatctattgaaagtgtctttggtcaaacaataaataatttaaaagagaaggaattaattgtagaaaagaacgatgtgattgcacttacaaatagagggaaagtcataggtaatgaggtttttgaagctttcctaataaatgat

SEQ ID NO: 436 - protein, 385 aa, Staphylococcus aureus
  MISC_FEATURE (1)..(385): oxygen-independent
LDKKSEKRGIKMTVQSAYIHIPFCVRICTYCDFNKYFIQNQPVDEYLDALITEMSTAKYRILKTMYVGGGTPTALSINQLERLLKAIRDTFTITGEYTFEANPDELTKEKVQLLEKYGVKRISMGVQTFKPELLSVLGRTHNTEDIYTSVLNAKNAGIKSISLDLMYHLPKQTIEDFEQSLDLALDMDIQHISSYGLILEPKTQFYNMYRKGLLKLANEDLGADMYQLLMSKIEQSPFHQYEISNFALDGHESEHNKVYWFNEEYYGFGAGASGYVDGVRYTNINPVNHYIKAINKESKAILVSNKPSLTERMEEEMFLGLRLNEGVSSSRFKKKFDQSIESVFGQTINNLKEKELIVEKNDVIALTNRGKVIGNEVFEAFLIND

SEQ ID NO: 437 - DNA, 975 bp, Staphylococcus aureus
atgattacagataggcaattgagtatattaaacgcaattgttgaggattatgttgattttggacaacccgttggttctaaaacactaattgagcgacataacttgaatgttagtcctgctacaattagaaatgagatgaaacagcttgaagatttaaactatatcgagaagacacatagttcttcagggcgttcgccatcacaattaggttttaggtattatgtcaatcgtttacttgaacaaacatctcatcaaaaaacaaataaattaagacgattaaatcaattgttagttgagaatcaatatgatgtatcatcagcattgacatattttgcagatgaattatcaaatatatctcaatatacaactttagttgttcatcctaatcataaacaagatattatcaataatgtacacttgattcgtgctaatcctaatttagttataatggttatcgtattttcatcaggtcatgttgagcatgtacatcttgcttcagacataccgtttaataatgacaaactaaatacaatatcaaattttgttacaaacaaactaactgagtttaatcagaatttacaagatgatattgtctcttttgttcaatcagagcaggaagaaatttttatcaataaattgttaaatacgatgaataatcatatttctaatcaaagtaatagcatttatatgggtggaaaggttaaacttattgatgcattgaatgaaagtaatgtatcttcaattcagcccattctacaatatatagaatcaaatagaattgcagaattattacaagatatatcttcaccaaatattaatgtaaaaattggtaatgaaattgatgacagcttaagtgatatttcaattgtaacaagtcaatatcattttgatgaaacgttaaaaggtcaaatcgctgtgattggacctacagctatgcattatcaaaatgtcattcaattattaaatagaatttgg

SEQ ID NO: 438 - protein, 325 aa, Staphylococcus aureus
  MISC_FEATURE (1)..(325): Heat-inducible
MITDRQLSILNAIVEDYVDFGQPVGSKTLIERHNLNVSPATIRNEMKQLEDLNYIEKTHSSSGRSPSQLGFRYYVNRLLEQTSHQKTNKLRRLNQLLVENQYDVSSALTYFADELSNISQYTTLVVHPNHKQDIINNVHLIRANPNLVIMVIVFSSGHVEHVHLASDIPFNNDKLNTISNFVTNKLTEFNQNLQDDIVSFVQSEQEEIFINKLLNTMNNHISNQSNSIYMGGKVKLIDALNESNVSSIQPILQYIESNRIAELLQDISSPNINVKIGNEIDDSLSDISIVTSQYHFDETLKGQIAVIGPTAMHYQNVIQLLNRIW

SEQ ID NO: 439 - DNA, 624 bp, Staphylococcus aureus
atgacaaataaagacgaatcagttgaaaaaaacactgaatcaacagttgaagaaacaaacgtcaaacaaaatattgatgattcagttgaacaagctgaagaaagtaaaggtcatttacaagatgaagcaatagaagaaacgtctgacgagaatgttattgaagaaatagatccaaaagatcaaaaaattaatgaacttcaacaattagcagatgaaaacgaagagaaatatttaaggctctacgctgagtttgaaaattataagcgtagaattcaaaaagaaaatgaaataaacaaaacatatcaagcacaacgtgtgttaacagatattttaccagcaatagacaatatagaacgtgcacttcaaattgaaggtgatgatgagacttttaaatctcttcaaaaaggtgtacaaatggtgcatgaaagtttgattaacgcactaaaagataatggtcttgaagttattaaaactgaaggtgaagcatttgatccaaatattcaccaagctgtagttcaagatgataaccctgattttgaatctggcgaaatcactcaagaactacaaaaaggatacaagcttaaagatagagtattaagaccatcaatggtcaaagtaaaccaa

SEQ ID NO: 440 - protein, 208 aa, Staphylococcus aureus
  MISC_FEATURE (1)..(208): GrpE protein
MTNKDESVEKNTESTVEETNVKQNIDDSVEQAEESKGHLQDEAIEETSDENVIEEIDPKDQKINELQQLADENEEKYLRLYAEFENYKRRIQKENEINKTYQAQRVLTDILPAIDNIERALQIEGDDETFKSLQKGVQMVHESLINALKDNGLEVIKTEGEAFDPNIHQAVVQDDNPDFESGEITQELQKGYKLKDRVLRPSMVKVNQ

SEQ ID NO: 441 - DNA, 1854 bp, Staphylococcus aureus
atgattaaatggaggaattttattatgagtaaaattattggtatagacttaggtacaacaaattcatgtgtaacagtattagaaggcgatgagccaaaagtaattcaaaaccctgaaggttcacgtacaacaccatctgttgtagctttcaaaaatggagaaactcaagttggtgaagtagcaaaacgtcaagctattacaaacccaaacactgttcaatctattaaacgtcatatgggtactgattataaagtagatattgaaggtaaatcatacacaccacaagaaatctcagctatgattttacaaaacttaaaaaatacagctgaaagctatttaggtgagaaagttgacaaagctgtaattacagtacctgcatactttaacgatgctgaacgtcaagcaactaaagatgctggtaaaattgctggtttagaagttgagcgtatcattaatgaaccaacagctgcagcattagcatatggtttagacaaaactgataaagatgaaaaagttcttgtttttgacttaggtggcggtacatttgacgtatctatcctagaattaggtgacggtgtattcgaagtactatcaacagccggtgacaacaaacttggcggtgatgattttgaccaagtaattattgactacctagttgcagaattcaaaaaagaaaatggcgtagacttatctcaagataaaatggcattacaacgtttgaaagatgctgctgaaaaagctaaaaaagacttatcaggtgtatcacaaactcaaatctcattaccatttatctcagctggtgaaaacggtccattacacttagaagtaaacttaactcgttctaaatttgaagaattatcagattcattaattagaagaacaatggaacctacacgccaagcaatgaaagacgctggcttaacaaactcagatatcgatgaagttatcttagttggtggatcaactcgtattccagcagtacaagaagctgtcaaaaaagaaatcggtaaagagcctaacaaaggagtaaacccggacgaagtagtggcaatgggagctgcaatccaaggtggcgttatcacaggtgacgttaaagacgtagtattattagacgtaacaccactatctttaggtattgaaattttaggtggacgtatgaatacgttaattgaacgtaacactacgattcctacatctaaatctcaaatctattcaacagcagtagataatcaaccatcagtagatgtacacgtattacaaggtgaacgtccaatggctgcggataataaaacacttggtagattccaattgactgatattccaccagctgaacgtggtaaacctcaaattgaagtaacgtttgatatcgataaaaacggtattgtaaatgtaactgcaaaagacttaggtacaaataaagaacaaagaattacaattcaatcaagttcttcattatcagacgaagaaatcgaccgtatggtaaaagatgctgaagttaacgctgaagcagataaaaaacgtcgtgaagaagtagacttaagaaacgaagctgacagtctagtattccaagttgaaaaaactttaactgatttaggcgaaaatatcggtgaagaagataaaaaatctgctgaagagaaaaaagacgctcttaaaactgctttagaaggtcaagatatagaagatattaaatctaaaaaagaagaacttgaaaaagtgattcaagaattatcagcaaaagtatatgagcaagcggctcaacagcaacaacaagcacaaggtgctaatgctggtcaaaacaatgatagtactgtagaagatgctgaatttaaagaagtaaaagacgacgacaaaaaa

SEQ ID NO: 442 - protein, 618 aa, Staphylococcus aureus
  MISC_FEATURE (1)..(618): DnaK protein
MIKWRNFIMSKIIGIDLGTTNSCVTVLEGDEPKVIQNPEGSRTTPSVVAFKNGETQVGEVAKRQAITNPNTVQSIKRHMGTDYKVDIEGKSYTPQEISAMILQNLKNTAESYLGEKVDKAVITVPAYFNDAERQATKDAGKIAGLEVERIINEPTAAALAYGLDKTDKDEKVLVFDLGGGTFDVSILELGDGVFEVLSTAGDNKLGGDDFDQVIIDYLVAEFKKENGVDLSQDKMALQRLKDAAEKAKKDLSGVSQTQISLPFISAGENGPLHLEVNLTRSKFEELSDSLIRRTMEPTRQAMKDAGLTNSDIDEVILVGGSTRIPAVQEAVKKEIGKEPNKGVNPDEVVAMGAAIQGGVITGDVKDVVLLDVTPLSLGIEILGGRMNTLIERNTTIPTSKSQIYSTAVDNQPSVDVHVLQGERPMAADNKTLGRFQLTDIPPAERGKPQIEVTFDIDKNGIVNVTAKDLGTNKEQRITIQSSSSLSDEEIDRMVKDAEVNAEADKKRREEVDLRNEADSLVFQVEKTLTDLGENIGEEDKKSAEEKKDALKTALEGQDIEDIKSKKEELEKVIQELSAKVYEQAAQQQQQAQGANAGQNNDSTVEDAEFKEVKDDDKK

SEQ ID NO: 443 - DNA, 1137 bp, Staphylococcus aureus
gtggccaaaagagattattatgaagttttaggcattagtaaggatgcttcaaaagatgaaatcaaaaaagcgtatcgaaagctttcgaaaaaatatcatccagatattaacaaagaagaaggtgcagatgaaaagtttaaagaaatttctgaagcctatgaagttttaagtgatgataataaacgcgcaagctatgatcaatttggacatgatggtccacaaggttttggtggacaaggattcaatggctctgactttggcggttttagtggcttcggtggcggcggttttgaagatatctttagctctttcttcggtggcggcagacaaagagatccaaatgcaccgcaaaaaggtgatgatcttcagtatacaatgacattaacatttgaagaagcggtatttggtacaacaaaagaaatttcaatccgtaaagatgtaacatgcgaaacatgtcatggtgatggtgcaaagcctggaacaagtaaaaagacttgtagttactgtaatggcgctggtcatgtagctgtagaacaaaacacaattttaggtagagttcgtactgaacaagtttgtcctaaatgtaatggaagtggtcaagaatttgaagaagcttgtccaacatgtcacggaaaaggtactgaaaataaaacagttaaattagaagtgaaagtacctgaaggtgtcgacaatgaacaacaaattagattagctggtgaaggctctccaggcgtgaatggaggacctgctggtgatttatacgtagtatttagagttaaaccatctgaaacatttaaacgtgatggtgatgatatttattacaaattaaatgttagcttcccacaagcagctttaggcgatgaaataaaaataccaacattaaataatgaagttatgttaacaatccctgctggtacacaaacaggtaagcaattccgcttaaaagaaaagggtataaaaaatgttcatggctatggatacggagatttatatgttgatattaaagtagtaacgcctactaaattaacagatagacaaaaagaactaatgaaagaatttgcccaattaaatggtgaagaaattaatgaacaaccttcgaattttaaagatagagcaaaaagattctttaagggagaa

SEQ ID NO: 444 - protein, 379 aa, Staphylococcus aureus
  MISC_FEATURE (1)..(379): DnaJ protein
VAKRDYYEVLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINEQPSNFKDRAKRFFKGE

SEQ ID NO: 445 - DNA, 936 bp, Staphylococcus aureus
atgaactggacagagctttcaattattattaatcatgaagcagtagaattggctaccaatatacttgaaaatcatggatcaaatggtgtcgtgatagaagattcagatgatttaattaaccaaccagaagataaatacggtgaaatttacgctttgaaaaaagaggattatccagataagggagtaagattgaaagcctattttaatgaaatgacttatgatgataagttgcgacagcaaattaaagatgagttattaaatttagatgaacttgatcaacataacgttcaattcagtgagcaaattattgcagagacggattgggaaaatgaatggaaaaactatttccatccattccgagcgtcgaagaagttcacaatagttcctagttgggaaacatatgctaaagaagcggatgaagagctttgcattgagctcgacccaggtatggcttttggaacaggtgatcatccgactacaagtatgtgtttgaaggcaatagaaacatatgtattgccacagcattcagtaattgatgttggtactggctcaggtatattaagtattgcaagtcatctaatcggtgtaaaacgtattaaagcgttggatattgatgaaatggcagtgagtgtagctaaagaaaacttcagaagaaatcattgtgaaacgttaattgaagctgttccaggtaacttattgaaagacgaaacagaaaaatttgatattgtaatagcaaatattttagcgcatattattgatgaaatgattgaagatgcttataatactctaaatgaaggcggttattttattacttctggtattataaaagagaagtatgaaggtatacagtcacatatggagcgtgtaggttttaaaattatttcagaacaacatgacaacggttgggtttgtcttgttggccagaaagtgagtgaa

SEQ ID NO: 446 - protein, 312 aa, Staphylococcus aureus
  MISC_FEATURE (1)..(312): conserved hypothetical
MNWTELSIIINHEAVELATNILENHGSNGVVIEDSDDLINQPEDKYGEIYALKKEDYPDKGVRLKAYFNEMTYDDKLRQQIKDELLNLDELDQHNVQFSEQIIAETDWENEWKNYFHPFRASKKFTIVPSWETYAKEADEELCIELDPGMAFGTGDHPTTSMCLKAIETYVLPQHSVIDVGTGSGILSIASHLIGVKRIKALDIDEMAVSVAKENFRRNHCETLIEAVPGNLLKDETEKFDIVIANILAHIIDEMIEDAYNTLNEGGYFITSGIIKEKYEGIQSHMERVGFKIISEQHDNGWVCLVGQKVSE

SEQ ID NO: 447 - DNA, 759 bp, Staphylococcus aureus
gtgaataatgtgcaacgttatttcatagaccaaaacgctgatgtaagtcagcgtttttttattacaaaaaaagaagatattcatcatataacaaatgtaatgagatatgatgttggtagtaaaattattttaacttttaatgatcaaacagtttatttatgtgaaattgctgacataacaagtgataaaattgaagttgatttaaaagaaaaacaaaatattaatacagaattgccagttgatgttacgatttgcagtggactaatcaaagctgacaaatatgagtggttgctacaaaaagctactgaattgggtgcttcatcatttatagctgtgagcatggaacgttcaattgttaaattaaacgaggcaaaagttgccaaaaagatagagcgttggcaaaaaataattaaagaagctgctgaacaaagctatcgtttagtgattccatctattcaattcgagtcgaatttaaaattaatttgtgatactattgataattatgactatattcttattgcatatgaagaggaagcaaaagatggtgagttaagcaatttcaagcaaactttacaacaattcaatgctcaggataaagtgttgatgatttttggtcctgagggtggtttgtcagaaaatgaaatttcattatttagtaatactagtacagttgttggtcttgggccgagaattttacgggcagaaactgcgccattgtatgcgttaagtgcaataagttatgaaaaagaattaatgggg

SEQ ID NO: 448 - protein, 253 aa, Staphylococcus aureus
  MISC_FEATURE (1)..(253): conserved hypothetical
VNNVQRYFIDQNADVSQRFFITKKEDIHHITNVMRYDVGSKIILTFNDQTVYLCEIADITSDKIEVDLKEKQNINTELPVDVTICSGLIKADKYEWLLQKATELGASSFIAVSMERSIVKLNEAKVAKKIERWQKIIKEAAEQSYRLVIPSIQFESNLKLICDTIDNYDYILIAYEEEAKDGELSNFKQTLQQFNAQDKVLMIFGPEGGLSENEISLFSNTSTVVGLGPRILRAETAPLYALSAISYEKELMG

SEQ ID NO: 449 - DNA, 1404 bp, Staphylococcus aureus
atgcgatgttgcatggaggctatagcaatgagcaataaagcttggggcggtagatttgaagtacaacctgaagagtgggttgacgactttaacgcatccattacttttgatcaaacgctcatagatcaagatatcgaaggcagcattgcacatgcaactatgcttgcgaatcaaggcattattagtcaacaagacagcgaacaaattatacaaggactaaaatctattcaacatgattatcatcaagatcaaattcaatttagtgcatcattagaagatattcatttaaatattgaacatgaattaattaaacgtatcggtgatgctggtggtaagttgcatactggacgcagtagaaacgatcaagttgcaacagacatgcacttgtacactaagaaacaagtgcaagatatcatcgcattaattaagtcgttacaaagtgtaattgtagacatcgcttccaataatgttgatacaattatgcctggttatactcatttacagcgtgcacagccaatttcatttgcacatcatattatgacttatttttggatgttacaacgagaccaacaacgatttgaagatagtttaaaacgaatcgatattaatcctttaggtgcagcagccttaagtggtaccacataccctatcgatagacacgagacaacagcattgttgaactttggcagtctctatgagaatagcctagatgctgttagtgacagagactatattattgaaacattgcataatatttctttaacgatggttcacttatcacgctttgcagaggaaattattttctggtccacagacgaagctaaattcattacattatcagatgcattttcaactggctcatctattatgccacaaaagaaaaatcctgatatggcagaattaattagaggtaaagttggtcgaacgactggtcatttaatgagcatgcttatgactttaaaaggattacctctagcatataacaaagatatgcaggaagataaagaaggtttattcgatgctgtccatacaattaaaggttctttacgtattttcgaaggtatgattcaaacgatgacaattaataaagaacgactcaatcaaactgttaaagaagatttttcaaatgcaacggaactagcagattatttagtaactaaaaatattccatttagaactgcacatgaaattgtaggaaaaatcgtcttagaatgtatacaacaaggtcattatttattagatgttcctttagcaacatatcaacaacatcattctagtattgatgccgatatttacgattatttgcagcctgaaaattgtttaaaacgacgtcaaagttacggttcaacaggtcaatcatcggtcaaacaacaacttgatgttgctaaacaattactatcacaa

SEQ ID NO: 450 - protein, 468 aa, Staphylococcus aureus
  MISC_FEATURE (1)..(468): argininosuccinate lyase
MRCCMEAIAMSNKAWGGRFEVQPEEWVDDFNASITFDQTLIDQDIEGSIAHATMLANQGIISQQDSEQIIQGLKSIQHDYHQDQIQFSASLEDIHLNIEHELIKRIGDAGGKLHTGRSRNDQVATDMHLYTKKQVQDIIALIKSLQSVIVDIASNNVDTIMPGYTHLQRAQPISFAHHIMTYFWMLQRDQQRFEDSLKRIDINPLGAAALSGTTYPIDRHETTALLNFGSLYENSLDAVSDRDYIIETLHNISLTMVHLSRFAEEIIFWSTDEAKFITLSDAFSTGSSIMPQKKNPDMAELIRGKVGRTTGHLMSMLMTLKGLPLAYNKDMQEDKEGLFDAVHTIKGSLRIFEGMIQTMTINKERLNQTVKEDFSNATELADYLVTKNIPFRTAHEIVGKIVLECIQQGHYLLDVPLATYQQHHSSIDADIYDYLQPENCLKRRQSYGSTGQSSVKQQLDVAKQLLSQ

SEQ ID NO: 451 - DNA, 1344 bp, Staphylococcus aureus
atgtcaacagttgcgtttcacacattaggttgtaaagtaaaccattatgaaactgaagcaatctggcaattatttaaagaagcaaactatgagcgcgttgactttgaagcgaatgctgatgtatttgttattaatacttgtacagtaacgaatacgggtgataaaaaaagtcgtcaaataattagacgtgcaataagacaaaatcctgatgctgtaatctgtgtaacaggttgttatgcgcaaacttcatcagctgaaattatggaaattcctggtgtcgatgtagtagttggtacacaagatagacataaactattaggttacattgacgaattccgtaaagaacgccaaccaattaatggtgttggaaatatcatgaaaaatcgtaaatatgaagaattagatgtcccttattttacagatagaacacgtgcgtcattaaaaattcaagaaggttgtaacaacttctgcacattctgtattattccatgggctcgtggcttaatgcgttcaagagatccggaaaaagtagttgaacaagcgacgcaactagtgaattcaggatataaggaaattgtattgacgggaattcatacaggtggatatggtcaagatttaaaagattataacttggcccaattattacgtgatcttgaaacgattaatggattagaacgaattcgaatttcttcaattgaagcaagtcaacttacagatgaagtaattgacgttttagaacgttcaacaaaagttgtgcgtcatttgcatattccattacaatctggttcagatacagtattaaaacgtatgagacgtaagtatacaatggatagattttcagaacgattaacaaaattgcataaagctttaccagacttggcagttacgagtgatgtaattgttggtttcccaggtgaaactgaagctgagttccaagaaacatatgattttatcgtaaagcataagttctctgaactgcatgttttcccttattctcctagaattggcacgccagctgcaagaatggatgaccaaattgatgaagaaattaaaaatgaacgggtgcataagttaattacgctaagcaatcaactcggaaagttatatgcgtctaaatttgatcaagatgtgcttgaagtaattcctgaggaacagggtgacacagaaggtacattagttggatatgcagataattatatgaaagtacaatttgaaggtgacgaatcactcataggtcaaattgtaaaagttaaaattacgcaagcaaattatccattaaatgaagggcaagcaattaaagttgttgatttcgcaacaaataaatctgatagagaagttttagtt

SEQ ID NO: 452 - protein, 448 aa, Staphylococcus aureus
  MISC_FEATURE (1)..(448): conserved hypothetical
MSTVAFHTLGCKVNHYETEAIWQLFKEANYERVDFEANADVFVINTCTVTNTGDKKSRQIIRRAIRQNPDAVICVTGCYAQTSSAEIMEIPGVDVVVGTQDRHKLLGYIDEFRKERQPINGVGNIMKNRKYEELDVPYFTDRTRASLKIQEGCNNFCTFCIIPWARGLMRSRDPEKVVEQATQLVNSGYKEIVLTGIHTGGYGQDLKDYNLAQLLRDLETINGLERIRISSIEASQLTDEVIDVLERSTKVVRHLHIPLQSGSDTVLKRMRRKYTMDRFSERLTKLHKALPDLAVTSDVIVGFPGETEAEFQETYDFIVKHKFSELHVFPYSPRIGTPAARMDDQIDEEIKNERVHKLITLSNQLGKLYASKFDQDVLEVIPEEQGDTEGTLVGYADNYMKVQFEGDESLIGQIVKVKITQANYPLNEGQAIKVVDFATNKSDREVLV

SEQ ID NO: 453 - DNA, 201 bp, Staphylococcus aureus
ttgatatttggagggagggaaatacagatgtctaaaacagtagtacgtaaaaatgaatcacttgaagatgcgttacgtagatttaaacgttcagtttctaaaagtggaacaatccaagaagtacgtaaacgtgaattttacgaaaaaccaagcgtaaaacgtaaaaagaaatcagaagctgcacgtaaacgtaaattcaaa

SEQ ID NO: 454 - protein, 67 aa, Staphylococcus aureus
  MISC_FEATURE (1)..(67): 30S ribosomal protein S21
LIFGGREIQMSKTVVRKNESLEDALRRFKRSVSKSGTIQEVRKREFYEKPSVKRKKKSEAARKRKFK

SEQ ID NO: 455 - DNA, 705 bp, Staphylococcus aureus
gtgagttataataattttttacaaatgacaactatcttggaatcaacggctggagatacttgggttgaacaagttagcaatataattgttcaacctatttttacgttaatattaacctgtttgacattcttaggatttgtatatcaactttactctaaaaaaatcaatgcagctggtattatcgccacattatcattacttattttatttttgggatttctaatccaaggaaatgtcaatatgcattctatcttaatattctcaattggcgttatattagttgtaattgaattatttgtagttggtgcagtaattggtattattggcatgatactgataactataagcataacaacgctcggtgataatttgctatttatgcttgcgaatgttatcgttgccttgattttaacgattgtagaatgggtgatattagtgaagattttcaacagaaagattccgtttttggataaagttatcttaaaagattcaactaattctgagtcaggttacaattctcatgataaccgctcgcacctcgtaggaaagactgctcaaacagttacagatcttcgacctgcagggattattttttgtgaaaatgaacgtattgatgctgtttcagatggcaactttattttgcgcaataaaacggtaaaaatccttgaagttgaaggaacaagagtagttgtgagggaagtagat

SEQ ID NO: 456 - protein, 235 aa, Staphylococcus aureus
  MISC_FEATURE (1)..(235): conserved hypothetical
VSYNNFLQMTTILESTAGDTWVEQVSNIIVQPIFTLILTCLTFLGFVYQLYSKKINAAGIIATLSLLILFLGFLIQGNVNMHSILIFSIGVILVVIELFVVGAVIGIIGMILITISITTLGDNLLFMLANVIVALILTIVEWVILVKIFNRKIPFLDKVILKDSTNSESGYNSHDNRSHLVGKTAQTVTDLRPAGIIFCENERIDAVSDGNFILRNKTVKILEVEGTRVVVREVD

SEQ ID NO: 457 - DNA, 987 bp, Staphylococcus aureus
atgtttagtttaagttttatcgtaatagcagttattatagtagttgcattacttattttattctcatttgtacccattggtttatggatttcagcgttagcagctggcgttcatgttggtataggtacattggttggtatgcgtttacgtcgtgtatctccaagaaaagttatagcgccattaattaaagcgcacaaagcaggactagcattaacaacaaaccaattagaatcgcattatctagcaggaggaaatgttgacagagttgttgacgctaatattgctgcacaacgtgctgacattgatcttcctttcgaacgtgctgctgcaattgaccttgcaggacgtgacgtattagaagcggttcaaatgtctgttaatcctaaagtcattgaaacaccatttatcgcaggtgtagcaatgaacggtattgaagtgaaagccaaagctcgtatcacagttagagctaatattgctcgacttgttggtggtgctggtgaagaaacaatcatcgcacgtgttggtgaaggtatcgtttcaacaattggttctagtaagcatcatacagaagtacttgaaaacccagataatatttctaaaacagttttaagcaaaggtttagattcaggtactgcatttgaaattttatcaattgatattgctgacgttgatattagtaaaaatattggtgcagacttacaaactgaacaagcattagcagacaaaaatattgcacaagcaaaagctgaagaacgtagagctatggctgtagcaactgagcaagaaatgaaagcgcgtgtacaagaaatgcatgctaaagtagttgaagccgaatctgaagtaccattagctatggctgaagcattacgttcaggtaatatcagtgttaaagattattataatttgaaaaatatcgaagctgatacaggcatgagaaatgcaattaataaacgaactgatcaaagtgatgatgagtcacctgaacat

SEQ ID NO: 458 - protein, 329 aa, Staphylococcus aureus
  MISC_FEATURE (1)..(329): conserved hypothetical
MFSLSFIVIAVIIVVALLILFSFVPIGLWISALAAGVHVGIGTLVGMRLRRVSPRKVIAPLIKAHKAGLALTTNQLESHYLAGGNVDRVVDANIAAQRADIDLPFERAAAIDLAGRDVLEAVQMSVNPKVIETPFIAGVAMNGIEVKAKARITVRANIARLVGGAGEETIIARVGEGIVSTIGSSKHHTEVLENPDNISKTVLSKGLDSGTAFEILSIDIADVDISKNIGADLQTEQALADKNIAQAKAEERRAMAVATEQEMKARVQEMHAKVVEAESEVPLAMAEALRSGNISVKDYYNLKNIEADTGMRNAINKRTDQSDDESPEH

SEQ ID NO: 459 - DNA, 696 bp, Staphylococcus aureus
atgagtgtcggtattctaatttttgtcatatcagtgatcatttctatcattactactatgcgcgaaaatagtcataaagatagacaaaatcaaaagccacctcaaaaaacatctaccgataatgaaccaaaaaaaggtggcttttttgaagaaattgagcgaacgtttaaagaaataagtgaagaattaaatgaagaagaaaagaaatcatcgaaacgaaaatatgatgatacgttaccacctttattcgatgaacttccaaaggaagagcctaaatcgaaacctgttgtagaacctatggcacctaaaaaacaacaagaaacaaaaccgatgacagagaaaccaatcacagtgcctaaagcagaaccggtggagcagaaacatagaccttctagacaagataattctgacgaaattagacgtcaattagaaaaatcacttagagatgatattaaaacgattcgtactgacattgatagagaaaaagaaaagcaaattgctaaaatggaaaaacgtgctagagatattattgaggataaatacttatctgaacgtacaaaacgtttgaaattaaagcagctgcttaattctcaaaatgtcgaaaaagatttgactaaatcagcgttccaatttgataaagatgaagtaatcaatggtatgatatggtcagaaattttagctaaaccaaaacaatta

SEQ ID NO: 460 - protein, 232 aa, Staphylococcus aureus
  MISC_FEATURE (1)..(232): conserved hypothetical
MSVGILIFVISVIISIITTMRENSHKDRQNQKPPQKTSTDNEPKKGGFFEEIERTFKEISEELNEEEKKSSKRKYDDTLPPLFDELPKEEPKSKPVVEPMAPKKQQETKPMTEKPITVPKAEPVEQKHRPSRQDNSDEIRRQLEKSLRDDIKTIRTDIDREKEKQIAKMEKRARDIIEDKYLSERTKRLKLKQLLNSQNVEKDLTKSAFQFDKDEVINGMIWSEILAKPKQL

SEQ ID NO: 461 - DNA, 963 bp, Staphylococcus aureus
atgaaaaggagcgcgtgtatgcctggaattatacaaatagacgatatgaaccaatctcaagctttaattggaaataatgatgaacatttaaaagcaattgaagagagtttcgatgttgtcatccatgcaagaggacaagaagttgccgttaaaggtacaaaaatagaaaacgtagaaaaagcggaatcagtattaatcaatttgctgaaggttattgatttaggtaataatattacaattaaagatgttgaagcagctattaaaatggcgcataataacacaattcaacatctgttagatttatatgatgaagagataactaaagatgcatttggtaagacgattcgtgcgaaaacgatggggcaacgtatatatgttaatgccatgaaaaataatgatttagtatttggtataggtcctgctggtacaggtaagacattcttagctgtagtttatgcagcaaagcaactccgtaaaggtgctgttaaacgtattgtattaacaagacctgctgttgaagcaggagagtcacttggatttttaccaggagatttgaaagaaaaggtagatccatatttaagacctttatatgatggtctatatactgttcttgggcgtgaacaaacagagcgatttattgaaagaggcattatcgaaatagcgccacttgcatatatgcgcggacgaacattagaagatgcatttgtaattcttgatgaggcgcagaatacgacacatgcgcaaatgaaaatgtttttaacaagactaggttttggctcaaaaatggtagttactggtgaccaaactcaaatcgatttacctaaaggtgttaaaagtggacttaaggaagcggtcagtaggttacacaacgttaaaggtataagtatattgaaattagatcagagcgatgtagtcagacatccattggtaagtaagatcattgaacattatgaaggagagaat

SEQ ID NO: 462 - protein, 321 aa, Staphylococcus aureus
  MISC_FEATURE (1)..(321): phosphate
MKRSACMPGIIQIDDMNQSQALIGNNDEHLKAIEESFDVVIHARGQEVAVKGTKIENVEKAESVLINLLKVIDLGNNITIKDVEAAIKMAHNNTIQHLLDLYDEEITKDAFGKTIRAKTMGQRIYVNAMKNNDLVFGIGPAGTGKTFLAVVYAAKQLRKGAVKRIVLTRPAVEAGESLGFLPGDLKEKVDPYLRPLYDGLYTVLGREQTERFIERGIIEIAPLAYMRGRTLEDAFVILDEAQNTTHAQMKMFLTRLGFGSKMVVTGDQTQIDLPKGVKSGLKEAVSRLHNVKGISILKLDQSDVVRHPLVSKIIEHYEGEN

SEQ ID NO: 463 - DNA, 465 bp, Staphylococcus aureus
atgtttacgatagattttagcgatcacacaggcttagttaaagatgcttggtataaacaaattgaagatttattagaatttgctaaaaaagaagagcatatagaagacgatgctgagctttctgttacatttgtagataaacaagaaatacaagaaattaatcgaacatatagagataaagataaagttacagatgtaatctcatttgctttagaagaagatgagccagagattgattttagtggtcttgatataccacgtgttttaggggatataattatctgtacggatgtagcgcaagaacaagcaaacaattacggacattcttttgaacgagaattacgatttttagcattacatggatttttgcatctattaggttatgatcatatgactgaagcggatgaaaagggaatgtttggtcgacaagctacaatattaaacgcatatggattaacacgagac

SEQ ID NO: 464 - protein, 155 aa, Staphylococcus aureus
  MISC_FEATURE (1)..(155): conserved hypothetical
MFTIDFSDHTGLVKDAWYKQIEDLLEFAKKEEHIEDDAELSVTFVDKQEIQEINRTYRDKDKVTDVISFALEEDEPEIDFSGLDIPRVLGDIIICTDVAQEQANNYGHSFERELRFLALHGFLHLLGYDHMTEADEKGMFGRQATILNAYGLTRD

SEQ ID NO: 465 - DNA, 342 bp, Staphylococcus aureus
atgaaaaggtttaaatatgcacttgatgggctgaaaatcttaattcaaaaagactataaatttcttttacatgtgtttgcaatgattgttgctattgtctttggtctcgtactaaatattaatcggattgagtggatatttatactcattgctattgcattagttctcactgttgaagctttaaacactgctattgaatatgttgtcgatttagtgaccgttgaatatcatgatttagctaaatacgctaaagatattgcggcttttagtgtacttatagtttcaatattagcatttattataggtttaatagtatttttaccacattttatagcgttattt

SEQ ID NO: 466 - protein, 114 aa, Staphylococcus aureus
  MISC_FEATURE (1)..(114): hypothetical protein
MKRFKYALDGLKILIQKDYKFLLHVFAMIVAIVFGLVLNINRIEWIFILIAIALVLTVEALNTAIEYVVDLVTVEYHDLAKYAKDIAAFSVLIVSILAFIIGLIVFLPHFIALF

SEQ ID NO: 467 - DNA, 402 bp, Staphylococcus aureus
atgagttatcaacctcattattttcaagaagttagaaaagcacaacaagaatcatattcgccatacagtcaatttaaagtaggggcttatttaaaaacgaaagacggtagaactttttatggtaccaatgtagaaaatgcttcttatccattatcgatatgtgctgaacgagctagtttggtatcggcaatttctcaaggatacagaccaggtgattttgaatcaataactgtaaccgtagatgcagataaaccgtcatcaccttgtggtgcatgtcgtcaagttttgaaggaattatgtgatgatgatatgcctgtgtatatgacaaatcataaaggagatatggttatgatgacagtcgcagagttactaccatttggattttcaggaaaggatttagaa

SEQ ID NO: 468 - protein, 134 aa, Staphylococcus aureus
  MISC_FEATURE (1)..(134): cytidine deaminase
MSYQPHYFQEVRKAQQESYSPYSQFKVGAYLKTKDGRTFYGTNVENASYPLSICAERASLVSAISQGYRPGDFESITVTVDADKPSSPCGACRQVLKELCDDDMPVYMTNHKGDMVMMTVAELLPFGFSGKDLE

SEQ ID NO: 469 - DNA, 1155 bp, Staphylococcus aureus
gtggccgttcaatggcttatcgacaaaggatacgacgttgtagcttgttgcctagatgttggtgaaggtaaagatttagacatcgtttataaaaaagctttagatatgggagcagttgaatgtcatattattgatgcaacaaaagaatttagtgatgagtatgtaagttatgcaatcaaaggaaatttaatgtatgaaaatgcatatccattagtttcagctttatcaagaccattaatcgctaaaaaattagtagagattgctgagaaaacaaattcagtaggtattgcacatggttgtactggtaaagggaatgaccaagtacgtttcgaagttgccattaaagcattaaacccatcattgaaagcattcgcacctgtacgtgagtgggcatggagtcgtgaagaagaaatcgattatgcaattaaacataatatccctgtatcaatcaaccatgattcaccttattctatcgatcaaaatctatggggcagagcgaatgaatgtggtattttagaagatccttatgctgcgccaccagaggatgcgttcgatctaacaaatgctttagaagaaacaccagatactgctgatgaaatcattttaacgtttgataaaggcatcccagttcaaattgatggcaaaacatatgaattagacgatttaattttaacgttgaatgcattagctggtaagcatggtatcggaagaattgaccatgtagaaaatagacttgtaggtatcaaatcaagagaaatttatgaggcacctgctgcagaagttattttaaaagcgcataaagcattagaaacgattacgttaacgaaagatgtcgcacactttaaaccaatcattgagaagcaatttgctgaacaactatacaatggactttggttctcacctttaactgatagcttgaaattatttattgatagtactcagcaatacgtaagtggtgatgtcagaattaaattattcaaaggtaatgccatcgtgaatggtagaaaatcaccttacacattatatgatgaaaaattagcaacttatacaaaagaagatgcatttaatcaagacgctgctgttggctttatcgatatctatggtttacctactcaagtaaatgcgatgttgcatggaggctatagcaatgagcaa

SEQ ID NO: 470 - protein, 385 aa, Staphylococcus aureus
  MISC_FEATURE (1)..(385): argininosuccinate synthase
VAVQWLIDKGYDVVACCLDVGEGKDLDIVYKKALDMGAVECHIIDATKEFSDEYVSYAIKGNLMYENAYPLVSALSRPLIAKKLVEIAEKTNSVGIAHGCTGKGNDQVRFEVAIKALNPSLKAFAPVREWAWSREEEIDYAIKHNIPVSINHDSPYSIDQNLWGRANECGILEDPYAAPPEDAFDLTNALEETPDTADEIILTFDKGIPVQIDGKTYELDDLILTLNALAGKHGIGRIDHVENRLVGIKSREIYEAPAAEVILKAHKALETITLTKDVAHFKPIIEKQFAEQLYNGLWFSPLTDSLKLFIDSTQQYVSGDVRIKLFKGNAIVNGRKSPYTLYDEKLATYTKEDAFNQDAAVGFIDIYGLPTQVNAMLHGGYSNEQ

SEQ ID NO: 471 - DNA, 1377 bp, Staphylococcus aureus
atggagaacaatgaactacaaaggggattgagtgcccgtcaaattcaaatgattgcacttggtggtacgattggcgtggggcttttcatgggtgcgacaagtacaattaaatggacaggcccatcagttatccttgcatatttaattgcgggtatctttttatttttaatcatgagagcaatgggggaaatgatttatttaaaccctacaacaggatcatttgcaacatttgcaagtgattatatacatcctgcagcaggttatatgacagcatggagtaatatattccaatggattgtagttggtatgagtgaggtcatcgcagtaggagaatatatgaagttttggttcccggaattgccaacttggattcctggtgttattgctattttattattaatggcagcgaatttattctcggtaaaagcgtttggagaatttgaattttggtttgctttaattaaagttgtaacaattattttaatgattattgctggttttggtcttattttctttggttttggaaatggtggccatgcggtaggtatttctaatctatggacaaatggcggatttatgccaaatggtattgttggtttcttctttgcattatcaattgtaattggttcataccaaggtgtggaactgataggtattacggcaggtgaaactaaagatcctcagaaaaatatcgttaaagcagtgaatggtgttatctggagaattttaattttctatttaggcgctatttttgttattgtttcagtgtatccttggaatcaattaggagacattggaagtccgtttgttgcaacatttgctaaaatcggtattacatttgcagctggattaattaactttgttgtattaactgcagcaatgtcaggatgtaactcaggtattttcagtgcgagtcgtatgatttatacacttgctcataaaggtgaaatgccgaaaatatttactaaaatcatgagaaatggtgtaccattgtacactgttgtagcagtatctcttggtattttaattggtgctttattaaacgtaattttacctttatatatcgatggagcgaagagtattttcgtatacgtttatagtgcgtctattttaccaggtatgattccttggtttatgattttattcagtcatttacgttttagaaaattacaccctgaagaattggaaggtcacccattcaaaatgcctggtggcgcagtaactaactatttaacaatcttattcttaatattagtattggttggtatggtatttaatgttgaaactagaatatcagtgcttattggtgtcatcttcttaacgattgtaacgatttattattttattagatataataaaaataatgtaaaagcaaaa

SEQ ID NO: 472 - protein, 459 aa, Staphylococcus aureus
  MISC_FEATURE (1)..(459): hypothetical protein
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVVAVSLGILIGALLNVILPLYIDGAKSIFVYVYSASILPGMIPWFMILFSHLRFRKLHPEELEGHPFKMPGGAVTNYLTILFLILVLVGMVFNVETRISVLIGVIFLTIVTIYYFIRYNKNNVKAK

SEQ ID NO: 473 - DNA, 897 bp, Staphylococcus aureus
atgacagaacataaatcaggatttgtttcaattataggtagaccaaatgtaggaaagtcaacatttgttaatagagtgatcggccataaaatagcaatcatgtccgataaagctcaaacaactagaaataaaattcaaggtgttatgacaagagatgacgcgcaaattatattcattgatacgccaggtattcataaacctaaacacaaattaggtgactatatgatgaaagtcgctaaaaatacattatctgagatagatgcaatcatgtttatggttaatgccaatgaggaaattggacgaggcgatgaatatattatagaaatgttgaaaaatgttaagacaccagtatttttagtattaaataaaatagatttagtgcatccagatgaattaatgccaaagattgaagaatatcaaagttatatggactttacagagattgtacctatttcagcattagaagggctaaatgtcgatcattttattgatgttttaaagacgtatttacccgaaggacctaaatattatccagatgatcaaatttcagaccatcctgaacaatttgtagtgggtgaaatcattcgtgaaaaaatccttcatcttacaagtgaagaaatccctcatgcgattggtgttaatgtggaccgtatggttaaagaaagcgaagatcgtgttcatatcgaagcaactatatatgttgaaagaggttcgcaaaaaggaattgtcattggaaaaggcggtaaaaagttaaaagaagtaggaaaacgtgcgagacgtgatatagaaatgcttctaggctctaaagtttacttagaattatgggtcaaagttcaaagagactggcgaaacaaagttaactttattcgccaaattggttatgttgaagaccaagat

SEQ ID NO: 474 - protein, 299 aa, Staphylococcus aureus
  MISC_FEATURE (1)..(299): GTP-binding protain Era
MTEHKSGFVSIIGRPNVGKSTFVNRVIGHKIAIMSDKAQTTRNKIQGVMTRDDAQIIFIDTPGIHKPKHKLGDYMMKVAKNTLSEIDAIMFMVNANEEIGRGDEYIIEMLKNVKTPVFLVLNKIDLVHPDELMPKIEEYQSYMDFTEIVPISALEGLNVDHFIDVLKTYLPEGPKYYPDDQISDHPEQFVVGEIIREKILHLTSEEIPHAIGVNVDRMVKESEDRVHIEATIYVERGSQKGIVIGKGGKKLKEVGKRARRDIEMLLGSKVYLELWVKVQRDWRNKVNFIRQIGYVEDQD

SEQ ID NO: 475 - DNA, 750 bp, Staphylococcus aureus
ttgttaatgcgccaaaaagggattatcatcaaagcagttgattatggtgaatctgataaaattatcacgattttaaatgagcatggtgcaaaagtaccacttatggcaagacgtgctaaaaaagttaagacgggtttacaagcgcaaacgcaattgtttgtttatggtttgtttatttacaatcagtggcgaggtatgggaacgttaaattctgtagatgttattagtcaacattataaattacaaatggacctttacgtaagcagttatgccgctctggcagctgaaactattgagcgctcaatggatgaaggtgacattgcaccatataactatcaattattacaatttgttcttgaaaaaatagaatcaggtacatctgcacagttaatgtcagtcgtagttatgttaaagtgcatgaaacgatttggttttactgcatcatttaatcgctgtgctgtgagtggtaatgacacacaagcagatttaataggttatagttttaagtttgacggtgcgatttcaaggcaagaggcttctaaagatgtacatgcagttatattatcgaataaaacactatatttattagatgtattacaaaaattaccgatagataaaatgaattcattgaatatccatcaagaaattattgatgaaatgtcagatatcattttaatgttatatcgtgaatatgcaggtatgttttttaaaagtcagaaactaatcaaccaattaaaaagattggaacaa

SEQ ID NO: 476 - protein, 250 aa, Staphylococcus aureus
  MISC_FEATURE (1)..(250): hypothetical protein
LLMRQKGIIIKAVDYGESDKIITILNEHGAKVPLMARRAKKVKTGLQAQTQLFVYGLFIYNQWRGMGTLNSVDVISQHYKLQMDLYVSSYAALAAETIERSMDEGDIAPYNYQLLQFVLEKIESGTSAQLMSVVVMLKCMKRFGFTASFNRCAVSGNDTQADLIGYSFKFDGAISRQEASKDVHAVILSNKTLYLLDVLQKLPIDKMNSLNIHQEIIDEMSDIILMLYREYAGMFFKSQKLINQLKRLEQ

SEQ ID NO: 477 - DNA, 1389 bp, Staphylococcus aureus
atggcaaaagatatggatacaattgtttcattagcaaaacacagaggttttgtgttccctggtagtgatatttacggtggtttatcaaacacatgggattatggtcctttaggtgttgaattaaagaataatgttaaaaaagcttggtggcaaaaattcattacacaatcaccgtttaacgttggtatcgatgctgcaatcttaatgaatccaaaagtatgggaagcttcaggacacttaaacaacttcaacgacccaatgattgataataaagatagtaaaattcgatatcgcgctgataaattaattgaagattatatgcaagatgttaaaggtgatgaaaacttcattgccgatggtttaagttttgaacaaatgaaaaaaattattgacgatgaaggtattgtttgtcctgtaagtaaaactgctaactggactgaaattcgccaattcaatttaatgtttaaaacattccaaggtgtaactgaagattctacaaatgaaattttcttacgtcctgaaacagcacaaggtatttttgtaaactataaaaacgtgcaacgttcaatgcgtaaaaaattaccatttggtatcggtcaaattggtaaatcattccgtaatgaaatcactccaggtaacttcattttcagaacaagagaatttgaacaaatggaacttgaattcttctgtaaacctggagaagaaatcgaatggcaaaattattggaaaacttttgcaagtgactggttaacaagcttaaatatgagcagtgaaaatatgcgtttacgtgatcatgatgaagatgaattatctcattactcaaatgcaacaactgatattgaatataaattcccatttggttggggtgagttatggggtatcgcaagtcgtacagacttcgacttacgtaaacatgctgaacactctggtgaagatttcagataccatgatccagaaacgaacgaaaaatatattccatattgtatcgagccatcacttggtgcagatcgtgtaacattagctttcttatgtgatgcatatgatgaagaaggcgttgaaggtagtaaagatgcacgtacagttttacacttccatcctgcattagcaccatataaagcagcgattttacctttaagtaagaaattatctggcgaagcgattaagatttttgagcaattaagttctaaattctcaatcgatttcgatgaatcacaatctatcggtaaaagataccgtcgtcaagatgaaatcggtacaccttattgtgtaacattcgactttgattcattagaagataatcaagttacagtacgtgacagagattcaatggaacaagttcgtatgccaatctcagagttagaagctttcttaactgaaaaaacaaaattc

SEQ ID NO: 478 - protein, 463 aa, Staphylococcus aureus
  MISC_FEATURE (1)..(463): glycyl-tRNA synthetase
MAKDMDTIVSLAKHRGFVFPGSDIYGGLSNTWDYGPLGVELKNNVKKAWWQKFITQSPFNVGIDAAILMNPKVWEASGHLNNFNDPMIDNKDSKIRYRADKLIEDYMQDVKGDENFIADGLSFEQMKKIIDDEGIVCPVSKTANWTEIRQFNLMFKTFQGVTEDSTNEIFLRPETAQGIFVNYKNVQRSMRKKLPFGIGQIGKSFRNEITPGNFIFRTREFEQMELEFFCKPGEEIEWQNYWKTFASDWLTSLNMSSENMRLRDHDEDELSHYSNATTDIEYKFPFGWGELWGIASRTDFDLRKHAEHSGEDFRYHDPETNEKYIPYCIEPSLGADRVTLAFLCDAYDEEGVEGSKDARTVLHFHPALAPYKAAILPLSKKLSGEAIKIFEQLSSKFSIDFDESQSIGKRYRRQDEIGTPYCVTFDFDSLEDNQVTVRDRDSMEQVRMPISELEAFLTEKTKF

SEQ ID NO: 479 - DNA, 537 bp, Staphylococcus aureus
ttgaatttaacaagagcaacgcttagaccagatttagcgatattaacaatgtcaggttttttagaagcgcgtccccgagttggatattattattcaggtaaatcaaaaggcaaattttttaatgaaaaacttcgacaatttgaggttaaggactatatgtctcaacctgttgtgctaagagagaatacaacagtttatgacgctatttgtacaatttttttagaagatgtaagtacattatttattattaatgaagataacgattttgttggtgtgtgttcaagaaaagatttattaagagcttcaatgattggagcagatattcataaagtacctatcagtgtaaatatgacacgtatgcctaatgtcacttatttagaggaaagcgaattagtcatatacgcagcagatagaatgattgaaaaagaaattgattcgattccaattgtaagaaaaaaagataatcaaaagtatgaagtaattggaagaatttccaaaacaacaatagctaagttattagtagcattatataaagaa

SEQ ID NO: 480 - protein, 179 aa, Staphylococcus aureus
  MISC_FEATURE (1)..(179): conserved hypothetical
LNLTRATLRPDLAILTMSGFLEARPRVGYYYSGKSKGKFFNEKLRQFEVKDYMSQPVVLRENTTVYDAICTIFLEDVSTLFIINEDNDFVGVCSRKDLLRASMIGADIHKVPISVNMTRMPNVTYLEESELVIYAADRMIEKEIDSIPIVRKKDNQKYEVIGRISKTTIAKLLVALYKE

SEQ ID NO: 481 - DNA, 816 bp, Staphylococcus aureus
atggaaaaaattaaaattatcgtagcttcagattctataggtgaaacggcagagttagttgctagggcaggtatttcacaattcaatcctaagcaatgtaaaaatgaattattaagatatccatatattgaatcttttgaagatgttgatgaagtgattcaagttgcaaaagatacaaatgctatcattgtttatacacttattaaacctgaaatgaagcaatatatgagtgagaaagtagcagaattccaattgaagtctgtcgatatcatggggccattaatggatttattatctgcttcggttgaagaaaaaccttataatgagccaggtatcgttcatagattagatgatgcatatttcaagaaaattgatgcgatagagtttgcagttaaatatgatgatggtaaagatcctaaaggattacctaaagctgatattgttttacttggtatttcgagaacttcaaagacaccattatctcagtatttagcgcataagagttacaaagttatgaatgtaccgattgtaccagaagtgacaccgccagatggcttatatgatattaatccaaagaaatgtatcgcacttaaaataagtgaagaaaaattaaatcgcattagaaaagagcgactaaaacaattaggactaggtgacacagctcgatatgcaacagaagcacgaattcaagaagaattgaattactttgaagaaatcgtaagtgaaattggatgtcctgtcattgatgtttctcaaaaagcaatcgaagaaacagcaaacgatataatccattatattgaacaaaataaatcgaaa

SEQ ID NO: 482 - protein, 272 aa, Staphylococcus aureus
  MISC_FEATURE (1)..(272): conserved hypothetical
MEKIKIIVASDSIGETAELVARAGISQFNPKQCKNELLRYPYIESFEDVDEVIQVAKDTNAIIVYTLIKPEMKQYMSEKVAEFQLKSVDIMGPLMDLLSASVEEKPYNEPGIVHRLDDAYFKKIDAIEFAVKYDDGKDPKGLPKADIVLLGISRTSKTPLSQYLAHKSYKVMNVPIVPEVTPPDGLYDINPKKCIALKISEEKLNRIRKERLKQLGLGDTARYATEARIQEELNYFEEIVSEIGCPVIDVSQKAIEETANDIIHYIEQNKSK

SEQ ID NO: 483 - DNA, 1797 bp, Staphylococcus aureus
ttgcgaatagatcaatcgatcattaatgaaataaaagataaaaccgacattttagacttggtaagtgaatatgtaaaattagaaaagagaggacgcaattatataggtttgtgtccttttcatgatgaaaagacaccttcatttacagtttctgaagataaacaaatttgtcattgttttggttgtaaaaaaggtggcaatgtttttcaatttactcaagaaattaaagacatatcatttgttgaagcggttaaagaattaggtgatagagttaatgttgctgtagatattgaggcaacacaatctaactcaaatgttcaaattgcttctgatgatttacaaatgattgaaatgcatgagttaatacaagaattttattattacgctttaacaaagacagtcgaaggcgaacaagcattaacgtacttacaagaacgtggttttacagatgcgcttattaaagagcgaggcattggctttgcacccgatagctcacatttttgtcatgattttcttcaaaaaaagggttacgatattgaattagcatatgaagccggattattatcacgtaacgaagaaaatttcagttattacgatagatttcgaaatcgtattatgtttcctttgaaaaatgcgcaaggaagaattgttggatattcaggtcgaacatataccggtcaagaaccaaaatacttaaatagtcctgaaacacctatctttcaaaaaagaaagttgttatacaacttagataaagcgcgtaaatcaattagaaaattagatgaaatcgtattactagaaggttttatggatgttataaaatctgatactgctggcttgaaaaacgttgttgcaacaatgggtacacagttgtcagatgaacatattacttttatacgaaagttaacatcaaatataacattaatgtttgatggggattttgcgggtagtgaagcaacacttaaaacaggtcaaaatttgttacagcaagggctaaatgtatttgttatacaattgccatcaggcatggatccggatgaatacattggtaagtatggcaacgatgcatttactgcttttgtaaaaaatgacaaaaagtcatttgcacattataaagtgagtatattaaaagatgaaattgcacataatgacctttcatatgaacgttatttgaaagaactaagtcatgatatttcgcttatgaaatcatcgattttgcaacaaaaggctttaaatgatgttgcaccatttttcaatgttagtcctgagcaattagctaacgaaatacaattcaatcaagcaccagccaattattatccagaagatgagtatggcggttacattgaacctgagccaattggtatggcacaatttgacaatttgagccgtcaagaaaaagcggagcgagcatttttaaaacatttaatgagagataaagatacatttttaaattattatgaaagtgttgataaggataacttcacaaatcagcattttaaatatgtattcgaagtcttacatgatttttatgcggaaaatgatcaatataatatcagtgatgctgtgcagtatgttaattcaaatgagttgagagaaacactaattagcttagaacaatataatttgaatgacgaaccatatgaaaatgaaattgatgattatgtcaatgttattaatgaaaaaggacaagaaacaattgagtcattgaatcataaattaagggaagctacaaggattggcgatgtagaattacaaaaatactatttacagcaaattgttgctaagaataaagaacgcatg

SEQ ID NO: 484 - protein, 599 aa, Staphylococcus aureus
  MISC_FEATURE (1)..(599): DNA primase [Staphylococcus
LRIDQSIINEIKDKTDILDLVSEYVKLEKRGRNYIGLCPFHDEKTPSFTVSEDKQICHCFGCKKGGNVFQFTQEIKDISFVEAVKELGDRVNVAVDIEATQSNSNVQIASDDLQMIEMHELIQEFYYYALTKTVEGEQALTYLQERGFTDALIKERGIGFAPDSSHFCHDFLQKKGYDIELAYEAGLLSRNEENFSYYDRFRNRIMFPLKNAQGRIVGYSGRTYTGQEPKYLNSPETPIFQKRKLLYNLDKARKSIRKLDEIVLLEGFMDVIKSDTAGLKNVVATMGTQLSDEHITFIRKLTSNITLMFDGDFAGSEATLKTGQNLLQQGLNVFVIQLPSGMDPDEYIGKYGNDAFTAFVKNDKKSFAHYKVSILKDEIAHNDLSYERYLKELSHDISLMKSSILQQKALNDVAPFFNVSPEQLANEIQFNQAPANYYPEDEYGGYIEPEPIGMAQFDNLSRQEKAERAFLKHLMRDKDTFLNYYESVDKDNFTNQHFKYVFEVLHDFYAENDQYNISDAVQYVNSNELRETLISLEQYNLNDEPYENEIDDYVNVINEKGQETIESLNHKLREATRIGDVELQKYYLQQIVAKNKERM

SEQ ID NO: 485 - DNA, 1104 bp, Staphylococcus aureus
atgtctgataacacagttaaaattaaaaaacaaacaattgatccgacattaacattagaagatgttaagaagcaattaattgaaaaaggtaaaaaagagggtcatttaagtcatgaagaaattgctgaaaaacttcagaattttgatatcgactctgatcaaatggatgatttctttgatcaattaaatgataatgatatttcactagttaatgaaaaagatagttcagatactgacgagaaactgaatccaagtgatcttagtgcccctccaggtgttaaaataaatgacccagttcgtatgtaccttaaagaaattgggcgtgttaacttattaagtgcacaagaagaaatcgaattagccaaacgtattgaacaaggtgatgaagtagcaaaatcaagacttgcagaagcgaacttacgtttagttgtaagtattgctaaaagatacgtaggtcgtggtatgttattccttgatttaatccaagaaggtaatatgggtcttattaaagctgttgaaaaatttgactttaacaaaggatttaagttttcaacatatgcaacatggtggattagacaagcaatcactcgtgcaattgctgaccaagcacgtacgattcgtatccctgtgcatatggtagaaacaattaataaattaattcgtgttcaacgtcaattattacaggacttaggtcgagatccagcaccagaagaaattggtgaagaaatggatttaccagcagaaaaagttcgtgaaattttaaaaattgcgcaagaacctgtttcattagaaacaccaattggtgaagaagatgatagtcatttaggagactttattgaggatcaggaagcacaaagtccttcagatcatgctgcttatgaattattaaaagagcaattagaagatgtgcttgatacattaactgatagagaagaaaatgtattacgattaagatttggtcttgatgacggcagaacaagaacacttgaagaagttggtaaagttttcggtgttacacgtgaacgtattcgacaaattgaagcaaaagcacttagaaaattaagacatccaagtcgtagtaaacgtttgaaagactttatggat

SEQ ID NO: 486 - protein, 368 aa, Staphylococcus aureus
  MISC_FEATURE (1)..(368): RNA polymerase sigma factor
MSDNTVKIKKQTIDPTLTLEDVKKQLIEKGKKEGHLSHEEIAEKLQNFDIDSDQMDDFFDQLNDNDISLVNEKDSSDTDEKLNPSDLSAPPGVKINDPVRMYLKEIGRVNLLSAQEEIELAKRIEQGDEVAKSRLAEANLRLVVSIAKRYVGRGMLFLDLIQEGNMGLIKAVEKFDFNKGFKFSTYATWWIRQAITRAIADQARTIRIPVHMVETINKLIRVQRQLLQDLGRDPAPEEIGEEMDLPAEKVREILKIAQEPVSLETPIGEEDDSHLGDFIEDQEAQSPSDHAAYELLKEQLEDVLDTLTDREENVLRLRFGLDDGRTRTLEEVGKVFGVTRERIRQIEAKALRKLRHPSRSKRLKDFMD

SEQ ID NO: 487 - DNA, 675 bp, Staphylococcus aureus
atgatttcgttaaataaccgattaacgacggtaagtcgatttttaaaacaaggtacaatcgcggatattggctcagatcatgcttatttgccaatctatgcaattcaaaaccatttatgcgaatgcggtattgctggagaagttattcaaggcccttttcaagctgctgtgaaaaatgtagctgcaaaccaattagtagatagaattgatgtacgtttaggggatggcttaagtgttattcaacctgaggacgtaatcgataatatcacaatttgtggtatgggcggaccacttattgctaaaattttaaaagatgggcaagataagttaagtcaacatccaaggttgattttacaaagtaatatccaaactgaaaatttaagacaaacattacaacaattgaattatgaaataattgatgaaataataatggaagaaaaaggccatatttatgaaattgttgtagcagaatattctacagaattaatagagctatcatctgatgaattgaaattcggaccaaaattgctgaacaacaaaaatgaatattttataaaaaaatggcaaagagagttagaagcactttatcatattaaatcgaaactcaatactgaacaacatcatcaacgtttagctcaaattaatgacgaaattgctgtaattgaaagggtgtta

SEQ ID NO: 488 - protein, 225 aa, Staphylococcus aureus
  MISC_FEATURE (1)..(225): conserved hypothetical
MISLNNRLTTVSRFLKQGTIADIGSDHAYLPIYAIQNHLCECGIAGEVIQGPFQAAVKNVAANQLVDRIDVRLGDGLSVIQPEDVIDNITICGMGGPLIAKILKDGQDKLSQHPRLILQSNIQTENLRQTLQQLNYEIIDEIIMEEKGHIYEIVVAEYSTELIELSSDELKFGPKLLNNKNEYFIKKWQRELEALYHIKSKLNTEQHHQRLAQINDEIAVIERVL

SEQ ID NO: 489 - DNA, 1098 bp, Staphylococcus aureus
atgaaaatagctgatttaatgacattgttagatcatcatgtgccatttagtactgctgaatcttgggataatgtaggattgttaataggtgatgaagatgttgaagttactggtgttttaacagcattagactgtacgttggaagtagtaaatgaagcaatcgaaaaaggttataatactattattagtcatcatcctctaatctttaaaggcgtaacatcattaaaagctaatggttatggtttgatcattagaaaactaattcaacatgacattaatttaatagcgatgcatacaaatttagatgtaaatccgtatggtgtcaatatgatgttggcgaaggcgatgggtttgaagaacatttcaataataaataatcaacaagatgtatactataaagttcaaacatatatacctaaggataatgttggaccatttaaagataagcttagtgaaaatggattagcgcaagaaggtaattatgaatattgtttctttgaaagtgaaggaagagggcaattcaaaccagttggtgaagctaatccaacaataggacaaattgataaaattgaatatgtagatgaagttaaaattgaatttatgatagatgcatatcaaaagtcaagggctgagcaattaattaaacaataccatccatatgaaacaccggtatttgattttattgagataaaacaaacatccctttatggacttggcgttatggcagaagtggataatcaaatgacattggaagatttcgcagctgatattaaatctaaattaaatatcccaagtgtccgttttgttggtgagtctaatcagaaaattaaacgtattgcaattattggtggttcaggtattggatatgaatatcaagctgtccaacaaggcgcagatgtctttgttacaggtgatattaaacatcatgatgccttagatgctaaaattcatggtgtgaatttaattgatattaatcattacagcgaatatgtgatgaaagaaggtttaaaagcgttactaatgaattggttcaatacagaaaaaataaatttagatgttgaagcatctacaattaatacagatccatttcaatatatt

SEQ ID NO: 490 - protein, 366 aa, Staphylococcus aureus
  MISC_FEATURE (1)..(366): conserved hypothetical
MKIADLMTLLDHHVPFSTAESWDNVGLLIGDEDVEVTGVLTALDCTLEVVNEAIEKGYNTIISHHPLIFKGVTSLKANGYGLIIRKLIQHDINLIAMHTNLDVNPYGVNMMLAKAMGLKNISIINNQQDVYYKVQTYIPKDNVGPFKDKLSENGLAQEGNYEYCFFESEGRGQFKPVGEANPTIGQIDKIEYVDEVKIEFMIDAYQKSRAEQLIKQYHPYETPVFDFIEIKQTSLYGLGVMAEVDNQMTLEDFAADIKSKLNIPSVRFVGESNQKIKRIAIIGGSGIGYEYQAVQQGADVFVTGDIKHHDALDAKIHGVNLIDINHYSEYVMKEGLKALLMNWFNTEKINLDVEASTINTDPFQYI

SEQ ID NO: 491 - DNA, 1344 bp, Staphylococcus aureus
atggcaaaacatccattcgaacaatttaatctagaatctagtttaattgacgctgtgaaagaccttaattttgaaaaaccaactgaaattcagaatcgaattattccaagaatactaaagagaacaaatttaattggtcaatctcaaacgggtacagggaaatctcatgcatttttattaccattaatgcagttaattgatagtgaaataaaagaaccacaagcaatcgtagttgcaccaacaagagaacttgcacaacaactatacgatgcagcgaaccatttaagccaatttaaagctggtgtttcagttaaagtttttattggtggtacagatatagagaaagatagacaacgttgtaatgcacaaccacaattgattataggcacccctactagaattaatgacttagctaaaacgggacatttacatgtgcacttagcatcatatttagttattgatgaagcggatcttatgattgacttaggattaattgaagatgtagattacattgctgcaagattggaagataatgcaaatattgcggtgtttagtgctacaatcccacaacagttacaaccatttttaaataaatatttaagtcatccagaatatgtagctgtcgacagtaaaaaacaaaataaaaagaacatcgaattctatttaatacctactaaaggtgcagctaaagttgaaaagactttaaatttaattgatatactaaatccatacttatgtattattttctgtaatagtagagataatgcaaatgatttagcacgttcactaaatgaagctggtattaaagttggtatgattcatggtggcttaacgccacgtgaacgtaaacaacaaatgaaacgtatacgtaatttagaattccaatacgttattgccagcgatttagcatctcgtggtattgatattgaaggtgttagtcatgtcatcaattttgatgtgccaaatgatattgacttctttacgcatagagtcggacgaactggtcgtgggaattataaaggtgtagcaattacgctttatagtcctgatgaagaacacaatatttcattaatagaagatcgcggttttgtattcaatactgttgatattaaagatggtgagttaaaagaagttaaagcgcacaatcagcgtcaagcaagaatgcgcaaagatgaccatttaactaatcaagtgaagaacaaagttcgaagtaaaattaaaaacaaagttaaaccaggttataagaagaaatttaaacaagaagttgaaaaaatgaaacgtcaagagcgtaagcaatttagtaagcagcaaaatagacaaaaacgtaagcaaaacaaaaaaggt

SEQ ID NO: 492 - protein, 448 aa, Staphylococcus aureus
  MISC_FEATURE (1)..(448): hypothetical protein
MAKHPFEQFNLESSLIDAVKDLNFEKPTEIQNRIIPRILKRTNLIGQSQTGTGKSHAFLLPLMQLIDSEIKEPQAIVVAPTRELAQQLYDAANHLSQFKAGVSVKVFIGGTDIEKDRQRCNAQPQLIIGTPTRINDLAKTGHLHVHLASYLVIDEADLMIDLGLIEDVDYIAARLEDNANIAVFSATIPQQLQPFLNKYLSHPEYVAVDSKKQNKKNIEFYLIPTKGAAKVEKTLNLIDILNPYLCIIFCNSRDNANDLARSLNEAGIKVGMIHGGLTPRERKQQMKRIRNLEFQYVIASDLASRGIDIEGVSHVINFDVPNDIDFFTHRVGRTGRGNYKGVAITLYSPDEEHNISLIEDRGFVFNTVDIKDGELKEVKAHNQRQARMRKDDHLTNQVKNKVRSKIKNKVKPGYKKKFKQEVEKMKRQERKQFSKQQNRQKRKQNKKG

SEQ ID NO: 493 - DNA, 897 bp, Staphylococcus aureus
gtgtgttttatgttattaggatcacatgtttcaatgagtggtaaaaagatgttagaaggttctgctatagaagcgcatgaatatggtgaaacaacatttatgatttatactggtgcacctcaaaacacgcgccgtaaaagtattgaagatttaaatataactaaaggtcatgaagtgatggaaaaatatggtttatctaatattgttgttcatgcaccatacatcattaatattgcaaatacaaccaaaccagaaacgtttaatcttggtgtagatttcttgcaacaagaaattgaaagaacgcaagctataggggctaaagatattgtattacatccaggtgcgcatgttggagctggtgttgatgccggaattaataagattattgaaggattaaatgaagttttaacgaatgacaataatgtacgtattgcgcttgaaacgatggcaggtaaaggtacagagattggtcgctcatttgaagagttagcacgtattattgatggagttcataataacgaacgtttatcagtatgttttgatacatgtcatacgcatgatgctggatataatgttaaagaggactttgatggcgtattaaatgaatttgataaaatcattggagtcgacagaatcaaagttgttcatgtcaatgattctaaaaatgaccgtggcgctcaaaaagaccgacatgaaaatattggcttcggttacattggttttgatgcattaaattacattgtgcatcatgatagttttaaagatattccgaaaatcttagaaacaccttatgttggtgaagataagaaaaataaaaaaccgccatataaacttgaaattgaaatgttaaaacaacagcaatttgacccagaattaaaaaataaggttatgcaacaa

SEQ ID NO: 494 - protein, 299 aa, Staphylococcus aureus
  MISC_FEATURE (1)..(299): hypothetical protein
VCFMLLGSHVSMSGKKMLEGSAIEAHEYGETTFMIYTGAPQNTRRKSIEDLNITKGHEVMEKYGLSNIVVHAPYIINIANTTKPETFNLGVDFLQQEIERTQAIGAKDIVLHPGAHVGAGVDAGINKIIEGLNEVLTNDNNVRIALETMAGKGTEIGRSFEELARIIDGVHNNERLSVCFDTCHTHDAGYNVKEDFDGVLNEFDKIIGVDRIKVVHVNDSKNDRGAQKDRHENIGFGYIGFDALNYIVHHDSFKDIPKILETPYVGEDKKNKKPPYKLEIEMLKQQQFDPELKNKVMQQ

SEQ ID NO: 495 - DNA, 783 bp, Staphylococcus aureus
atgcgaggtgagaatacgatgacaccagtctttgaattgaaaaatgtcaattactactatgatcataaaaaagtgttagaaaatataaacattaaaataaataaaggtgaatttttagcaattgttggaccaaatggtgctggtaaatcaacattattgaagttgattctagggttattacctttacaaagtggtgagatttttgttgaaggtattgattttaaaaataagaaaacatcaattaaattaagctatgtatcacaaaaagcaaatgcctttaattcaggtttcccagcaagtgttaaagaagttgttttaagcggattaacaaagacaaaacgtcttttccaaacatttaatagcaaagataatgaaaaagtgattaaagtactagaaagactgaatataagtgatttaattcataaaaatatagcagaattatcaggtggtcaacaacaacgtgtaatgattgctcgagcattgatttcagaacctgcagtattagtacttgatgaaccaacgaatggtattgatgcaaaacatgtaagtgaattttataatactttagatcaattaaaacaagaaggtatcaccattatcttagttactcatgatatcggtgttgtagcagatactgctactgaagtagcatgtttaaataagcatttgcatttccatggtacaactgatgagtttaaatcacttgatgaagttgaaatttcaaaaatttatggacatcctgtacgttttgtcgatcatcagcataatcgagaatgttgtaat

SEQ ID NO: 496 - protein, 261 aa, Staphylococcus aureus
  MISC_FEATURE (1)..(261): hypothetical protein
MRGENTMTPVFELKNVNYYYDHKKVLENINIKINKGEFLAIVGPNGAGKSTLLKLILGLLPLQSGEIFVEGIDFKNKKTSIKLSYVSQKANAFNSGFPASVKEVVLSGLTKTKRLFQTFNSKDNEKVIKVLERLNISDLIHKNIAELSGGQQQRVMIARALISEPAVLVLDEPTNGIDAKHVSEFYNTLDQLKQEGITIILVTHDIGVVADTATEVACLNKHLHFHGTTDEFKSLDEVEISKIYGHPVRFVDHQHNRECCN

SEQ ID NO: 497 - DNA, 870 bp, Staphylococcus aureus
gtgtcacaattgatagatgcattattgaattttgattttatgaggtactctttaattagtggtatcttgataggttttattgcgcctctaatcggtgcttttatcgttgttagacgactatcacttatagctgatgctctaagtcatgtaactttaggtggtatatctttcggtatgtttttacttactattatgccaacactagtatttattaatccaatgtggtttggaatcttattcgcaatagtaggtgcgcttctaattgaaaaattaagaacgtcatacactgcttaccaagaaattgctattccaattataatgagtgctggtatcgccttgagtgcaatcttcatttcattagctgatgggttcaatcaagaaattgttggattgctatttggctcaataagcgcagtgaatataagtgatttaacaacgattattgtcattgccatcatagttgttctgtttattacattgttttataaagaattatttatattgtcatttgatgaggaatatagtaaagtcattggcattcctaaatggattcaatttttatttattgttattgtagcgatggttatttctgcctcaatgcgtgttgtagggatactgttagtaagtgcgttaatcacgttaccaattgcaataagtatgcgaataacaaaaagttttaagcaattgatattactaagtgtatttttaggtgaattatcagtaatattaggcttagtcctagctttctatatggacatttctccgggtggtgtaattgtagttctacttgttattttacttatgattacaatggcttatcagaaaatgcgaatgaagtttaaaaagggagctaatatcaatgaatacaaa

SEQ ID NO: 498 - protein, 290 aa, Staphylococcus aureus
  MISC_FEATURE (1)..(290): hypothetical protein
VSQLIDALLNFDFMRYSLISGILIGFIAPLIGAFIVVRRLSLIADALSHVTLGGISFGMFLLTIMPTLVFINPMWFGILFAIVGALLIEKLRTSYTAYQEIAIPIIMSAGIALSAIFISLADGFNQEIVGLLFGSISAVNISDLTTIIVIAIIVVLFITLFYKELFILSFDEEYSKVIGIPKWIQFLFIVIVAMVISASMRVVGILLVSALITLPIAISMRITKSFKQLILLSVFLGELSVILGLVLAFYMDISPGGVIVVLLVILLMITMAYQKMRMKFKKGANINEYK

SEQ ID NO: 499 - DNA, 408 bp, Staphylococcus aureus
atgaatacaaatgatgctattaaaattttaaaagagaacggtttaaaatatacagataaacgtaaagatatgttagatatttttgtcgaagaagataagtatataaacgcaaagtatatacaacaagttatggatgaaaattatcctggaatttcattcgacacaatatatagaaacctgcacttatttaaagatttaggaattattgaaaatacagaacttgatggtgaaatgaagtttagaatcgcttgtacaaaccatcatcatcatcattttatctgtgaaaagtgtggagatacaaaggtaatagattattgtccaatagatcagataaaattatcactacctggtgttaatattcacaaacacaaacttgaagtttatggtgtatgtgagtcttgccaagat

SEQ ID NO: 500 - protein, 136 aa, Staphylococcus aureus
  MISC_FEATURE (1)..(136): ferric uptake regulator
MNTNDAIKILKENGLKYTDKRKDMLDIFVEEDKYINAKYIQQVMDENYPGISFDTIYRNLHLFKDLGIIENTELDGEMKFRIACTNHHHHHFICEKCGDTKVIDYCPIDQIKLSLPGVNIHKHKLEVYGVCESCQD

SEQ ID NO: 501 - DNA, 597 bp, Staphylococcus aureus
atggcttttgaattaccaaaattaccatacgcatttgatgcattagaaccacattttgacaaagaaactatggaaattcaccatgacagacatcataacacgtatgttacgaaattaaatgctgcagtagaaggtacagatttagaatctaaatctattgaagaaattgttgctaatttagacagtgtaccagctaacatccaaactgctgtacgtaataatggcggtggacatttaaaccattcattattctgggagttactttcaccaaactcagaagaaaaaggtactgtagtagaaaaaattaaagaacaatggggttctttagaagaatttaaaaaagaatttgctgacaaagcagctgcacgctttggttcaggttgggcttggttagtcgtaaacaatggccagttagaaattgtgactacaccaaaccaagataatccattaactgagggtaaaacacctattttaggtttagacgtatgggaacacgcttattacctaaaatatcaaaacaaacgccctgactacattggcgcattttggaatgtagttaactgggaaaaagttgacgaattatataatgcaacaaaa

SEQ ID NO: 502 - protein, 199 aa, Staphylococcus aureus
  MISC_FEATURE (1)..(199): superoxide dismutase
MAFELPKLPYAFDALEPHFDKETMEIHHDRHHNTYVTKLNAAVEGTDLESKSIEEIVANLDSVPANIQTAVRNNGGGHLNHSLFWELLSPNSEEKGTVVEKIKEQWGSLEEFKKEFADKAAARFGSGWAWLVVNNGQLEIVTTPNQDNPLTEGKTPILGLDVWEHAYYLKYQNKRPDYIGAFWNVVNWEKVDELYNATK

SEQ ID NO: 503 - DNA, 2073 bp, Staphylococcus aureus
ttgttaaaaagactaaaagaaaaatcaaatgatgaaatcgttcaaaatacaattaacaagagaattaactttatatttggtgtgattgtatttatttttgcagtactagtactacgtttaggttatttacaaatcgcacaaggctcacattataaacaaattataaaaaatgatgaaaacattacagtgaatgagtctgtgccaagaggtcgtattttagacagaaatgggaaagttttagttgataatgcttctaaaatggctattacatatactaggggtcgaaaaacaacacaatcggaaatgttggatacggctgaaaagttatcaaagctaatcaagatggatactaagaaaattacagaacgtgataagaaagatttctggattcagttgcatcctaaaaaagcaaaagcaatgatgacaaaagaacaagctatgttagcagatggaagtattaaacaagatcaatatgataaacaactgttatcgaaaatcggaaaatcacaattagatgaattgtcttctaaagatttacaagttttagctatttttcgagagatgaatgcaggaacagttttagatccacaaatgataaaaaatgaagatgtcagtgaaaaagagtatgcagcagtttctcagcaactttccaaattaccaggtgttaacacgtctatggattgggatagaaaatatccatatggcgatactttaagaggtatattcggagatgtatcgacacctgctgaaggtattccaaaagaattgacagaacattacttatccaaaggatattcacgcaatgatcgtgttggaaaatcttacctagaatatcaatatgaagatgtattgcgtggtaagaagaaagaaatgaaatacacaacggacaaatctggtaaagttacatcttcagaagtgttaaatcctggcgctcgcggtcaagatttgaaattaacgatcgatatagatcttcaaaaagaagtagaagcattattagataaacaaattaagaagcttcgcagtcaaggtgccaaagatatggataatgcaatgatggttgtacaaaatcctaaaaatggagacattcttgcgcttgccggaaagcatattaataggagtggtaaaatgactgattatgacattggtacgtttacttctcaatttgcggttggatcttctgtaaaaggtggaacattattagccggttatcagaataaagctatcaaagttggagaaacaatggtcgatgaaccattacatttccaaggtggtttgacaaaacgatcatacttcaataaaaacgggcatgtaactattaatgataagcaagctttgatgcattcatcaaacgtatatatgtttaaaacagcattaaaattagcgggagacccttattattctggtatggctttaccttcagacataagttcacctgcccaaaagctaagaagaggattaaatcaagtaggcttaggtgtgaaaacagggatagatttaccaaatgaaacaagaggtcaaatcgaaccattaacaaataatccaggtaattatctagatttatcaattggtcaatatgatacctatacaccattacaattatcacaatatgtttcaactatagcgaatgatggttatagaatacagccacacattggattaacgattcatgaatcaactaataaagatgaggttggtccactcaagaagaaaattaatggcactgtcttgaacaaggttaataatactgaaaaggaaatcaaacaaattcaagaaggattcaaaatggcatttaatgataaagatggtactggatatgttagttttaaagatacagtagtacctactgctggtaaaacgggtaccgcagaagtgttccaaaacggagagccaagagttaactctacttatataggatacgcgccaattgatgatccaaaattagcgttttcaattgtatatacaaatcagcctgtaccaccaccatggttaacaggtggagacttaggtagagatgtaattaactactactttaagcagttaggtaaagatgataaaaataaagacaaagacaaa

SEQ ID NO: 504 - protein, 691 aa, Staphylococcus aureus
  MISC_FEATURE (1)..(691): penicillin-binding protein
LLKRLKEKSNDEIVQNTINKRINFIFGVIVFIFAVLVLRLGYLQIAQGSHYKQIIKNDENITVNESVPRGRILDRNGKVLVDNASKMAITYTRGRKTTQSEMLDTAEKLSKLIKMDTKKITERDKKDFWIQLHPKKAKAMMTKEQAMLADGSIKQDQYDKQLLSKIGKSQLDELSSKDLQVLAIFREMNAGTVLDPQMIKNEDVSEKEYAAVSQQLSKLPGVNTSMDWDRKYPYGDTLRGIFGDVSTPAEGIPKELTEHYLSKGYSRNDRVGKSYLEYQYEDVLRGKKKEMKYTTDKSGKVTSSEVLNPGARGQDLKLTIDIDLQKEVEALLDKQIKKLRSQGAKDMDNAMMVVQNPKNGDILALAGKHINRSGKMTDYDIGTFTSQFAVGSSVKGGTLLAGYQNKAIKVGETMVDEPLHFQGGLTKRSYFNKNGHVTINDKQALMHSSNVYMFKTALKLAGDPYYSGMALPSDISSPAQKLRRGLNQVGLGVKTGIDLPNETRGQIEPLTNNPGNYLDLSIGQYDTYTPLQLSQYVSTIANDGYRIQPHIGLTIHESTNKDEVGPLKKKINGTVLNKVNNTEKEIKQIQEGFKMAFNDKDGTGYVSFKDTVVPTAGKTGTAEVFQNGEPRVNSTYIGYAPIDDPKLAFSIVYTNQPVPPPWLTGGDLGRDVINYYFKQLGKDDKNKDKDK

SEQ ID NO: 505 - DNA, 147 bp, Staphylococcus aureus
atgcgcgtaaacgtaactttagcttgtacggaatgtggtgacagaaactacattacaactaagaacaaaagaaataatccagaacgtgttgaaatgaagaaattctgttcacgtgaaaacaaacaaactttacaccgtgaaacaaaa

SEQ ID NO: 506 - protein, 49 aa, Staphylococcus aureus
  MISC_FEATURE (1)..(49): 50S ribosomal protein L33
MRVNVTLACTECGDRNYITTKNKRNNPERVEMKKFCSRENKQTLHRETK

SEQ ID NO: 507 - DNA, 591 bp, Staphylococcus aureus
atgacatgtattgttattaacgatataatagaattgaataaagtgggtgataatgtgactaaaaatgagattagaaaatacattttacataaaatgaagaattttaataaagctgaaaagcgaaaagcagacacatggttaagaaatcaattttttgcaactgaagaatacaaagaagcaaacgcaattgcgctagttctttcttttaatcatgaagtagatactttttctattattgaacaagccttaatggatcataaacgtatttttgtaccgaaaatggattatttaaatcatcaaatgacttttaaagagatatttaatctcaaagatattgatgtcgataataaggggatttactatccaacttcaaaaggtgaaacaacgaataacctagatttaattgttgttcctggtgttggatttcaagacgatggatatagaattgggtatggtggtggctattacgacaggtttttagctaattatcagacaaagacaataagcttattatacgattttcaaataacatcatttgaaccggaatcattcgatcaaccagtcgataaattgattatatatcaagcagca

SEQ ID NO: 508 - protein, 197 aa, Staphylococcus aureus
  MISC_FEATURE (1)..(197): conserved hypothetical
MTCIVINDIIELNKVGDNVTKNEIRKYILHKMKNFNKAEKRKADTWLRNQFFATEEYKEANAIALVLSFNHEVDTFSIIEQALMDHKRIFVPKMDYLNHQMTFKEIFNLKDIDVDNKGIYYPTSKGETTNNLDLIVVPGVGFQDDGYRIGYGGGYYDRFLANYQTKTISLLYDFQITSFEPESFDQPVDKLIIYQAA

SEQ ID NO: 509 - DNA, 1008 bp, Staphylococcus aureus
atgaacatagacaaacaattttggaaaacaatatattattggattaggtacttgaattttgatattgtcagtagggaaaaagatgaccaagaaatttggttagcccataaaagaaaaaaacaagtagtcatttttaaacaacatatcaagtctacccaagaaatacgttttgacaaagcgaaagtgcttgaacacaaagatgaaatagcaaattttatttctttcgaaccacaaagttttgaattttattattttacagaatcggaattttcagaagaacaattaaatgaagtttcgccaattagaattaaattcaatgttataagacacacaaaagatttgataaagcatatgccgaatatatttttggctagacttatttcagaagataatgataaaaagacatatatgttctataaacgcaaagtattaaccgataactttttagataaatatatgcagaaattttcaccggcaacatacacaataatatttgtaaatgtcttaatatggttatgtatgattttatatttaaataatttttcggatgtaaaattattagatgttggcgggttagtgcattttaatgtcgtacatggtgaatggtatcgaattgttacatcgatgtttttacattttagttttgaacatatacttatgaatatgctttcattatttatttttggtaaaatagtcgaagcaattattggttcatggcggatgttaactgtatactttattgcagggttgtttggaaactttgtatcactatcatttaatacgactacaatttcagttggggctagtggtgctatatttggtctgattggatcaatttttgcgatgatgtatgtttcaaaaacatttaacaaaaaaatgttaggacagttattaattgcattagtgatattagttggtgtttctctgtttatgtcaaatataaatattgtggcgcatattggaggattcattggtggtttattaataactttaattggctattactat

SEQ ID NO: 510 - protein, 336 aa, Staphylococcus aureus
  MISC_FEATURE (1)..(336): conserved hypothetical
MNIDKQFWKTIYYWIRYLNFDIVSREKDDQEIWLAHKRKKQVVIFKQHIKSTQEIRFDKAKVLEHKDEIANFISFEPQSFEFYYFTESEFSEEQLNEVSPIRIKFNVIRHTKDLIKHMPNIFLARLISEDNDKKTYMFYKRKVLTDNFLDKYMQKFSPATYTIIFVNVLIWLCMILYLNNFSDVKLLDVGGLVHFNVVHGEWYRIVTSMFLHFSFEHILMNMLSLFIFGKIVEAIIGSWRMLTVYFIAGLFGNFVSLSFNTTTISVGASGAIFGLIGSIFAMMYVSKTFNKKMLGQLLIALVILVGVSLFMSNINIVAHIGGFIGGLLITLIGYYY

SEQ ID NO: 511 - DNA, 879 bp, Staphylococcus aureus
gtgattaatatgtcaaacgtactaacagaaatagatagtcaatatccatatatgactaaaaatgaaaaaaagatagctaaatttatactaaattcacctcaaaaggtgattaaaatgaggtctcaagacttagcaagcttattagatattagtacatcatcagtcattcgattcagcaagaaaattactgatggcggttttcacgacttgaaaataaatatatctaaatatgttcctaaagcatcatcaatttacaatgttgaattaatgaataacgaaagcacagaatctttaagaactaaactccatacacgtactacacgcgcacttaatcatgcaaataacgaattaaatgataaaactattgatcaaatatgtcattgtttaaaacgttctgagacgatttttatatatggttttggcgcatcttttgtagttgctaccgacttataccaaaagttatcaagaataggtcttaatattcaacttgttcaagaaacacatatttttgctacattattagcaactcacaattcgaacgacagtgttattcttattactaacaatggtacgcaaagtgaaatgcaatcaatggttaaagttattgatgactaccatatacctataattacaattactagtacaagggataatcccgtagcacaggcatcaaatattgttttaacttatgggaaaactgatgaaaatgagatgcatatgggagcaacaacttcattatttgctcaaatgttcactattgatattttatattatcgttatgttgcattaaattatcacgcatcattagatttcataacacaatctaaaatggctttagataactatcgtaaacatttatcaaatattaactttaaacat

SEQ ID NO: 512 - protein, 293 aa, Staphylococcus aureus
  MISC_FEATURE (1)..(293): hypothetical protein
VINMSNVLTEIDSQYPYMTKNEKKIAKFILNSPQKVIKMRSQDLASLLDISTSSVIRFSKKITDGGFHDLKINISKYVPKASSIYNVELMNNESTESLRTKLHTRTTRALNHANNELNDKTIDQICHCLKRSETIFIYGFGASFVVATDLYQKLSRIGLNIQLVQETHIFATLLATHNSNDSVILITNNGTQSEMQSMVKVIDDYHIPIITITSTRDNPVAQASNIVLTYGKTDENEMHMGATTSLFAQMFTIDILYYRYVALNYHASLDFITQSKMALDNYRKHLSNINFKH

SEQ ID NO: 513 - DNA, 450 bp, Staphylococcus aureus
gtgaatcgtaatattttttggattttactaattggtatgcttgttatatttattgcacttcaaattagaatttttacaattaaagaagataatatttataataaattgatcaaagatgatatgactagtggtaattatgataatgctcaaaatattgcgaagcagacaataaataaaaattatgccgatgatcaaacatattatttaagtggtatgattatggctactatcaattctaagtccgaaggtatgacagaatgggagcgaggacttagaatgtttcctaaatcaggtttattaaattttgagttagcgatagcaaatcgttcattaaatgatgatgaaaaagcattaaaatatgtgcgtaaagcattaaatgcagaccctaaaaatacagattatattaacttagaaaaagagttgactaaatcaaatgagtcgaaaaataaa

SEQ ID NO: 514 - protein, 150 aa, Staphylococcus aureus
  MISC_FEATURE (1)..(150): conserved hypothetical
VNRNIFWILLIGMLVIFIALQIRIFTIKEDNIYNKLIKDDMTSGNYDNAQNIAKQTINKNYADDQTYYLSGMIMATINSKSEGMTEWERGLRMFPKSGLLNFELAIANRSLNDDEKALKYVRKALNADPKNTDYINLEKELTKSNESKNK

SEQ ID NO: 515 - DNA, 201 bp, Staphylococcus aureus
atgagtcgaaaaataaataacttttatgatgtacaacagttattgaaaagttacggatttctaatatattttaaaaatccagaagatatgtacgaaatgattcaacaggagatttcatcattgtatcaatatgaactgttatctaaggaagaatatttgaaatgtacgttgataattaatcagagaaggaatgaacagaaa

SEQ ID NO: 516 - protein, 67 aa, Staphylococcus aureus
  MISC_FEATURE (1)..(67): conserved hypothetical
MSRKINNFYDVQQLLKSYGFLIYFKNPEDMYEMIQQEISSLYQYELLSKEEYLKCTLIINQRRNEQK

SEQ ID NO: 517 - DNA, 984 bp, Staphylococcus aureus
atgacaaaaattattttagcagctgatgtaggcgggacgacttgtaaattaggtattttcacacctgaattagaacaattacataaatggtctattcacactgatacatctgatagtacaggatatacacttttgaaaggaatttatgattcgtttgttgaaaaagtaaatgaaaataattataatttttcaaatgtacttggcgtaggtattggtgtaccaggtcctgttgactttgaaaaaggtacagtaaatggagcagtaaacttatattggccagaaaaagttaatgtacgtgagatttttgaacaattcgttgattgtccagtgtatgtagataatgatgctaacatagctgctttaggggagaaacacaaaggtgctggtgaaggtgccgatgatgttgttgccatcacacttggtacaggtctaggtggaggaattatttcaaatggtgaaatcgtacatggtcataatggctctggcgcagaaataggtcattttagagcagacttcgatcaacgatttaaatgtaattgtggtcgttctggatgtattgaaacagttgcttcagcgacaggcgttgttaacttagttaacttctactatccgaagttgacgtttagatcttctatattagaattgattaaagaaaataaggttacagcaaaagctgtttttgatgcggcaaaagctggtgaccaattctgtattttcattactgaaaaggttgcaaactatattggatatttatgtagtattattagtgttacaagtaatccgaaatatatcgttctaggtggaggaatgtctactgcaggacctattttaattgaaaatattaaaacagaatatcataatttaacatttgcacctgctcaatttgaaactgaaattgtacaagcgaaattaggtaatgatgcaggtattacaggagcagcaggattaatcaagacctatgtattagataaagagggggtaaaa

SEQ ID NO: 518 - protein, 328 aa, Staphylococcus aureus
  MISC_FEATURE (1)..(328): glucokinase [Staphylococcus
MTKIILAADVGGTTCKLGIFTPELEQLHKWSIHTDTSDSTGYTLLKGIYDSFVEKVNENNYNFSNVLGVGIGVPGPVDFEKGTVNGAVNLYWPEKVNVREIFEQFVDCPVYVDNDANIAALGEKHKGAGEGADDVVAITLGTGLGGGIISNGEIVHGHNGSGAEIGHFRADFDQRFKCNCGRSGCIETVASATGVVNLVNFYYPKLTFRSSILELIKENKVTAKAVFDAAKAGDQFCIFITEKVANYIGYLCSIISVTSNPKYIVLGGGMSTAGPILIENIKTEYHNLTFAPAQFETEIVQAKLGNDAGITGAAGLIKTYVLDKEGVK

SEQ ID NO: 519 - DNA, 327 bp, Staphylococcus aureus
atggctattgttgatgtggttgttattccagttggaacggaaggtccgagtgttagtaaatatattgcagatattcagaaaaaacttcaagaatataaagcaatgggtaaaattgattttcaattaacaccaatgaatactctaattgaaggtgaattaagcgatgtattagaagttgtgcaagtgatacatgaattaccttttgataaaggtttaagtagagtttgtacaaatatccgtattgatgaccgacgagacaaatctagaaaaatgaatgataaactaacatcagtacaaaaacatttagaaaatagtggtgaaaaccta

SEQ ID NO: 520 - protein, 109 aa, Staphylococcus aureus
  MISC_FEATURE (1)..(109): conserved hypothetical
MAIVDVVVIPVGTEGPSVSKYIADIQKKLQEYKAMGKIDFQLTPMNTLIEGELSDVLEVVQVIHELPFDKGLSRVCTNIRIDDRRDKSRKMNDKLTSVQKHLENSGENL

SEQ ID NO: 521 - DNA, 621 bp, Staphylococcus aureus
atgaggatttcaagcttaactttaggcttagttgatactaatacgtatttcatcgaaaatgacaaagctgttattctgattgacccttcaggtgaaagtgaaaaaattattaaaaaattaaaccaaataaataaaccgttaaaagctattttattaacacatgcacactttgatcatatcggagcagtcgatgatatagttgatcgattcgatgtcccggtttatatgcatgaagcagagtttgattttctaaaagatcccgttaaaaatggggcagataaatttaagcaatatggattaccaattattacaagtaaggtaactcctgaaaagttaaacgaaggtagcacagaaatagaaggatttaagtttaatgtgttacacacacctggacattcaccaggaagtttaacatatgtgttcgatgaattcgcagttgttggagatacattatttaataatggaatcggacgtacagatttatataaaggtgattatgaaacgctagttgattctattcaagataaaatatttgaattagaaggcgatttacctttattccctggacatggtccatatacgacggttgatgatgaacaattaaatccatttttacacggt

SEQ ID NO: 522 - protein, 207 aa, Staphylococcus aureus
  MISC_FEATURE (1)..(207): conserved hypothetical
MRISSLTLGLVDTNTYFIENDKAVILIDPSGESEKIIKKLNQINKPLKAILLTHAHFDHIGAVDDIVDRFDVPVYMHEAEFDFLKDPVKNGADKFKQYGLPIITSKVTPEKLNEGSTEIEGFKFNVLHTPGHSPGSLTYVFDEFAVVGDTLFNNGIGRTDLYKGDYETLVDSIQDKIFELEGDLPLFPGHGPYTTVDDEQLNPFLHG

SEQ ID NO: 523 - DNA, 972 bp, Staphylococcus aureus
ttgaagattctatttcaagaaataattaataaagcgatagaaatgaaagcgagtgatgtacattttattccagttaaaaatgaagtaagtattaaatttagaattaatgataacttggagcagtatgaacaaattgggaatagcatttatcaaaagttattagtttatatgaagtttcaagctgggcttgatgtttctacacagcaagtcgcacagagcggtcgatatagttaccttttcaataaaatatattttttgagaatatcaactttaccattgtcacttggccaagaaagttgtgttatcagaattgtacctcaattttttcaaccacagaaatcaacttataaattcaatgattttaaacacctcatgaataagaaacaaggattactattgtttagtggaccaactggttcaggaaagagtacattaatgtatcaaatggtctcatacgcgaataaagccttgaatttaaatgtaatttctatagaggatcctgtagagatgcaaattcctggtatcgtccaaattaatgtgaatgataaagctggcataaactatgtaaattcgtttaaagctattttaagatgtgatcctgatgttattttaataggtgaaatcagagataaagatgttgccaagtgtgttatacaggctagtttaagtggtcaccttgttctgactacattgcatgcaactgattgtaaaggtgctattttaaggctattagaaatgggcatttctgtacaagaattgatacaggcaactaacttaattataaaccaacgacttgtaactactattaagcaacagcgacaattagtatgtgaaattctatctcagcaacaactccgatatttcttttcccataatcattcattaccatcatcatttaagaacttagaagataaacttgatgatatgacaaaagcaggtgtcatttgtgaaactacaatgcataaatacatt

SEQ ID NO: 524 - protein, 324 aa, Staphylococcus aureus
  MISC_FEATURE (1)..(324): hypothetical protein
LKILFQEIINKAIEMKASDVHFIPVKNEVSIKFRINDNLEQYEQIGNSIYQKLLVYMKFQAGLDVSTQQVAQSGRYSYLFNKIYFLRISTLPLSLGQESCVIRIVPQFFQPQKSTYKFNDFKHLMNKKQGLLLFSGPTGSGKSTLMYQMVSYANKALNLNVISIEDPVEMQIPGIVQINVNDKAGINYVNSFKAILRCDPDVILIGEIRDKDVAKCVIQASLSGHLVLTTLHATDCKGAILRLLEMGISVQELIQATNLIINQRLVTTIKQQRQLVCEILSQQQLRYFFSHNHSLPSSFKNLEDKLDDMTKAGVICETTMHKYI

SEQ ID NO: 525 - DNA, 918 bp, Staphylococcus aureus
atgacatataaaaataagcaattaggtaccaccattctaagtgaaatttcaaatggtgcaccatgcaatcaaatattatcactgataggttatagcgatactatcgtcatgcaagtatatttggcagaaagatttggcaatattatagacgttctagaagaaaccgtaaattatatgaaagtgaatagaaagtcagaacaacgattgttaaagacactgcaataccccttaatactagtttctatctttattgctatgattattatattaaacctcacagtaattccacagtttcaacaattatatacttctatgaatattcaactatcttcttttcaaaaaacattgtcttttttcattaccagcttacctactataattgtagtaatgctcataatagtatctatgttggctattattatgaaattaatttataacaatttaaatatgctcaataagataaactttgtgatgaaactaccgctaatatcaggctatttccaattatttaaaacttattttgtaactaatgaattagtgttgttttataaaaatggtattacacttcaatcaatagtagacgtttatattaaccatagtagtgatccatttagacagtttctaggtaaatacttattaacttattcagaaatgggatatggtttgcctcaaattttagaaaaactaaaatgctttaagcctcaattaattaagtttgtgctacaaggtgaaaagagagggaagctagaagtagaactaaagttatattcgcaaatattagtaaaacaaatagaagataaagcgataaaacagactcagtttttacagcctattttatttttgattttaggtttatttattgtcgcaatttatttagtaattatgttaccaatgtttcaaatgatgcaaagtataaaa

SEQ ID NO: 526 - protein, 306 aa, Staphylococcus aureus
  MISC_FEATURE (1)..(306): hypothetical protein
MTYKNKQLGTTILSEISNGAPCNQILSLIGYSDTIVMQVYLAERFGNIIDVLEETVNYMKVNRKSEQRLLKTLQYPLILVSIFIAMIIILNLTVIPQFQQLYTSMNIQLSSFQKTLSFFITSLPTIIVVMLIIVSMLAIIMKLIYNNLNMLNKINFVMKLPLISGYFQLFKTYFVTNELVLFYKNGITLQSIVDVYINHSSDPFRQFLGKYLLTYSEMGYGLPQILEKLKCFKPQLIKFVLQGEKRGKLEVELKLYSQILVKQIEDKAIKQTQFLQPILFLILGLFIVAIYLVIMLPMFQMMQSIK

SEQ ID NO: 527 - DNA, 309 bp, Staphylococcus aureus
atgtttaaatttcttaagaaaactcaagcgtttacattgatagagatgctattagtgttattaatcatcagtttattattaattttaatcattccaaatattgctaaacaaactgctcacatacaatcaacaggttgtaatgcacaggtaaaaatggttaatagtcaaattgaagcgtatgcattgaaacataatagaaatccatcgtctattgaagacttaattgcagatggttttataaaagaagcacaaaagacatgtaaatcaggagagacaatcacaattagtaatggagaagcagttgcaaat

SEQ ID NO: 528 - protein, 103 aa, Staphylococcus aureus
  MISC_FEATURE (1)..(103): exogenous DNA-binding
MFKFLKKTQAFTLIEMLLVLLIISLLLILIIPNIAKQTAHIQSTGCNAQVKMVNSQIEAYALKHNRNPSSIEDLIADGFIKEAQKTCKSGETITISNGEAVAN

SEQ ID NO: 529 - DNA, 444 bp, Staphylococcus aureus
atggagaagcagttgcaaattagaaagcagtcagcatttactatgattgagatgcttgtggtaatgatgttaatcagtatatttctacttttgacaatgacatctaaaggattaagcaatcttagagtaatagatgatgaggcaaatatcatttcttttattactgaattgaattatattaagtcgcaagctatagcaaatcaaggatatatcaatgttagattttatgaaaacagtgacactattaaagtaatagagaataataaaatacgatttctaaaattaaaagtaggcaaaataattaatgttgcaaaagttgatattattgcctttgataaaaaagggaatatcaataaatttggtagcataacaatttacaataacaattcaatttatagaataatattccatattgaaaaaggaagaattcgttatgaaaagcta

SEQ ID NO: 530 - protein, 148 aa, Staphylococcus aureus
  MISC_FEATURE (1)..(148): hypothetical protein
MEKQLQIRKQSAFTMIEMLVVMMLISIFLLLTMTSKGLSNLRVIDDEANIISFITELNYIKSQAIANQGYINVRFYENSDTIKVIENNKIRFLKLKVGKIINVAKVDIIAFDKKGNINKFGSITIYNNNSIYRIIFHIEKGRIRYEKL

SEQ ID NO: 531 - DNA, 327 bp, Staphylococcus aureus
atgataaacgaaactaagtatatgagacaacaaattactaatttgattcaaatcattgatacgattaaatataatactttaatgacagattggaacattcaaacgcatatttataaatttaaccaaatagttactaatgaattgaataagttcaaaggctttgaaacatcatatataataaacgaaaatcaagtttcctattatgaaattataacactacttaataaacgtcccctccgacaagtcgactatggtaacaaaattcaatatcttaatttttatcatacagaactatctaacgcattatttgcaattaaatttgcccat

SEQ ID NO: 532 - protein, 109 aa, Staphylococcus aureus
  MISC_FEATURE (1)..(109): hypothetical protein
MINETKYMRQQITNLIQIIDTIKYNTLMTDWNIQTHIYKFNQIVTNELNKFKGFETSYIINENQVSYYEIITLLNKRPLRQVDYGNKIQYLNFYHTELSNALFAIKFAH

SEQ ID NO: 533 - DNA, 735 bp, Staphylococcus aureus
gtggaaaatgaaaaaaagaaatacacgtttaaagatatagcatggagagatttgcttataattccaattataggtgttatattttatgcactcacaattgcagcttacataggaccaattttgtttggttattatgaaatcgatagtaatctgatatttgtagcgactatcacacaagctttagcatatacgattgggattggcgcattttatttatttcatttaaaagtgatgccatcaaggcttcgagctggttttgcgtatatcaaaaaatattggcttagattgtcaataacgtatattattgctctcatcttaatttatacatatgaatatatgacacagtttctacctaaacatttgcaatatagtgaaacagccaatgaacttgagctaaataaaatgtttgaagtgcctgcatttttacctgtagcattcttattaattgtgattgtaggtccaatagttgaagaaatcgtatttagacatattttaattggagaattaggtaagaagtttaattttatagctatgagtattgtttcggtgttcttatttgcatttattcatgtgactgatgcaaagtcgccgtttgagtttggtccatatctcatactatccatcatattagttttcacttatttaaaatctggaagaaacctaggttcaacaattgcattacatatagcaaataattttgtttctttcgttatatcagtaataagtatttatgcg

SEQ ID NO: 534 - protein, 245 aa, Staphylococcus aureus
  MISC_FEATURE (1)..(245): hypothetical protein
VENEKKKYTFKDIAWRDLLIIPIIGVIFYALTIAAYIGPILFGYYEIDSNLIFVATITQALAYTIGIGAFYLFHLKVMPSRLRAGFAYIKKYWLRLSITYIIALILIYTYEYMTQFLPKHLQYSETANELELNKMFEVPAFLPVAFLLIVIVGPIVEEIVFRHILIGELGKKFNFIAMSIVSVFLFAFIHVTDAKSPFEFGPYLILSIILVFTYLKSGRNLGSTIALHIANNFVSFVISVISIYA

SEQ ID NO: 535 - DNA, 297 bp, Staphylococcus aureus
atgaaaagctataagtgtaaaggttcattcttaatagatagtatggctggatttttgctaattggattgattacattactattgataccaatgatgaatcaaatgcaagcgagtataaaccataaactacaaacaattgatgcttctaaagtaattttgacgactgtatctaaaattaataaagaagaacttaagaagggggtaactatagggaagtatgatattaagcaaagtgaccaacaaatttgtgctatttcaaaaaataccacttcttatcaaaagacatgtatacagtat

SEQ ID NO: 536 - protein, 99 aa, Staphylococcus aureus
  MISC_FEATURE (1)..(99): hypothetical protein
MKSYKCKGSFLIDSMAGFLLIGLITLLLIPMMNQMQASINHKLQTIDASKVILTTVSKINKEELKKGVTIGKYDIKQSDQQICAISKNTTSYQKTCIQY

SEQ ID NO: 537 - DNA, 387 bp, Staphylococcus aureus
atgttagtagcgatgatggttataagtataactttactaattgttccagacttaattagacttagtaaaacttttctaattgaaagtagggatttaacaactgtagatttcgaatttttctcaagagatattctagatgattttaaaggagtagatagaaacgatattgaaattaggcaacaccgtatcattttacataaaggtgaagaaatgatcgaatacaaattaattaataataaaattattaaagttgtaaatgacagaggaaatataacaatgattaataatgttacagcatttactgcaaatatctactataaatccattattaaaataacgataacagttaaagtcggtacaaatgtgcagactaaaactatttatgta

SEQ ID NO: 538 - protein, 129 aa, Staphylococcus aureus
  MISC_FEATURE (1)..(129): hypothetical protein
MLVAMMVISITLLIVPDLIRLSKTFLIESRDLTTVDFEFFSRDILDDFKGVDRNDIEIRQHRIILHKGEEMIEYKLINNKIIKVVNDRGNITMINNVTAFTANIYYKSIIKITITVKVGTNVQTKTIYV

SEQ ID NO: 539 - DNA, 144 bp, Staphylococcus aureus
ttgatgctaacagcaatttatttttccattttcactttttatatcagtcaatatagtttaaaattaaagacattatataatattgaaactgactataactataagattgttttgttattgaaagaagggaaaacgcatgaatca

SEQ ID NO: 540 - protein, 48 aa, Staphylococcus aureus
LMLTAIYFSIFTFYISQYSLKLKTLYNIETDYNYKIVLLLKEGKTHES

SEQ ID NO: 541 - DNA, 522 bp, Staphylococcus aureus
atgaatcatgataaatcaccaataattttaattggtttcatgggtaccggtaaatctacgattggtaaatacgttgcagatgagcaaaatttatcatttattgatatagattcatatatcgaagagaagtataagttaacaataccagaaatattttgtaaacatggtgaacaatatttcaggaatttagagttcacatgtttgcaagaatgtattaacactgcagatataattgctactggtggtggtattattgagagtgaagaggcatttaattttttgaaaaatcaaaaaaacattatttggttagattgtaatattgatattatatatagtcgaatcaatgatgacccacatcgacctaatgcaaataataagacaatcaagcagttaaatgacttgtattgctcgcggaatttaagatataatgaaatcgcattcaagaaatttgatagtcatttgctatcaatttcagaaatatattatgaattgctaaatttaataaaagcgagtgatcagtat

SEQ ID NO: 542 - protein, 174 aa, Staphylococcus aureus
  MISC_FEATURE (1)..(174): hypothetical protein
MNHDKSPIILIGFMGTGKSTIGKYVADEQNLSFIDIDSYIEEKYKLTIPEIFCKHGEQYFRNLEFTCLQECINTADIIATGGGIIESEEAFNFLKNQKNIIWLDCNIDIIYSRINDDPHRPNANNKTIKQLNDLYCSRNLRYNEIAFKKFDSHLLSISEIYYELLNLIKASDQY

SEQ ID NO: 543 - DNA, 1089 bp, Staphylococcus aureus
atgtcaagtgatttaaaacaaacacctttatatcaaaattatgttgatagaggtgcaaaaattgtggaattcggaggatgggcgatgcctgttcaattttcaagtattaaagaggagcataatgctgttcgatacgaaattggcctgtttgatgttagtcatatgggtgaaattgaagtaacaggtaaagatgctagtcagtttgtgcaatatttattatcaaatgatactgataatttaactacttcaaaagcattatatactgctttatgtaatgaagaaggcggtattattgatgatttagtaatatataaattagctgacgacaattatttattagttgttaatgctgctaatactgaaaaagattttaattggattttaaaacacaaagagaaatttgatgttgaagtacaaaatgtatcaaaccaatatggtcaattagcaatacaaggaccaaaagctagagatttaattaatcaattagttgatgaagatgtaactgaaatgaaaatgtttgaatttaaacagggtgtcaaattatttggagcaaacgtcattttatctcagtcaggttacacaggtgaagatgggtttgaaatttattgtaatatcgatgatactgaaaaaatttgggatggtttattagagtataatgttatgccatgtgggttaggcgctcgtgatacattaagattagaggctggattgccattacatggacaagatttaactgaatcaattacaccatatgaaggtggtatcgcttttgcaagtaaaccattaattgatgctgattttattggtaaatctgtattaaaagatcaaaaagaaaatggtgcaccaagaagaacagtgggattagaattacttgaaaaaggaattgcaagaactggttatgaagttatggatttagatggaaatattattggagaagtaacttcaggaacacagtctccatcatcaggaaaatcaattgcacttgcaatgataaaaagagatgagtttgaaatgggtagagagttgcttgttcaagttcgtaagcgtcaattaaaagcgaaaattgttaagaaaaatcaaattgataaa

SEQ ID NO: 544 - protein, 363 aa, Staphylococcus aureus
  MISC_FEATURE (1)..(363): aminomethyltransferase
MSSDLKQTPLYQNYVDRGAKIVEFGGWAMPVQFSSIKEEHNAVRYEIGLFDVSHMGEIEVTGKDASQFVQYLLSNDTDNLTTSKALYTALCNEEGGIIDDLVIYKLADDNYLLVVNAANTEKDFNWILKHKEKFDVEVQNVSNQYGQLAIQGPKARDLINQLVDEDVTEMKMFEFKQGVKLFGANVILSQSGYTGEDGFEIYCNIDDTEKIWDGLLEYNVMPCGLGARDTLRLEAGLPLHGQDLTESITPYEGGIAFASKPLIDADFIGKSVLKDQKENGAPRRTVGLELLEKGIARTGYEVMDLDGNIIGEVTSGTQSPSSGKSIALAMIKRDEFEMGRELLVQVRKRQLKAKIVKKNQIDK

SEQ ID NO: 545 - DNA, 1353 bp, Staphylococcus aureus
gtgtgcattgtgagtcatcgttatatacctttaactgaaaaagacaagcaagaaatgttacaaacaattggtgcaaaatctataggagaattattcggtgatgtaccaagtgacattttattaaatagagatttaaatattgctgaaggcgaagcggaaacaacgttacttagaagattaaatcgcattgcaagcaagaatatcactaaagaaacgcatacatcatttttgggtgctggtgtttatgatcattacgcgccatcagttgtggatgctatgatttcaagatcagaattttacacagcatatacgccatatcaaccggaaatttctcaaggtgaattacaagccatttttgagttccaaactttaatttgtgaattaacagatatggatgtagcaaattcttctatgtatgatgggatgactagctttgctgaagcatgtatcttagcatttagtcaaacaaagaaaaataaaattgtagtctcaaaaggtttacattatcaagcattacaagtacttcatacttatgctaagacgcgtaaggaattcgaagtagtggaaatcgatttagatggcactgttacagatttgaaaaaattagaagcagcagtggatgatgaaacagcagctgttgcagtacaatatccaaacttttacggttcaattgaagatcttgaaaagattcatagctttattgaagataaaaaagcattatttatcgtatatgcaaatccattagcattgggattacttacacctccaggttcatttggtgcagatattgttgtaggtgatactcagccattcggaattcctgctcaattcggtgggccacattgtggatattttgcaacgacgaaaaagttaatgcgtaaagtgccaggtagattagtcggtcaaacacaagatgatgaaggtaatcgtggctttgtattaacattacaagcacgtgaacaacatattcgacgcgataaagcgacatctaatatttgttctaaccaagcattaaatgctttagcgtcatcaattgcaatgtcagcacttggtaaacaaggtatctatgatattgcagttcaaaatatagaacatgctaactatgctaaacaacaatttattaaaaaaggttttgaagtattagatggtacatctttcaatgagtttgtagtcaaatttgacaaaccaattcaacaagttaacgaggaattagtgaagtacaatattatcggtggttttgatttaggtgttgtttcagacgactttaaaaatcacatgttaatagctgtaactgaattaagaacaaaagatgaaatcgatacatttgtagaaaaggctggtgagttaaatgac

SEQ ID NO: 546 - protein, 451 aa, Staphylococcus aureus
  MISC_FEATURE (1)..(451): glycine dehydrogenase
VCIVSHRYIPLTEKDKQEMLQTIGAKSIGELFGDVPSDILLNRDLNIAEGEAETTLLRRLNRIASKNITKETHTSFLGAGVYDHYAPSVVDAMISRSEFYTAYTPYQPEISQGELQAIFEFQTLICELTDMDVANSSMYDGMTSFAEACILAFSQTKKNKIVVSKGLHYQALQVLHTYAKTRKEFEVVEIDLDGTVTDLKKLEAAVDDETAAVAVQYPNFYGSIEDLEKIHSFIEDKKALFIVYANPLALGLLTPPGSFGADIVVGDTQPFGIPAQFGGPHCGYFATTKKLMRKVPGRLVGQTQDDEGNRGFVLTLQAREQHIRRDKATSNICSNQALNALASSIAMSALGKQGIYDIAVQNIEHANYAKQQFIKKGFEVLDGTSFNEFVVKFDKPIQQVNEELVKYNIIGGFDLGVVSDDFKNHMLIAVTELRTKDEIDTFVEKAGELND

SEQ ID NO: 547 - DNA, 1470 bp, Staphylococcus aureus
atgactagtaaatcaagtccattaatttttgaaagatctcgtgaaggcagatatgcatattcattaccaaaaagtgatattaaaacaaattctgttgagtcattgttagatgataaatttattcgtaaaaacaaagcggagtttcctgaagttgctgaactagacttagtacgtcattatactgaactttcaaataaaaatttcggtgtagacaacggattttatccattgggttcatgtacgatgaagtataaccctaaaattaatgaaaaggttgctagaataccaggatttagtgaatcacatccattacaagatgaagatcaagttcaaggttcattagaaattatttatagtttgcaagaagaattaaaagaaattactggtatggatgaggtgacattacaaccagctgctggcgcacatggtgaatggactgcattgatgatatttaaagcttaccatgagaataatggtgaaggtcatcgtgatgaagtcattgtgccagattctgcgcatggtacgaatccagcctcagcttcatttgcaggatttaaatcagttactgtaaaatcaaacgaacgtggcgaagttgatattgatgacttgaaacgtgttgtaaatgaaaatacagcagctattatgttaactaatccaaacactttaggtattttcgaaaaaaatattatggaaatccgtgaaatcgtccataatgctggtggtctattatattatgatggtgcgaatttaaacgctattatggacaaagttcgcccaggagatatgggatttgatgctgttcatttaaacttgcataaaacatttactggtccacatggtggtggcggtcctggttcaggtccagtcggtgtagtaaaagaactagcaagttacttaccaaagccaatggttattaaagatggcgacaaatttaaatatgataatgacattaaaaattctatcggacgtgtaaaaccattttatggtaactttggtatttacttaagagcttatacgtatattcgaactatgggagcaactggacttaaagaggtttctgaagcagcggttcttaatgcgaattatattaaagcacgtttatctaaacactttgaaataccttataaacaatattgtaaacacgagtttgtgttaagtggtgtgcgtcaaaaagaatttggtgtacgtactttagacatggctaagcgattattagatttcggtgtacatccaccaacaatatacttcccattaaatgttgaagaaggtatgatgattgaaccgactgagacagagtctaaagaaacacttgattattttatcgatacattaattagtattgctgaagaagctaaaaatgatcctgataaagtgctagaagcaccacatacaactgtgattgatcgattagacgaagctacagctgctcgtaaaccaatattaaagtttgaaaatcttaaacaggaaaaa

SEQ ID NO: 548 - protein, 490 aa, Staphylococcus aureus
  MISC_FEATURE (1)..(490): glycine dehydrogenase
MTSKSSPLIFERSREGRYAYSLPKSDIKTNSVESLLDDKFIRKNKAEFPEVAELDLVRHYTELSNKNFGVDNGFYPLGSCTMKYNPKINEKVARIPGFSESHPLQDEDQVQGSLEIIYSLQEELKEITGMDEVTLQPAAGAHGEWTALMIFKAYHENNGEGHRDEVIVPDSAHGTNPASASFAGFKSVTVKSNERGEVDIDDLKRVVNENTAAIMLTNPNTLGIFEKNIMEIREIVHNAGGLLYYDGANLNAIMDKVRPGDMGFDAVHLNLHKTFTGPHGGGGPGSGPVGVVKELASYLPKPMVIKDGDKFKYDNDIKNSIGRVKPFYGNFGIYLRAYTYIRTMGATGLKEVSEAAVLNANYIKARLSKHFEIPYKQYCKHEFVLSGVRQKEFGVRTLDMAKRLLDFGVHPPTIYFPLNVEEGMMIEPTETESKETLDYFIDTLISIAEEAKNDPDKVLEAPHTTVIDRLDEATAARKPILKFENLKQEK

SEQ ID NO: 549 - DNA, 384 bp, Staphylococcus aureus
atgagtgctagtttgtacatcgcaataattttagttatagcaattattgcttatatgattgttcaacaaattcttaacaagcgagctgttaaagaattagatcaaaatgaattccataatgggattagaaaagctcaagtcatcgatgttagagagaaagttgactatgactacggtcacattaatgggtctcgcaatattcctatgacaatgttcaggcaacgattccaaggattaagaaaagatcaaccggtatacttatgtgatgccaatgggattgctagctatagagccgctcgtattttgaaaaagaatggatatacagatatctatatgttaaaaggcggctataaaaaatggactggaaaaataaagtctaaaaaa

SEQ ID NO: 550 - protein, 128 aa, Staphylococcus aureus
  MISC_FEATURE (1)..(128): conserved hypothetical
MSASLYIAIILVIAIIAYMIVQQILNKRAVKELDQNEFHNGIRKAQVIDVREKVDYDYGHINGSRNIPMTMFRQRFQGLRKDQPVYLCDANGIASYRAARILKKNGYTDIYMLKGGYKKWTGKIKSKK

SEQ ID NO: 551 - DNA, 834 bp, Staphylococcus aureus
ttgaatatgactgaaacttggaattttattaatacaggaagtaaagacccatattataatatggcaatggatgaagcgttattaaattttgtctctagaggtgaaattgatccagttatacgtttttacacatggaatcctgcaacattatcaatagggtatttccaaaggctacaaaaagaaattgatattgataaggttaaagagaaaggttttggtctcgtaaggcgtcaaactggtggccgtggggtgctacatgataaagagttaacttacagtgtgattgtgcctgaatcgcatccgaatatgccttctacagttacagaagcgtacagagtgatttcacaaggattattagaaggatttaaaaacttaggatttgatacttattttgcggtacctaaaacgcctgaagagcgtcaaaaattaaaacaacctcgaagttcagtgtgttttgatgcaccaagttggtatgagctagttgttgaaggccgtaagattgctgggagtgctcaaacgagacaaaagggcgtaatcctccaacacggttcgattttacaagatattgatattgatgaactgtttgatatgtttatttataaaaatgaaagattaaaattaaaaatgaaagaggcattcgttgaaaaagcagttgccatcaatgatatttcagatgaacacattactattagtcaaatggaagaagctttcgagaaaggttttaagaaaggtttaaatatagaattaaagccacttgaattaacagaagctcaattggcagaagtggaagaattaactgaaaaatatcgttcagatgaatggatgtttagaaag

SEQ ID NO: 552 - protein, 278 aa, Staphylococcus aureus
  MISC_FEATURE (1)..(278): conserved hypothetical
LNMTETWNFINTGSKDPYYNMAMDEALLNFVSRGEIDPVIRFYTWNPATLSIGYFQRLQKEIDIDKVKEKGFGLVRRQTGGRGVLHDKELTYSVIVPESHPNMPSTVTEAYRVISQGLLEGFKNLGFDTYFAVPKTPEERQKLKQPRSSVCFDAPSWYELVVEGRKIAGSAQTRQKGVILQHGSILQDIDIDELFDMFIYKNERLKLKMKEAFVEKAVAINDISDEHITISQMEEAFEKGFKKGLNIELKPLELTEAQLAEVEELTEKYRSDEWMFRK

SEQ ID NO: 553 - DNA, 243 bp, Staphylococcus aureus
atgcaaaatcatgataggagtcttttaatgcgtaatataatattttatcttgtacttattattgctgcgattggattagtaatgaatctagatgcctttattttttcaatcgtcagaatgttaatcagctttgctgtaatagctggtattatttatctgatttattatttcttcatcttaactgaagaccaacgcaaatatcgcaaagcaatgcgtaagtataaaagaaatcaaagaagaaaa

SEQ ID NO: 554 - protein, 81 aa, Staphylococcus aureus
  MISC_FEATURE (1)..(81): hypothetical protein
MQNHDRSLLMRNIIFYLVLIIAAIGLVMNLDAFIFSIVRMLISFAVIAGIIYLIYYFFILTEDQRKYRKAMRKYKRNQRRK

SEQ ID NO: 555 - DNA, 579 bp, Staphylococcus aureus
atgaaaaaattggtttcaattgttggcgcaacattattgttagctggatgtggatcacaaaatttagcaccattagaagaaaaaacaacagatttaagagaagataatcatcaactcaaactagatattcaagaacttaatcaacaaattagtgattctaaatctaaaattaaagggcttgaaaaggataaagaaaacagtaaaaaaactgcatctaataatacgaaaattaaattgatgaatgttacatcaacatactacgacaaagttgctaaagctttgaaatcctataacgatattgagaaagatgtaagtaaaaacaaaggcgataagaatgttcaatcgaaattaaatcaaatttctaatgatattcaaagtgctcacacttcatacaaagatgctatcgatggtttatcacttagtgatgatgataaaaaaacgtctaaaaatatcgataaattaaactctgatttgaatcatgcatttgatgatattaaaaatggctatcaaaataaagataaaaaacaacttacaaaaggacaacaagcgttgtcaaaattaaacttaaatgcaaaatca

SEQ ID NO: 556 - protein, 193 aa, Staphylococcus aureus
  MISC_FEATURE (1)..(193): hypothetical protein
MKKLVSIVGATLLLAGCGSQNLAPLEEKTTDLREDNHQLKLDIQELNQQISDSKSKIKGLEKDKENSKKTASNNTKIKLMNVTSTYYDKVAKALKSYNDIEKDVSKNKGDKNVQSKLNQISNDIQSAHTSYKDAIDGLSLSDDDKKTSKNIDKLNSDLNHAFDDIKNGYQNKDKKQLTKGQQALSKLNLNAKS

SEQ ID NO: 557 - DNA, 1095 bp, Staphylococcus aureus
ttgaaatgcacaaacgtttcactaggaggtaataagatgagcagaataacacaagtgcatcgtattttagaacaaaaacatttagatgcgattatcattctttcggattacaatagaagatatttatcaggttttactggtaccagtggagcacttatcatatctaaagataaacaatatttgataacagactttagatatattgatcaagcaactaagcaggcgccaaattatgaaattattaatcgtaaatctactattattggtgagattaaagaattgctacaccaagaaaattttgaaaatgtaggttttgaggggcatcatgtaagttatgatacataccttgaattaaataaaagccgtatatcattaataagcatttctaatactgtagataaaattagagacgtcaaagatgctgacgaaattgctttaattcaaaaagcagctaatattgttgatgaaacatatgaatatattttaactgttgtaaaagcaggcatgactgaaaaagaattaaaggcaatattagaaagcaaaatgctagaattaggagcagatggaccatcattcgatacgattgtagcatctggtcatagaggtgcattaccacatggtgttgcaagtgataaaattattgaaaaaggcgacatgattacattagattttggcgcgtattataacggctattgttcagatattactagaacatttgctattggagaaccagatcctaaactgaaagaaatatatcaaatagtacttgaatctcaaatgaaagcaattaatgagattagacctggcatgactggtgcagaagctgatgccatttcaagaaactatttagagtcaaaagggtatggaaaagaatttggacattcactaggacatggtattggtttagaaatccatgaagggccaatgctggctcgtacgatacaagataaacttcaagttaacaactgtgttacagtagaacctggtgtttatatagaaggtttgggcggtataagaatagaagatgatattttaattacagaaaatggttgtcaagtctttactaaatgcacaaaagaccttatagttttaaca

SEQ ID NO: 558 - protein, 365 aa, Staphylococcus aureus
  MISC_FEATURE (1)..(365): Xaa-Pro dipeptidase
LKCTNVSLGGNKMSRITQVHRILEQKHLDAIIILSDYNRRYLSGFTGTSGALIISKDKQYLITDFRYIDQATKQAPNYEIINRKSTIIGEIKELLHQENFENVGFEGHHVSYDTYLELNKSRISLISISNTVDKIRDVKDADEIALIQKAANIVDETYEYILTVVKAGMTEKELKAILESKMLELGADGPSFDTIVASGHRGALPHGVASDKIIEKGDMITLDFGAYYNGYCSDITRTFAIGEPDPKLKEIYQIVLESQMKAINEIRPGMTGAEADAISRNYLESKGYGKEFGHSLGHGIGLEIHEGPMLARTIQDKLQVNNCVTVEPGVYIEGLGGIRIEDDILITENGCQVFTKCTKDLIVLT

SEQ ID NO: 559 - DNA, 555 bp, Staphylococcus aureus
atgatttcggttaatgattttaaaacaggtttaacaatttctgttgataacgctatttggaaagttatagacttccaacatgtaaagcctggtaaaggttcagcattcgttcgttcaaaattacgtaatttaagaactggtgcaattcaagagaaaacgtttagagctggtgaaaaagttgaaccagcaatgattgaaaatcgtcgcatgcaatatttatatgctgacggagataatcatgtatttatggataatgaaagctttgaacaaacagaactttcaagtgattacttaaaagaagaattgaattacttaaaagaaggtatggaagtacaaattcaaacatacgaaggtgaaactatcggtgttgaattacctaaaactgttgaattaacagtaactgaaacagaacctggtattaaaggtgatactgcaactggtgccactaaatcggcaactgttgaaactggttatacattaaatgtacctttatttgtaaacgaaggtgacgttttaattatcaacactggtgatggaagctacatttcaagagga

SEQ ID NO: 560 - protein, 185 aa, Staphylococcus aureus
  MISC_FEATURE (1)..(185): translation elongation
MISVNDFKTGLTISVDNAIWKVIDFQHVKPGKGSAFVRSKLRNLRTGAIQEKTFRAGEKVEPAMIENRRMQYLYADGDNHVFMDNESFEQTELSSDYLKEELNYLKEGMEVQIQTYEGETIGVELPKTVELTVTETEPGIKGDTATGATKSATVETGYTLNVPLFVNEGDVLIINTGDGSYISRG

SEQ ID NO: 561 - DNA, 462 bp, Staphylococcus aureus
atgaactttaaagaaatcaaagaattaattgaaattctggataaatcaactttaacggaaatcaatattgaagatactaaaggcaaagtgacgcttaagaaagaaaaagaaactgagattatcacgccacaaatctcacaaatgccagttgaagctgcggcaatgcctatgcctcaagcacaatcaactgatagcaataaaactgaagctccaaagccaacttcagataatcacaaaacaattaatgcacctatggtaggtacattttacaaatcgccatctccagacgaagaagcatatgtgcaagttggggacactgtttcaaatgaaacaacagtgtgtattttagaggcaatgaaactatttaatgaaattcaagcagaaatttcaggtgaaattgttgaaatcttagtagaagacggacaaatggtagagtatggccaaccgttatttaaggtgaaa

SEQ ID NO: 562 - protein, 154 aa, Staphylococcus aureus
  MISC_FEATURE (1)..(154): acetyl-CoA carboxylase
MNFKEIKELIEILDKSTLTEINIEDTKGKVTLKKEKETEIITPQISQMPVEAAAMPMPQAQSTDSNKTEAPKPTSDNHKTINAPMVGTFYKSPSPDEEAYVQVGDTVSNETTVCILEAMKLFNEIQAEISGEIVEILVEDGQMVEYGQPLFKVK

SEQ ID NO: 563 - DNA, 1353 bp, Staphylococcus aureus
atgaaaaaggttttaattgcaaaccgcggtgaaatcgcagttaggattattcgcgcttgtcgtgatttaggcatccaaactgttgcaatctattctgaaggggataaagatgcgctacatactcaaattgctgatgaagcatattgcgtaggtcccactttgtctaaagattcatatttaaatattccgaacatcttatctattgcaacttctacaggttgtgatggcgttcatccgggttatggctttttagctgaaaatgctgattttgcagaattatgcgaagcatgccaattgaagttcattggaccaagttatcaatctatccaaaaaatgggtatcaaagatgttgctaaggcagaaatgatcaaagccaatgttccagttgttcctggtagtgacggtttaatgaaagacgtctcagaagctaagaaaatcgccaaaaaaattggctatccggtcatcattaaagctactgctggcggtggcggaaaaggtatccgtgttgctcgtgatgaaaaagaacttgaaactggcttccgaatgacagaacaagaagctcaaactgcatttggtaatggtggactttatatggagaaattcatcgaaaacttccgccatattgaaatccaaattgttggggacagctatggtaatgtaattcatttaggagaacgtgattgtacaattcaaagacgtatgcagaaattagtggaagaagcaccttccccaattttagatgatgaaacacgtcgtgaaatgggaaatgccgcagttcgtgcagcgaaagctgtaaattatgaaaatgcgggaacaattgagtttatatatgatttaaatgataataaattttattttatggaaatgaatacacgtattcaagtagaacatcctgtaactgaaatggtaacaggaattgatttagttaaattacaattacaagttgctatgggtgacgtgttaccgtataaacaagaagatattaaattaacaggacacgcaattgaatttagaattaatgctgaaaatccttacaagaactttatgccatcaccaggtaaaattgagcaatatcttgcaccaggtggatatggtgttcgaatagagtcagcatgttatactaattatacgataccgccatattatgattcgatggtagcgaaattaatcatacatgaaccgacacgagatgaagcgattatggctggcattcgtgcactaagtgaatttgtggttcttggtattgatacaactattccattccatattaaattattgaataacgatatatttagaagcggtaaatttaatacaaactttttagagcaaaatagcattatgaatgatgaaggt

SEQ ID NO: 564 - protein, 451 aa, Staphylococcus aureus
  MISC_FEATURE (1)..(451): acetyl-CoA carboxylase
MKKVLIANRGEIAVRIIRACRDLGIQTVAIYSEGDKDALHTQIADEAYCVGPTLSKDSYLNIPNILSIATSTGCDGVHPGYGFLAENADFAELCEACQLKFIGPSYQSIQKMGIKDVAKAEMIKANVPVVPGSDGLMKDVSEAKKIAKKIGYPVIIKATAGGGGKGIRVARDEKELETGFRMTEQEAQTAFGNGGLYMEKFIENFRHIEIQIVGDSYGNVIHLGERDCTIQRRMQKLVEEAPSPILDDETRREMGNAAVRAAKAVNYENAGTIEFIYDLNDNKFYFMEMNTRIQVEHPVTEMVTGIDLVKLQLQVAMGDVLPYKQEDIKLTGHAIEFRINAENPYKNFMPSPGKIEQYLAPGGYGVRIESACYTNYTIPPYYDSMVAKLIIHEPTRDEAIMAGIRALSEFVVLGIDTTIPFHIKLLNNDIFRSGKFNTNFLEQNSIMNDEG

SEQ ID NO: 565 - DNA, 360 bp, Staphylococcus aureus
atggtcaaagtaactgattattcaaattcaaaattaggtaaagtagaaatagcgccagaagtgctatctgttattgcaagtatagctacttcggaagtcgaaggcatcactggccattttgctgaattaaaagaaacaaatttagaaaaagttagtcgtaaaaatttaagccgtgatttaaaaatcgagagtaaagaagatggcatatatatagatgtatattgtgcattaaaacatggtgttaatatttcaaaaactgcaaacaaaattcaaacgtcaatttttaattcaatttctaatatgacagcgatagaacctaagcaaattaatattcacattacacaaatcgttattgaaaag

SEQ ID NO: 566 - protein, 120 aa, Staphylococcus aureus
  MISC_FEATURE (1)..(120): conserved hypothetical
MVKVTDYSNSKLGKVEIAPEVLSVIASIATSEVEGITGHFAELKETNLEKVSRKNLSRDLKIESKEDGIYIDVYCALKHGVNISKTANKIQTSIFNSISNMTAIEPKQINIHITQIVIEK

SEQ ID NO: 567 - DNA, 402 bp, Staphylococcus aureus
ttgaaggagttaaaaatgagtcgtaaagaatcccgagtgcaagcttttcaaactttatttcaattagaaatgaaggacagtgatttaacgataaatgaagcgataagctttattaaagacgataatccagatttagacttcgaatttattcattggctagtttctggcgttaaagatcacgaacctgtattagacgagacaattagtccttatttaaaagattggactattgcacgtttattaaaaacggatcgtattattttaagaatggcaacatatgaaatattacacagtgatacacctgctaaagtcgtaatgaatgaagcagttgaattaacaaaacaattcagtgatgatgatcattataaatttataaatggtgtattgagtaatataaaaaaa

SEQ ID NO: 568 - protein, 134 aa, Staphylococcus aureus
  MISC_FEATURE (1)..(134): hypothetical protein
LKELKMSRKESRVQAFQTLFQLEMKDSDLTINEAISFIKDDNPDLDFEFIHWLVSGVKDHEPVLDETISPYLKDWTIARLLKTDRIILRMATYEILHSDTPAKVVMNEAVELTKQFSDDDHYKFINGVLSNIKK

SEQ ID NO: 569 - DNA, 1335 bp, Staphylococcus aureus
atgtcagattatttaagtgtttcagctttaacgaaatatattaaatataaatttgatcaagatccacatctccaatctgtattgattaaaggtgagctttcaaatttcaaaaagcattcaagtggtcatttatactttaatgtgaaagataaagaaagcgttataagtgccatgatgttcaaaggtagtgcttctaaattaaacttcgaacctaaagaaggagatgaagtcttattagaagcacgtgtttctgtttttgaacgtcgtggaaactatcaaatttatgtaaataaaatgcaattagatggtatagggaacttatatcaaaaattagaagcattaaagaaaaaattaactgaagaaggttgttttgataaagcgaataagaaatcaatacctaagtttcctaaaaaaattgcagttttaacagcgagtacaggtgccgcaattcgagatatccattcaacgataaatagtcgttttccattagctgaacaaatacaaattagtactttggttcaaggtgaaaaagcaaaagacgacattattgaaaaaattgaatatgcagatagtttaggtgtagataccattattgtaggtcgaggcggtggatccatagaagatttatggaatttcaacgaagaagctgtcgtccgtgcaatatataattgtaagacaccgattatatcagcagttggtcatgaaacagactttacattaagtgattttgctgcagacatcagagctgcgactccaactcaagctgctgttattgcaacaccagaccaatatgaattgctgcaacaaatacagcaatatcagtttacattgactcgtttcatcaagaaacatttagaacaacaacgtaaacatgttgaacatttgtcatcgtattacaagtttaaacaaccaactttattgtatgatcaacagatacaacgtcgagatgatttagaaaagagactgaaacaacaaattcaggcaacttttgaacaacagagacatcgattaatgctgttgcaacaacgttataatttaaaagcattactaagtagtgttaatcaagaacaacaaaataatcttcaattgacaaaccaacttgttaaattattgaattctaagatattaagttataaaaatgatttgaaaaataaagtagaaaacttaaacaatttaagtccaactaatacaatgttgcgtggatatgcaattgttaataaaaaagacgaagtcattacgagtactaaagatttaacagaaaatgatcaattgacgttaacaatgaaagatggcttagtagatgcaaaagttacgaaagtaaggtgtaataatgac

SEQ ID NO: 570 - protein, 445 aa, Staphylococcus aureus
  MISC_FEATURE (1)..(445): hypothetical protein
MSDYLSVSALTKYIKYKFDQDPHLQSVLIKGELSNFKKHSSGHLYFNVKDKESVISAMMFKGSASKLNFEPKEGDEVLLEARVSVFERRGNYQIYVNKMQLDGIGNLYQKLEALKKKLTEEGCFDKANKKSIPKFPKKIAVLTASTGAAIRDIHSTINSRFPLAEQIQISTLVQGEKAKDDIIEKIEYADSLGVDTIIVGRGGGSIEDLWNFNEEAVVRAIYNCKTPIISAVGHETDFTLSDFAADIRAATPTQAAVIATPDQYELLQQIQQYQFTLTRFIKKHLEQQRKHVEHLSSYYKFKQPTLLYDQQIQRRDDLEKRLKQQIQATFEQQRHRLMLLQQRYNLKALLSSVNQEQQNNLQLTNQLVKLLNSKILSYKNDLKNKVENLNNLSPTNTMLRGYAIVNKKDEVITSTKDLTENDQLTLTMKDGLVDAKVTKVRCNND

SEQ ID NO: 571 - DNA, 228 bp, Staphylococcus aureus
atgactaaagaaacgcaaagttttgaagaaatgatgcaagaattagagcaaattgttcaaaaattagataatgaaacagtatctttagaggaatcattagatttatatcaacgtggtatgaaactatcagcagcttgtgacacaactttaaaaaatgccgaaaaaaaggtgaatgacttaataaaagaagaagctgaggatgtaaaaaatgacgaatctaccgatgaa

SEQ ID NO: 572 - protein, 76 aa, Staphylococcus aureus
  MISC_FEATURE (1)..(76): hypothetical protein
MTKETQSFEEMMQELEQIVQKLDNETVSLEESLDLYQRGMKLSAACDTTLKNAEKKVNDLIKEEAEDVKNDESTDE

SEQ ID NO: 573 - DNA, 879 bp, Staphylococcus aureus
atgacgaatctaccgatgaataaattaatagatgaagtcaataatgaattatcggttgcgataaataaatcagtaatggatactcagctagaagaaagtatgttgtattcattaaatgctggaggtaaacgcatccgaccagttctgttattactcactttagattcactaaataccgagtatgagttaggtatgaagagcgcaattgcactagaaatgattcatacatattcacttattcatgatgacctaccagcgatggataatgatgattatcgacgaggaaaattaacaaatcataaagtatatggtgagtggactgcgatattagcaggtgatgctttattaactaaagcatttgaacttatttcaagtgatgatagattaactgatgaagtaaaaataaaagttctacaacggctgtcaatagcaagtggtcatgttggaatggtcggcggtcaaatgttagatatgcaaagcgaaggccaaccaattgatcttgaaactttggaaatgatacacaaaacaaaaacaggagcattattaacttttgcggttatgagtgcagcagatatcgctaatgtcgatgatacaactaaagaacatttagaaagttatagttatcatttaggtatgatgttccagattaaagatgatttattagactgctatggtgatgaagcaaagttaggtaaaaaagtgggcagcgatcttgaaaataataaaagtacgtacgtgagtttattagggaaagatggcgcagaagataaattgacttatcatagagacgcagcagtggatgaactaacgcaaattgatgaacaattcaatacaaaacacttattagaaatcgttgatttattttatagcagggatcac

SEQ ID NO: 574 - protein, 293 aa, Staphylococcus aureus
  MISC_FEATURE (1)..(293): geranyltranstransferase
MTNLPMNKLIDEVNNELSVAINKSVMDTQLEESMLYSLNAGGKRIRPVLLLLTLDSLNTEYELGMKSAIALEMIHTYSLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDTTKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 575 - DNA, 312 bp, Staphylococcus aureus
atgatgttaaaaatcacctcatattcatatactcaatctgaattttctggccgtagaatagaaaaattacttcataacagtattcgaatgatgtggttagctcaagatcaaacaccttcttataaaactattaatctttttagagtgaatcctaatactgatgcgctaattgaatctttatttattcagtttcataataaaatgcatatcaaaaaagctgatttctatcaaataattaatagaaatcagcttttttcattgcctaaaaacttaatgtcccgacctctttatctacgcataaatacttattac

SEQ ID NO: 576 - protein, 104 aa, Staphylococcus aureus
  MISC_FEATURE (1)..(104): truncated transposase
MMLKITSYSYTQSEFSGRRIEKLLHNSIRMMWLAQDQTPSYKTINLFRVNPNTDALIESLFIQFHNKMHIKKADFYQIINRNQLFSLPKNLMSRPLYLRINTYY

SEQ ID NO: 577 - DNA, 459 bp, Staphylococcus aureus
gtgtttactgtgcccaaaaaatcggttaggcatataaaaattagagaaattatttcaaatgaacagatagagacacaagatgaattagttaaacgattaaacgattatgatttaaatgtcactcaagcaactgtttctcgtgatattaaagaactacaacttattaaagtacctataccttcaggtcaatatgtttatagtttaccaaatgatagaaaattccatcctttagaaaaattgggacgttatttaatggattcctttgttaatatagatggtactgataatttacttgttctaaaaacattacctggtaatgcacaatctattggagctatattagaccaaatcaattgggaagaagtactaggcacaatttgtggtgatgatacttgtttaattatttgtcgaagcaaagaggcaagtgatgaaatcaagtcaagaattttcaatttgtta

SEQ ID NO: 578 - protein, 153 aa, Staphylococcus aureus
  MISC_FEATURE (1)..(153): arginine repressor
VFTVPKKSVRHIKIREIISNEQIETQDELVKRLNDYDLNVTQATVSRDIKELQLIKVPIPSGQYVYSLPNDRKFHPLEKLGRYLMDSFVNIDGTDNLLVLKTLPGNAQSIGAILDQINWEEVLGTICGDDTCLIICRSKEASDEIKSRIFNLL

SEQ ID NO: 579 - DNA, 1677 bp, Staphylococcus aureus
atgttacaaaccttatcaatcaagcaatttgctattattgaagaattagaaattcaattttctgatggtttaactgttttaagtggtgaaacgggttcaggtaagtcaattattatagatgcaattggacaattaattggaatgagagcttcatctgattttgtaagacatggtgaaaaaaaggctgtcatcgaaggtatatttgatattgacgagagtaaagatgctatacatatattgaaaaatatggatattgatgtagatgaagattttttattagttaaacgggaaattttcagctctggtaaaagtctttgtaaaattaataatcaaacagttactttacaagatttacgaaaagttatgcaagaattattagatattcatggccaacatgaaacgcagtctttgttgaaacaaaaataccatttaacattattggataattacgcagaatcacgttatcaagatttgttggataaatatcaccaaacttttcaaaattataaagccaaaaagcaagagttagaagatttagaatcagcagaccaagcattgctacagcgtttagatttaatgaaattccaattagaagaattgtctgaagcacatctaaaagaaggcgaaatagagcaacttgaaatagatattaaacgcattcaaaactctgaaaaattaagcttagcgcttaataacgcatatatgacattaacggatgaaaatgctatcactgatcgtttatatgaactaagcaaccatttgttaacaataaacgatatagttccaaacaaatatgacaaattaaaagaagatattgatcaattttactacattttagaagatgcaaaacatgagttatatgatgaaatggctaatacagaattcgacgaacaagtgttaaacgagtatgaatctcgtatgaatttgctgaataatttaaaacgtaaatatggaaaagatatttcagaattaatcgcatatcaagaaaagcttaataatgaaatcaataaaattgaaaactatgaacaaagtacatcgcagttacgagaagaaataaatgcattgtataatcaagttatagaggttggacaagcgttatcaaagcagcgtcgtatagtcgctagggagttaagagaccacattgtatcggaaattcaaaacttacaaatgaaagacgcaaatcttgagatttcatttaaaaaattagaagaaccgaatattgatggaatcgaatttgtagaatttttaatcagtccaaataaaggggaaccattaaaaagtttaaataaaattgcgtcaggtggagaactttctagaattatgttagcgttaaaaagtatttttgttaaatcgagaggtcaaactgcaattttattcgatgaggttgactcaggtgtatctggacaagctgcacaaaaaatggcagagaaaatgcgagatatagcagaatatatacaagttatttgtatctctcacttaccacaagttgcatcgatgagcgaccatcatttattaatttcgaaatcatcaaaagatgatcgtacaacaacacaagttcaagagttaattagcgatgataaagtagatgaaattgcacgaatgatttcaggtgcaagtgttactgatttaactcgagaaaatgcaagagaaatgatacaacacaatcaaagacgtaga

SEQ ID NO: 580 - protein, 559 aa, Staphylococcus aureus
  MISC_FEATURE (1)..(559): DNA repair protein
MLQTLSIKQFAIIEELEIQFSDGLTVLSGETGSGKSIIIDAIGQLIGMRASSDFVRHGEKKAVIEGIFDIDESKDAIHILKNMDIDVDEDFLLVKREIFSSGKSLCKINNQTVTLQDLRKVMQELLDIHGQHETQSLLKQKYHLTLLDNYAESRYQDLLDKYHQTFQNYKAKKQELEDLESADQALLQRLDLMKFQLEELSEAHLKEGEIEQLEIDIKRIQNSEKLSLALNNAYMTLTDENAITDRLYELSNHLLTINDIVPNKYDKLKEDIDQFYYILEDAKHELYDEMANTEFDEQVLNEYESRMNLLNNLKRKYGKDISELIAYQEKLNNEINKIENYEQSTSQLREEINALYNQVIEVGQALSKQRRIVARELRDHIVSEIQNLQMKDANLEISFKKLEEPNIDGIEFVEFLISPNKGEPLKSLNKIASGGELSRIMLALKSIFVKSRGQTAILFDEVDSGVSGQAAQKMAEKMRDIAEYIQVICISHLPQVASMSDHHLLISKSSKDDRTTTQVQELISDDKVDEIARMISGASVTDLTRENAREMIQHNQRRR

SEQ ID NO: 581 - DNA, 1419 bp, Staphylococcus aureus
atgtcagagaaacaatatgatttagtcgttctcggtggaggtactgcaggatatgttgctgcgatacgtgcgtctcaattaggtaaaaaagtggcaatagtagaacgacaactattaggaggtacttgtctccataaaggttgtattcctactaaatcgctgcttaaatctgctgaagtatttcaaacagtaaaacaggcagcaatgtttggcgttgatgtcaaagatgctaatgttaattttgaaaatatgttggcacgaaaagaagacattattaatcaaatgtatcaaggtgtaaagcatttaatgcaacacaatcacattgacatttataatggcacgggacgtattctaggtacatctatattttcacctcaaagtggcacaatttctgtcgaatatgaagatggtgaatcagacttattacccaaccaatttgtattaattgcaactggttcttcgcctgcagagttgccattcttatcatttgatcatgataaaattttatctagcgatgatatattatcattaaagacgttaccatcaagtattggtattattggtggtggtgttatcggaatggaatttgcatcattgatgatagatttaggtgttgacgtaacagttatagaagcaggtgaaagaattttaccaactgaaagtaaacaagcttcacaactattaaaaaaatcattgtcagcacgtggtgttaaattctatgagggaataaaactttctgaaaatgatataaatgttaacgaagatggtgttacgtttgaaatttcctcagacataattaaagtagataaagtgttgctatcgattggtagaaaacctaacacatcagatattggtttaaacaacactaaaataaaactttcaacatcaggacatattttaacgaacgaatttcaacaaactgaagataaacatatttatgcagctggtgattgtataggaaaattacaattggcacatgttggatcaaaagaaggtgttgtggctgttgatcatatgtttgaggggaacccaatcccagtaaactataacatgatgcctaagtgtatttattcacaacctgaaattgcttctatcggtttaaacattgaacaagcaaaggcagagggaatgaaagttaaaagttttaaagtaccatttaaagcaattggtaaagcagtgattgatagccatgacacaaacgaagggtatagcgaaatggtgattgatcaatcaactgaagaaattgtgggtattaatatgattggtccacatgtaacagaattgattaatgaggcatcactgttacagttcatgaatggctcggcattagaattaggactaacaacacacgcacatccttccatctctgaagtgttgatggaattaggattgaaagcagaaagtagagctattcacgta

SEQ ID NO: 582 - protein, 473 aa, Staphylococcus aureus
  MISC_FEATURE (1)..(473): dihydrolipoamide
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSIGIIGGGVIGMEFASLMIDLGVDVTVIEAGERILPTESKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDTNEGYSEMVIDQSTEEIVGINMIGPHVTELINEASLLQFMNGSALELGLTTHAHPSISEVLMELGLKAESRAIHV

SEQ ID NO: 583 - DNA, 990 bp, Staphylococcus aureus
atgattgattataaatcattaggccttagcgaagaagacctaaaagtaatatataaatggatggatttaggtagaaaaatagatgaaagactgtggttattgaaccgtgcaggtaaaattccatttgttgtaagtggtcaaggacaagaagcaactcagattgggatggcatacgcattagaagaaggtgatattacagcgccttattatagagatctagctttcgttacttatatgggtatctcagcgtatgatacgtttttatcagcgtttggaaagaaagacgatgttaactctggtggaaaacaaatgccatcacactttagtagtagagctaagaatattttgtctcaaagttcaccggtagcaactcaaataccccatgctgttggtgctgctttagctttaaaaatggatggtaagaagaaaattgcaacagcaactgttggtgaaggtagctcaaaccaaggtgacttccatgaaggtttaaacttcgcgggtgtacacaaacttccttttgtatgtgtcattataaataataaatatgcaatttcagtacctgattcattacaatacgcagctgaaaaattatcggatagagcacttggttacggtatacatggtgaacaagtagatggtaatgatccattagcaatgtataaagcgatgaaagaagcaagagatcgagctatttctggtcaaggttcaactttgattgaagcagtaacaagtcgtatgacagctcattcatcagatgatgacgaccaatatcgtacgaaagaagagcgtgaaacgcttaaaaaagcagactgcaatgaaaagttcaaaaaagagttgctttcagctggcattatcgatgatgcttggttggcagaaatagaagcggagcataaagacatcatcaataaagcgacaaaggctgctgaagacgcgccatatccaagtgtcgaagaagcctatgcatttgtgtacgaagaagggagtcttaac

SEQ ID NO: 584 - protein, 330 aa, Staphylococcus aureus
  MISC_FEATURE (1)..(330): branched-chain alpha-keto
MIDYKSLGLSEEDLKVIYKWMDLGRKIDERLWLLNRAGKIPFVVSGQGQEATQIGMAYALEEGDITAPYYRDLAFVTYMGISAYDTFLSAFGKKDDVNSGGKQMPSHFSSRAKNILSQSSPVATQIPHAVGAALALKMDGKKKIATATVGEGSSNQGDFHEGLNFAGVHKLPFVCVIINNKYAISVPDSLQYAAEKLSDRALGYGIHGEQVDGNDPLAMYKAMKEARDRAISGQGSTLIEAVTSRMTAHSSDDDDQYRTKEERETLKKADCNEKFKKELLSAGIIDDAWLAEIEAEHKDIINKATKAAEDAPYPSVEEAYAFVYEEGSLN

SEQ ID NO: 585 - DNA, 981 bp, Staphylococcus aureus
atggctaaattatcttatttagaggcgatacgccaggcacaagacttagcattacaacaaaataaagatgtgtttattcttggtgaagatgttggtagaaaaggtggcgtatttggtactactcaaggactgcaacaaaaatatggtgaagacagagttatcgatacgccattagctgagtcaaatattgttggaactgccattggtgcagctatggtaggtaaaagaccaattgcagaaattcaatttgcagattttattttacctgcgacaaatcaaattattagtgaagctgcgaaaatgcgttatcgttcaaataatgattggcaatgcccattaacgattcgtgcaccatttggtggcggtgttcacggaggactatatcattcacaaagtattgaaagtatatttgcttcatcgccaggtttaacaattgttattccttccacaccgtatgatgctaaagggcttttattatcatctatcgaatcaaatgatccagtattgtactttgagcataaaaaagcttatcgtttcttaaaggaagaagtgccagaagaatattacactgtacctttaggaaaagcagatgtgaaacgtgaaggtgaagatttaacagtattttgttatggattaatggtcaattattgtttacaagcagcggatattttagctgcagacggtatcaatgttgaagtcgttgatttacgaactgtttatccattagataaagaaacaattattgatcgtgctaaacatacaggtaaagttttacttgtaactgaagataatttagaaggtagtattatgtcagaagtgtcagcgattattgcagagcattgcttgttcgatttagatgcaccaatcatgcgtttagctgctccagatgtaccatctatgccattttctcctgtattagaaaatgaaattatgatgaatccagaaaaaatcttaaataaaatgcgtgaattagcagaattc

SEQ ID NO: 586 - protein, 327 aa, Staphylococcus aureus
  MISC_FEATURE (1)..(327): branched-chain alpha-keto
MAKLSYLEAIRQAQDLALQQNKDVFILGEDVGRKGGVFGTTQGLQQKYGEDRVIDTPLAESNIVGTAIGAAMVGKRPIAEIQFADFILPATNQIISEAAKMRYRSNNDWQCPLTIRAPFGGGVHGGLYHSQSIESIFASSPGLTIVIPSTPYDAKGLLLSSIESNDPVLYFEHKKAYRFLKEEVPEEYYTVPLGKADVKREGEDLTVFCYGLMVNYCLQAADILAADGINVEVVDLRTVYPLDKETIIDRAKHTGKVLLVTEDNLEGSIMSEVSAIIAEHCLFDLDAPIMRLAAPDVPSMPFSPVLENEIMMNPEKILNKMRELAEF

SEQ ID NO: 587 - DNA, 1272 bp, Staphylococcus aureus
atggaaataacaatgcctaagttaggtgagagtgttcatgaaggcaccattgaacaatggttagtttctgttggtgatcatattgatgaatatgaaccattatgtgaagttattacagataaagtgacagctgaagtcccttccacgatatcaggaacaattacagaaattttagttgaagcggggcagacagtagctattgatacaattatctgtaaaattgaaactgctgatgaaaagacaaatgaaacaactgaagagatacaagcaaaagtggatgagcatactcagaaatctactaaaaaagctagtgcaacagtggaacagacatctactgctaaacaaaatcaaccacgtaataatggtcgcttttcacctgttgtatttaaactcgcttcagagcatgacattgatttatcacaagttgtaggtagtggatttgaaggtcgtgtaactaagaaggatataatgtcagttattgaaaatggtggtaccacagctcaatctgacaaacaagttcaaacaaaatcaacatcagtagatacatcaagtaaccaatcatctgaagacaatagtgaaaacagcacaataccagtaaatggtgtgcgtaaagcaattgcgcaaaatatggttaatagtgtaacagagattccacatgcatggatgatgattgaagtagatgctacaaatcttgtgaatacgagaaatcattataaaaacagctttaaaaataaagaaggatataatctaacgttctttgctttctttgtaaaagctgtagcagatgctttaaaagcatatcctttattaaatagtagctggcaaggaaatgaaattgtcttacataaagacattaatatttcaattgctgttgctgatgaaaataaattatacgtacctgtgattaagcatgcagacgaaaagtcaatcaaaggtatagctagagaaattaatactttagcaacgaaagcgcgtaataagcaattgacagctgaagatatgcagggcggtacatttacggtaaataatactggtacatttggttcagtatcatcaatgggtattataaatcatccacaagcagcgattttacaagtagaatcaatcgttaaaaagccagtagtaattaatgatatgattgcaattcgtaacatggttaatttatgtatttcaattgatcatcgtattttagatggtttacaaacaggtaaatttatgaatcatattaaacagcgtatcgaacagtatactttagaaaatacaaatatatat

SEQ ID NO: 588 - protein, 424 aa, Staphylococcus aureus
  MISC_FEATURE (1)..(424): branched-chain alpha-keto
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTSTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVNTRNHYKNSFKNKEGYNLTFFAFFVKAVADALKAYPLLNSSWQGNEIVLHKDINISIAVADENKLYVPVIKHADEKSIKGIAREINTLATKARNKQLTAEDMQGGTFTVNNTGTFGSVSSMGIINHPQAAILQVESIVKKPVVINDMIAIRNMVNLCISIDHRILDGLQTGKFMNHIKQRIEQYTLENTNIY

SEQ ID NO: 589 - DNA, 447 bp, Staphylococcus aureus
gtgattgaacttatggacatgaatttcgatttatacatgaacggtgttgtagaacaagcaaggaatgaaattgaatctgcgggatatgagcaattaactactgcagaagatgttgacaaagttcttaaacaagatggtacaacactagttatgatcaattctgtatgtggttgtgcaggtggtatcgcaagaccagcagcatcacatgctttacattatgacgtattacctgatcgtctagtgacagtatttgctggacaagataaagaagcgacacaaagagcgcgtgaatacttcgaaggttatgcgccttcaagtccgtcatttgcattagtaaaagatggaaagattacagaaatgattgaaagacatcaaatcgaaggtcatgatgtgatgaacgtaattaatcaattacaaacattattcaataaatattgtgaagaaaga

SEQ ID NO: 590 - protein, 149 aa, Staphylococcus aureus
  MISC_FEATURE (1)..(149): conserved hypothetical
VIELMDMNFDLYMNGVVEQARNEIESAGYEQLTTAEDVDKVLKQDGTTLVMINSVCGCAGGIARPAASHALHYDVLPDRLVTVFAGQDKEATQRAREYFEGYAPSSPSFALVKDGKITEMIERHQIEGHDVMNVINQLQTLFNKYCEER

SEQ ID NO: 591 - DNA, 978 bp, Staphylococcus aureus
atgttaaagttaaatccttacaagattggatttagaacaataaaaacagcagtgggtatgactttaggtgtaattattagtaagctgttaggtttagataattatgcttcaagcgccatattagtcgtattatgtattaaacatacaaaagtacattcgctacaagcgattatttcaagattagtatcatgttttttagtattgtttttaggttcagcaatatttagtttattaggtcagagtccaattgtactcggtattatcgtattgttatttataccattaactgtcgtattaaaagtacaagaaggtgtcattacgagttgcgttatattacttcatgtttttaatgcaaaatcaattgatgcacatttaattgttaatgaaacattattactgttaattggactaagcattgcatttacaatgaatttaatgatgccaagtttagacaaacaactagacgaatacaaatgtaaaattgagcaacaaattgctgatatttttagtaaatatagttatatttgtgaaaaatatgaagataccattgcgattgaatttgaagtgttacttttaaatattaaaaaggcgaagtctatcgcgttccgagatgttaaaaatcattttgttagaaacgaaaattcatactatcattattttgatatgcgagaagagcaagtggaattgttaatgagaatgaaaccgctcatcgaaagtatctgtcataaagatccgcttttaaatgatgttgcgtcactgctgaaagaaattggtctaaatgtgaatagtaatgactatacagcaatgcgtttacacaatttgtatgagacgcgtttgaaattggatgaactgccattgccaacaacacacaaagcgcttaactcgagagcaagtattattcaaatattaaatgaattagaagaatatttacaaatcaaatcgcaatttggttcattgaaaatgcatagtgaagtagct

SEQ ID NO: 592 - protein, 326 aa, Staphylococcus aureus
  MISC_FEATURE (1)..(326): conserved hypothetical
MLKLNPYKIGFRTIKTAVGMTLGVIISKLLGLDNYASSAILVVLCIKHTKVHSLQAIISRLVSCFLVLFLGSAIFSLLGQSPIVLGIIVLLFIPLTVVLKVQEGVITSCVILLHVFNAKSIDAHLIVNETLLLLIGLSIAFTMNLMMPSLDKQLDEYKCKIEQQIADIFSKYSYICEKYEDTIAIEFEVLLLNIKKAKSIAFRDVKNHFVRNENSYYHYFDMREEQVELLMRMKPLIESICHKDPLLNDVASLLKEIGLNVNSNDYTAMRLHNLYETRLKLDELPLPTTHKALNSRASIIQILNELEEYLQIKSQFGSLKMHSEVA

SEQ ID NO: 593 - DNA, 177 bp, Staphylococcus aureus
ttgctagttatatcgtctcaagttaaaagttttatatcttatgtcgtaattattaatacaaaggttattcatttggaggcacacaaaatgcaaaataaagttttaagaattatcattatcgttatgcttgtatcagttgtattagcattgttattaacgagtatcattccaatttta

SEQ ID NO: 594 - protein, 59 aa, Staphylococcus aureus
LLVISSQVKSFISYVVIINTKVIHLEAHKMQNKVLRIIIIVMLVSVVLALLLTSIIPIL

SEQ ID NO: 595 - DNA, 699 bp, Staphylococcus aureus
gtggctgtcatgaataaagctgaaaggcaaaatttaataattactgcaattcaacaaaataaaaaaatgaccgctttagaattagctaaatattgcaacgtatccaaacgcacaattttaagagatattgatgatttagaaaatcaaggtgttaaaatttatgcgcattatgggaaaaatggtggttaccaaatacaacaagcacaatctaaaattgcattaaacttatctgaaacacaattatcagccttatttttagtgcttaatgaaagtcagtcgtactcgacattaccatataaaagcgaaatcaacgcaattataaaacaatgtttaagtcttccacaaacacgcttaagaaaattgcttaaacgcatggacttttatattaaatttgatgacacacaacatatgacactcccaatgctgttttccgacattttaatttattgtacagaacgaaatgtgatgttagtagatcatagggttgatgataatattaaagctgaaaacgttatatttattggccttttgtgtaaacatggacattggcatgcagtcatttatgacattgctcaagacaaaactgccgaactcgaaattgaaaatattatagatatttcgtattcattcggtaagacgattcaaaccagagacatatccattgataactatcatcaatttttaaaccccatcgattcc

SEQ ID NO: 596 - protein, 233 aa, Staphylococcus aureus
  MISC_FEATURE (1)..(233): conserved hypothetical
VAVMNKAERQNLIITAIQQNKKMTALELAKYCNVSKRTILRDIDDLENQGVKIYAHYGKNGGYQIQQAQSKIALNLSETQLSALFLVLNESQSYSTLPYKSEINAIIKQCLSLPQTRLRKLLKRMDFYIKFDDTQHMTLPMLFSDILIYCTERNVMLVDHRVDDNIKAENVIFIGLLCKHGHWHAVIYDIAQDKTAELEIENIIDISYSFGKTIQTRDISIDNYHQFLNPIDS

SEQ ID NO: 597 - DNA, 807 bp, Staphylococcus aureus
gtggtggacgaaatgacagataaaacattacagcaaatagataagttaatatgttcgtggttgaaacaaatagacaatgttattccgcaattaattatggaaatgactacagaaactaagcgtcatcgatttgatttagttacaaatgtagataaacagattcaacaacaattccaacaatttttagcaacacattttccggaacaccaactattagcggaagaaaaaagtaatgaaatgattacgaatgaaattaatcatttatggattatggatcccattgatggaactgccaatttagtaaaacagcaagaagattattgtattatattggcgtatttttatgaaggtaaaccaatgttatcgtacgtatatgattatccgcataaaaagctttataaagcaatacgaggagaaggtgctttttgtaatggaattaagatggaagaaccaccatcgttaaaattggaagacgctattatatcgtttaatgcacaagtgatgaatctagatacggtgcaagatttatttgacgcctcatttagttatcgtttagttggtgcttgcggattagattctatgcgagtggcaaaaggtcaatttggggcacatattaatacaaatcctaaaccttgggacattgctgcacagtttttatttgcagaactattgaatctaaaaatgacgactttagatggtaaggcaattgatcatttaaagggtgcaccttttattataagtaataaagcatgtcatgaaacggtacttaaaattttaaatgcaaatggtggttatcaaaaatacaga

SEQ ID NO: 598 - protein, 269 aa, Staphylococcus aureus
  MISC_FEATURE (1)..(269): hypothetical protein
VVDEMTDKTLQQIDKLICSWLKQIDNVIPQLIMEMTTETKRHRFDLVTNVDKQIQQQFQQFLATHFPEHQLLAEEKSNEMITNEINHLWIMDPIDGTANLVKQQEDYCIILAYFYEGKPMLSYVYDYPHKKLYKAIRGEGAFCNGIKMEEPPSLKLEDAIISFNAQVMNLDTVQDLFDASFSYRLVGACGLDSMRVAKGQFGAHINTNPKPWDIAAQFLFAELLNLKMTTLDGKAIDHLKGAPFIISNKACHETVLKILNANGGYQKYR

SEQ ID NO: 599 - DNA, 1245 bp, Staphylococcus aureus
atgacacaatttacaaacctgataaatctgtgtaacgtcaattactgtaacattttatttcatcaatttttaccgtttggcgtacatgaaaattttgataaaaggggttccattatgattaatgagcaaagattacttaatacgttttttgaacttgtacaaatcgattctgagacagggaatgaatcaacaatccaacctattttaaaagaaaaattcatagcattagggttagatgttaaagaagatgaagcggctaaacatcctaaattaggtgccaataatctagtgtgtacaatgaatagtactatcgaagaaggcgaagtacctaaattatatttgacgagccatatggatactgttgtacccgcaattaatgtaaagccaattgtaaaagatgacggctacatatactctgatggtacgactattctaggtgcagatgataaagcaggattatcagcgatgcttgaagttttgcaagtgataaaggaacaacaaatcccacatggacaaattcaatttgtgattactgttggagaagaatcaggtttaattggtgctaaagaattaaattcagagttgttggacgcggactttggttatgctattgatgcaagtgctgatgtcggtactacggttgtaggtgcaccgacgcaaatgttaatttcagctaaaatttttggcaaaacggctcatgcaagtacgccaaaagagggtgttagtgctattaatattgcggcgaaagcaattagtcgaatgaaattaggacaagttgatgaaataactactgccaatattggtaagtttcatggcggttcagctacgaatattgttgcagatgaagtcattttagaagcagaggcacgttctcacgatccagaaagaataaaaacacaagtcaaacatatgactgatgtgtttgaaactactgcatcagaattaggtgggaaagcagtagttacagtggagcaaagttatccaggatttaaaattaatgataatgaagcggttgttaaaattgcacaagaaagtgctcgtaatttaggattatctgcaaatacaattatttctggtggcggttcagacggcagtattattaatacatttggtattccttcagtcattttaggagtgggttatgaaaaaatccatacaacaaatgagagaatgccgattaaatcattgaacttgcttgcaagtcaagtgttagaaataatcaaaatagttgcgcgacattcgaaa

SEQ ID NO: 600 - protein, 415 aa, Staphylococcus aureus
  MISC_FEATURE (1)..(415): hypothetical protein
MTQFTNLINLCNVNYCNILFHQFLPFGVHENFDKRGSIMINEQRLLNTFFELVQIDSETGNESTIQPILKEKFIALGLDVKEDEAAKHPKLGANNLVCTMNSTIEEGEVPKLYLTSHMDTVVPAINVKPIVKDDGYIYSDGTTILGADDKAGLSAMLEVLQVIKEQQIPHGQIQFVITVGEESGLIGAKELNSELLDADFGYAIDASADVGTTVVGAPTQMLISAKIFGKTAHASTPKEGVSAINIAAKAISRMKLGQVDEITTANIGKFHGGSATNIVADEVILEAEARSHDPERIKTQVKHMTDVFETTASELGGKAVVTVEQSYPGFKINDNEAVVKIAQESARNLGLSANTIISGGGSDGSIINTFGIPSVILGVGYEKIHTTNERMPIKSLNLLASQVLEIIKIVARHSK

SEQ ID NO: 601 - DNA, 1404 bp, Staphylococcus aureus
atgacacaacaaattggagttattggtttagccgttatgggtaaaaacctagcttggaatattgaatcacgcggatatagtgtatctgtatttaaccgctcaagtgaaaaaactgatttaatggttgaagaatcaaaagggaaaaatattcatccaacgtattcattggaagaatttgttaattctttagaaaaaccacgtaaaattttattaatggttcaagcaggtaaagctacggacgcaacgattgatagtttgttacctttattagatgatggagatattttaattgatggtggtaatacaaactatcaagatactatcagacgtaataaagcattagcacaaagtgcaatcaactttattggtatgggcgtttctggtggtgaaattggagcgttaactggtccgtcattaatgccgggtggacaagaagaagcttataacaaagttgcagatattcttgatgcaattgctgcaaaggcaaaagacggtgcttcatgtgttacttatattggacctaatggtgctggacactatgtgaaaatggtacacaatggtatcgaatatgctgacatgcaattaattgcagaaagttatgctatgatgaaagaattattaggcatgtctcatgaagacattgctcaaacgttcaaagactggaatgctggtgaattagaaagttatttaattgaaatcactggtgatattttcatgaaattagatgaaaataaagaagcattagttgaaaaaattcttgatactgcaggtcaaaaaggtacaggaaaatggacttcaattaacgcattagaattaggtattccattaacaatcattactgaatctgtatttgcacgttttatctcttcaatcaaagaagagcgcgtaaatgcttctaaagaattaaatggtccaaaagcatcatttgatggtgacaagaaagactttttagaaaaaattcgtaaagcattatatatgagtaaaatttgttcttatgcacaaggtttcgcgcaaatgcgtaaagcaagtgaagataatgaatggaatttaaaacttggtgatttagctatgatttggagagaaggttgcattatccgtgcacaattcttacaaaagatcaaagatgcttacgataataatccaggattacaaaacttattgctagatccttactttaaaaacatcgttactgaatatcaagatgcgttacgtgatgttgtcgcaactggtgttcaaaatggtgtaccaacacctggtttctcatcaagtattaattactatgatagttaccgtgctgctgatttacctgcaaacttaattcaagcacaacgtgactacttcggtgctcatacgtacgaaagaaaagataaagaaggcgtattccatacacaatggattgaagaa

SEQ ID NO: 602 - protein, 468 aa, Staphylococcus aureus
  MISC_FEATURE (1)..(468): phosphogluconate
MTQQIGVIGLAVMGKNLAWNIESRGYSVSVFNRSSEKTDLMVEESKGKNIHPTYSLEEFVNSLEKPRKILLMVQAGKATDATIDSLLPLLDDGDILIDGGNTNYQDTIRRNKALAQSAINFIGMGVSGGEIGALTGPSLMPGGQEEAYNKVADILDAIAAKAKDGASCVTYIGPNGAGHYVKMVHNGIEYADMQLIAESYAMMKELLGMSHEDIAQTFKDWNAGELESYLIEITGDIFMKLDENKEALVEKILDTAGQKGTGKWTSINALELGIPLTIITESVFARFISSIKEERVNASKELNGPKASFDGDKKDFLEKIRKALYMSKICSYAQGFAQMRKASEDNEWNLKLGDLAMIWREGCIIRAQFLQKIKDAYDNNPGLQNLLLDPYFKNIVTEYQDALRDVVATGVQNGVPTPGFSSSINYYDSYRAADLPANLIQAQRDYFGAHTYERKDKEGVFHTQWIEE

SEQ ID NO: 603 - DNA, 369 bp, Staphylococcus aureus
atggaaaagttaaatcaagttatgttatatgttgatgatgtcgaaaaagcgaaagcattttggacagaaactttagaatttgttgttgtaagtgaaacaccgttagctgaggactatgttgcagttgaagtatcacctaccaaagatgctgaaacgtcattgacgattatggcaaaagaatttattgaaaagcatagcccggaagtgaacctaggaacaccatctttaatgtttaaagagaaaaactttgatgcattatactcaaaattaaatgatttaggtttaactgggcatgatatagtagaaatgaatggtcaacgtgtatttaattttcaagatggccaaggtaactattttgcagttagtgac

SEQ ID NO: 604 - protein, 123 aa, Staphylococcus aureus
  MISC_FEATURE (1)..(123): conserved hypothetical
MEKLNQVMLYVDDVEKAKAFWTETLEFVVVSETPLAEDYVAVEVSPTKDAETSLTIMAKEFIEKHSPEVNLGTPSLMFKEKNFDALYSKLNDLGLTGHDIVEMNGQRVFNFQDGQGNYFAVSD

SEQ ID NO: 605 - DNA, 1017 bp, Staphylococcus aureus
atggttacgattaaagatgttgcactaaaagccggtgtttctccttcgacagtttcaagagttataaaaggaaatcaacgtattagcgaagcgacaatttcaaaagtgaagaaagttatggaagaattgaattattttcctaataccgctgctagaactttaattacaaaccaaacatataaaattggtttagtgttaaaagggtctgaggagcctattcgactgaatccattctacatcaatgtattgctaggaatttctgaaacgtgtaaccagcatggctatggtacacaaacgacagtctcaaataatatgaatgatttaatggatgaagtttataaaatgattaaacaacgaatggttgatgcgtttatactgctctattcaaaagaaaatgatccgattaaacaaatgttaattgatgaaagcatgccatttattgtgattggtaagcctacatcggatatagatcatcaatttacacatatagataatgataatatattagcttctgaaaatttgacacgacatgttattgaacaaggtgtagatgaattaatatttattacagaaaaaggaaattttgaagtttcaaaagatagaattcaaggatttgaaacgatagcttctcaaaataaaattaattatcaaattattgagactagtaatgaaagagaagttatttttaattacatgcaaaatctacatacgcgtttgaaggacccaaatattaaacaggcaatcatttcgttagatgctatgttacatttagcgattttaagtgtcctatatgaacttaatattgaaattccgaaagatgtaatgacagcaacgttcaatgattcttatttaaccgaaattgcgtcaccaccacaaacctgtattgacatcaagcctcgaatgttaggtcaacaggctggtgcagcaattttaaatatattgaaaaacaaagcacaggatgttattgaactcgtcattatagatacagaattaaaaataagaaaatcaacacagcga

SEQ ID NO: 606 - protein, 339 aa, Staphylococcus aureus
  MISC_FEATURE (1)..(339): maltose operon
MVTIKDVALKAGVSPSTVSRVIKGNQRISEATISKVKKVMEELNYFPNTAARTLITNQTYKIGLVLKGSEEPIRLNPFYINVLLGISETCNQHGYGTQTTVSNNMNDLMDEVYKMIKQRMVDAFILLYSKENDPIKQMLIDESMPFIVIGKPTSDIDHQFTHIDNDNILASENLTRHVIEQGVDELIFITEKGNFEVSKDRIQGFETIASQNKINYQIIETSNEREVIFNYMQNLHTRLKDPNIKQAIISLDAMLHLAILSVLYELNIEIPKDVMTATFNDSYLTEIASPPQTCIDIKPRMLGQQAGAAILNILKNKAQDVIELVIIDTELKIRKSTQR

SEQ ID NO: 607 - DNA, 1647 bp, Staphylococcus aureus
atgaataagcaatggtggaaagaagcagtagcatatcaagtatatccaagaagttttaatgatagtaatcacgatggtattggggatttacctggaatgattgataaattggactacttaaaagatttcggtatcgatgtcatttggctcagtccaatgtttaaatcacctaatgatgacaatggttatgatattagtgactaccaagagattatggatgaatttggaacgatggaagactttgatcgtttattaaaaggtgttcatgatagaggcatgaagcttattttagatttagttgtaaatcatacatctgatgaacatccttggtttatagaatccaaatctagtaaagacaatcccaaacgtgattggtacatttggcaagatccaaagccagatggctctgaacctaacaactgggaaagtatatttaatggatctacatgggaatatgatgctaatactgagcaatattatttccatttattcagtaaaaaacaacctgatttgaattggggtaatccggaagttagagatgctgtatttgaaatgatgaactggtggtttgataaaggcattgatggatttagagtagatgcaattacgcatattaagaagacgtttgaagcgggtgacttacctgtacctgagggtaaaacatatgccccagcatttgatgtagatatgaatcagccaggtatacaaacttggttacaagagatgaaagatcgctcattaagtaagtatgacattatgactgttggtgaagcgaatggtgtaagccctgatgatgctgatgactgggtcggggaagaaaatggtaaatttaatatgatattccaatttgaacatttgggactgtggaatagtggtgattctcactttgatgtaaattcgtataaatctgtattaaatagatggcaaaaacaacttgaaaataaaggttggaatgcgttgtttattgaaaatcacgaccaaccacgacgtgtatcgacgtggggtgacgatgacaagtattggtatgaatcagcaacaagtcatgcagctgtttatttcttgcaacaaggtacgccattcatttatcaaggtcaagaaattggtatgacgaattatccatttgaaagtattgaaacgtttaacgatgttgctgttaaaaatgactatcaaatagtgaaagctcaaggtggagatgtagacgctttacttgcgaaatataaagatgagaaccgagataattctcgcacaccaatgcaatgggatgatacgttaaatggaggatttacaaatggtgaaccgtggttcccagtgaatccgaattataaaactatcaatgttgcacaacaattagaagatgagcattcagtattacaattttataaagatttaattcaattaagaaagtctaatgatgtatacgtatatggtcaatttgatttagtagatgctgaaaattcacaagtttttgcgtacacgagaacattaaatgaaaagcaagttcttattgtaggtaatcttactaaccacgaagcagaattaactgtaccatttgatttaagccatggagaagtaaagctatttaattatgatgccaaagttaatttaaaacagttacgtccatatgaagcatgtgttatcgaactaaat

SEQ ID NO: 608 - protein, 549 aa, Staphylococcus aureus
  MISC_FEATURE (1)..(549): alpha-D-1,4-glucosidase
MNKQWWKEAVAYQVYPRSFNDSNHDGIGDLPGMIDKLDYLKDFGIDVIWLSPMFKSPNDDNGYDISDYQEIMDEFGTMEDFDRLLKGVHDRGMKLILDLVVNHTSDEHPWFIESKSSKDNPKRDWYIWQDPKPDGSEPNNWESIFNGSTWEYDANTEQYYFHLFSKKQPDLNWGNPEVRDAVFEMMNWWFDKGIDGFRVDAITHIKKTFEAGDLPVPEGKTYAPAFDVDMNQPGIQTWLQEMKDRSLSKYDIMTVGEANGVSPDDADDWVGEENGKFNMIFQFEHLGLWNSGDSHFDVNSYKSVLNRWQKQLENKGWNALFIENHDQPRRVSTWGDDDKYWYESATSHAAVYFLQQGTPFIYQGQEIGMTNYPFESIETFNDVAVKNDYQIVKAQGGDVDALLAKYKDENRDNSRTPMQWDDTLNGGFTNGEPWFPVNPNYKTINVAQQLEDEHSVLQFYKDLIQLRKSNDVYVYGQFDLVDAENSQVFAYTRTLNEKQVLIVGNLTNHEAELTVPFDLSHGEVKLFNYDAKVNLKQLRPYEACVIELN

SEQ ID NO: 609 - DNA, 891 bp, Staphylococcus aureus
atgattgaattaattggagtgaaagttttggacgttatcaagcaaatacaacaggcaattgtttatattgaagatcgtttattagagcctttcaatttgcaagaattaagtgattacgttggtctttcgccataccatcttgatcaatcatttaaaatgattgtcggcttatctccagaagcttatgcacgcgcgcgtaaaatgacactcgctgcaaatgatgtgattaatggtgctacacgacttgtagatatcgctaaaaaatatcactatgcaaattcaaatgattttgcaaatgattttagtgattttcacggcgtatcacctattcaagcctctactaaaaaagatgaattacaaattcaagagcgattatatatcaaattatcaactactgagagagcaccttatccatacagattagaagagacagatgatatttcattggttggatatgcacgatttatagacactaagtatttgtcacatccttttaatgttccggattttttagaagacttgctcattgatggtaaaattaaagagttacgacgatataatgacgttagtccatttgaactatttgttattagttgtcctcttgaaaatggtttagaaatatttgtaggtgtaccaagtgaacgttatcctgcacacttagaaagtcgatttttacctggcaaacattgtgcgaaattcaatttacaaggtgaaattgattatgcaactaatgaagcttggtactatattgaatcaagtttgcagttaacattgccatatgaacgaaatgatttatatgttgaagtgtaccctctcgatatttcatttaatgacccattcactaaaattcagctttggattcctgttaaacagagtccttatgacgaagat

SEQ ID NO: 610 - protein, 297 aa, Staphylococcus aureus
  MISC_FEATURE (1)..(297): transcription regulator
MIELIGVKVLDVIKQIQQAIVYIEDRLLEPFNLQELSDYVGLSPYHLDQSFKMIVGLSPEAYARARKMTLAANDVINGATRLVDIAKKYHYANSNDFANDFSDFHGVSPIQASTKKDELQIQERLYIKLSTTERAPYPYRLEETDDISLVGYARFIDTKYLSHPFNVPDFLEDLLIDGKIKELRRYNDVSPFELFVISCPLENGLEIFVGVPSERYPAHLESRFLPGKHCAKFNLQGEIDYATNEAWYYIESSLQLTLPYERNDLYVEVYPLDISFNDPFTKIQLWIPVKQSPYDED

SEQ ID NO: 611 - DNA, 1482 bp, Staphylococcus aureus
ttgagtactaaaaacaaacacatcccatgtttaatcacaatctttggtgcaactggtgacttaagccatcgtaagttgtttccatcaatattccatctctaccaacaagacaatttagatgaacatattgccatcatcggtattggacgtcgtgacattactaatgatgatttccgtaatcaagtaaaatcatcaattcaaaagcacgtaaaagatacaaacaaaattgacgcgtttatggaacatgtcttctatcatagacatgatgttagtaatgaagaaagctatcaagaattactagattttagtaatgaattagatagccaatttgaattaaaaggtaatcgactattctatttagcaatggcaccacaattctttggcgttatttctgattatctaaaatcttctggtcttactgatacaaaaggatttaaacgccttgttatcgaaaaaccattcggtagtgatttaaaatcagccgaagcattaaacaatcaaattcgtaaatcatttaaagaagaagaaatttatcgtattgaccactatttaggaaaagacatggttcaaaatatcgaggtattacgttttgcgaatgcgatgtttgaaccattatggaataacaaatatatttcaaacatccaagttacatcttctgaaatactaggtgttgaagatcgtggtggttattatgaatcaagtggcgcgctaaaagatatggtgcaaaaccacatgttacaaatggttgcattattagctatggaagcacctattagtttaaatagtgaagatatccgtgctgagaaagtaaaagtacttaaatcactgcgtcatttccaatctgaagatgttaaaaagaactttgttcgtggtcaatatggcgaaggctatatcgatggtaaacaagttaaagcataccgtgatgaagatcgcgttgcagatgactctaacacacctacctttgtttcaggtaaattaacaattgataactttagatgggctggtgtaccattctatattcgtactggtaaacgtatgaaatctaaaacaattcaagttgtcgttgaatttaaagaagtaccaatgaacttatactatgaaactgataaactgttagattcaaacctattagtaatcaatatccaacctaatgaaggtgtatctttacatctaaatgctaagaaaaatacacaaggtatcgaaacagaacctgtccaattgtcttactcaatgagcgctcaagataaaatgaatactgtagatgcatatgaaaatctattatttgattgtcttaaaggtgatgccactaacttcacgcactgggaagaattaaaatcaacatggaaatttgttgatgcaattcaagatgaatggaatatggttgatccagaattccctaactatgaatcaggtactaatggtccattagaaagtgatttactacttgctcgtgatggtaaccattggtgggacgatattcaa

SEQ ID NO: 612 - protein, 494 aa, Staphylococcus aureus
  MISC_FEATURE (1)..(494): glucose-6-phosphate
LSTKNKHIPCLITIFGATGDLSHRKLFPSIFHLYQQDNLDEHIAIIGIGRRDITNDDFRNQVKSSIQKHVKDTNKIDAFMEHVFYHRHDVSNEESYQELLDFSNELDSQFELKGNRLFYLAMAPQFFGVISDYLKSSGLTDTKGFKRLVIEKPFGSDLKSAEALNNQIRKSFKEEEIYRIDHYLGKDMVQNIEVLRFANAMFEPLWNNKYISNIQVTSSEILGVEDRGGYYESSGALKDMVQNHMLQMVALLAMEAPISLNSEDIRAEKVKVLKSLRHFQSEDVKKNFVRGQYGEGYIDGKQVKAYRDEDRVADDSNTPTFVSGKLTIDNFRWAGVPFYIRTGKRMKSKTIQVVVEFKEVPMNLYYETDKLLDSNLLVINIQPNEGVSLHLNAKKNTQGIETEPVQLSYSMSAQDKMNTVDAYENLLFDCLKGDATNFTHWEELKSTWKFVDAIQDEWNMVDPEFPNYESGTNGPLESDLLLARDGNHWWDDIQ

SEQ ID NO: 613 - DNA, 132 bp, Staphylococcus aureus
atgtttaatgtgatacttattaatgataagtataacgtaattatcaaaatttatatagttatgtctacgttaaagttagaaaaattaactagcaaagacgaatttttaacagattttgattcaagtataaat

SEQ ID NO: 614 - protein, 44 aa, Staphylococcus aureus
MFNVILINDKYNVIIKIYIVMSTLKLEKLTSKDEFLTDFDSSIN

SEQ ID NO: 615 - DNA, 918 bp, Staphylococcus aureus
atggaagttacattttttggaacgagtgcaggtttgcctacaaaagagagaaatacacaagcaatcgccttaaatttagaaccatattccaattccatatggcttttcgacgttggtgaaggtacacagcaccaaattttacatcatgcaattaaattaggaaaagtgacacatatatttattactcatatgcatggcgatcatatttttggtttgccaggattactttctagtcgttcttttcagggcggtgaacagaagccgcttacattggttggaccaaaaggaattaaagcatatgtggaaatgtctatgaatttatcagagtcacatttaaactatccaattacatatattgaaatcgatgatcatctgacatatcatcatgatggttttactgtagaggcgcatttacttaatcatggtattccatcatatggatatagagtaatggcacctgaaactacaggtacaatcaatgttgaagcgttaaaaaacattggtcttgaaccaggtcctaaatatcaagaagtaaaatctcatgatacatttgaacataatggtcaagtttatcaatcaaaagattttagaggtgagtccaaacagggtccagttgtagcaatttttggtgatacaaaaccatgttctaatgaacgtgtgatttctagagatgctgatgtgatggtacatgaagcgacctatatagatggtgaaaagcatttagccaacaattatcatcatagccatattgaagacgtatttgcattgataaaagaagccaatgttaaacgtacgttgattacacatttgagcaatcgctataatacagaagatataaatgaaatttatcaaacattgatacaaaatgaagatacacctaattttaattttgtaaaagattttgatagttttaaaatc

SEQ ID NO: 616 - protein, 306 aa, Staphylococcus aureus
  MISC_FEATURE (1)..(306): conserved hypothetical
MEVTFFGTSAGLPTKERNTQAIALNLEPYSNSIWLFDVGEGTQHQILHHAIKLGKVTHIFITHMHGDHIFGLPGLLSSRSFQGGEQKPLTLVGPKGIKAYVEMSMNLSESHLNYPITYIEIDDHLTYHHDGFTVEAHLLNHGIPSYGYRVMAPETTGTINVEALKNIGLEPGPKYQEVKSHDTFEHNGQVYQSKDFRGESKQGPVVAIFGDTKPCSNERVISRDADVMVHEATYIDGEKHLANNYHHSHIEDVFALIKEANVKRTLITHLSNRYNTEDINEIYQTLIQNEDTPNFNFVKDFDSFKI

SEQ ID NO: 617 - DNA, 822 bp, Staphylococcus aureus
gtgacgttaatgaaactcgtattttatggagctggtaatatggcacaagctatatttacaggaattattaactcaagcaacttagatgccaatgatatatatttaacaaataaatctaatgaacaagctttaaaagcattcgctgaaaaactaggtgttaactatagttatgatgatgcgacattattaaaagatgcagattatgtatttttaggtaccaaaccacatgactttgatgctctagcaacacgcatcaaaccacatattacaaaagacaattgcttcatttcaattatggcaggtattccgattgattatattaaacaacaattagaatgccaaaatccagttgctagaattatgccaaacacaaatgcgcaagttggacactctgttactggcattagtttttcaaacaactttgaccctaaatctaaagatgaaattaacgatttagttaaagcatttggttctgtaattgaagtatcagaagatcatttacatcaagtaacagctatcaccggaagcggcccagcatttttatatcatgtattcgagcaatatgttaaagctggtacgaaacttggtctagaaaaagaacaagttgaagaatctatacgcaaccttattataggtacaagtaagatgattgaacgttcagatttgagcatggctcaattaagaaaaaatattacctctaaaggtggtacgacacaagctggccttgatacattgtcacaatatgatttagtatctattttcgaagattgtctaaacgctgccgtcgaccgtagtattgaactttctaatatagaagaccaa

SEQ ID NO: 618 - protein, 274 aa, Staphylococcus aureus
  MISC_FEATURE (1)..(274): hypothetical protein
VTLMKLVFYGAGNMAQAIFTGIINSSNLDANDIYLTNKSNEQALKAFAEKLGVNYSYDDATLLKDADYVFLGTKPHDFDALATRIKPHITKDNCFISIMAGIPIDYIKQQLECQNPVARIMPNTNAQVGHSVTGISFSNNFDPKSKDEINDLVKAFGSVIEVSEDHLHQVTAITGSGPAFLYHVFEQYVKAGTKLGLEKEQVEESIRNLIIGTSKMIERSDLSMAQLRKNITSKGGTTQAGLDTLSQYDLVSIFEDCLNAAVDRSIELSNIEDQ

SEQ ID NO: 619 - DNA, 954 bp, Staphylococcus aureus
gtggtgggattgaaacgttcgtctaaaagtaaaatgagcctaccgaaaaaaatatttttatgggtattcggtattttagtaatcttagcgattgtagctgttgtgtatgtagctgctaaaatttttattactggtaataagatacacaatccgttagatcgcaatcattcagaattaagagataaaaaagtgagtttaaacgatggtgatccattcacaatcgctttatttggtgtcgattcagatgctgatcgtaagaaaaagggtggcggagagcgtagtgatagtattatgattttatctatcaaccctaaaacgaagaaaactgaaatagtaagtataccgcgtgatacaagagcggaaattgttggccgtggtactactgaaaaaattgcacatgcctatgcatatggtggaccaaatatggctgttaaatcacttgaaaaattaatgaatgtgccaattgatcattatgcgacaatcgatatggatggtttgcataatatgatagatagcatcggcggtgttgatgtagtaagtaatgatacattcactgttgatggtgttcgttttacaaaaggacagcagacacatgtaaatggtgatcaagcattgaagtttattagaagtcgtaaagaagaaggtgctggtggtgactttggtcgacaacaacgtcagcaaattgtgcttgaagcgatggccaataagattgcaagcccatcatcgattacacattttaatagtctaatgaatgaaattcaaaataatgttaaaacagatttaacattaggtgatttgaatacgattagaagcaattataaagatgctaatgacacgattaataaacatcaattgagtggtcaaggcggcattcaaagtgacggattgtactacttcattcctagtgagcagtcaaaagctgaaagtactaagttattaaaagataatctagag

SEQ ID NO: 620 - protein, 318 aa, Staphylococcus aureus
  MISC_FEATURE (1)..(318): hypothetical protein
VVGLKRSSKSKMSLPKKIFLWVFGILVILAIVAVVYVAAKIFITGNKIHNPLDRNHSELRDKKVSLNDGDPFTIALFGVDSDADRKKKGGGERSDSIMILSINPKTKKTEIVSIPRDTRAEIVGRGTTEKIAHAYAYGGPNMAVKSLEKLMNVPIDHYATIDMDGLHNMIDSIGGVDVVSNDTFTVDGVRFTKGQQTHVNGDQALKFIRSRKEEGAGGDFGRQQRQQIVLEAMANKIASPSSITHFNSLMNEIQNNVKTDLTLGDLNTIRSNYKDANDTINKHQLSGQGGIQSDGLYYFIPSEQSKAESTKLLKDNLE

SEQ ID NO: 621 - DNA, 756 bp, Staphylococcus aureus
ttgatgaaaggacaacattttatagtgactggtggtacgagtggtttaggtttatcgattgtccgaaagttactagaaaataaagtgcatgtaacgttgttggtgcgtgatgttgataaagcaactagaatctttgaacaggaattggggaaaactataaatgttattccttgtgacttaaatgatttgaagtcgatacaggcactgcaatttgaagacaatacatcattcgatggattcatttatagtgcaggtttaggttatttcaaatctatttcagaccatagtttttcagaaatgattgaaacgtatcagcttaatttaattagttttaatgttttatatactgtgttgagaccatatttaacatctaacgcacatattgtaggtatttcaagtcaagctgcattttccacacaagcaaatgctgcacattatggggcatcgaaagcagggttttatgcattaatgaatgctttaagactagagtcaccaaacttacatatcatgacagttaatgttggcccgattgatacaccttttcatcaaaaagccgacccatcaatgaagtatgctaaaaagatgggggaaattatgcttgatgctaatcagcttgcagaagatatcatttatggcattaaaacaaaacaattggaaattaatcggcctaaatggatgcatcatgcgttgaaaatgtatcaaattgcgcctagattttttgaacgatgtttccctaaattatttaaaaataaagca

SEQ ID NO: 622 - protein, 252 aa, Staphylococcus aureus
  MISC_FEATURE (1)..(252): hypothetical protein
LMKGQHFIVTGGTSGLGLSIVRKLLENKVHVTLLVRDVDKATRIFEQELGKTINVIPCDLNDLKSIQALQFEDNTSFDGFIYSAGLGYFKSISDHSFSEMIETYQLNLISFNVLYTVLRPYLTSNAHIVGISSQAAFSTQANAAHYGASKAGFYALMNALRLESPNLHIMTVNVGPIDTPFHQKADPSMKYAKKMGEIMLDANQLAEDIIYGIKTKQLEINRPKWMHHALKMYQIAPRFFERCFPKLFKNKA

SEQ ID NO: 623 - DNA, 252 bp, Staphylococcus aureus
atggcaatgaactgtcaatcggagagtgtggtaagactttgtgtacgatatgcggaacaactatcagtatttgaagaatttacagtgctggatattttaggcgatatttctgtagaccaaatttcagacggtacattatattatacttgtgaaaaattcaaactacttgtgttgcaaggaaatgtgctgggtgtacaaataataactaataatgatgaatcaacatgcgaagtgaaatatagaaagatgttt

SEQ ID NO: 624 - protein, 84 aa, Staphylococcus aureus
  MISC_FEATURE (1)..(84): hypothetical protein
MAMNCQSESVVRLCVRYAEQLSVFEEFTVLDILGDISVDQISDGTLYYTCEKFKLLVLQGNVLGVQIITNNDESTCEVKYRKMF

SEQ ID NO: 625 - DNA, 906 bp, Staphylococcus aureus
atgcaaaaaaatatattaaaaagtggtatttcattatctgaattaggtctaggttgcatgagtttaggtacagatttaaaaaaagccgaacaaattatagattgtgctgttgaaaatggtatcacttattttgatacagcagatatgtacgataaaggtataaatgaatcagttgttggtaaggcacttcttaaatatcaacaacgcgatgatatttttattggtacaaaagtaggcaatcgtttaacaaaagatggcagtacaacatgggatccgagtaaatcctatattaaagaggcagttaaaggttcactaaagcgtttaggtatcgatcatatcgatttatatcaacttcatggcggaaccattgatgacccattagacgaaacaataagcgcatttgatgaattgaaacaagaaggaattatacgtgcttacggtatttcttctattcgcccaaatgtaattgattattatttaaaacatagtcaaatcgaaacgataatgtctcaattcaatttgattgataatcgtccagaatcattattagatgcaattcacaacaatgatgttaaagtattggcaagaggacctgtgtctaaaggattattaacttcaaacagtgttaatgtgctcgacaataaatttaaagatggtatttttgattattctcatgatgaattgggtgaaacaatagcctctattaaagaaattgaaagtaatttatctgcattgacatttagttatttaacatcacatgacgtgcttggttccatcattgtaggtgcaagtagcgtcgaccaattaaaagaaaatattgaaaactatcatactaaagttagtttagatcagattaaaacagcaagagctcgtgtaaaggatttggaatataccaatcatttagtg

SEQ ID NO: 626 - protein, 302 aa, Staphylococcus aureus
  MISC_FEATURE (1)..(302): conserved hypothetical
MQKNILKSGISLSELGLGCMSLGTDLKKAEQIIDCAVENGITYFDTADMYDKGINESVVGKALLKYQQRDDIFIGTKVGNRLTKDGSTTWDPSKSYIKEAVKGSLKRLGIDHIDLYQLHGGTIDDPLDETISAFDELKQEGIIRAYGISSIRPNVIDYYLKHSQIETIMSQFNLIDNRPESLLDAIHNNDVKVLARGPVSKGLLTSNSVNVLDNKFKDGIFDYSHDELGETIASIKEIESNLSALTFSYLTSHDVLGSIIVGASSVDQLKENIENYHTKVSLDQIKTARARVKDLEYTNHLV

SEQ ID NO: 627 - DNA, 549 bp, Staphylococcus aureus
gtgattataatggatttaaatgaaaaaacaattgatcgaacagttatttataatggcaaaattgtagatgtagaaattcatacagtgacattaccaaacggtgaaacgtcaacaagagaattagtttatcataatggtgcagttgctgtttgtgcagtgacacctaaaaaagaagtcgtattagtgaaacagtatcgtaaaccagtagaaaaaccattgctagaaattccagctggtaaattagaagatgatgaagatagagtcgaagcggcaaaacgtgaattagaagaagaaacaggatatattgccaaagagttaacacatgttgtagatatgtatggttcaccaggtttttgcgatgaacaattatcaatatattttacggataatttagaagaaggtacagttcacttagatgaagatgaatttgtcgaagtcattaaagttccgattgagaatgttaaatcgatgctaatgaataaagaaatagaagatgcgaagactatcattgcattgcaacacctattattaaattataatcattctaaa

SEQ ID NO: 628 - protein, 183 aa, Staphylococcus aureus
  MISC_FEATURE (1)..(183): conserved hypothetical
VIIMDLNEKTIDRTVIYNGKIVDVEIHTVTLPNGETSTRELVYHNGAVAVCAVTPKKEVVLVKQYRKPVEKPLLEIPAGKLEDDEDRVEAAKRELEEETGYIAKELTHVVDMYGSPGFCDEQLSIYFTDNLEEGTVHLDEDEFVEVIKVPIENVKSMLMNKEIEDAKTIIALQHLLLNYNHSK

SEQ ID NO: 629 - DNA, 447 bp, Staphylococcus aureus
ttggaagaacgattaaatcgcgttaagcaacaattacaacaatcatcatataagctaacgccacaacgcgaagctactgttagagttctaattgaaaatgaaaaagatcatctaagtgctgaagacgtatatctgaaagtaaaagataaagcgcctgaaattggcttggcgacagtatacagaacgttagagttgttagctgaactaaaagttgtcgacaaaattaactttggtgatggcgtcgctcgttttgatttaagaaaagaaggcgcaaaacatttccaccatcatttagtatgtatggaatgtggtcgtgtagatgaaatcgatgaagatttgttaccagaagttgaaaatcgagttgaaaatgagttcaattttaaaattttagatcatcgtttaactttccatggtgtgtgtgaaacgtgccaagctaaaggtaaagga

SEQ ID NO: 630 - protein, 149 aa, Staphylococcus aureus
  MISC_FEATURE (1)..(149): ferric uptake regulator
LEERLNRVKQQLQQSSYKLTPQREATVRVLIENEKDHLSAEDVYLKVKDKAPEIGLATVYRTLELLAELKVVDKINFGDGVARFDLRKEGAKHFHHHLVCMECGRVDEIDEDLLPEVENRVENEFNFKILDHRLTFHGVCETCQAKGKG

SEQ ID NO: 631 - DNA, 891 bp, Staphylococcus aureus
gtggttatggaaacaattattgaagaatatttgcgttttatacaaattgaaaaaggactaagttctaacacaattggtgcttatagacgtgatttgaaaaagtatcaagattatatgactgaacatcatatctcgcatattgattttatagatcgacaattaattcaagagtgtttggggcatttaatagaccaagggcaatctgctaaatctattgcgcgatttatttcaacaatccgtagttttcatcaatttgctataagagaaaaatatgcggcgaaagatccaacggtattattagattcaccaaaatatgacaaaaaattgcctgacgttttaaatgttgacgaagtgttggctttattagaaacgccagatttaaataaaattaatggatatcgtgatcgtacgatgttagaacttctgtacgcaacgggaatgcgtgtatctgaattgatacatttagagttagaaaacgtgaacttaataatgggatttgtacgcgtatttggtaaaggcgataaagaaagaattgtaccattaggcgacgcagtcattgagtacttaactacttatattgaaacgattagaccgcaacttttaaaaaagactgttactgaagtcttatttttaaatatgcatggtaaacctttatcacgacaagcaatatggaaaatgattaaacaaaatggtgtaaaggcaaacattaaaaagacgttaacgccacatacgttacgccactcttttgcgacacatttattggaaaatggcgcagatttaagagcagtgcaagagatgttaggtcactctgacatatctactacccaactctatacacatgtttcgaaatctcaaattagaaaaatgtataaccaatttcatcctagagca

SEQ ID NO: 632 - protein, 297 aa, Staphylococcus aureus
  MISC_FEATURE (1)..(297): site-specific recombinase
VVMETIIEEYLRFIQIEKGLSSNTIGAYRRDLKKYQDYMTEHHISHIDFIDRQLIQECLGHLIDQGQSAKSIARFISTIRSFHQFAIREKYAAKDPTVLLDSPKYDKKLPDVLNVDEVLALLETPDLNKINGYRDRTMLELLYATGMRVSELIHLELENVNLIMGFVRVFGKGDKERIVPLGDAVIEYLTTYIETIRPQLLKKTVTEVLFLNMHGKPLSRQAIWKMIKQNGVKANIKKTLTPHTLRHSFATHLLENGADLRAVQEMLGHSDISTTQLYTHVSKSQIRKMYNQFHPRA

SEQ ID NO: 633 - DNA, 504 bp, Staphylococcus aureus
atgcaacaggcactgataaatttctattatcaatttcatactaagcaacattatttcctatgtcatgacattttagaagatgcatggaaagctgaaaataactacagtaagcaagatgcagttgttagtttaatcttgtttgcaactgcttgttaccattatcgccgcaataatttaaaaggcgcctataagtcttttaataaatctaaagaaataatacaaaatgctaaagatagagatgcgttataccttaatttaaatgattatcagttgttaattgagcaacagattgcaaaattgaatgcagcaaagcctttttcatctgttatattaccaataactccagtctttgaacgcatcatcaaggccaactatccagactatgattataatcaggaaacagcaacagatccttttattgtagaccatcacatgcgccgtgatcgttcagaagtgattgcagcaaaagaagaagcgattcaattaagaaaacatagacgtaat

SEQ ID NO: 634 - protein, 168 aa, Staphylococcus aureus
  MISC_FEATURE (1)..(168): conserved hypothetical
MQQALINFYYQFHTKQHYFLCHDILEDAWKAENNYSKQDAVVSLILFATACYHYRRNNLKGAYKSFNKSKEIIQNAKDRDALYLNLNDYQLLIEQQIAKLNAAKPFSSVILPITPVFERIIKANYPDYDYNQETATDPFIVDHHMRRDRSEVIAAKEEAIQLRKHRRN

SEQ ID NO: 635 - DNA, 819 bp, Staphylococcus aureus
ttgttatcaccccaatttaaaagtaagttattttcatgctataatattttagagaattatgcacatatgacgcaatacgaggtagatattatgtatgaagttaaattagatgctttcaatggaccattagatttattgctgcatcttatccaaaaatttgaaatagatatttatgatattcctatgcaagcattaacagagcagtatatgcagtacgttcatgcaatgaaacagcttgaaattaatattgcaagtgaatacctagtattagcgtcagaactcttaatgattaaaagtaagatgctattaccacaatcaacatcagatatggatgttgatgatgacccacgggaagatttagttgggcgtttaatagaatatcaaaattataaagaatatactgctattttaaatgacatgaaagaagaaagagatttttattttacaaaaagaccgacagatttatctcatttggaaacagatgaatcttgggatccaaatcatacgattgatttaactgaattaattgtagcttatcaaagagttaaaaatagagttgagttaaatacacctaaatctgttgaaatccgaaaagagacatttaccattcaacaagctacagaacaagtgacatcgagattgaaagataaagatcattttaacttctttagtctgtttacgttttctgagccaattgaacaagtagtcactcactttttagctattttagagatgtcaaaagcaggaataattaatattgagcaacaacgtaattttgaagatattaacattattagaggagtgaactaccattttgga

SEQ ID NO: 636 - protein, 273 aa, Staphylococcus aureus
  MISC_FEATURE (1)..(273): conserved hypothetical
LLSPQFKSKLFSCYNILENYAHMTQYEVDIMYEVKLDAFNGPLDLLLHLIQKFEIDIYDIPMQALTEQYMQYVHAMKQLEINIASEYLVLASELLMIKSKMLLPQSTSDMDVDDDPREDLVGRLIEYQNYKEYTAILNDMKEERDFYFTKRPTDLSHLETDESWDPNHTIDLTELIVAYQRVKNRVELNTPKSVEIRKETFTIQQATEQVTSRLKDKDHFNFFSLFTFSEPIEQVVTHFLAILEMSKAGIINIEQQRNFEDINIIRGVNYHFG

SEQ ID NO: 637 - DNA, 540 bp, Staphylococcus aureus
ttggataatcatggtatattagagtcgcttttatttacagctggcgatgaaggtttagatgaaaaacaactattagaaatattagatatgtcgaaagaccaactcgttgaattaattgaaaattattcatcacatggattaatgatacaacgatttggaatgacgtatgttttaacgactaaaaaagaagcggcaacgtatattgaacaattaattgaacaaaagtcacaaatgaaattatcacaagcagcaatggaagtactatcaattattgcttataaccagccattatcaagaagtgatattgaattaattcgtagtatcaattcagatggtgcagttaagacattgattgccaaaggactagttgaggctaaagtggttaatgaacagcgtagccaacagttaattactactgatttatttttaaatgtatttggtatttccaatatagaagatttgccgacaactgaagaagacgatgaagaaatggatgcttttttcagtaatctagtcaatcaaaaaggagaaaataatgac

SEQ ID NO: 638 - protein, 180 aa, Staphylococcus aureus
  MISC_FEATURE (1)..(180): conserved hypothetical
LDNHGILESLLFTAGDEGLDEKQLLEILDMSKDQLVELIENYSSHGLMIQRFGMTYVLTTKKEAATYIEQLIEQKSQMKLSQAAMEVLSIIAYNQPLSRSDIELIRSINSDGAVKTLIAKGLVEAKVVNEQRSQQLITTDLFLNVFGISNIEDLPTTEEDDEEMDAFFSNLVNQKGENND

SEQ ID NO: 639 - DNA, 735 bp, Staphylococcus aureus
atgactaaagaattagaacgattacaaaaacgtatagctaatagcggttatacttcaagacgtaaggcagaaactttaatttctgaaggaaaagtgaaagtgaatggtacgactgtcactgaattaggaacaaaagtgaagccatcagatacgattgaagttgaaggtattaaaatagaactagaagacaaaatttacattttattccataaaccaactcaagtgataacaagtgtatctgatgatagaggacgtacagtggttacagattactttaaagatatagaagcacgtatttatcctgttggtcgtttagactatgatacttctggattgttattactcacaaatgatggtgaatttactaatttaatgacacatccaagatatcaaattaagaaaaaatatgttgcgaaattaaaaggttatttaatgagagaagaagtgaaagcgctagaaaaaggtattgaattagaagatggtatgacgcaaccggctgaagtgaaagttaagaaacaagataaagataaaaacacaacattggttgaaattacaattacagaaggtcgtaatcgccaagtcagaagaatgttcgaacattttggtcatcaagtgacgaaactgtctcgtattgaatatgggcctttaaatgttgtcggtttgaatgctggtgaaggacgtgtattgacgcctcatgaagtaaaagtgatgcgtcatttagcagaacatgggaaa

SEQ ID NO: 640 - protein, 245 aa, Staphylococcus aureus
  MISC_FEATURE (1)..(245): ribosomal large subunit
MTKELERLQKRIANSGYTSRRKAETLISEGKVKVNGTTVTELGTKVKPSDTIEVEGIKIELEDKIYILFHKPTQVITSVSDDRGRTVVTDYFKDIEARIYPVGRLDYDTSGLLLLTNDGEFTNLMTHPRYQIKKKYVAKLKGYLMREEVKALEKGIELEDGMTQPAEVKVKKQDKDKNTTLVEITITEGRNRQVRRMFEHFGHQVTKLSRIEYGPLNVVGLNAGEGRVLTPHEVKVMRHLAEHGK

SEQ ID NO: 641 - DNA, 3036 bp, Staphylococcus aureus
gtgtggggcatcgttattttaggtggatatgagcaatttattaaaagtcatttacggaaaatatatatagacggggtgagtaatatgcaagaacatttggtggttacacttgatggaaaagattatcttgtagaaccaggtacgaatttacttgaatttattaaatcacaagatacttttgtaccttcaatttgttataacgagtcgatgggaccaattcaaacatgtgatacatgtactgttgagattgacggtaaaattgaacgttcatgtagtacggtgattgatcgtccaatgactgtaaatactgtgaacaatgatgtgaaagatgctcaaaaagaagcgcttgatcgaattttagaaaagcatatgctgtattgtacagtatgtgattataataatggtgattgtgaaattcataatacgatggatgcatgggggcttcagcatcaaacgtatgaatataaagagaagccatacgaaaaagattacggcccattttatcgttatgatccaaatcaatgtatcttatgtgggcgttgtgtagaagcatgtcaagatatcgaagtgaatgaaactattagaattgattgggatcgtgaacatccacgtgttatttgggataatgatgtaccgattaatgagtcttcatgtgtatcttgtggtcaatgtgcgacggtatgtccatgtaatgccatgatggaagtgaatatggaaggtaatgcgggttatatgactgatacggaacctggttcattagcagcaatgattgatttaactaaaaaagcagaacctggttatggtccactatttgcaatctcagattcagaagcagaaatgcgtaaagagcgtattaagaaaactaaaacagtgtgtacttattgtggtgtgggttgttcatttgaagtttggactaaagatagagaaattttaaaagtacaaccatcacatgattctccagcaaataaaattgcgacttgtgttaaaggtaagttttcatggggacatattaattcagatcaacgattaactaaaccactagtaaggaaaaatggtgagttccatgaagtagaatgggatgaagctttaaacgtcattgcagataattttacagctattaaagaaaagcatggcccagatgcactatcattcatttcttcttctaaagcgacgaatgaagaatcgtatttaatgcaaaaattagcaagacaagttattggcacaaataacgttgataactgttcaagatattgccaagcacctgcaacaaaaggcttatttagaacggttggacacggcggtgactcaggtagtattgaagatttagaaaaagcggcaatgtctgtattgataggtactaatacagccgaagctcatccagttatcgcatcacgcatgaaacgtgcacaaaaattatttggtcaaaaaatacatgtatttgatattagaaaacatgaaatggcagaacgtgcggatcgtttttatcaacctaaaccaggtacggatttagcgtggttaagtgcagtgactaagtatattattgatcatgatttacacgataaagcatttattgatgagtgggtagatgattttgatgaatattacaaatcattagaaacatttacaatggcttttgctgaagaagcaacaggtattcctgaatcagaattgattaaatttgctgaagaatgtgctaaagctgaatctgttgtaatttgttgggcaatgggtattacacaacaagacattggtagtgactcaagtacagcgatttcaaacttattattagtaacaggtaattatcgtcgtcctggtactggtgcgtatccattacgtggacataataatgttcaaggatgtagtgatatgggaagtatgcctgataagattactggttatcaaagtattgaagcggatgatattcgcgctaaatttgaaaaagaatatggcgttaaattgaatccaaaagctggtaaagataatcatgaaatggtagaaggtatacatgacggagaagtacactcattgtacttatatggtgaagatacgggtattgtggattcaaatattaattttgtacaagctgcgtttgaaaaattagatttcatggtagtccaagatgaatttttaacattcacagcaacatacgcagatgttgtattgccagcaagtccttcacttgaaaaagacggtacttttacaaataccgaacgtcgtattcaacgtttataccaagcattagaacctcttggtgattcaaaacctgactggaaaattttccaagcaattgctaatagattaggatttgattggaattacaagcatcctagtgaaattatggatgaagtagcacgcttaacacctctatatgctggggtaagttatgatcgtttagaaggattcaatagtttacaatggccagtacaacctgatggtactgatgagcctattctatacttagaaggattcaattttgataatggtaaagcaaaattattcccattatcatttgataattactttaagcaagatgaaatttatgatattcatgtaaacaatggtcgattgttagagcacttccatgaaggtaatatgacttatcaaacaccaatgattaaatacaaagtgccacgtgcatttgttgaaatttctccagagcttgctgaagatagaggcattcatgaaggtgcagaagttaagctgatttctgaaacaggagaagcggtattacaagttcacgtgacagatcgtgttaaaggtaaagaaatctatattccattaaataatgatgcgatggaaaatggagatctaggtgcaattaacttattaactaatagtgatgttgatcaatacacggatacaccatcttataaacgtactagctgtcgtttggaggtaattacgaaacgtggtaagtcaccgttgaaccctaataatttccgtgtcaataaaaaacgtcaaccgcagtacagtgttcaagtacagaaaaaatgggaacgttcagattatgttttcccgggaaatcaggtggataaa

SEQ ID NO: 642 - protein, 1012 aa, Staphylococcus aureus
  MISC_FEATURE (1)..(1012): formate dehydrogenase homolog
VWGIVILGGYEQFIKSHLRKIYIDGVSNMQEHLVVTLDGKDYLVEPGTNLLEFIKSQDTFVPSICYNESMGPIQTCDTCTVEIDGKIERSCSTVIDRPMTVNTVNNDVKDAQKEALDRILEKHMLYCTVCDYNNGDCEIHNTMDAWGLQHQTYEYKEKPYEKDYGPFYRYDPNQCILCGRCVEACQDIEVNETIRIDWDREHPRVIWDNDVPINESSCVSCGQCATVCPCNAMMEVNMEGNAGYMTDTEPGSLAAMIDLTKKAEPGYGPLFAISDSEAEMRKERIKKTKTVCTYCGVGCSFEVWTKDREILKVQPSHDSPANKIATCVKGKFSWGHINSDQRLTKPLVRKNGEFHEVEWDEALNVIADNFTAIKEKHGPDALSFISSSKATNEESYLMQKLARQVIGTNNVDNCSRYCQAPATKGLFRTVGHGGDSGSIEDLEKAAMSVLIGTNTAEAHPVIASRMKRAQKLFGQKIHVFDIRKHEMAERADRFYQPKPGTDLAWLSAVTKYIIDHDLHDKAFIDEWVDDFDEYYKSLETFTMAFAEEATGIPESELIKFAEECAKAESVVICWAMGITQQDIGSDSSTAISNLLLVTGNYRRPGTGAYPLRGHNNVQGCSDMGSMPDKITGYQSIEADDIRAKFEKEYGVKLNPKAGKDNHEMVEGIHDGEVHSLYLYGEDTGIVDSNINFVQAAFEKLDFMVVQDEFLTFTATYADVVLPASPSLEKDGTFTNTERRIQRLYQALEPLGDSKPDWKIFQAIANRLGFDWNYKHPSEIMDEVARLTPLYAGVSYDRLEGFNSLQWPVQPDGTDEPILYLEGFNFDNGKAKLFPLSFDNYFKQDEIYDIHVNNGRLLEHFHEGNMTYQTPMIKYKVPRAFVEISPELAEDRGIHEGAEVKLISETGEAVLQVHVTDRVKGKEIYIPLNNDAMENGDLGAINLLTNSDVDQYTDTPSYKRTSCRLEVITKRGKSPLNPNNFRVNKKRQPQYSVQVQKKWERSDYVFPGNQVDK

SEQ ID NO: 643 - DNA, 741 bp, Staphylococcus aureus
gtgggaggtatgacctgtatgtcgaacgaaatacttatcgtagatgatgaggatagaatcagaagattacttaaaatgtatttagaaagagaatcttttgaaatccatgaagcaagtaatggccaagaggcttatgaacttgcaatggagaataattatgcttgcatactactagatttaatgttgcctgaaatggatggtatccaggtggcaactaaattgcgtgaacataaacaaacaccgattattatgttgactgctaaaggtgaagaaacaaaccgtgttgaaggttttgaatctggtgcagatgattatatcgtcaaaccattttcaccaagagaagtagtcttaagagttaaagcacttctaagaagaacgcaatctacaactgtagaacaaagcgaacctcacgcacgtgatgtgattgaatttaaacatttagaaatagataatgatgcacatcgcgtacttgctgataatcaagaagttaatttgactcctaaagagtacgaattattaatatatttagctaaaacaccaaataaagtatttgaccgtgaacaattattaaaagaagtttggcattatgaattctatggtgatttaagaacagttgatactcatgttaaacgacttagagaaaagttaaatcgtgtgtctagtgaagctgcgcatatgattcaaacagtctggggcgttgggtataaatttgaggttaaatctaatgatgagccggctaaa

SEQ ID NO: 644 - protein, 247 aa, Staphylococcus aureus
  MISC_FEATURE (1)..(247): staphylococcal respiratory
VGGMTCMSNEILIVDDEDRIRRLLKMYLERESFEIHEASNGQEAYELAMENNYACILLDLMLPEMDGIQVATKLREHKQTPIIMLTAKGEETNRVEGFESGADDYIVKPFSPREVVLRVKALLRRTQSTTVEQSEPHARDVIEFKHLEIDNDAHRVLADNQEVNLTPKEYELLIYLAKTPNKVFDREQLLKEVWHYEFYGDLRTVDTHVKRLREKLNRVSSEAAHMIQTVWGVGYKFEVKSNDEPAK

SEQ ID NO: 645 - DNA, 1749 bp, Staphylococcus aureus
atgatgagccggctaaatagtgtcgtaattaaactgtggataactattattttaatagtgacgacagttttaattttattaagtattgctttaattacctttatgcaatactatttcacacaagaaaccgaaaatgccataagagaagatgctagacgtataagttcactggtcgaacaatcacataataaagaagaagcaataaaatatagtcaaacattaattgaaaatcctggtgggttgatgattataaataataaacatcgtcaatcaacggcttcactttctaatattaaaaagcaaatgttgaatgaagtagtcaacaacgaccattttgacgatgtgtttgataaaggtaaatctgttactcgaaatgtaacgattaaagaaaagggctcatctcaaacatatattttgttaggctatccaacaaaagcacagaagaatagtcatagcaaatatagtggagtctttatatataaagacttgaaatcaatcgaagatacaaataatgctattacgattatcaccataattacggctgttattttcttaacaattacaacagtctttgcgtttttcttatcgtcaagaattacaaaacctttaagacgtttaagagaccaagctacacgtgtatctgaaggggattactcttataaaccttctgtcacaacgaaagatgaaattggtcaattatcgcaggcatttaatcagatgagtacagaaatcgaagagcatgtcgacgcattatccacatctaaaaatattagagacagcttaattaactctatggtagaaggtgtcctaggtattaatgagagtcgacaaattatcttatctaataagatggcgaatgatattatggacaatattgatgaagatgctaaagctttcttattaagacaaatagaagatacttttaaatcaaaacaaactgaaatgcgcgatttagaaatgaatgcacgattctttgttgtgaccacaagctatatcgacaagattgaacagggaggtaaaagtggtgttgttgtgacagttcgtgatatgactaatgagcacaatctagatcaaatgaagaaagatttcattgctaatgtatcacatgaattacgtacaccgatatcattacttcaaggttatactgaatcaattgtagatggtattgttacagaaccggatgaaataaaagaatcgcttgccattgtccttgatgaatcgaaacgtttaaatcgtttagttaatgaattgttaaatgtcgcacgcatggatgctgaagggttatccgtaaataaagaagttcagcctattgcagcgttactagataagatgaaaattaagtatcgccaacaagctgatgatttaggtctaaatatgacttttaattattgtaagaagcgtgtttggagttatgatatggatcgcatggaccaagtactaacgaacttaattgataatgcatcacgttatacgaaacctggagatgaaattgcaattacttgtgatgaaaatgaaagcgaagatattttatacattaaagatacaggtacaggcattgcaccagaacatttacaacaagtatttgatcgtttttataaagttgatgcagcgagaacgcgaggtaaacaaggtaccggtttaggtttgttcatttgtaaaatgattatcgaagagcatggtggttccatagatgttaaaagcgaattagggaaaggcacaacatttattattaaactaccaaaaccagaa

SEQ ID NO: 646 - protein, 583 aa, Staphylococcus aureus
  MISC_FEATURE (1)..(583): staphylococcal respiratory
MMSRLNSVVIKLWITIILIVTTVLILLSIALITFMQYYFTQETENAIREDARRISSLVEQSHNKEEAIKYSQTLIENPGGLMIINNKHRQSTASLSNIKKQMLNEVVNNDHFDDVFDKGKSVTRNVTIKEKGSSQTYILLGYPTKAQKNSHSKYSGVFIYKDLKSIEDTNNAITIITIITAVIFLTITTVFAFFLSSRITKPLRRLRDQATRVSEGDYSYKPSVTTKDEIGQLSQAFNQMSTEIEEHVDALSTSKNIRDSLINSMVEGVLGINESRQIILSNKMANDIMDNIDEDAKAFLLRQIEDTFKSKQTEMRDLEMNARFFVVTTSYIDKIEQGGKSGVVVTVRDMTNEHNLDQMKKDFIANVSHELRTPISLLQGYTESIVDGIVTEPDEIKESLAIVLDESKRLNRLVNELLNVARMDAEGLSVNKEVQPIAALLDKMKIKYRQQADDLGLNMTFNYCKKRVWSYDMDRMDQVLTNLIDNASRYTKPGDEIAITCDENESEDILYIKDTGTGIAPEHLQQVFDRFYKVDAARTRGKQGTGLGLFICKMIIEEHGGSIDVKSELGKGTTFIIKLPKPE

SEQ ID NO: 647 - DNA, 927 bp, Staphylococcus aureus
atgaaaaaattcattggatcagttttagctacgacattaattttagggggatgttccacgatggaaaatgaatcaaaaaaagacacaaaaacagaaacaaaatctgtaccagaagaaatggaagcttcaaaatatgtaggccaaggcttccaaccgcctgcagaaaaaaatgcgattgaatttgcgaagaagcatcgtaaagaatttgaaaaagtaggtgaacaattctttaaagataactttggactaaaagttaaagctacaaatgttgtaggtaaagatgatggtgtagaagtttatgtgcattgtgaagatcatggcattgtatttaatgcaagtctacctttgtacaaagatgccatccatcaaaaaggatcaatgcgcagtaatgacaatggtgatgatatgagtatgatggtgggtacagtgctgagtggctttgaatatcgagcgcaaaaagaaaagtatgataacttatataaattcttcaaagaaaatgaaaagaaatatcaatatacaggctttacaaaagaggcaattaacaagacacaaaatgtcggatataaaaatgaatatttttatattacatactcttctagaagtttaaaagaatatcgaaagtattatgaaccactgattcgaaaaaatgataaagaatttaaagaaggaatggaacgagcaagaaaagaagtgaattacgctgcaaatacagatgctgttgctacacttttttctactaagaaaaactttactaaagacaatacagtagatgatgtaatcgaactaagtgataaattatataatttaaaaaataaaccagataaatctacaatcacaatacaaatagggaaacccactattaatactaagaaagccttttatgatgataatcgtccaatagaatatggggtgcacagtaaagatgaa

SEQ ID NO: 648 - protein, 309 aa, Staphylococcus aureus
  MISC_FEATURE (1)..(309): hypothetical protein
MKKFIGSVLATTLILGGCSTMENESKKDTKTETKSVPEEMEASKYVGQGFQPPAEKNAIEFAKKHRKEFEKVGEQFFKDNFGLKVKATNVVGKDDGVEVYVHCEDHGIVFNASLPLYKDAIHQKGSMRSNDNGDDMSMMVGTVLSGFEYRAQKEKYDNLYKFFKENEKKYQYTGFTKEAINKTQNVGYKNEYFYITYSSRSLKEYRKYYEPLIRKNDKEFKEGMERARKEVNYAANTDAVATLFSTKKNFTKDNTVDDVIELSDKLYNLKNKPDKSTITIQIGKPTINTKKAFYDDNRPIEYGVHSKDE

SEQ ID NO: 649 - DNA, 2043 bp, Staphylococcus aureus
atggggtgcacagtaaagatgaataaaattaatgatagggatttaacagaattaagtagttactgggtttatcaaaatattgatataaaaaaagaatttaaagttaatggaaaaaggtttaaacaagtagacagttataatgatgataagaatagtaatttgaatggtgctgctgatattaaaatatatgagttattagatgataaaagtaaaccaactggtcaacagacaataatttatcaaggaacatctaatgaggcaattaatccaaataatccattaaaatcatcggggtttggagatgattggctccaaaatgctaaattaatgaataatgataatgaaagcacagattatttaaagcaaacagatcaattatcaaatcaatataaaataaagttagaagatgcagatagattatcaaatagtgattttttaaaaaaatatagaatggaatcaagtaacttcaaaaacaaaaccattgtggcggatggcggtaattcggaaggcggtgcaggagcaaaatatcaaggagcgaaacatccgaatgaaaaagttgttgctactgactcagcaatgattccttatgctgcttggcagaaatttgctagaccacgctttgataatatgattagttttaatagtaccaacgatttattaacatggttacaagatccattcatcaaagatatgccaggaaaacgcgttaacattaatgatggtgtgcccaggttagatactttaatagacagccatgtaggttataaaaggaagttaaatagaaaagataacacatacgatactgtaccactaatcaaaataaagtcggtaaaagatacagaaattaaaaatggaaaaaaagtaaaaaagactattaacataacattagatatggatgggcgaattccaataaatgtttggacaggagattcgattgcacgttctggaagaggaactttaattaaacttaatttagaaaatcttgatgcgttgagtaaactgattactggtgaaacaagtggtatgttagcagaatgcgtaatctttttaaatgaaagttttaacatctcagaaaatgaaaataaaaattttgcagatagaaagaaacaattatcagaaggatttaaggataagattaacttatttcagttagaagaaatggaaagaactttaattagtaaaataaactcacttgaagaagttgcagatgaaacaatagaaagtattagtgctgttaaacacttattacctgattttgcattggatgcattaaaagaaagaattaatgagttgtttaaaggtataaaatcttttatagaaaaagtgtatgatagtatagataatgaaattttagaaattttcaaaaatatagatcacgacttcagagatggagtatctgaagaaatgatgaaacatttgaaagtagtgaaacagaatatagaccaaataaaaaatcaaaatgatatttatggtaggcaaattgcagatattagaagtattatgaaacaacaagatgcaacaattttagatggaaattttcaaattaattgtagcggcgaaaatatggtacagggtctagttataccttctaattatttaggaagaaaaatgaaaatattaaaagaccatatcgatgatggtattaaaaaaatagcagactatgttcaaggtatatatgatgaatatgcatcgaaaattgtcgatgtaataaaatatttgattaatacaattcccaaaatacgtaagaatttaagacatgcaattgaaatgttaaatgtaaaaaagaaagaatttttgtccctgattcctaatgtaacttgtaattatattaaaactaaattagaagaattagataatactttaggcaaatgggagccttttcttaatgatttaaaagcagtgtcaccaattttagataaccatttagatgatattgttaagaacatgaagcctttgattgtacaaatgatatttgaaccatcacattatgacgatatgtttaattcaagaaaagctttaacgccagtgttctcaagcgtttta

SEQ ID NO: 650 - protein, 681 aa, Staphylococcus aureus
  MISC_FEATURE (1)..(681): hypothetical protein
MGCTVKMNKINDRDLTELSSYWVYQNIDIKKEFKVNGKRFKQVDSYNDDKNSNLNGAADIKIYELLDDKSKPTGQQTIIYQGTSNEAINPNNPLKSSGFGDDWLQNAKLMNNDNESTDYLKQTDQLSNQYKIKLEDADRLSNSDFLKKYRMESSNFKNKTIVADGGNSEGGAGAKYQGAKHPNEKVVATDSAMIPYAAWQKFARPRFDNMISFNSTNDLLTWLQDPFIKDMPGKRVNINDGVPRLDTLIDSHVGYKRKLNRKDNTYDTVPLIKIKSVKDTEIKNGKKVKKTINITLDMDGRIPINVWTGDSIARSGRGTLIKLNLENLDALSKLITGETSGMLAECVIFLNESFNISENENKNFADRKKQLSEGFKDKINLFQLEEMERTLISKINSLEEVADETIESISAVKHLLPDFALDALKERINELFKGIKSFIEKVYDSIDNEILEIFKNIDHDFRDGVSEEMMKHLKVVKQNIDQIKNQNDIYGRQIADIRSIMKQQDATILDGNFQINCSGENMVQGLVIPSNYLGRKMKILKDHIDDGIKKIADYVQGIYDEYASKIVDVIKYLINTIPKIRKNLRHAIEMLNVKKKEFLSLIPNVTCNYIKTKLEELDNTLGKWEPFLNDLKAVSPILDNHLDDIVKNMKPLIVQMIFEPSHYDDMFNSRKALTPVFSSVL

SEQ ID NO: 651 - DNA, 1203 bp, Staphylococcus aureus
atgtggattgaaaaatttaaaaacaaaaataacgaaactaaatacagatactacgagaagtataaagatccatacacagataaatggaagcgcgtaagtgttgtgttgaacaagaatacaaaacaatcacaaaaagaagcaatgtttcgtttagaagaaaaaataaaagaaaaactaaacaacaagtcgtcaagcgaattaaaaactttgacttttcacgcgctattagatgaatggcttgaatatcatataaaaacatcaggttcaaagttgactactcttaataatataaaaataagaattaaaaacattaaacgatactgctctgagaacttgcttttaaacaaacttgatacaaaatatatgcagatatttattaataaattatcagatatctattctcaaaatcaagtaacccgtcaactcggagatatgaaaggagctattaaatatgcagttaaattttacaattatccaaatgaatatttgttaactaatgtcaaaattcctaaaagaagaaaaacaatagaggatatcgaaaaagatgaatctaaaatgtacaactatttagaaatgaaccaagtcctacagatacgtgatcatatactaaatgataataagttacaaaagcgaaatcgcattttaattgccagcatcttagaagtacaggctttaactggtatgcgcataggagaactacaagcactgcaggaaaaagatatagatttattaaacaaaactatcaatataacaggtacaattcaccgcattaaatacgagaaaggattcggatacaaagacactacaaagactataagttcaaaaagaagtatcagcatcaattctagaaccgtagaaatttttaaaaagataatactggaaaacaaaatgttgaaaagatggaattcgagctatgttgacagagggttcatattcacaacaaaaaaagggaatcctttatgtaataatcaaatcgccggtgtgcttaagaaaactacaaaagctttaaatatgaataagaaagttaccacgcacacatttagacatacacacataactttattagtagaaatgaatgtttctttaaaagcaattatgaaaagggtaggacatgtagatgaaaaaacaaccattcgcatatatactcatgtaactgaaaaaatggatagagaactaactcaaaaactcgaaaacattccaagt

SEQ ID NO: 652 - protein, 401 aa, Staphylococcus aureus
  MISC_FEATURE (1)..(401): hypothetical protein
MWIEKFKNKNNETKYRYYEKYKDPYTDKWKRVSVVLNKNTKQSQKEAMFRLEEKIKEKLNNKSSSELKTLTFHALLDEWLEYHIKTSGSKLTTLNNIKIRIKNIKRYCSENLLLNKLDTKYMQIFINKLSDIYSQNQVTRQLGDMKGAIKYAVKFYNYPNEYLLTNVKIPKRRKTIEDIEKDESKMYNYLEMNQVLQIRDHILNDNKLQKRNRILIASILEVQALTGMRIGELQALQEKDIDLLNKTINITGTIHRIKYEKGFGYKDTTKTISSKRSISINSRTVEIFKKIILENKMLKRWNSSYVDRGFIFTTKKGNPLCNNQIAGVLKKTTKALNMNKKVTTHTFRHTHITLLVEMNVSLKAIMKRVGHVDEKTTIRIYTHVTEKMDRELTQKLENIPS

SEQ ID NO: 653 - DNA, 375 bp, Staphylococcus aureus
  MISC_FEATURE (1)..(375): n = g, a, t, or c
atgactcaatttctaggggcgcttcttcttacaggagttttaggttacataccatataaatatctaacaatgataggtttagttagtgaaaaaaacaagattatcaatactcctgtattattgattttttctattgaaacatgtttgatatggttttatacttttataatttttaataatgttgatttaaaaaatttgagtttacttcagttgcttacaggtctaaaagcaaatatttggtttctaattattttgttttacagtgcttgtattatcccttggtacgagtccgatatcgtttactacccnctttttaaaaancctttattcaataacccccccgaacaaggtttttgcttaatgaaagaacgaaat

SEQ ID NO: 654 - protein, 125 aa, Staphylococcus aureus
  MISC_FEATURE (1)..(125): Xaa = any amino acid
MTQFLGALLLTGVLGYIPYKYLTMIGLVSEKNKIINTPVLLIFSIETCLIWFYTFIIFNNVDLKNLSLLQLLTGLKANIWFLIILFYSACIIPWYESDIVYYPLFKXPLFNNPPEQGFCLMKERN

SEQ ID NO: 655 - DNA, 1146 bp, Staphylococcus aureus
atgaatgcactatttattatcatatttatgattgtagtaggggcgataattggtggcattactaatgtaattgcaattagaatgctgtttcacccctttaaaccatactatatatttaaatttagagtcccatttacaccaggtttaataccgaaaagacgcgaagaaattgcaactaaaattggccaagtgattgaagagcatttgcttacagaaactttaattaatgaaaaattgaaaagcgagcaatcacagcaagcaatagaatctatgattcaacagcagttacaaaagttgacgaaagatcaattgtcaataaaacaaattacttctcaaatcgatattgatttagaacaagtattacaaactaatggaaatcaatatattgaatcacaattgaataattattatacaaagcatcaaaaccaaacaatagcatctttattgccaaatcaacttgtaacatttttaaatcagcatgtagataacgcaacagacttattatgtgatcgtgcaaggaattatttatcatctgcaaaaggcacacaagatattaatgatatgttggatacttttttcaatgagaaaggtaagttaattggtatgttgcaaatgtttatgacaaaagagagtattgcagatcgcattcaacaagaacttatacgtttaacatctcatcctaaagcaagaacaattgtgacatcgttaattaccaatgaatatcaaacttttaaagataaaccattgaatgaactgttagatgcatcgcagtttaatgaaatcgctgaaaatctatcagtgtatgtaacaacatatgcaagcaaacaagcgaataagccagtggttacgttaatgcctcaattcgttgattatttagaaggtcaactctctagcaaattagcaaatttaatcattgaaaaattatcgattcacttatctacaattatgaaaaaagtggatttacgaggattaattgaagaacaaattaatacgtttgacttagattatattgaaaaattaattatagaaattgctaacaaagaactaaagttgattatgtcattaggtttcattttaggtggtattattggatttttcccaaggtttggttgcaatctttgtctaaaaaagcgagatgtggtaaag

SEQ ID NO: 656 - protein, 382 aa, Staphylococcus aureus
  MISC_FEATURE (1)..(382): conserved hypothetical
MNALFIIIFMIVVGAIIGGITNVIAIRMLFHPFKPYYIFKFRVPFTPGLIPKRREEIATKIGQVIEEHLLTETLINEKLKSEQSQQAIESMIQQQLQKLTKDQLSIKQITSQIDIDLEQVLQTNGNQYIESQLNNYYTKHQNQTIASLLPNQLVTFLNQHVDNATDLLCDRARNYLSSAKGTQDINDMLDTFFNEKGKLIGMLQMFMTKESIADRIQQELIRLTSHPKARTIVTSLITNEYQTFKDKPLNELLDASQFNEIAENLSVYVTTYASKQANKPVVTLMPQFVDYLEGQLSSKLANLIIEKLSIHLSTIMKKVDLRGLIEEQINTFDLDYIEKLIIEIANKELKLIMSLGFILGGIIGFFPRFGCNLCLKKRDVVK

SEQ ID NO: 657 - DNA, 342 bp, Staphylococcus aureus
atggcagtaaatttatatgattatgcaaatcaattagaacaagctttaagagaaagcgaagaatacaaagcaatcaaagaagcattcgctaatgtaaaagctaacgaagaatctaaaaagttattcgacgagttccgtgaaactcaaattaacttccaacaaaaacaaatgcaaggtgaagaaattgctgaagaagatttacaaaaagcgcaagaacaagcgcaagcaattgaaaaagatgaaaacatctctgcattaatgaatgctgaacaaaaaatgagtcaagtattccaagaaatcaaccaaattatcgttaaaccattagacgaaatttacgctgac

SEQ ID NO: 658 - protein, 114 aa, Staphylococcus aureus
  MISC_FEATURE (1)..(114): conserved hypothetical
MAVNLYDYANQLEQALRESEEYKAIKEAFANVKANEESKKLFDEFRETQINFQQKQMQGEEIAEEDLQKAQEQAQAIEKDENISALMNAEQKMSQVFQEINQIIVKPLDEIYAD

SEQ ID NO: 659 - DNA, 96 bp, Staphylococcus aureus
gtgccatttgattcactagcggtgttaataactacggaaattgcatttccgactgaaatttttgaaaaatatcaacgtacgctacaaataaaattt

SEQ ID NO: 660 - protein, 32 aa, Staphylococcus aureus
VPFDSLAVLITTEIAFPTEIFEKYQRTLQIKF

SEQ ID NO: 661 - DNA, 1194 bp, Staphylococcus aureus
atggttaaatttattcattgttcggatttacatttagatagtcctttcaaatctaagagtcatataagccctaaaatttttgaggatgttcaaaaaagtgcttatgaaagttttaaaaatattgtagatattgcattacaacaagatgttgattttgtaattatcgcgggtgatttatttgatagtgaaaacagaacattacgtgctgaaattttcttaaaacagcaatttgaacgtttacaaaatgaacaaatctttgtttatgtttgtcatggtaatcacgatcctttatcatcaaagatttcatcaaactggccagataatgtttctgtattttcaaataaagttgagacgtatgaagcaattactaaatctggtgaaacaatttatattcacggatttagttatgaaaatagagcaagttatgagaacaagattgatgaatatccatcaagtcaaggccaaaaaggcatacatattggtgtcttgcatggtacgtatagtaaatcttcagttaacgaaagatataccgagttcattttagaagatttaaacagtaaattgtatcattattgggctttaggtcatatacatgaacgtcaacaattaagtgatatgcctgtaattaactattcaggtaatattcaaggtagacattttaatgagcaaggtgaaaaaggttgcttattaatcgagggtgaccacttaaaattaaagactaaattttatcctacacagtatattagatttgaagaagcaactattgaaacggataagacatctaagcaaggtttatacgaggtcattcaaaactttaaagaacaagtgagagaagaaggaaaagccttttatcgtttaacgcttgttattaatagtgagacattaatttcacctcaagatttattacaagttgaagaaatgattacagattatgaagaaaacgaaaatcaatttgtatatattgatgagttaaaaatacaatatgcacaaaatgatgagtcacctttagttaatgaattttcagcggaattattagtcgatcaaactgtttttgataaagcgatgtcagatttatatttaaatccaagggcatctaagttcctagacgattatggaacattcgaccatacagcattagttaatcgtgctgaagaaatattaaaagctgaaatgagaggtgaacaaaatgataat

SEQ ID NO: 662 - protein, 398 aa, Staphylococcus aureus
  MISC_FEATURE (1)..(398): conserved hypothetical
MVKFIHCSDLHLDSPFKSKSHISPKIFEDVQKSAYESFKNIVDIALQQDVDFVIIAGDLFDSENRTLRAEIFLKQQFERLQNEQIFVYVCHGNHDPLSSKISSNWPDNVSVFSNKVETYEAITKSGETIYIHGFSYENRASYENKIDEYPSSQGQKGIHIGVLHGTYSKSSVNERYTEFILEDLNSKLYHYWALGHIHERQQLSDMPVINYSGNIQGRHFNEQGEKGCLLIEGDHLKLKTKFYPTQYIRFEEATIETDKTSKQGLYEVIQNFKEQVREEGKAFYRLTLVINSETLISPQDLLQVEEMITDYEENENQFVYIDELKIQYAQNDESPLVNEFSAELLVDQTVFDKAMSDLYLNPRASKFLDDYGTFDHTALVNRAEEILKAEMRGEQNDN

SEQ ID NO: 663 - DNA, 471 bp, Staphylococcus aureus
atggctgagagaatatcttctaaaattagacgcttagaaaaatcagaagaacaaattaagttagaaagtttaaatgaagttacagaggcaattgcagcgaataaagatagtatattaaaagcaatcaagcttattaaaacattagatgatgcaaaactattagatgctttaaatggtgcaattcgaggacgtcaagtcatcataaataaatttgcagttgaacttaataaagatatttatacagggctattatctaatatggcttcaatggtatttttattaggtgaactcaatgtatcagatttaagcgacttcctaaataaagttaataaaggattacacgttgccaatcaagcgagtccaaatgctaagacaactataagaagtctattgggcgtattgaaagatgacgacatgaaccgtagtttaacatacatgcttaatatgctaaaaggtatgtctcgagaagaa

SEQ ID NO: 664 - protein, 157 aa, Staphylococcus aureus
  MISC_FEATURE (1)..(157): conserved hypothetical
MAERISSKIRRLEKSEEQIKLESLNEVTEAIAANKDSILKAIKLIKTLDDAKLLDALNGAIRGRQVIINKFAVELNKDIYTGLLSNMASMVFLLGELNVSDLSDFLNKVNKGLHVANQASPNAKTTIRSLLGVLKDDDMNRSLTYMLNMLKGMSREE

SEQ ID NO: 665 - DNA, 2943 bp, Staphylococcus aureus
gtgaacaaaatgataattaaatcacttgaaatttatggttacggtcaatttgttcaacgtaaaattgaatttaataaaaacttcactgaaatttttggtgaaaatgaagcgggtaaatcgacgattcaagcattcatccattcgatattatttggatttccaactaaaaagtctaaagagccaagactagaaccacgtctaggtaaccaatacggtggtaaattagtacttattcttgatgatggcttagagattgaagttgaacgaattaaaggcagtgctcaaggtgatgtgaaagtatatttacctaatggtgctgtgcgtgatgatgcttggttacaaaagaaacttaattatatttctaaaaagacatatcaaggtatcttttcatttgatgtactagggcttcaagacattcatagaaatctaaatgaaaaacaattgcaagattatttattacaagcaggggctttaggatcaactgaattcacgtcaatgcgcgaagtgattaatcgtaaaaaagatgaattatataaaaaatcaggtaaaaatccgatcattaatcaacaaattgagcaattaaaacaactagaaagtcaaattcgtgaagaagaagcaaagctagaaacatatcatcgcttagtagatgatcgagataaatcatcacgtcgattagagaatttaaagcataatttaaatcaattatcaaaaatgcatgaagaaaaacaaaaagaggttgctttacatgatcattcacaagaatggaagtctctagaacaacagttaaatattgagccaatcacattcccagaaaaaggtgtggatcgttacgaaaaagcacgagcgcataagcaatcgttagaaagagatattggtttaagaaatgagcgtttagctcaacttaaagaagaagcgactcaattagagccagttaaacaatctgatattgacgccttcattagtttgaatcaacaagaaaatgaaattaaaaataaagaatttgaacttactgcaatcgaaaaggatattgcgaataaacaacgtgataaagatgaattgcaatcaaatattggttggtctgaaacgcatcatgacgtagatagttcagaggcaatgaaaagttatgtcagtgagcaaatcaagaataaacaagaacaagctgcatacattaaacaattagaacgtagtttagaagaaaataaaatcgaagataatgcggttcatagcgaactagattctgttgaagaaaaaatagttcctgaagagacttttgaaaagaaaaaagaatactcacaacaagtcattgaattaaacgaaaaagagaacttgtatagcaaattgaaagaacgtttcgaaattgagcaacaagaaaaacaaaaacgtcaaaaattgttacgaacaacgtttattcttttaacattagtaggtattggtttaactgccttctcatttatttcaaacaacatgttgtttggtattattttcgcagtattaactttagtatttgttatcggtatcatcatgtctaaatcaaaagaagtagattatagcgaggccatcacagatgaaatcgaagaaattaaagcacaactagccattttagatgaaaattatgacttagattttgatcttgatgagcaatatcgcattcgtgatcactggcaacaagctttgaaaaataaagatattttagaagagaaacgtcagtatattgaaggtcgtttaaatgatgcgaaagggcgtcatgatgaattacaatcgacagttgagaacgttaaggatgaattatacttatcatctaaaatttcaaatgatttaattgttgatagtatttctacaatggcgaatattaaagcattagatcaacatatcagtgatttaaatcaacaacgccagcaattggttcaagaattagatacattctacaatcatgctgaagctgttacaaaatcacaatttgtttatttcaacaaattatctttattccacgatgtgcaacaatggttgaaatcagctgaagacacgaatgaaaaatggcgtattaatgctgaaaataccaaacttgttacaaatgaattaaatcatttaaatgctcaattagaagaaaataataaagaaattacagcactattcgattttatcaatgttggtactgaagaagatttttaccaacatcatgaagattaccaaacttatactagtaatttgagtcgttttaatgatttaactaaatatcttgagaaccaaaactattcttatgaattaagttctagtttaagtgaaaaaacaactgcacaacttgaagaagaagatcatttattggctactcaagttgacgaatataatgagcaatatcttgaaatgcaagcacaagtcagtgatttaagtgcacaaatcaatcacatggaaactgatacaacgcttgctaatttaagacatgaatatcacagtcttaaaaatcaacttaatgatatcgcaaaagattgggcaagtttaagttatttacaaagtttagttgatgaacacattaaacaaattaaagataaacgtttgcctcaagttattaatgaagcggtagaaatattgaagcatttaacagatggcagatatacgatgattaactataatgaagattcaattacggttaaacatgttaatggtcaattatatgatcctgttgaactaagtcaatctacaaaagaattactttatgtagctttacgtatcagtttaattaaggtactaagaccatattatccgttcccattaattgttgatgatgcatttgttcattttgataaaaaacgtactgaaaaaatgttgaattatttacgatcattatcagaacactatcaagtactatactttacatgtgtaaaagataatattgttccatcaaaagaagtgattacattaaacaaaatagaggaaggcgggaaacga

SEQ ID NO: 666 - protein, 981 aa, Staphylococcus aureus
  MISC_FEATURE (1)..(981): conserved hypothetical
VNKMIIKSLEIYGYGQFVQRKIEFNKNFTEIFGENEAGKSTIQAFIHSILFGFPTKKSKEPRLEPRLGNQYGGKLVLILDDGLEIEVERIKGSAQGDVKVYLPNGAVRDDAWLQKKLNYISKKTYQGIFSFDVLGLQDIHRNLNEKQLQDYLLQAGALGSTEFTSMREVINRKKDELYKKSGKNPIINQQIEQLKQLESQIREEEAKLETYHRLVDDRDKSSRRLENLKHNLNQLSKMHEEKQKEVALHDHSQEWKSLEQQLNIEPITFPEKGVDRYEKARAHKQSLERDIGLRNERLAQLKEEATQLEPVKQSDIDAFISLNQQENEIKNKEFELTAIEKDIANKQRDKDELQSNIGWSETHHDVDSSEAMKSYVSEQIKNKQEQAAYIKQLERSLEENKIEDNAVHSELDSVEEKIVPEETFEKKKEYSQQVIELNEKENLYSKLKERFEIEQQEKQKRQKLLRTTFILLTLVGIGLTAFSFISNNMLFGIIFAVLTLVFVIGIIMSKSKEVDYSEAITDEIEEIKAQLAILDENYDLDFDLDEQYRIRDHWQQALKNKDILEEKRQYIEGRLNDAKGRHDELQSTVENVKDELYLSSKISNDLIVDSISTMANIKALDQHISDLNQQRQQLVQELDTFYNHAEAVTKSQFVYFNKLSLFHDVQQWLKSAEDTNEKWRINAENTKLVTNELNHLNAQLEENNKEITALFDFINVGTEEDFYQHHEDYQTYTSNLSRFNDLTKYLENQNYSYELSSSLSEKTTAQLEEEDHLLATQVDEYNEQYLEMQAQVSDLSAQINHMETDTTLANLRHEYHSLKNQLNDIAKDWASLSYLQSLVDEHIKQIKDKRLPQVINEAVEILKHLTDGRYTMINYNEDSITVKHVNGQLYDPVELSQSTKELLYVALRISLIKVLRPYYPFPLIVDDAFVHFDKKRTEKMLNYLRSLSEHYQVLYFTCVKDNIVPSKEVITLNKIEEGGKR

SEQ ID NO: 667 - DNA, 939 bp, Staphylococcus aureus
atgagaaatatagagaatctaaatcccggagattcagttgatcactttttcttagtgcataaagctacacagggtgtaacagcacaaggtaaagattatatgacattacatttgcaagataaaagtggtgaaattgaagcgaaattttggacggctacaaaaaatgatatggcaacaatcaagcctgaagaaattgtacatgttaaaggtgacatcataaactatcgcggaaataaacagatgaaagtcaaccaaattagactagcgacaactgaagatcaattaaaaacagaacaatttgtagatggtgcacctttatcaccggcagaaatacaagaagagatttctcattatttgctagatattgaaaatgctaatttacaacgtatcacacgtcatttattgaaaaaatatcaagaacgattttacacatatccagctgctagttctcatcatcataactttgcgagtggcttaagctatcatgtattaacgatgttacgtattgcaaaatcaatttgtgacatttatccattgttaaacaaaagtttgttatatagtggtattattttgcatgatattggtaaagttagagaattgagtggtcctgttgcgacgtcgtatacagtcgaaggtaacttattaggacacatctcgattgcgagtgatgaagtagttgaagcagctcgtgaattgaacattgaaggagaagaaatcatgttgttaagacatatgattttatctcatcatggtaagttagagtatggttctccaaaactgccatacttaaaagaagcagaaattttatgctatatcgataatatcgatgctagaatgaatatgtttgaaaaggcatataaaaaaactgacaagggtcagtttacagataaaatatttggtcttgaaaatcgtagattctacaatcctgaatcactcgat

SEQ ID NO: 668 - protein, 313 aa, Staphylococcus aureus
  MISC_FEATURE (1)..(313): cmp-binding-factor 1
MRNIENLNPGDSVDHFFLVHKATQGVTAQGKDYMTLHLQDKSGEIEAKFWTATKNDMATIKPEEIVHVKGDIINYRGNKQMKVNQIRLATTEDQLKTEQFVDGAPLSPAEIQEEISHYLLDIENANLQRITRHLLKKYQERFYTYPAASSHHHNFASGLSYHVLTMLRIAKSICDIYPLLNKSLLYSGIILHDIGKVRELSGPVATSYTVEGNLLGHISIASDEVVEAARELNIEGEEIMLLRHMILSHHGKLEYGSPKLPYLKEAEILCYIDNIDARMNMFEKAYKKTDKGQFTDKIFGLENRRFYNPESLD

SEQ ID NO: 669 - DNA, 960 bp, Staphylococcus aureus
atgaagatgataaacaaattaatcgttccggtaacagctagtgctttattattaggcgcttgtggcgctagtgccacagactctaaagaaaatacattaatttcttctaaagctggagacgtaacagttgcagatacaatgaaaaaaatcggtaaagatcaaattgcaaatgcatcatttactgaaatgttaaataaaattttagctgataaatataaaaataaagttaatgataagaagattgacgaacaaattgaaaaaatgcaaaagcaatacggcggtaaagataaatttgaaaaggcccttcaacagcaaggtttaacagccgataaatataaagaaaatttacgtactgctgcttatcataaagaattactatcagataaaattaaaatctctgattctgaaattaaagaagacagcaagaaagcttcacacattttaattaaagttaaatctaagaaaagcgacaaagaaggcttagatgataaagaagcgaaacaaaaagctgaagaaattcaaaaagaagtttcaaaagatccaagtaaatttggtgaaatcgctaaaaaagaatcaatggatactggttcagctaaaaaagatggcgaattaggttatgttcttaaaggacaaactgataaagattttgaaaaagcactatttaagcttaaagatggtgaagtatcagaggttgttaaatcaagctttggatatcatattattaaagctgataaaccaacagactttaacagtgaaaaacaaagcctgaaagaaaaattagtcgatcagaaagtacaaaaaaatccaaaattattgactgatgcatacaaagatctattaaaagaatacgatgttgactttaaagatcgtgatattaaatcagttgtcgaagataaaatcttaaaccctgaaaaacttaaacaaggtggcgcacaaggcggacaatccggcatgagccaa

SEQ ID NO: 670 - protein, 320 aa, Staphylococcus aureus
  MISC_FEATURE (1)..(320): peptidyl-prolyl cis/trans
MKMINKLIVPVTASALLLGACGASATDSKENTLISSKAGDVTVADTMKKIGKDQIANASFTEMLNKILADKYKNKVNDKKIDEQIEKMQKQYGGKDKFEKALQQQGLTADKYKENLRTAAYHKELLSDKIKISDSEIKEDSKKASHILIKVKSKKSDKEGLDDKEAKQKAEEIQKEVSKDPSKFGEIAKKESMDTGSAKKDGELGYVLKGQTDKDFEKALFKLKDGEVSEVVKSSFGYHIIKADKPTDFNSEKQSLKEKLVDQKVQKNPKLLTDAYKDLLKEYDVDFKDRDIKSVVEDKILNPEKLKQGGAQGGQSGMSQ

SEQ ID NO: 671 - DNA, 555 bp, Staphylococcus aureus
atgtttttatgtaaaagacaaattgatatcaatgcacgatttggtttgcctagaattgcatttatgagtgcagttgcaaccatcattatgtttttagttagttatgaagtaatgtattttttatctaatacgccattatcagatagacattttctcatctttttattacttgtatttatgacgtatccattacataaaagtatacatttattatttttcttaccatatagaaaatcgtttaaagttcataagttaactaaaagaaaatggcttatattctataatacctacgtcaatcaacctgtacacaaattttatttttgcattaacttaatattgccgttaattatcttatctgcaatgttcgtttatctaacaatttcattcccgcaatatggacattattttatgttcttattggcattgaatttcggtatttccattacagatttattatatttaaaaataattatattttctaattatggacaatatatagaagaacatagtacaggtattaatattttgaaaaaaattaaaaatccatatcattta

SEQ ID NO: 672 - protein, 185 aa, Staphylococcus aureus
  MISC_FEATURE (1)..(185): conserved hypothetical
MFLCKRQIDINARFGLPRIAFMSAVATIIMFLVSYEVMYFLSNTPLSDRHFLIFLLLVFMTYPLHKSIHLLFFLPYRKSFKVHKLTKRKWLIFYNTYVNQPVHKFYFCINLILPLIILSAMFVYLTISFPQYGHYFMFLLALNFGISITDLLYLKIIIFSNYGQYIEEHSTGINILKKIKNPYHL

SEQ ID NO: 673 - DNA, 363 bp, Staphylococcus aureus
atgaaagcatcacgcattctattcggtatcggtgttggcgtagcagctggttttgtagttgcacttcaaggacgtgacgacaaaagtgtcaagaacaacacgatcgatcgtactgcccctactggttcaaaatcagaactacaacgtgaatttgaaacgattaaacaaagttttaatgacattttaaactatggtgttcaaattaaaaacgaaagtgcggaatttggtagttcaattggtggtgaaattaagtcattacttggaaacttcaaatctgacattaatcctaatattgaacgtttacagtcacacatcgaaaatttacaaaatcgtggcgaggatattggaaacgaaatttctaag

SEQ ID NO: 674 - protein, 121 aa, Staphylococcus aureus
  MISC_FEATURE (1)..(121): conserved hypothetical
MKASRILFGIGVGVAAGFVVALQGRDDKSVKNNTIDRTAPTGSKSELQREFETIKQSFNDILNYGVQIKNESAEFGSSIGGEIKSLLGNFKSDINPNIERLQSHIENLQNRGEDIGNEISK

SEQ ID NO: 675 - DNA, 441 bp, Staphylococcus aureus
ttgaaaaggagtgtagtcatcatgtcagaaacaattttcggcaaaattttaactggagaaattcctagctttaaagtatatgaagacgattatgtctatgcctttttagatatatcacaagttactaaaggacatacgttattaattcctaaaaaagcttctgctaatatctttgaaactgatgaagaaacaatgaaacatatcggtgcagcattacctaaagtagcaaatgctattaagcgtgcatttaatcctgatggtttaaacattattcaaaataatggtgagtttgcagatcaatctgtatttcatattcatttccacttaattcctcgatacgaaaatgatattgatggatttggttataagtgggaaacacatgaagacattttagataacgatgcaaaacaacaaattgctgaacaaattcaagcacaattt

SEQ ID NO: 676 - protein, 147 aa, Staphylococcus aureus
  MISC_FEATURE (1)..(147): Hit-like protein involved
LKRSVVIMSETIFGKILTGEIPSFKVYEDDYVYAFLDISQVTKGHTLLIPKKASANIFETDEETMKHIGAALPKVANAIKRAFNPDGLNIIQNNGEFADQSVFHIHFHLIPRYENDIDGFGYKWETHEDILDNDAKQQIAEQIQAQF

SEQ ID NO: 677 - DNA, 768 bp, Staphylococcus aureus
ttggtacaatataagtcatggaggtgccttatgacagttaaagtagaacagcttacaggtggatatggaaaacgccctgtaattaaagatataaattttgaattaaacaaaggcgaaattgttggacttattggccttaatggcgctggtaagagtacaacgattaaacatatgctaggattgcttacacctatggaaggatctctatcaatttcagatatcaacattaatgatgacatagaggcttatagaagaaagttatcttatattccggaatcaccggttatttatgaagaactcacattagaggaacacattgagatgacagcaatggcatatgatattgatcgtgatgaaacgatgaatcgagcaatgccattattaaagacattccgtttagaaaatgagttgaaagtttttccgagtcatttttctaaggggatgaaacaaaaagtcatgattatttgtgcgtttatcgttaatcccgaattgtatattatagacgaaccattccttggcctagatccattaggaattcaatccatgttagatttaatggttgaaaagaaaaacgaaggtagaaccgttctaatgagtacacatattttagcaacagctgaacgttactgtgatcgttttatcatactagacgaaggtgaagtcgttgcatttggagatttagaagcattgagacaacaaactggcttacataatcaaacattagacgatatatatattcatgtgacgcaaggtggagatgtacatgcg

SEQ ID NO: 678 - protein, 256 aa, Staphylococcus aureus
  MISC_FEATURE (1)..(256): ABC transporter ecsA
LVQYKSWRCLMTVKVEQLTGGYGKRPVIKDINFELNKGEIVGLIGLNGAGKSTTIKHMLGLLTPMEGSLSISDININDDIEAYRRKLSYIPESPVIYEELTLEEHIEMTAMAYDIDRDETMNRAMPLLKTFRLENELKVFPSHFSKGMKQKVMIICAFIVNPELYIIDEPFLGLDPLGIQSMLDLMVEKKNEGRTVLMSTHILATAERYCDRFIILDEGEVVAFGDLEALRQQTGLHNQTLDDIYIHVTQGGDVHA

SEQ ID NO: 679 - DNA, 1125 bp, Staphylococcus aureus
atggtctttttacttattttgctgggtgcatttatttttggatatggtgaatggttaaaacatattccaacgaatatcaatttttcattaatagcagcagtgattgttgcgttgacatctatttttccaatgcgaccactgttaaaagaagcggataaaatctttttattaccatttgaaaaacacatgtctcaatttatgcgtcatgcgattttatatagttactttgcgcgcatattaatccaactcattattgttattgtaatgttcccgttgttttacaatattaatcaacataatgtggcattttatatttgttttggagtcagtgcattaatttttccatatgttggtttacgcttaagatggcaatggtatcaatcgggacttaaaacatggcaagttaatttaatatcattcatcacctttgctctaacatattacttactattagctccaaaatggtacatcgcatttgtgatggttgctttgcctgtgttaatagaatttttagttaaaaaatataaaccaggctttttgtatccttgggagaaaatgattgcaatcgaacatcgacatcatatgaattattataaatttgttaatatgttcaccgatgtaaaacatttgaaagaatctgcagtcagaagaagttatctagatatacttttaccagttccaaagggtagtaaatttaactctaatgcgatgtatttattcttatttattagaagctttataagagggagagacgcatttaatattatctttaggttagtaattattgcagttttattaatggtttggttatcatatccattagtgacagcaattattgggtgtttatttgtatatattatattgttacaaatggcacaattttattcacagcaagcatatggcttatggcctcaagtgtggcctgtacctgaagagaaggtaatcaaagggtatgaacagtttttatatagattaatgtttgttatttgtactgtgtttgcagtgacatttattataaaacatatgacgttattctatgttgtactcattttctatattgtaggtttattaacgattagaagtattattaaaaagttgaaatatcaggaaacattattacgagac

SEQ ID NO: 680 - protein, 375 aa, Staphylococcus aureus
  MISC_FEATURE (1)..(375): hypothetical protein
MVFLLILLGAFIFGYGEWLKHIPTNINFSLIAAVIVALTSIFPMRPLLKEADKIFLLPFEKHMSQFMRHAILYSYFARILIQLIIVIVMFPLFYNINQHNVAFYICFGVSALIFPYVGLRLRWQWYQSGLKTWQVNLISFITFALTYYLLLAPKWYIAFVMVALPVLIEFLVKKYKPGFLYPWEKMIAIEHRHHMNYYKFVNMFTDVKHLKESAVRRSYLDILLPVPKGSKFNSNAMYLFLFIRSFIRGRDAFNIIFRLVIIAVLLMVWLSYPLVTAIIGCLFVYIILLQMAQFYSQQAYGLWPQVWPVPEEKVIKGYEQFLYRLMFVICTVFAVTFIIKHMTLFYVVLIFYIVGLLTIRSIIKKLKYQETLLRD

SEQ ID NO: 681 - DNA, 501 bp, Staphylococcus aureus
atgaagaaactatatacatcttatggcacttatggatttttacatcagataaaaatcaataacccgacccatcaactattccaattttcagcatcagatacttcagttatttttgaagaaactgatggtgagactgttttaaaatcaccttcaatatatgaagttattaaagaaattggtgaattcagtgaacatcatttctattgtgcaatcttcattccatcaacagaagatcatgcatatcaacttgaaaagaaactgattagtgtagacgataatttcagaaactttggtggctttaaaagctatcgtttgttaagacctgctaaaggtacaacatacaaaatttatttcggatttgctgatcgacatgcatacgaagactttaagcaatctgatgcctttaatgaccatttttcaaaagacgcattaagtcattactttggttcaagcggacaacattcaagttattttgaaagatatctatacccaataaaagaa

SEQ ID NO: 682 - protein, 167 aa, Staphylococcus aureus
  MISC_FEATURE (1)..(167): signal transduction protein
MKKLYTSYGTYGFLHQIKINNPTHQLFQFSASDTSVIFEETDGETVLKSPSIYEVIKEIGEFSEHHFYCAIFIPSTEDHAYQLEKKLISVDDNFRNFGGFKSYRLLRPAKGTTYKIYFGFADRHAYEDFKQSDAFNDHFSKDALSHYFGSSGQHSSYFERYLYPIKE

SEQ ID NO: 683 - DNA, 774 bp, Staphylococcus aureus
atgaagaagaatttcaagttacgcatttcaacgctactattgatagttattttagttgtttttgctgtattactcatcgtgaatgaaactaaattgtttaaaaatgatgtgaattactcttttgatgaggctgtttcaatgcaacaagggaaaggtattgtacagacaaaagaagaggatggtaaatttgttgaagcaaataataatgaaattgctaaagcaatgactatttcacataaagacaatgatatgaagtatatggatatcacagaaaaagtgccaatgtcggaatctgaagttaaccaattgctaaaaggtaaggggattttagaaaatcgagggaaagtttttctagaagctcaagaaaaatatgaggttaatgtcatttatcttgttagccatgcattagtagaaacaggtaacggcaaatcagaattagcaaaaggcattaaagatgggaaaaaacgctattacaacttttttggtataggagcattcgatagtagtgctgttcgtagtgggaaaagttatgctgaaaaggaacaatggacatcaccagataaggcgattattggtggtgcaaagttcattcgtaatgaatattttgaaaacaatcaactgaatttatatcaaatgcgatggaatccagaaaatcctgcgcaacatcaatatgcgagtgacattcgctgggcagataaaattgccaaattaatggataaatcctataagcagtttggtataaagaaagatgatattagacaaacatattataaa

SEQ ID NO: 684 - protein, 258 aa, Staphylococcus aureus
  MISC_FEATURE (1)..(258): hypothetical protein
MKKNFKLRISTLLLIVILVVFAVLLIVNETKLFKNDVNYSFDEAVSMQQGKGIVQTKEEDGKFVEANNNEIAKAMTISHKDNDMKYMDITEKVPMSESEVNQLLKGKGILENRGKVFLEAQEKYEVNVIYLVSHALVETGNGKSELAKGIKDGKKRYYNFFGIGAFDSSAVRSGKSYAEKEQWTSPDKAIIGGAKFIRNEYFENNQLNLYQMRWNPENPAQHQYASDIRWADKIAKLMDKSYKQFGIKKDDIRQTYYK

SEQ ID NO: 685 - DNA, 108 bp, Staphylococcus aureus
atgattaaatgtcagttttatgacatttatttattgaaaatacgaacgaatgagcgatatgataatatagataagaatgattttaatttaggaggcctttatggtgca

SEQ ID NO: 686 - protein, 36 aa, Staphylococcus aureus
MIKCQFYDIYLLKIRTNERYDNIDKNDFNLGGLYGA

SEQ ID NO: 687 - DNA, 1035 bp, Staphylococcus aureus
atggtgcataataaaaacaatacaattttaaaaatgatcaaaggtgaagaaacatcacatacacctgtttggtttatgcgacaagctggccgttcgcaaccagaatatcgaaaattgaaagaaaaatattcactattcgatattacacatcagccggagttgtgcgcttatgtaacacatttaccagttgataattatcatacagatgcagcaattttatacaaagatattatgacaccattaaagccaattggtgtcgatgtagaaattaaatcgggtattggtccagtgattcataatccaatcaaaacaattcaagatgttgagaaactttctcaaatagaccccgaacgagatgtaccatatgtattagatacaattaaacttttaacagaagaaaagttaaatgtgccgctaataggatttactggggcaccatttacattagcgtcatatatgattgaaggcggaccatcgaaaaattacaattttacaaaagcgatgatgtatagagatgaagcaacatggtttgctttaatgaatcatttagttgatgtatctgttaaatatgtaacagctcaagtcgaagcaggtgccgaattgattcaaattttcgattcatgggtaggtgcattaaatgtcgaggattacagacgttacattaaaccacatatgattcgattaatcagtgaggttaaagaaaaacatgatgtgccggtaattttattcggtgtaggtgccagtcatttaatcaatgaatggaatgatttaccgattgatgtattaggcctagattggagaacgtctattaatcaggctcaacaattaggcgttactaaaacattacaagggaatttagatccatcaattttattagcaccatggaatgtcattgaagagagattgaaaccaatattagatcaaggtatggagaacggtaaacacatctttaatttaggacacggtgtattcccagaagtgcaaccagagacgttacgtaaagtaagcgaattcgtacacacatatacacaaaga

SEQ ID NO: 688 - protein, 345 aa, Staphylococcus aureus
  MISC_FEATURE (1)..(345): uroporphyrinogen
MVHNKNNTILKMIKGEETSHTPVWFMRQAGRSQPEYRKLKEKYSLFDITHQPELCAYVTHLPVDNYHTDAAILYKDIMTPLKPIGVDVEIKSGIGPVIHNPIKTIQDVEKLSQIDPERDVPYVLDTIKLLTEEKLNVPLIGFTGAPFTLASYMIEGGPSKNYNFTKAMMYRDEATWFALMNHLVDVSVKYVTAQVEAGAELIQIFDSWVGALNVEDYRRYIKPHMIRLISEVKEKHDVPVILFGVGASHLINEWNDLPIDVLGLDWRTSINQAQQLGVTKTLQGNLDPSILLAPWNVIEERLKPILDQGMENGKHIFNLGHGVFPEVQPETLRKVSEFVHTYTQR

SEQ ID NO: 689 - DNA, 921 bp, Staphylococcus aureus
atgactaaaaaaatgggattattagttatggcttatggcacaccttataaagaaagtgacatagagccatattatacagatattagacatggtaaacgtccatctgaagaagaacttcaagatttgaaagatagatatgaatttataggtggtttatcaccattagcaggtacaacagatgaccaggctgatgcgctagtttcagcattaaataaagcatatgcagatgttgaatttaaactatacttaggattaaaacacatttcaccatttatcgaagatgcggttgaacaaatgcacaatgatggcattactgaagcaatcacggtagtactagcaccacattattcttcattttcagtaggatcatatgacaaacgtgctgatgaagaagctgcaaaatatggtattcaacttacacatgtgaaacattattatgaacaacctaaatttattgaatattggacgaataaagtcaacgaaacattagctcaaataccggaagaggaacataaagacacggtattagttgtttcggcacatagtttgccaaaaggtttaatcgaaaagaataatgatccatatccacaagaactagaacatactgcgcttttaattaaagaacaatctaatattgaacatatcgcgattggttggcaatctgaaggtaatacaggtacaccttggttagggccagatgtacaagatttaacacgtgatttatatgaaaaacatcagtataaaaactttatatatacgccagtaggttttgtatgtgagcatttagaggtgctttatgacaatgattatgaatgtaaagtagtttgcgatgatattggtgcgaattattatcgtccaaaaatgccgaatacacatccattatttatcggtgcaattattgatgaaatcaagtctatattt

SEQ ID NO: 690 - protein, 307 aa, Staphylococcus aureus
  MISC_FEATURE (1)..(307): ferrochelatase
MTKKMGLLVMAYGTPYKESDIEPYYTDIRHGKRPSEEELQDLKDRYEFIGGLSPLAGTTDDQADALVSALNKAYADVEFKLYLGLKHISPFIEDAVEQMHNDGITEAITVVLAPHYSSFSVGSYDKRADEEAAKYGIQLTHVKHYYEQPKFIEYWTNKVNETLAQIPEEEHKDTVLVVSAHSLPKGLIEKNNDPYPQELEHTALLIKEQSNIEHIAIGWQSEGNTGTPWLGPDVQDLTRDLYEKHQYKNFIYTPVGFVCEHLEVLYDNDYECKVVCDDIGANYYRPKMPNTHPLFIGAIIDEIKSIF

SEQ ID NO: 691 - DNA, 1398 bp, Staphylococcus aureus
gtgactaaatcagtggctattataggagcggggataacaggtttatcaagtgcatattttttaaaacagcaagatcctaatattgatgtaaccatctttgaagcatcgaatcgtccggggggaaagattcaatcgtatcgtaaagatggttatatgattgaactagggcctgaatcttatttaggtagaaaaacgattatgacagaattagcgaaagatattggattagaacaagatattgttacaaatacgactggacaatcatatatttttgcgaaaaataaattatatccgattccaggtggttcaattatgggtattccaacagatattaaaccatttgttactacaaaattaatatcgccacttggtaaattaagagcagggtttgatttattaaaaaaacctactcaaatgcaggatggtgacatttctgttggtgcatttttcagagcaagattaggtaatgaggtacttgagaatttaatagagcctttaatgggtggtatttatggtaccgatattgataaattaagtttgatgagtacgtttcctaattttaaagaaaaagaagaggcattcggaagtctgataaaaggtatgaaggatgagaaaaataagcgtctgaaacaaagacaattatatcctggcgcaccgaaaggacaattcaaacaatttaagcatggtttaagctcatttattgaagcattagaacaagatgttaaaaataaaggtgtgacaatacgctacaatacgtcagtggatgatataattacatctcaaaaacaatataaaattgtttacaatgatcaactagaagaagtgtatgatggcgtattagtaacgacaccacatcaagtgtttttaaattggttcggacaagatccagcatttgattactttaaaacgatggatagtacgactgttgcaactgttgtattggcatttgatgaaaaagacattgaaaatacccatgatggtactggcttcgtaattgcgagaacgagtgatacagacattaccgcatgtacttggacatcgaaaaaatggccatttactacaccggaaggtaaggttttgattcgtgcgtatgtaggtaaaccaggtgatactgtggttgatgatcatacagataatgaattagtatcgattgtacgtagagatttaagtcaaatgatgacatttaaaggtgatcctgaatttacaattgtcaatcgtttgccgaaaagtatgccacagtaccatgtcggtcatattcaacaaattagacagattcaagcacatattaaacaaacatatccacgacttagagtaactggtgcatcttttgaagcggttggactacctgattgtattacgcaaggtaaagttgctgctgaagaagtaatcgcagagttg

SEQ ID NO: 692 - protein, 466 aa, Staphylococcus aureus
  MISC_FEATURE (1)..(466): protoporphyrinogen oxidase
VTKSVAIIGAGITGLSSAYFLKQQDPNIDVTIFEASNRPGGKIQSYRKDGYMIELGPESYLGRKTIMTELAKDIGLEQDIVTNTTGQSYIFAKNKLYPIPGGSIMGIPTDIKPFVTTKLISPLGKLRAGFDLLKKPTQMQDGDISVGAFFRARLGNEVLENLIEPLMGGIYGTDIDKLSLMSTFPNFKEKEEAFGSLIKGMKDEKNKRLKQRQLYPGAPKGQFKQFKHGLSSFIEALEQDVKNKGVTIRYNTSVDDIITSQKQYKIVYNDQLEEVYDGVLVTTPHQVFLNWFGQDPAFDYFKTMDSTTVATVVLAFDEKDIENTHDGTGFVIARTSDTDITACTWTSKKWPFTTPEGKVLIRAYVGKPGDTVVDDHTDNELVSIVRRDLSQMMTFKGDPEFTIVNRLPKSMPQYHVGHIQQIRQIQAHIKQTYPRLRVTGASFEAVGLPDCITQGKVAAEEVIAEL

SEQ ID NO: 693 - DNA, 570 bp, Staphylococcus aureus
ttgaaaggagagaatgagatgacagatgtaattattgtacattctatgcatggaaatagtagaaatcattggtatcagtggttggagcataacttaactttagaaggatatgacgtaacattatttaattttgaatcccctgaagcgaagacagtggatcagtggattgaagctatgacgaaacaaattaatgtacgcaaaaaggatacatattttgtaacacatggtttaggttcaatcacagctttaaaatatattgaaatgattgatcagccgattgaaggctttttcagtatagcgggctttaaagaagatgcagaaaatatagatttagatattgatttaagtaatgtaaccattgattacgataatattaaaaagaaagttgacaatttttacggattgagttctaaaaatgacaaatacgtttcatataaagagacccagcgtttaatgaatgcattagaggggaacttgcaaatcgtggaagatggagggcacttcttagaagaggatggcttcgaaacatttacagcgttgcaagatcggatgcaagattacatgacacga

SEQ ID NO: 694 - protein, 190 aa, Staphylococcus aureus
  MISC_FEATURE (1)..(190): conserved hypothetical
LKGENEMTDVIIVHSMHGNSRNHWYQWLEHNLTLEGYDVTLFNFESPEAKTVDQWIEAMTKQINVRKKDTYFVTHGLGSITALKYIEMIDQPIEGFFSIAGFKEDAENIDLDIDLSNVTIDYDNIKKKVDNFYGLSSKNDKYVSYKETQRLMNALEGNLQIVEDGGHFLEEDGFETFTALQDRMQDYMTR

SEQ ID NO: 695 - DNA, 786 bp, Staphylococcus aureus
atgactacatttgatgctaaaaaattaaaaaaagaatatcttgattggtataatcagaccttagagttttctaatttatcaaacaatgtagtaagaatagatactccttttaaagataattctttagataatttaataatttacgctttatacgatcagtccagagacatgattacactgacagatgacggctatactatatttgatttagaaaataatggtatttctttaaataaatcaaaaaaacgtaaaaagatttttgaagagcacctttcagcttacggtattaaatataacgataaaactcacgaaatttttgttcaaactaactttaaaaattttaataaatcgaaacataatttattacagtgccttatatttgttaatgatatgtacttactttctaatcctaagtcacagaacatatttacagaagatgttgcaaacaaattggatgaacataacatttattacggaagagatttacctattataggaagcagtggtgttgttcataatttcgacttttttattagcgctaagaaaaatcaaaaagaaaaatttatcaatgctatttctaaccctaataattctatgattattaagtcgaaaataacggatgctatgcaagcaaaaaaaataaaaagacacaggcaaaatgagtttatttttattttaaatgactcaaaaaaagaaataaatgaacataataaaaatcttcttcatgaaaactatattagtacaatagattatagcgaattagatgaaaagataggtttattgatt

SEQ ID NO: 696 - protein, 262 aa, Staphylococcus aureus
  MISC_FEATURE (1)..(262): hypothetical protein
MTTFDAKKLKKEYLDWYNQTLEFSNLSNNVVRIDTPFKDNSLDNLIIYALYDQSRDMITLTDDGYTIFDLENNGISLNKSKKRKKIFEEHLSAYGIKYNDKTHEIFVQTNFKNFNKSKHNLLQCLIFVNDMYLLSNPKSQNIFTEDVANKLDEHNIYYGRDLPIIGSSGVVHNFDFFISAKKNQKEKFINAISNPNNSMIIKSKITDAMQAKKIKRHRQNEFIFILNDSKKEINEHNKNLLHENYISTIDYSELDEKIGLLI

SEQ ID NO: 697 - DNA, 537 bp, Staphylococcus aureus
ttggttgtgtatgcatctcacctatcttttttgcttttttcaaataagaaagtattaaaaattaatgcctatacaggaacagacatggctaaacttgatttaaatagtcttgacgacgagcacgtaaaattattaataaatgaattaaaatatccagaaactcatatcgatgtaaatgaattaaaaacaatagttgctagtcgaataaatgaaaggcaagaaataataagttttaagttaggaataaagtacttattaacaataaaaagagggaacatagaaaaagataggttttcaatttcaatcattttcaaagatacctatcacaccctagttagaatagatattaacggtggtactcacgataatccagatggaacaatcgctccgaaaagtcatattcacatatataatgataagtatgataaaaaggataggtttgcttatgaaattaacttgaaagatttccccgacatctataacttgtataatgtgtatatgtcgtttttagagtataataatataaaagaccttgaa

SEQ ID NO: 698 - protein, 179 aa, Staphylococcus aureus
LVVYASHLSFLLFSNKKVLKINAYTGTDMAKLDLNSLDDEHVKLLINELKYPETHIDVNELKTIVASRINERQEIISFKLGIKYLLTIKRGNIEKDRFSISIIFKDTYHTLVRIDINGGTHDNPDGTIAPKSHIHIYNDKYDKKDRFAYEINLKDFPDIYNLYNVYMSFLEYNNIKDLE

SEQ ID NO: 699 - DNA, 918 bp, Staphylococcus aureus
atgttagctgcaactttgtcagtaggactgattgcacctttagcatctccgattcaagaatctagagcaaatactaatattgaaaatattggtgatggtgctgaagtaatcaaacgtacggaggatgtaagtagtaagaaatggggcgttactcaaaatgtccaattcgactttgtaaaagataaaaaatataacaaagacgctttaattgttaaaatgcaaggttttattaattccagaacttcattttcagatgtgaagggtagtggatatgaattaactaaacgaatgatttggccattccaatataatataggactgacgactaaagatccaaatgttagcttaatcaattaccttcctaaaaacaaaatagaaactactgatgttggtcaaacattaggatataacattggaggtaatttccagtcagcaccatctataggtggcaatggctcatttaattattctaaaacaattagttatacccaaaagagttatgtcagtgaagtagacaagcaaaactcaaaatctgttaaatggggtgttaaagcaaacgaatttgttacgcctgatggaaaaaaatctgcgcatgatagatatttattcgtacaaagtccaaatggtccaacaggttcagcaagagaatattttgctcctgataatcaattgccacctttagttcaaagtggctttaatccatcgtttatcactacactatcacatgaaaaaggttcaagtgatacgagtgaatttgaaatttcatatggtagaaacttagatattacatatgcgactttattccctagaactggtatttacgcagaaagaaagcataatgcatttgtaaatagaaactttgtagttagatatgaagttaattggaaaacacacgaaattaaagtgaaaggacataat

SEQ ID NO: 700 - protein, 306 aa, Staphylococcus aureus
  MISC_FEATURE (1)..(306): leukotoxin S-subunit
MLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 701 - DNA, 981 bp, Staphylococcus aureus
atgaaaatgaaaaaattagtcaaatcatcagttgcttcatcaattgcactgcttttgctatcgaatacagttgatgcagctcaacatatcacacctgtaagcgagaaaaaagtagatgacaaaatcactttatacaaaacaacagcaacatctgataatgataaattgaatatttctcaaattttaacgtttaatttcattaaggataaaagttatgacaaagatacgttagtacttaaggcagccggaaacattaattcaggttataaaaagcctaatccaaaagattacaattactcacagttttattggggcggtaagtataatgtttcggttagttcagaatcaaatgatgctgtaaatgttgttgactatgcacctaaaaatcaaaatgaagaattccaagttcaacaaacattaggttattcttatggcggagatattaatatatctaatggcttatcaggtggattaaatggatcaaaatcattttcagaaacgataaattataaacaagaaagttacagaactacgattgatagaaaaacaaatcataaatcaattggctggggtgttgaggcgcacaaaattatgaataatggttggggaccatatggtagagatagttatgacccaacatatggtaatgaactgtttttaggtggtagacaaagtagttcaaatgctggtcaaaatttcttgccaacacatcaaatgcctttattggcgcgtggtaactttaacccagaatttataagcgtactttctcataaacaaaatgatacaaaaaaatctaaaatcaaagtaacttaccaaagagaaatggatagatatactaatcaatggaatcgactacactgggttggaaataactacaaaaatcaaaatacagtaacgtttacatctacttatgaagttgactggcaaaaccatactgttaaattaatcggtacggattctaaagaaactaatcctggagta

SEQ ID NO: 702 - protein, 327 aa, Staphylococcus aureus
  MISC_FEATURE (1)..(327): leukotoxin F-subunit
MKMKKLVKSSVASSIALLLLSNTVDAAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWVGNNYKNQNTVTFTSTYEVDWQNHTVKLIGTDSKETNPGV

SEQ ID NO: 703 - DNA, 141 bp, Staphylococcus aureus
atggaaaaagttcttgatttagacgtgcaagttaaagcaaacaataactcaaatgattcagcaggtgacgaacgtattacaagtcatagtttatgtactcctggttgtgctaagactggtagttttaatagcttctgctgt

SEQ ID NO: 704 - protein, 47 aa, Staphylococcus aureus
MEKVLDLDVQVKANNNSNDSAGDERITSHSLCTPGCAKTGSFNSFCC

SEQ ID NO: 705 - DNA, 1122 bp, Staphylococcus aureus
atgaagatagcaattataggtgcaggcatcggtggattaacagctgctgcattattacaagaacaaggtcatactattaaagtctttgaaaaaaatgagtcagttaaagaaattggcgctgggattggtatcggagataatgtgcttaaaaaactaggtaatcatgacttagctaaaggtattaaaaatgctgggcaaatcttatctacaatgacagtgttagatgacaaagatcgcctgttaactactgttaaattaaaaagtaatacattgaatgtgacgttaccacgccaaacattaattgacattattaaatcttatgtaaaagatgacgcaatatttacaaatcatgaagtcacgcatatagataatgagacagataaagttaccatacatttcgcggaacaagaaagtgaagcatttgatttatgtattggtgctgatggaattcattctaaagtgagacaatctgtaaatgctgacagtaaagtattatatcaagggtatacatgctttagaggtttaattgatgatattgatttaaagcatccggattgtgcaaaagaatactggggaagaaaaggaagagtaggtattgttccgttattaaataatcaagcatattggttcattacaattaactcgaaggaaaacaatcataaatatagttcgtttggtaaacctcatttgcaagcatactttaatcactatccaaatgaagttagagagatcttagacaaacaaagtgaaacaggtatcttattgcataatatttatgatttgaaaccactcaaatcttttgtttatggtcgtactattttactaggagatgcagcacatgcgacaacgcctaatatggggcaaggtgctggacaagcaatggaagatgctatcgtattagtaaattgttttaacgcatacgactttgaaaaagcattacagcgttatgataaaatacgtgtcaaacatactgcaaaagtaattaagcgttctagaaaaatcggtaaaattgcccaatatcgtagtcgtttatttgttgcagttagaaatcgtattatgaaaatgatgccaaatgcattagcagctggacaaactaaattcttatataaatcgaaagaaaaa

SEQ ID NO: 706 - protein, 374 aa, Staphylococcus aureus
  MISC_FEATURE (1)..(374): hypothetical protein
MKIAIIGAGIGGLTAAALLQEQGHTIKVFEKNESVKEIGAGIGIGDNVLKKLGNHDLAKGIKNAGQILSTMTVLDDKDRLLTTVKLKSNTLNVTLPRQTLIDIIKSYVKDDAIFTNHEVTHIDNETDKVTIHFAEQESEAFDLCIGADGIHSKVRQSVNADSKVLYQGYTCFRGLIDDIDLKHPDCAKEYWGRKGRVGIVPLLNNQAYWFITINSKENNHKYSSFGKPHLQAYFNHYPNEVREILDKQSETGILLHNIYDLKPLKSFVYGRTILLGDAAHATTPNMGQGAGQAMEDAIVLVNCFNAYDFEKALQRYDKIRVKHTAKVIKRSRKIGKIAQYRSRLFVAVRNRIMKMMPNALAAGQTKFLYKSKEK

SEQ ID NO: 707 - DNA, 2865 bp, Staphylococcus aureus
atgaaagaatcaatcctaacaacaacatttaacttatattgtactttacaagaaataaattttgatggcgataacaagaaggttagagatgctaaagaaagtttattaaaatatttaattagaatgtcaacacgtccaactccatttggattattaagtggtattaatttggggcattttgtaaatgaaccaacacgtcttaaagttggaaatagtattcaaaaatatgtgaaagtcgatggcgaatggttgtataaactggttagttatattgagagtattgatgaatattatcaaaatttgaaagttatttggaatagtaaagcacatattatcaatgatcgaatatatttaaatgaacaaagtgctatttatttaaacaacaataaagatacatctttttccattaaaaatagcgaattactcgtattcatcaaaaccactgtgacgaataataatattactttttcaaatttagctgaaaagataaatcaagaatttgaaattaatgatattactaaagtgaaagtatatatccataatcttgtctcaaaggaaattatatattcaacaatcagaccaccgttatcatatagcgataatttaaattatattttaaataaactttctttacataatgatgattttgtgaaaaaaattagagaaatccagaaattgatattagcttatgaaaaaactgaaattggatttggcgaggaattatataaagacattattcatcatatgaaggcactattcaaatgtaaaaactatcttcaaattgataccaaaattgacatgattaacaattatttacatcaagatatagcaacaaatatatctgaagcagcgtacttattgtggcttttatcaagaaataatattggattcacagatttgaaagttcttcacaaccgttttattgaaaagtatggatttgaacaactcgtgaatattaaagatttgatttcagatataacaggtttcgggacaacaatttttcaagaagaagaaaccgatggaaataatattgtaatgcttaagcaaaaatttttacatgccttgagaaataacgatgagatagtcataaatgaaaaagatgtagagtcattgattaacgataatgaaatcaatcattatcatgcgccaatgagtgcagatgtttatgctgaactttatttaggacgtttttacaatcagtacaatgagctcattgttattagtcctttaacggcgtcttttaatgctggcgctacatttgggcgatttcatcatttaattgatactgaaactttagcaaaattagaacatgaaaaaggacattattatcagaagatgatatgtgatgacaatgtagaaatgatttctataaataacataccgaaatatccgagaaatcataatgtattaactaatcatgactcatacgaatattcattgaatttaggaagtagtaatagttattcaaagtatgagcttaccttagatgatatttatgttggtgctacctttaacaaattatatttatattctagccaactaaataaaagggtactatttgaatcaaacaatatgtataactttttaaaagaatgtaatttatatcgattgttacgagaaatttcaatggaatctgtgaaatgcattgaacctatgaatgatgtgagtattgattcatttagttattcaccacgaatcagatataaaaatgtcattcttaaaccagcatattggaaaattaacgagatggtattacctttacctaaaaatgaagaatgggatcaacaatttttgaaatatcaagaacaattcaatatacctaatatcgtgaatttagtttatggagataacaagcttctactaaatttatcattagctaatcatagatatttattgatgaaagaatataagaagcataaacgtgtacgtttagtagaatcatttttacctcaatcaaagaatgatcatgtgtatgaaattgttacaccaatttataaaaaatcatcttatcgaggacccgaaatcgaaattccaaaatataaaaatacagatattgaatatgacaaagactggtttgcattacatattcatatcgataagccatcgcaagatacatttatcatcgacaatttgtatccatttgtaaaacatcttaaagataagggagatatagatcaatattttttaatgcgttatatcaaacaaggtgacattttaaagttgaggttattcaggaatgacgaaaattacgcagaaatatacagcatcttgaagaattggttaccacatgttcgacaaacgacagaagtttcagattatgaatttgtatcatacgagccagaattttttagatatggtggaaagaacacgattaatgaaatagaagccttctttgaatatgacacgaatttagctgtcaatattattgaaaatgattttaagtttgatcgaccatatattgttgctatttcaataatgtatttatttgagatgttttcaatttctaatgaagagcgtatggaaattgttaataactatgtacctacatcatttaaaagtaaagatattagaccttttaaaaatgaacttgtaactatatgtaatcctgctaataattttgaatatatggctaaacactatagtggtatttatcgaattttaaaagatggcaaccaaattttgagcaaattaaatgaagggcttaaaaaaactttaactactaaaaggtcaaggattattggcagcttaattcatatgcgctgcaatcgaatatttggcattgataaggatcaagaaacatttgttttatctattgtaaaagaaattgttaaaactcaaaagcattggtgtggtgacaaaaatgat

SEQ ID NO: 708 - protein, 955 aa, Staphylococcus aureus
MKESILTTTFNLYCTLQEINFDGDNKKVRDAKESLLKYLIRMSTRPTPFGLLSGINLGHFVNEPTRLKVGNSIQKYVKVDGEWLYKLVSYIESIDEYYQNLKVIWNSKAHIINDRIYLNEQSAIYLNNNKDTSFSIKNSELLVFIKTTVTNNNITFSNLAEKINQEFEINDITKVKVYIHNLVSKEIIYSTIRPPLSYSDNLNYILNKLSLHNDDFVKKIREIQKLILAYEKTEIGFGEELYKDIIHHMKALFKCKNYLQIDTKIDMINNYLHQDIATNISEAAYLLWLLSRNNIGFTDLKVLHNRFIEKYGFEQLVNIKDLISDITGFGTTIFQEEETDGNNIVMLKQKFLHALRNNDEIVINEKDVESLINDNEINHYHAPMSADVYAELYLGRFYNQYNELIVISPLTASFNAGATFGRFHHLIDTETLAKLEHEKGHYYQKMICDDNVEMISINNIPKYPRNHNVLTNHDSYEYSLNLGSSNSYSKYELTLDDIYVGATFNKLYLYSSQLNKRVLFESNNMYNFLKECNLYRLLREISMESVKCIEPMNDVSIDSFSYSPRIRYKNVILKPAYWKINEMVLPLPKNEEWDQQFLKYQEQFNIPNIVNLVYGDNKLLLNLSLANHRYLLMKEYKKHKRVRLVESFLPQSKNDHVYEIVTPIYKKSSYRGPEIEIPKYKNTDIEYDKDWFALHIHIDKPSQDTFIIDNLYPFVKHLKDKGDIDQYFLMRYIKQGDILKLRLFRNDENYAEIYSILKNWLPHVRQTTEVSDYEFVSYEPEFFRYGGKNTINEIEAFFEYDTNLAVNIIENDFKFDRPYIVAISIMYLFEMFSISNEERMEIVNNYVPTSFKSKDIRPFKNELVTICNPANNFEYMAKHYSGIYRILKDGNQILSKLNEGLKKTLTTKRSRIIGSLIHMRCNRIFGIDKDQETFVLSIVKEIVKTQKHWCGDKND

SEQ ID NO: 709 - DNA, 1278 bp, Staphylococcus aureus
ttgttaaaactcaaaagcattggtgtggtgacaaaaatgattgatatgaatctaatattgaagaagaagtttcaagagatttcagaagtagatgatttcatttcaaaagcatctactgaaaccgattattttgaaccttcaactttatcacatggtataccaggtatcattttgtttttagatgcttatcaaaaagttttcgatattaatactgagcaaattgtgcataagtacatcatgaaattagcaccatatttacagagtggtcaatataacaattctttgtttggtggactttcaggtattgcattttcaatggatttagcatcgcaaaatggcaaaaattatcaaaatattttaaataatattgatggtcacattgtaaatgaaatagaaaataaatttgatcaaatattacaagaaccattaaatccattaaattatgatactgtcagtggattagctgggatagggagatatttgctaaatagagtagatgagaatgaatttaatgttaaagcattaaaaagcatattagtatactttaaagatattcaatattctaaaaatagctgggtagtcccacaagaaagtcaatttttagagtctgataaaaattattttactgaaggtaatatcaatcttggccttgcacatggagtgctaggaccgatgtctttatttgcattatgcgtgattaaaggaattacgattgaaaatcatcagcacatattaaaagacatgtacaaatttatcatggacgaaaaattttgtaaccacgaaagatggttgcagcgttacgatttaatttctgaacgtaatcatttcaattttattcggaatggttggtgttatggcaatacgggtgtaatgacgacgttgtttttaatcggccaagcattacaagatgatgaaataattaaaatgtctaaaaaagtgatgctacaagtagtaaatgataaagatgaaaatttaataagtccaactatttgtcatggattgtcatcacaaatattaatgttaacaattatgaatttgaattttgaattaaatgaagtgtctgattatatcactgtattaataaataaactgatttctcattataaggaagattatctggtgaattttatagacattaatgaaaataagcaagatgtatttaaaagtaggaaagttggccttttagaaggtgaattaggggtctatctaacattgatgacactgaaaaatacaaaaattctcaatgaaaaaaattggaccaatgcgtttttaattagc

SEQ ID NO: 710 - protein, 426 aa, Staphylococcus aureus
LLKLKSIGVVTKMIDMNLILKKKFQEISEVDDFISKASTETDYFEPSTLSHGIPGIILFLDAYQKVFDINTEQIVHKYIMKLAPYLQSGQYNNSLFGGLSGIAFSMDLASQNGKNYQNILNNIDGHIVNEIENKFDQILQEPLNPLNYDTVSGLAGIGRYLLNRVDENEFNVKALKSILVYFKDIQYSKNSWVVPQESQFLESDKNYFTEGNINLGLAHGVLGPMSLFALCVIKGITIENHQHILKDMYKFIMDEKFCNHERWLQRYDLISERNHFNFIRNGWCYGNTGVMTTLFLIGQALQDDEIIKMSKKVMLQVVNDKDENLISPTICHGLSSQILMLTIMNLNFELNEVSDYITVLINKLISHYKEDYLVNFIDINENKQDVFKSRKVGLLEGELGVYLTLMTLKNTKILNEKNWTNAFLIS

SEQ ID NO: 711 - DNA, 531 bp, Staphylococcus aureus
atggaggcgtatatcatgggagaaaatgtattgatttgtttgtgtggctcagttaatagtatcaatattagccactatattattgaattaaaatcaaaatttgatgaagtaaatgtaatcgcgtcaacaaacggtagaaagtttattaatggtgaaatattaaagcaattttgcgataactattatgacgaatttgaagacccttttttaaatcatgtagatatagcaaataaacatgacaagattattattttacctgcgacttctaatacgattaataaaattgcaaatggtatatgtgacaatttattattaactatttgtcatacagcttttgaaaaactttctatatttccaaatatgaatttacgaatgtgggaaaatccagttactcaaaataatattcgattattaaaagattatggtgtatcaatatatccagcaaatatttcagaaagttatgaattagcgtcaaaaacatttaaaaagaatgttgtcgcacctgaaccatataaagttctggaattcatt

SEQ ID NO: 712 - protein, 177 aa, Staphylococcus aureus
  MISC_FEATURE (1)..(177): pantothenate metabolism
MEAYIMGENVLICLCGSVNSINISHYIIELKSKFDEVNVIASTNGRKFINGEILKQFCDNYYDEFEDPFLNHVDIANKHDKIIILPATSNTINKIANGICDNLLLTICHTAFEKLSIFPNMNLRMWENPVTQNNIRLLKDYGVSIYPANISESYELASKTFKKNVVAPEPYKVLEFI

SEQ ID NO: 713 - DNA, 1371 bp, Staphylococcus aureus
atgaaaatcataaagcgcgctattattagtttaataatattgagtcttttaatatctattacaatgagtaatgcatcagcgtcagaagaactatattacagtgttgaatacaaaaatacagcaacatttaacaagttagttaaaaagaagtccttaaacgttgtctataatataccggaattacatgtggcacagattaaaatgacgaaaatgcatgctaatgctttagcaaactataaaaatgatattaaatatatcaatgccacatgttcaacttgtattactagcgagaaaacaatagacagaacatcaaatgagtcattattttcaagacaatgggatatgaataaaataaccaataatggtgcatcgtatgatgatttgccaaaacatgctaacaccaaaatagcaatcatagatacaggtgtgatgaaaaaccatgacgatttgaaaaataatttctcgactgattctaaaaatttagtacctttaaacggttttagaggtactgaaccggaggaaacaggtgatgttcacgatgtcaatgataggaaaggacatggcacgatggtgtcgggtcaaacgagtgctaatggtaagttaataggtgttgcaccgaataacaaatttacaatgtatcgcgtgtttggtagtaaaaaaacagaactgctttgggtatcaaaagcgattgttcaagctgcaaatgatggaaatcaagtcattaatattagtgttggtagttatattattttggacaaaaatgaccatcaaacatttagaaaagatgaaaaagtagaatacgatgcgttacagaaagcaatcaattacgccaagaagaaaaaatctatcgttgttgctgcagctggtaatgatggtattgatgtcaatgacaaacagaaactaaaattacagcgtgaatatcaaggtaatggcgaagtgaaagatgttcctgcatctatggacaatgtcgttacagtaggatctacagatcaaaagagtaatctatctgagttttccaattttggtatgaattatacagatattgctgcgcccggaggatcatttgcttatttaaatcaattcggtgtggataaatggatgaatgaagggtatatgcataaggagaacattttaactactgccaataacggaagatatatttatcaagctggaacttcattagccacacctaaagtttcgggagcactagctttaatcattgataaatatcatcttgaaaaacatccagataaagcgattgaattgttatatcagcatgggacatctaagaataataaaccatttagtagatatgggcatggtgagcttgatgtgtataaagcattaaatgtagcaaatcaaaaagcaagt

SEQ ID NO: 714 - protein, 457 aa, Staphylococcus aureus
MKIIKRAIISLIILSLLISITMSNASASEELYYSVEYKNTATFNKLVKKKSLNVVYNIPELHVAQIKMTKMHANALANYKNDIKYINATCSTCITSEKTIDRTSNESLFSRQWDMNKITNNGASYDDLPKHANTKIAIIDTGVMKNHDDLKNNFSTDSKNLVPLNGFRGTEPEETGDVHDVNDRKGHGTMVSGQTSANGKLIGVAPNNKFTMYRVFGSKKTELLWVSKAIVQAANDGNQVINISVGSYIILDKNDHQTFRKDEKVEYDALQKAINYAKKKKSIVVAAAGNDGIDVNDKQKLKLQREYQGNGEVKDVPASMDNVVTVGSTDQKSNLSEFSNFGMNYTDIAAPGGSFAYLNQFGVDKWMNEGYMHKENILTTANNGRYIYQAGTSLATPKVSGALALIIDKYHLEKHPDKAIELLYQHGTSKNNKPFSRYGHGELDVYKALNVANQKAS

SEQ ID NO: 715 - DNA, 696 bp, Staphylococcus aureus
ttgattatggcaaaattagttactgaaaacatttcgaagcggtttaaaaatcaagatgtattaaagcatattaatatcactttagaaaataacgaagtttatggattacttggtattaatggagccggtaaaacgacacttatgaaaattatatgtggcatacttcaacaagattcaggggaaattaaattagataatagaccaatgacacgaaatgatttgcacaaagttggttcgcttattgaaacacctgcgacatataatcatttaagtgcacaagataatttgaaaattgtgtgtttaaatgaaagcgttgatttcagcgaaattaatagtgttttaagcttagtcaatttaaatgtcgataaaaagaaaaaggttaaggacttttctttaggtatgaaacaaagacttggaattgcaatggcattaattaaaaagccagaaattttagtattagacgaaccatctaatggtttagacccatatggaatccaagaacttagagaacttctaaaattattaacagaacaaggtactagtattattatttcaagtcacattttatctgaaatccaagttttagcagatcatatcggtattattcatgagggtgagctaaaatatcagcaaagaaataacaaagatgaaaacttagaagagatattcttcaaaataacgaaaggtgattacaaa

SEQ ID NO: 716 - protein, 232 aa, Staphylococcus aureus
  MISC_FEATURE (1)..(232): hypothetical protein
LIMAKLVTENISKRFKNQDVLKHINITLENNEVYGLLGINGAGKTTLMKIICGILQQDSGEIKLDNRPMTRNDLHKVGSLIETPATYNHLSAQDNLKIVCLNESVDFSEINSVLSLVNLNVDKKKKVKDFSLGMKQRLGIAMALIKKPEILVLDEPSNGLDPYGIQELRELLKLLTEQGTSIIISSHILSEIQVLADHIGIIHEGELKYQQRNNKDENLEEIFFKITKGDYK

SEQ ID NO: 717 - DNA, 759 bp, Staphylococcus aureus
atgatacatttaaagatagaaggtatcaaatttaaaaattctttcagtatgtatgttttattaataagtccgctggtatttctttgttttgctattttcacagtcttattcgccaaaagtaatacgggaacagcgaatagtgtgtcaccatatataactttactatttaatatttggccaattgctttcatcccgattgtattatgtatggcttgtaattcgttatttaaaattgaaatgagaaataaatcatttaattattacttaagtaataattggtcgattacaaaagaaataagagcaaagattttcattttatcaatagcatttttggtacattgctttttagtatttattattgcttatataggtgacctaattattaatccacatccggttaatgctatgttgttattggtgacaatattgttgatgtatgtagtatctctaccattgataccgctcaactttttattaactcgatactttggtgtgttcgtatcaatattaataaacttagtattatcagtcatttgtgtcttgtttttaacattgaagagtttattttgggtgttgccgtgggggataatgcagagaatcccgcttattacgcttggtatactacctaatggtttagttgtaaaccataattcaaaatactttaatgatctcaatgccttatatatttcgattattgttagcatcattattttcgcgatagtaacatttttaaataataagaaaagttggcgattaaaa

SEQ ID NO: 718 - protein, 253 aa, Staphylococcus aureus
MIHLKIEGIKFKNSFSMYVLLISPLVFLCFAIFTVLFAKSNTGTANSVSPYITLLFNIWPIAFIPIVLCMACNSLFKIEMRNKSFNYYLSNNWSITKEIRAKIFILSIAFLVHCFLVFIIAYIGDLIINPHPVNAMLLLVTILLMYVVSLPLIPLNFLLTRYFGVFVSILINLVLSVICVLFLTLKSLFWVLPWGIMQRIPLITLGILPNGLVVNHNSKYFNDLNALYISIIVSIIIFAIVTFLNNKKSWRLK

SEQ ID NO: 719 - DNA, 708 bp, Staphylococcus aureus
ttggcgattaaaatgataattaacgaattaaagtcatgtaagttgaaattttctaagcaagcgctcacatttgtacccattattgtaaccatattgtttatattatttataaattggtatttaaacgtaaatttatggaatggtcgacaaataagtttgtttacagcgagttttaatgcaattacatcgctattaatttctataaacgtctatcaagttatcaattttgaagaaaatattggtcactttaatcatattttaggaaaagctaataggctaaattggttaaatgcatcaatgatttttacttatactattacagccatatgtattctattagcatcaattaatttattgtggcattcacatgatatgaaaataacacttatgtttataggcgtatcattgtttttcaatgtaattatattactgctactttttatttttagtattttcattaaagatgtaatggctattgttgtcggagttttaatgtttatttttaacgtttattttggattagaagtgcttggagatcattcgtggttctatttaccaatcacatatgctacacgttacgtttatatgtttatcgaagggagtataccagttacattaacattggcaatctatattattatcacgttgctattagcagttttactctttaaaggatttaataaatggagcggtagaacaattaaagat

SEQ ID NO: 720 - protein, 236 aa, Staphylococcus aureus
  MISC_FEATURE (1)..(236): truncated hypothetical
LAIKMIINELKSCKLKFSKQALTFVPIIVTILFILFINWYLNVNLWNGRQISLFTASFNAITSLLISINVYQVINFEENIGHFNHILGKANRLNWLNASMIFTYTITAICILLASINLLWHSHDMKITLMFIGVSLFFNVIILLLLFIFSIFIKDVMAIVVGVLMFIFNVYFGLEVLGDHSWFYLPITYATRYVYMFIEGSIPVTLTLAIYIIITLLLAVLLFKGFNKWSGRTIKD

SEQ ID NO: 721 - DNA, 564 bp, Staphylococcus aureus
atgaatacaaaatttttaggtaaaacattagtagcaagtgctttagtattaacaacattaggaacaggcttacattcttcatacttaggattagatacaaataaagttgttaaaacggctaaagcagaagaaaaaatgacagatggtcaattatggaaaaaagttaaagattcattacatgattctgatattattttaagtaacgagtacgaaacaatcaacgttacttatttattaagcaatggatattctagcagcgtttctgctcctggaaatgatgatggaggccatctaacacaatctatagactttaaaggattaaaacaaattgatttaactaaggaaaatgtctacgatgactttaacaaaaagctagatgctaaaaatacatggaattctctaaccgagaagttaaaaggtcttggtttactacaaaatggccaaaaagtatctatttattcttcagatagctcttctccagtctcgggtaaagtgggagaaggagtaactagtggtggcgaaaatactctaactaaacgcttcatcaacaaaatcacaattgat

SEQ ID NO: 722 - protein, 188 aa, Staphylococcus aureus
  MISC_FEATURE (1)..(188): probable beta-lactamase
MNTKFLGKTLVASALVLTTLGTGLHSSYLGLDTNKVVKTAKAEEKMTDGQLWKKVKDSLHDSDIILSNEYETINVTYLLSNGYSSSVSAPGNDDGGHLTQSIDFKGLKQIDLTKENVYDDFNKKLDAKNTWNSLTEKLKGLGLLQNGQKVSIYSSDSSSPVSGKVGEGVTSGGENTLTKRFINKITID

SEQ ID NO: 723 - DNA, 705 bp, Staphylococcus aureus
atgaataaaaatgtaatggttaaaggtttaactgctttaactattttaacatctcttggttttgctgaaaatatttctaatcagcctcattcaattgccaaagcagaaaagaatgtcaaagaaattaccgatgcaactaaggaaccatacaattcagtggtagcatttgtgggtggtactggtgtagttgttggtaaaaatacaatcgtaactaacaaacatatcgctaaaagtaatgatatttttaaaaatagagtatcagcacatcattcgagtaaaggtaaaggcggaggaaactacgacgttaaagacattgtagaatatcccggaaaagaagaccttgcgatagttcatgttcatgaaacaagtacagaaggtttgaattttaataagaacgttagttatacaaaatttgcagacggagcaaaagtgaaagatagaatttctgttattggttatccaaagggtgcacaaacaaaatataaaatgtttgaatcgacaggaacgattaaccatatcagtggaacgtttatggaatttgatgcgtatgcacaaccaggtaattcaggatctcctgtattgaattctaaacatgaactgattggtattttatatgcaggtagtggaaaagatgaatctgaaaagaatttcggtgtttatttcacaccacaattaaaagaatttattcaaaataatattgaaaaa

SEQ ID NO: 724 - protein, 235 aa, Staphylococcus aureus
  MISC_FEATURE (1)..(235): serine protease
MNKNVMVKGLTALTILTSLGFAENISNQPHSIAKAEKNVKEITDATKEPYNSVVAFVGGTGVVVGKNTIVTNKHIAKSNDIFKNRVSAHHSSKGKGGGNYDVKDIVEYPGKEDLAIVHVHETSTEGLNFNKNVSYTKFADGAKVKDRISVIGYPKGAQTKYKMFESTGTINHISGTFMEFDAYAQPGNSGSPVLNSKHELIGILYAGSGKDESEKNFGVYFTPQLKEFIQNNIEK

SEQ ID NO: 725 - DNA, 762 bp, Staphylococcus aureus
atgtatctagatatcaaaataattaaaagagaggaacttaaaatgaacaaaaacgtagtcatcaagagtttagcagcattaacaattttaacatctgtaacaggtattggaacaacattggttgaggaagtacaacaaactgccaaagcagaaaataatgtcacaaaagttaaagatactaatatttttccatatactggtgtagttgcttttaaaagtgcaactggatttgtagttggaaagaatactattttaacaaataaacatgtgtcgaaaaattacaaagtgggcgatcgtattactgcacatccaaatagtgataaaggtaatggtggtatttattcgattaaaaagattattaattatccaggtaaagaagatgtatcagtcattcaagttgaagagcgtgcaatagaacgtggaccaaaaggctttaattttaatgataatgtaacgccattcaaatatgcggcaggggctaaagctggtgagcgaattaaagtgattggttatccacacccatacaaaaataaatatgttttatatgagtcaactggccctgtgatgtcagtagaaggtagcagtattgtatattcagcgcatactgaaagcggaaactctggatcacctgtattaaacagcaacaacgaattagttggtattcattttgcttctgatgtaaaaaatgatgataacagaaatgcatatggcgtctactttacaccagaaattaaaaaattcattgcagaaaacatagataaa

SEQ ID NO: 726 - protein, 254 aa, Staphylococcus aureus
  MISC_FEATURE (1)..(254): serine protease
MYLDIKIIKREELKMNKNVVIKSLAALTILTSVTGIGTTLVEEVQQTAKAENNVTKVKDTNIFPYTGVVAFKSATGFVVGKNTILTNKHVSKNYKVGDRITAHPNSDKGNGGIYSIKKIINYPGKEDVSVIQVEERAIERGPKGFNFNDNVTPFKYAAGAKAGERIKVIGYPHPYKNKYVLYESTGPVMSVEGSSIVYSAHTESGNSGSPVLNSNNELVGIHFASDVKNDDNRNAYGVYFTPEIKKFIAENIDK

SEQ ID NO: 727 - DNA, 723 bp, Staphylococcus aureus
ttgaaaatgaataaaaatatagtcattaaaagcatggcagcattagccattctaacctcagtaactggaataaatgctgcagtcgttgaagagacacaacaaatagcaaatgcagagaagaatgttacgcaagttaaagatacaaatatttttccatataatggcgtcgtttcatttaaagatgcgacaggttttgtaattggaaaaaatacaattatcaccaataaacatgtatcaaaagattataaagttggcgatagaattactgcccatccaaacggtgacaaaggaaatggtggtatatataaaattaaaagcatttctgattatccgggtgatgaagacatctctgtcatgaatattgaagaacaagcagtcgaacgtggaccaaaaggctttaattttaatgaaaatgtccaagcattcaattttgcgaaagatgctaaagttgatgacaaaattaaagttattggttacccattacctgctcaaaatagttttaaacagtttgaatctacaggaactataaaaagaatcaaagacaatattttaaattttgatgcatacattgaacccgggaattcaggatcaccagttctaaattctaacaatgaggtcataggtgtggtgtatggcggtattggaaaaattggttctgaatataatggtgccgtatactttacgcctcaaatcaaagattttattcaaaagcacattgaacaa

SEQ ID NO: 728 - protein, 241 aa, Staphylococcus aureus
  MISC_FEATURE (1)..(241): serine protease
LKMNKNIVIKSMAALAILTSVTGINAAVVEETQQIANAEKNVTQVKDTNIFPYNGVVSFKDATGFVIGKNTIITNKHVSKDYKVGDRITAHPNGDKGNGGIYKIKSISDYPGDEDISVMNIEEQAVERGPKGFNFNENVQAFNFAKDAKVDDKIKVIGYPLPAQNSFKQFESTGTIKRIKDNILNFDAYIEPGNSGSPVLNSNNEVIGVVYGGIGKIGSEYNGAVYFTPQIKDFIQKHIEQ

SEQ ID NO: 729 - DNA, 741 bp, Staphylococcus aureus
atgaataaacagaggagcacaaaaatgaataaaaatataatcatcaaaagtattgcggcattgacgattttaacatcaataactggtgtcggcacaacagtggttgatggtattcaacaaacagccaaagcagaaaatagtgtgaaattaattaccaacacgaatgttgcaccatacagtggtgttacatggatgggcgctggaacaggatttgtagttgggaatcatacaatcattaccaataaacatgttacttatcacatgaaagtcggtgatgaaatcaaagcacatcctaatggtttttataataacggtggtggactttataaagttactaagattgtagattatcctggtaaagaagatattgcggtcgtacaagttgaagaaaaatcaacgcaaccaaaaggtagaaaattcaaagatttcactagcaaatttaatatagcatcagaagctaaagaaaatgaacctatatcagtcattggttatccaaatcctaatggaaataaactacaaatgtatgaatcaactggtaaagtactatcagtgaatggaaatatagtgacatctgatgcggttgtccaacctggcagctctggttcacctatattaaatagtaagcgagaagcaattggtgttatgtatgctagtgataaaccaacaggtgaaagtacaaggtcatttgctgtttatttctctcctgaaattaagaaatttattgcagataatttagataaa

SEQ ID NO: 730 - protein, 247 aa, Staphylococcus aureus
  MISC_FEATURE (1)..(247): serine protease
MNKQRSTKMNKNIIIKSIAALTILTSITGVGTTVVDGIQQTAKAENSVKLITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVTSDAVVQPGSSGSPILNSKREAIGVMYASDKPTGESTRSFAVYFSPEIKKFIADNLDK

SEQ ID NO: 731 - DNA, 714 bp, Staphylococcus aureus
atgaataaaaatataatcatcaaaagtattgcagcattgacgattttaacatcagtgactggcgtcggcacaacagtggttgagggtattcaacaaacggctaaagctgaacataatgtgaaactaatcaaaaatactaatgtagcaccatacaatggtgtcgtttcgataggatctggaacaggtttcattgtcggtaaaaatacaattgttaccaacaagcatgtcgttgcaggtatggaaattggtgcacatattatagcgcatcccaatggtgaatataataatggcggattttataaagttaaaaaaattgtccgttattcaggtcaagaagatattgccattctacatgtggaagataaagctgttcatccaaaaaacaggaattttaaagattacacaggcattttaaaaatagcatcagaagctaaagaaaatgaacgcatttcaattgttggctatccagaaccatatataaataaatttcaaatgtatgagtcaacaggaaaagtgctgtcagttaaaggcaacatgattattactgatgctttcgtagaaccaggcaactcaggttcagctgtatttaacagtaaatacgaagttgtaggtgttcactttggtggaaacggccctggaaataaaagtacaaaaggatatggtgtttatttctctcctgaaattaagaaattcattgcagataacacagataaa

SEQ ID NO: 732 - protein, 238 aa, Staphylococcus aureus
  MISC_FEATURE (1)..(238): serine protease
MNKNIIIKSIAALTILTSVTGVGTTVVEGIQQTAKAEHNVKLIKNTNVAPYNGVVSIGSGTGFIVGKNTIVTNKHVVAGMEIGAHIIAHPNGEYNNGGFYKVKKIVRYSGQEDIAILHVEDKAVHPKNRNFKDYTGILKIASEAKENERISIVGYPEPYINKFQMYESTGKVLSVKGNMIITDAFVEPGNSGSAVFNSKYEVVGVHFGGNGPGNKSTKGYGVYFSPEIKKFIADNTDK

SEQ ID NO: 733 - DNA, 717 bp, Staphylococcus aureus
atgaataaaaatataatcatcaaaagtattgcagcattgacgattttaacatcaataactggtgtcggcacaacaatggttgaaggtattcaacaaacagccaaagccgaaaatactgttaaacaaattacaaatacaaatgttgcaccatacagtggtgttacatggatgggcgctggaacaggatttgtagttggaaatcatacaatcattaccaataaacatgttacctatcacatgaaagtcggtgatgaaatcaaagcacatcctaatggtttttataataacggtggtggactttataaagttactaagattgtagattatcctggtaaagaagatattgcggttgtacaagttgaagaaaaatcaacacaaccaaaaggtagaaaattcaaagatttcactagtaaatttaatatagcatcagaagctaaagaaaatgaacctatatcagtcattggttatccaaatcctaatggaaataaactacaaatgtatgaatcaactggtaaagtattatcagtgaatgggaatatagtgtcatcggatgcaattattcagcctggtagctctggttcacctatattaaatagtaaacacgaagctattggtgtaatctatgccggtaataagccatcaggtgaaagcacaagaggatttgctgtttatttctctcctgaaattaagaaattcattgcagataatttagataaa

SEQ ID NO: 734 - protein, 239 aa, Staphylococcus aureus
  MISC_FEATURE (1)..(239): serine protease
MNKNIIIKSIAALTILTSITGVGTTMVEGIQQTAKAENTVKQITNTNVAPYSGVTWMGAGTGFVVGNHTIITNKHVTYHMKVGDEIKAHPNGFYNNGGGLYKVTKIVDYPGKEDIAVVQVEEKSTQPKGRKFKDFTSKFNIASEAKENEPISVIGYPNPNGNKLQMYESTGKVLSVNGNIVSSDAIIQPGSSGSPILNSKHEAIGVIYAGNKPSGESTRGFAVYFSPEIKKFIADNLDK

SEQ ID NO: 735 - DNA, 1737 bp, Staphylococcus aureus
atgattttgaaagcatttgaaagctacaacatttctataaaatttttcaataacaattgcgccactaaaactcaaaatttccaccaccaacatccaaattatcaacatcgcaacataaccaaatgttataataaatctattacacaaagagataaattacttatgcaaaggcggaggaatcacatgtctattactgaaaaacaacgtcagcaacaagctgaattacataaaaaattatggtcgattgcgaatgatttaagagggaacatggatgcgagtgaattccgtaattacattttaggcttgattttctatcgcttcttatctgaaaaagccgaacaagaatatgcagatgccttgtcaggtgaagacatcacgtatcaagaagcatgggcagatgaagaatatcgtgaagacttaaaagcagaattaattgatcaagtcggttacttcattgagccacaagatttattcagtgcgatgattcgtgaaattgaaacgcaagatttcgatatagaacatctagcgacggcgattcgcaaagttgaaacatctacattaggtgaagaaagtgaaaatgactttatcgggctgttcagcgatatggatttgagttcaacgcgactaggtaacaatgtcaaagaacgtactgctttaatctctaaagtcatggttaatcttgacgacttaccattcgttcacagtgacatggaaattgatatgttaggtgatgcatatgaattcctaatcgggcgctttgcggcgacagcgggtaaaaaagcaggcgagttctatacaccacaacaagtatctaagatactggcgaagattgtcacagacggtaaagataaattacgtcacgtgtacgacccaacatgtggttccggttcattgttgttacgtgttggtaaagaaacgcaagtgtatcgttatttcggacaagaacgtaacaatactacatacaacttagcacgcatgaatatgttattacatgatgtgcgttatgagaacttcgagatccgtaatgatgacacattggaaaatccagcctttttaggcaatacatttgatgcggttattgcgaacccaccatacagtgcgaaatggacagcagattcaaaatttgaaaatgatgaacgattcagtggttacggcaagcttgcgccaaaatccaaagcagactttgcctttattcaacacatggtacattacctagacgatgaaggtaccatggcagtcgtactcccacatggtgtattattccgtggtgccgcagaaggtgtgattcgtcgctatttaatagaagaaaagaactacttagaagccgtgattgggttaccagccaatattttctatgggacaagtattccaacatgtattttagtatttaaaaaatgtcgccaacaagacgacaacgtactatttatcgatgcatccaatgattttgaaaaaggaaaaaatcaaaaccatttaagcgatgcccaagtcgaacgtattatagacacatataagcgtaaagcaacgattgataaatatagctacagcgcgacattacaagagatcgccgataacgattacaacttaaacataccgcgatatgttgatacattcgaagaagaagcaccaattgatttagatcaagtccaacaagatttgaaaaatatcgacaaagaaatcgcagaaattgaacaagaaatcaatgcatacctgaaagaacttggggtgttgaaagatgag

SEQ ID NO: 736 - protein, 579 aa, Staphylococcus aureus
  MISC_FEATURE (1)..(579): type I restriction enzyme
MILKAFESYNISIKFFNNNCATKTQNFHHQHPNYQHRNITKCYNKSITQRDKLLMQRRRNHMSITEKQRQQQAELHKKLWSIANDLRGNMDASEFRNYILGLIFYRFLSEKAEQEYADALSGEDITYQEAWADEEYREDLKAELIDQVGYFIEPQDLFSAMIREIETQDFDIEHLATAIRKVETSTLGEESENDFIGLFSDMDLSSTRLGNNVKERTALISKVMVNLDDLPFVHSDMEIDMLGDAYEFLIGRFAATAGKKAGEFYTPQQVSKILAKIVTDGKDKLRHVYDPTCGSGSLLLRVGKETQVYRYFGQERNNTTYNLARMNMLLHDVRYENFEIRNDDTLENPAFLGNTFDAVIANPPYSAKWTADSKFENDERFSGYGKLAPKSKADFAFIQHMVHYLDDEGTMAVVLPHGVLFRGAAEGVIRRYLIEEKNYLEAVIGLPANIFYGTSIPTCILVFKKCRQQDDNVLFIDASNDFEKGKNQNHLSDAQVERIIDTYKRKATIDKYSYSATLQEIADNDYNLNIPRYVDTFEEEAPIDLDQVQQDLKNIDKEIAEIEQEINAYLKELGVLKDE

SEQ ID NO: 737 - DNA, 1197 bp, Staphylococcus aureus
atgagtaatacacaaacgaaaaatgtgccagagttgagattcccaggatttgaaggcgaatgggaagagaagaagttagggaatcttactaccaaaataggtagtggaaagactcccaaaggtggaagtgaaaactatacaaacaaaggcataccatttttaaggagtcaaaatattagaaatggtaaattaaatcttaatgacttagtttatattagtaaagatatagatgatgagatgaaaaatagtagaacgtactatggtgatgttcttttaaatattacaggagcatcaataggtagaacagccattaattcgatagttgaaacgcatgctaatttaaatcaacatgtatgtattattagattgaaaaaagagtattattataatttttttggacagtatctattatcaagaaaaggtaaaaggaaaattttccttgcacaaagtggaggtagtcgagaaggtctaaacttcaaagaaattgctaatttaaaaatcttcaccccaactatatttgaagaacagcaaaaaataggcaagttcttcagcaaactcgaccgacaaattgaattagaagaacaaaaacttgaattgcttcaacaacagaaaaaaggctatatgcagaaaatcttcacacaagaattgcgattcaaagatgagaatggtgaagaatatccagagtgggaaaacaaattcataaaagacatctttatctttgaaaataatagaagaaaaccaattacttcttcattaagagaaaaggggttatacccttactatggtgcaactggaattattgattacgtaaaagattatttattcaataatgaagaacgattactaataggagaagatggtgcaaaatgggggcagtttgagacgagtagctttattgctaatgggcaatactgggtaaataatcatgcgcatgtagttaaaagtaatgatcataatttgttttttatgaattattatttaaattttaaagaactacgagcatttgtcacaggtaatgcaccagctaaattaactcatgcgaacttatgcaatataaatcttaaaataccttgtctcactgaacaagataaagtaagtgcattgttaaaatctatagacaataaaatgaataatcaaatgaatagaattgagttattaaaagaacgtaaaaaaggactattacaaaaaatgtttatt

SEQ ID NO: 738 - protein, 399 aa, Staphylococcus aureus
  MISC_FEATURE (1)..(399): probable specificity
MSNTQTKNVPELRFPGFEGEWEEKKLGNLTTKIGSGKTPKGGSENYTNKGIPFLRSQNIRNGKLNLNDLVYISKDIDDEMKNSRTYYGDVLLNITGASIGRTAINSIVETHANLNQHVCIIRLKKEYYYNFFGQYLLSRKGKRKIFLAQSGGSREGLNFKEIANLKIFTPTIFEEQQKIGKFFSKLDRQIELEEQKLELLQQQKKGYMQKIFTQELRFKDENGEEYPEWENKFIKDIFIFENNRRKPITSSLREKGLYPYYGATGIIDYVKDYLFNNEERLLIGEDGAKWGQFETSSFIANGQYWVNNHAHVVKSNDHNLFFMNYYLNFKELRAFVTGNAPAKLTHANLCNINLKIPCLTEQDKVSALLKSIDNKMNNQMNRIELLKERKKGLLQKMFI

SEQ ID NO: 739 - DNA, 4110 bp, Staphylococcus aureus
ttgaaacgatcaacgaatcaagaaaaatttcttgatacactaattagacttaatactaagattgaagaactaggaaagataaatattttaaataatcatatatattccgaatatttttttagagacctgttaaatattgtatatgggtattcacttgagaatcataataaaaaacaaaaaaatgcaccagcatttgatcttatagataatacgaataaaattattattcaagttaccgcaacgtgtaaaaagcaaaaaatagaggacactctaaaaaaagagtatttaacaaataaaatggaagaaggttatcgattaaagtttatatttattggaaatcaaaataataatattaaaaataagaatttttcaaatccacataatatattattcgatagtaaaaaagatattattttaactcaagacttatgcgaagagtttttgaatttaaacataaataagcaagatcacgctattgaattattaaaaaaagaattatctccgcttttatttgaagattctttgtcatatttaaaagaagaatttattaatgaaaaattagaatttaatatatcgaatttagcttcacgatatactgcgaataatgatgtcgatactattaataataaaattatagaaggtatttctattaccaataattttaaatatactaatatttcatatctaaaagaattaaaaggttatatcgaaaatgatattttagataagatgaaatcaaaatacgcaaagaatatttatttgaatttcaaaaaaatattctctaatttagaacaatcagtcaataattatttggaactggaagaagagtttgaagaaaagaaaaaatacttaagtgaaatttatgaattgatagacgaaattaatattgacccttatatttttctgacagaacataatgaatgtaatatatacaaaataagtgagaatgaaaaattagaacttcaaacttatatgagtaaaatcgaaaaagtattattaaaatatcaaacgtatttaaaagaaacatgtaaagaatgcttgttttatccttatttgctagttcaaggtgaagctggcataggaaaatcacaccttttagcgcatctatctaaaaaacttagagatgaaaatcatattatttatctgtttttgggacaattttttactaaaaatgaagatccatggcatcaaatacttaatgatttagaagttacaaattctgttgataattttttaaggtcaataagtaataaggccaaagaaacaaaaaaaagagcttttattattattgatgcgcttaatgaaggtgaaggtaaaaggttatggggaaattattttcaaagctttatcaaccatataaagaagtattctaatatagctttaatattttctattagaaccccttttgaagatgttatattacccaaaaacgcaatacaagataacaatattgtagtatttcagcatgaaggttttagtaaggaagaaaactataatccaattgtatctttttgtgatttttatggattagagctacctaagttacctatattaaatccagaattcaacaatccattatttttaaaactaatgtgtgagtactgtgtaaataaatttaaggaatttgaccaaactataagtgttgcagagctatttacaaatgttcttaagacagtaaatattaatttatctaaggaagataaatttgattttgataaaaatattaatgttgtacaaaaagtaataaaaggattagttgaattaatgaacgactcagaatttaatcaactaaattatgaggaatcctatactgttgttaataatatagctaaagagtatgttcaaaagtcaaatagatttttagaagcgctaatagatgaaaatatattaattaaaaatactggctataaaggtgaaatgattatttatttttcgtatgagcgtatgggagattactttttatcagaataccttttagagaaatatagaaatgttgataaaagagatttagtaactaaattacagtcagatgaaaaagtgacaaggtattttcaaaaggaagacgatttatcttataatagaggtcttattaatgaactttttattaaattagcaaatgaatttaatatagagctatttgaagtatttccacagtttaaaaacaattataacatgatatattcttttataaatagtttagtatggagaaaagatggtagcataagtaaacatactaaatgctatatatccgataatgttattccttatgatgcatttagaaataattttttagatgtcttattaataaaaatgcctcaaaaaaaccatccgttaaatatttgggctttacataaattattgaaacaatgcaatttaggaaaaagagattttttatggactcaatatatatctataaataatgaaaaggtttttgaaattattaattggctatttagtaactataagaaattagatgaagaaactgcggaaaaatatatgatttttttaacgtggatattttctgcaactaataataaattaagagatctcggtactaaatctttagtaaaattattcaaaacatttccaactaaaattattggtttattaaaattatttgaaaataacaatgatccatatatagtcgaaagattatatgcttctgttttaggggcgacacttcgaatcgacatttgtgaaatacatatagagattgctaattatatttatgaagaaatatttgataaagaaatggtatatcctcatattttaatgagagattatgctaggcaaacaattgaatatattagtttatcaaaagatatatctaatataaatttagaaaaaattaggccaccttataaaagtaattggtataaaaaagaatattcgaatttaaatatagacgattacataaaatctttaaaaaacaaattagatagccatttacatttttctatcgataaaattaaaaactcaatgacaacggaatatggaagaggaactggggcatatggcgattttggcagatatgtatttggttatgctgtacgaaactgggtaaagggttttaaaagtgatcaagacttaagtaatatagcattaatgaggatttttgaaatgggttatgatgcaaaattacatggtgaatttgatatgtgggttaatcgttatgataactttaataattcaattgaaagaattagcaaaaaatatcaatggattgcttactatgaaattttagctaaacttgtagataaatttcctgatgttcaatattctggactatgggatgattatattagagatattgatcctactttactattacttgaaattgataaagaatcaaaaatactagtaccctcaccacttccttcgcatcaatcgaatgaatgggtaaaaaataccaaagtttttgatgaaacaaaattatttttagaaatagatatagacaatcatagatatatatgtttaagctcaaagtttaattttgaaaagagagagaaagaaataccatttgaagatagagactcatgttatttcttagcgatgggatatttttataataaagaagatagtaatgaaattatcaaaggttatgaaaataattatgatagaggtattaatattcctcgagcacatagtatatatttatatgaatattattggagcgaagcttataaaaattataaagagggatatttaactgaatcagatggtaaattatgtccagctatttatgaatatttttgggagttagattattctgttaaggacaaatcaataagtttttatattccgtgtaaagaaatagtagattatttttcattaatacaaacggaagaaggagtatggaaaactaaatttggtgaaacaatatgtattaattctaaattactcgaatttgataatgaatgtttacttattaaaaaagaaagtttattaaactttcttaatactaaaaaattgtctattggatggaaaatatatctagaaaaaatttctcttcgagatagacaagaatggtggtacaatgttttttatgacgatggcaaatataataagaaaataattaagaatgacatgtcaaaaattaggcgtaatttt

SEQ ID NO: 740 - protein, 1370 aa, Staphylococcus aureus
LKRSTNQEKFLDTLIRLNTKIEELGKINILNNHIYSEYFFRDLLNIVYGYSLENHNKKQKNAPAFDLIDNTNKIIIQVTATCKKQKIEDTLKKEYLTNKMEEGYRLKFIFIGNQNNNIKNKNFSNPHNILFDSKKDIILTQDLCEEFLNLNINKQDHAIELLKKELSPLLFEDSLSYLKEEFINEKLEFNISNLASRYTANNDVDTINNKIIEGISITNNFKYTNISYLKELKGYIENDILDKMKSKYAKNIYLNFKKIFSNLEQSVNNYLELEEEFEEKKKYLSEIYELIDEINIDPYIFLTEHNECNIYKISENEKLELQTYMSKIEKVLLKYQTYLKETCKECLFYPYLLVQGEAGIGKSHLLAHLSKKLRDENHIIYLFLGQFFTKNEDPWHQILNDLEVTNSVDNFLRSISNKAKETKKRAFIIIDALNEGEGKRLWGNYFQSFINHIKKYSNIALIFSIRTPFEDVILPKNAIQDNNIVVFQHEGFSKEENYNPIVSFCDFYGLELPKLPILNPEFNNPLFLKLMCEYCVNKFKEFDQTISVAELFTNVLKTVNINLSKEDKFDFDKNINVVQKVIKGLVELMNDSEFNQLNYEESYTVVNNIAKEYVQKSNRFLEALIDENILIKNTGYKGEMIIYFSYERMGDYFLSEYLLEKYRNVDKRDLVTKLQSDEKVTRYFQKEDDLSYNRGLINELFIKLANEFNIELFEVFPQFKNNYNMIYSFINSLVWRKDGSISKHTKCYISDNVIPYDAFRNNFLDVLLIKMPQKNHPLNIWALHKLLKQCNLGKRDFLWTQYISINNEKVFEIINWLFSNYKKLDEETAEKYMIFLTWIFSATNNKLRDLGTKSLVKLFKTFPTKIIGLLKLFENNNDPYIVERLYASVLGATLRIDICEIHIEIANYIYEEIFDKEMVYPHILMRDYARQTIEYISLSKDISNINLEKIRPPYKSNWYKKEYSNLNIDDYIKSLKNKLDSHLHFSIDKIKNSMTTEYGRGTGAYGDFGRYVFGYAVRNWVKGFKSDQDLSNIALMRIFEMGYDAKLHGEFDMWVNRYDNFNNSIERISKKYQWIAYYEILAKLVDKFPDVQYSGLWDDYIRDIDPTLLLLEIDKESKILVPSPLPSHQSNEWVKNTKVFDETKLFLEIDIDNHRYICLSSKFNFEKREKEIPFEDRDSCYFLAMGYFYNKEDSNEIIKGYENNYDRGINIPRAHSIYLYEYYWSEAYKNYKEGYLTESDGKLCPAIYEYFWELDYSVKDKSISFYIPCKEIVDYFSLIQTEEGVWKTKFGETICINSKLLEFDNECLLIKKESLLNFLNTKKLSIGWKIYLEKISLRDRQEWWYNVFYDDGKYNKKIIKNDMSKIRRNF

SEQ ID NO: 741 - DNA, 375 bp, Staphylococcus aureus
ttgaataaaaaatatcttatgattgtaattataattttaatattgattctaggcggaatctttttgaagatgaaatatgacgaaaagaaatattatgatgaacaaaaagaaagaataacgatttatatgaagtacaatgtgaaaggttataaaaatataagcttcgctaattttaaagaaaacccaatggatggttattctattagtggttatataaataatgataaaaagttatcatttacagctggtataagatctgttgatgattttcaatttgataccgatatttcttatacagatgaattgggtagaaaatttaataaaaatcctaagtcagtttctgaaataaaaaaagagcaaaatacgtccaataaa

SEQ ID NO: 742 - protein, 125 aa, Staphylococcus aureus
  MISC_FEATURE (1)..(125): hypothetical protein
LNKKYLMIVIIILILILGGIFLKMKYDEKKYYDEQKERITIYMKYNVKGYKNISFANFKENPMDGYSISGYINNDKKLSFTAGIRSVDDFQFDTDISYTDELGRKFNKNPKSVSEIKKEQNTSNK

SEQ ID NO: 743 - DNA, 99 bp, Staphylococcus aureus
atgcaaggttttaaagagaaacatcaagaactaaaaaaggctctatgtcaaattggactgatgcgttcaatatccgaagttaagcaactaaacattgct

SEQ ID NO: 744 - protein, 33 aa, Staphylococcus aureus
MQGFKEKHQELKKALCQIGLMRSISEVKQLNIA

SEQ ID NO: 745 - DNA, 141 bp, Staphylococcus aureus
atgacaagagaaagaagatcatttagttcagagtttaagttacaaatggttagattatataaaaatggtaagcctaggaatgaaattatacgcgagtatgatttcacaccttcgacgtttgtaaatggcggttataaaatg

SEQ ID NO: 746 - protein, 47 aa, Staphylococcus aureus
  MISC_FEATURE (1)..(47): probable transposase
MTRERRSFSSEFKLQMVRLYKNGKPRNEIIREYDFTPSTFVNGGYKM

SEQ ID NO: 747 - DNA, 381 bp, Staphylococcus aureus
ttgagtaaccaaaatttatttgatgaacttgagaaaaaaggttataaactggaagatatatttacaaaagaagaaataaaaaaatataaagctgaagaccaattgagagcgggtaaaactcaatatgtagaaacaggtaaagatactgcaacattatatctttcttctgcatatacaaaaacaatagctgctttaggtgcgggggctattagcgttatttctgcactaacaggaggtttagttggcgcaggtgttggtggtttccttggatctatagctgcatcgaatattgatactagtaagggaatatatataaaattaaaaactaaaaagtatgcagccggggaatacgttctgacaggagaaaaatggggatatcag

SEQ ID NO: 748 - protein, 127 aa, Staphylococcus aureus
LSNQNLFDELEKKGYKLEDIFTKEEIKKYKAEDQLRAGKTQYVETGKDTATLYLSSAYTKTIAALGAGAISVISALTGGLVGAGVGGFLGSIAASNIDTSKGIYIKLKTKKYAAGEYVLTGEKWGYQ

SEQ ID NO: 749 - DNA, 174 bp, Staphylococcus aureus
atggatagattaaaatattcacttaaagttggaattttagcattattattattttgtactttaaattatttagttccaatgcaaagcaatgctttttcaataattatatattcggcaatttttgctgtgttacttatgcttttagtttatatatttttaggaattttaaagaaa

SEQ ID NO: 750 - protein, 58 aa, Staphylococcus aureus
MDRLKYSLKVGILALLLFCTLNYLVPMQSNAFSIIIYSAIFAVLLMLLVYIFLGILKK

SEQ ID NO: 751 - DNA, 183 bp, Staphylococcus aureus
atgaaacaaattagcattggctatgaagaaatctatggggatagaatttttcatagccattttttaaaagagcatgaagtaaaaaattggaaaaccgtcaatcaaataattgaaaaagaacacttggacaaaaatgaatatgaagcggaaccgccgttatttttcttttcaggatcgttagat

SEQ ID NO: 752 - protein, 61 aa, Staphylococcus aureus
MKQISIGYEEIYGDRIFHSHFLKEHEVKNWKTVNQIIEKEHLDKNEYEAEPPLFFFSGSLD

SEQ ID NO: 753 - DNA, 639 bp, Staphylococcus aureus
atgtttacacctatagttataaatttattaaatgatgtaggttcgatttttttagttagggtggggaatcaattgaaagttattgagaaagttcattatgaagatattttagaatcaaaaatagttcgattatttcaggcatttataaaggacaaaatggatcaactttttattacttctgaacactttgctattgacatagacaagctattatttcaacttaatttaaatgttagatatattaaaatggagggtaatacttcgggttatttaagtggaagaacaatctatattaataataatcactcgattaataatacaagattttcaatagctcgtgaattgggccgttatttatttaaaaatacagacttaatgagagatagtaacgataatagtctaaagaatttacatgaaatgatttatgaaagcgacgtaaatcagttttcagtcgacttacttatgcctaaaaagcaaatagaggcattagtctataatttttatgaagtcaataatatcaatttaagttctggtttatctgaaaaagaacgaaacaaactattgaaccttatatcaactaagttggaagtttcgaaagtagctgctggattaaggctgtataatttaggaatacatatt

SEQ ID NO: 754 - protein, 213 aa, Staphylococcus aureus
MFTPIVINLLNDVGSIFLVRVGNQLKVIEKVHYEDILESKIVRLFQAFIKDKMDQLFITSEHFAIDIDKLLFQLNLNVRYIKMEGNTSGYLSGRTIYINNNHSINNTRFSIARELGRYLFKNTDLMRDSNDNSLKNLHEMIYESDVNQFSVDLLMPKKQIEALVYNFYEVNNINLSSGLSEKERNKLLNLISTKLEVSKVAAGLRLYNLGIHI

SEQ ID NO: 755 - DNA, 621 bp, Staphylococcus aureus
gtgagtattgattttattctttgtaaattacaagcatttcatattataaagtttgaaaagaggtatattgaaatggagaaaaatgaatatatagctaaatataatgaatatagtcaattattagacgctacatactcgcaagctgtagcataccttttaagtaaatatggcgctgtaaccgatgattattataaagaaaaatcatacacgcgatttttaaatggagaaatcaaaagtatttcaaaaggaaaatacactagagctagcgaaggattatattgccatcatataagcgaggacaaattccaaaatctatctgatctaagattcatttccaaatttaagtactcatacgacgttcaaaagaaagaaaacttagtgtactgtgatctaatcgagcatttaattttacatgcaattattacaaaagaatcccatggccaatttggtgtagctggattatgtcaaatgatcaaaccaacagtcattgattggtacattggcgaatataatccaaaaccagcatggatgcaagccaccaaagcacgtgcctatttgcctggaatattagtagagaaattactcattaaaattgacgatatgttaaaaggaatagaaata

SEQ ID NO: 756 - protein, 207 aa, Staphylococcus aureus
  MISC_FEATURE (1)..(207): hypothetical protein
VSIDFILCKLQAFHIIKFEKRYIEMEKNEYIAKYNEYSQLLDATYSQAVAYLLSKYGAVTDDYYKEKSYTRFLNGEIKSISKGKYTRASEGLYCHHISEDKFQNLSDLRFISKFKYSYDVQKKENLVYCDLIEHLILHAIITKESHGQFGVAGLCQMIKPTVIDWYIGEYNPKPAWMQATKARAYLPGILVEKLLIKIDDMLKGIEI

SEQ ID NO: 757 - DNA, 342 bp, Staphylococcus aureus
atgataacatttgagaatatacaacaacttgagaaatacaccttaatgactatgcatggtctttttaatcaacttaaactcggcattatttcaatcgaaaacgcagagcatacgctttttacaccttatatgttggaaacgctctcttccctaggcgtgaaagacagcattgtcgatttaattcataaagggactgaattagaagactttgcggcatttaatttatcaattgaagacacagttacagtctgtttacaaagaactgaagaactattaaaacaatacaaaaatgtggaattcaatgacaaaatattaatcaattggcgtattatacaagagaaa

SEQ ID NO: 758 - protein, 114 aa, Staphylococcus aureus
  MISC_FEATURE (1)..(114): hypothetical protein
MITFENIQQLEKYTLMTMHGLFNQLKLGIISIENAEHTLFTPYMLETLSSLGVKDSIVDLIHKGTELEDFAAFNLSIEDTVTVCLQRTEELLKQYKNVEFNDKILINWRIIQEK

SEQ ID NO: 759 - DNA, 951 bp, Staphylococcus aureus
atggaaaaagtttatgttgctggtgcaataccagaagtaggtttaaaacttttacaagaacattttgaagttgaaatgtatgaaggtaaaggattagtcgataaagacactttaattaaaggtgttaaaaacgcgactgccttaattagtttattatctacaaacgttgataaagatgttatcgatgctggtaaagacttaaaaatcattgccaactatggcgctggttttaataatattgatatcgagtatgcccgagaaaaaagtatagatgttacaaacacacctaaagcatcaacaaacgcgactgctgatttaacaattggattagtacttgcagtagcgcgtcgtattgttgaaggggaccaattatcacgtacaactggatttgatggatgggcacctttatttttcagaggtagagaagtatctgggaaaacaatcggcattatcggtttaggtgaaattggtagtgcagtagctcgtcgtgcaagagcatttgacatggatgtgctatacactggacctaatcgcaaagaagaaaaagaacgagaaatcggtgcaaaatatgtagatttagatacactattaaagaatgcagattttatcactatcaacgctgcttataatcctaaaatgcatcatttaattgatacagaacaatttaaaatgatgaaatctacggcgtatttaatcaatgcctctcgtggtccaatcgtgcacgaacaagcactagtgcaagcattgaaagataatgaaattgaaggtgctgcacttgatgtatatgaatttgaaccagatattaccgatgacttaaaatcacttaataatgtagtattaacaccgcatattggtaatgctacatttgaagcacgtgacatgatgtctaaaattgttgctaatgctgcaattagtgccgttcaaggtgagaaaccacaatttgtcgttaac

SEQ ID NO: 760 - protein, 317 aa, Staphylococcus aureus
  MISC_FEATURE (1)..(317): hypothetical protein
MEKVYVAGAIPEVGLKLLQEHFEVEMYEGKGLVDKDTLIKGVKNATALISLLSTNVDKDVIDAGKDLKIIANYGAGFNNIDIEYAREKSIDVTNTPKASTNATADLTIGLVLAVARRIVEGDQLSRTTGFDGWAPLFFRGREVSGKTIGIIGLGEIGSAVARRARAFDMDVLYTGPNRKEEKEREIGAKYVDLDTLLKNADFITINAAYNPKMHHLIDTEQFKMMKSTAYLINASRGPIVHEQALVQALKDNEIEGAALDVYEFEPDITDDLKSLNNVVLTPHIGNATFEARDMMSKIVANAAISAVQGEKPQFVVN

SEQ ID NO: 761 - DNA, 624 bp, Staphylococcus aureus
atgaaattcaaagctatcgttgcaatcacattatcattgtcactattaactgcctgtggtgctaatcaacataaagaaaatagtagtaaatcaaatgacactaataaaaagacgcaacaaactgacaacactacacagtcaaatacagaaaagcaaatgacaccacaagaagccgaagatatagttcgaaacgattacaaagcaagaggcgttaatgaatatcaaacattaaattataaaacaaatcttgaacgaagcaatgaacatgaatattatgttgaacatctagtccgcgatgcagttggcacaccattaaaacgttgtgctattgttaatcgacacaatggcacaattattaatatttttgatgatatgtcagaaaaagacaaagaagaatttgaagcatttaaaaagagaagccctaaatacaatccaggtatgaacaatcatgatgaaacagatggtgagtcagaagacattcaacatcatgacattgataataacaaagcaattcaaaatgacataccagatcaaaaagtcgacgataaaaatgataaaaatgctgttaataaagaagaaaaacatgataatggggcaaataattctgaagaaactaaagttaaa

SEQ ID NO: 762 - protein, 208 aa, Staphylococcus aureus
  MISC_FEATURE (1)..(208): hypothetical protein
MKFKAIVAITLSLSLLTACGANQHKENSSKSNDTNKKTQQTDNTTQSNTEKQMTPQEAEDIVRNDYKARGVNEYQTLNYKTNLERSNEHEYYVEHLVRDAVGTPLKRCAIVNRHNGTIINIFDDMSEKDKEEFEAFKKRSPKYNPGMNNHDETDGESEDIQHHDIDNNKAIQNDIPDQKVDDKNDKNAVNKEEKHDNGANNSEETKVK

SEQ ID NO: 763 - DNA, 1050 bp, Staphylococcus aureus
ttgtatttagctttatgcactaatcacatagtaaataatgagggagattttttaggcatgagcaatcaattcaaaagcgaagaagagcgaagacaatgggaacaattccaagctttccaaaatcaacaaaaccaacagaaccagcaatacggacaaaagaaatctaaaaaaggatggttctggggctgtggtggttgtctagtattatttattttaattatcatcggtatttcagcttgtacagctggtattacaggtaaccttggcggaaatagttctaaagaaacgaacaaaacccataaaatcggtgaaactgttaaaaatggcgaccttgaagtcactgtaaattcagtggaaactatgaaatctgtaggaccatctcttgcaccaacaaacgctaaaggtatatttgtcgttgctgatgtgacgattaaaaacaaaggtaaagaagcgttaacaattgatagttcaatgtttaagctaaaatccggtgataaaacatttgaagcagataatacaggttcaatgtctgctaatcaaagtgacaatggtagtatagaaaattcatttttcttacagcgtataaatccagatagcactgctcaaggtaaaattgttttcgatgtgtcagaaaacatagccaacgcaaaagataaaaaattagaagttatttctagtttatttagcgtcaagaagattacatttgatttatccgatgctaaaaaaacatcaaaagctaaaaaagacaagcaagatacagaagtagctgttgcgagttcaaatagcgataatgtaagttatgaagcttcggctactacacctgctacaacttctagtgcggatactgattctgaagatagcgaaaagtctagtaaagatgaggataagcagaatgcgtctaaaagtgataaatctagtgtagaaaaaagtgaatctaatgaggaaactgctcctgtagagcccatgccccatagcaaacctaccactagtgaagcaccacctagccaaaatattcacaatgaagatagcatgtacgacgcttcaacagaa

SEQ ID NO: 764 - protein, 350 aa, Staphylococcus aureus
  MISC_FEATURE (1)..(350): conserved hypothetical
LYLALCTNHIVNNEGDFLGMSNQFKSEEERRQWEQFQAFQNQQNQQNQQYGQKKSKKGWFWGCGGCLVLFILIIIGISACTAGITGNLGGNSSKETNKTHKIGETVKNGDLEVTVNSVETMKSVGPSLAPTNAKGIFVVADVTIKNKGKEALTIDSSMFKLKSGDKTFEADNTGSMSANQSDNGSIENSFFLQRINPDSTAQGKIVFDVSENIANAKDKKLEVISSLFSVKKITFDLSDAKKTSKAKKDKQDTEVAVASSNSDNVSYEASATTPATTSSADTDSEDSEKSSKDEDKQNASKSDKSSVEKSESNEETAPVEPMPHSKPTTSEAPPSQNIHNEDSMYDASTE

SEQ ID NO: 765 - DNA, 648 bp, Staphylococcus aureus
atgaaaataacatataaatatagaggagatttacctttgaatacagagaacaacaagaatcaaaaccaatctgttaaaaattctgaaagacgcggcatgttaaaaggatgcggcggttgccttatttcttttattttattaataatcttattatcagcctgttcaatgatgtttagtaataatgacaattccactaataatcaatcatcaaaaacgcaattaactcaaaaagatgaaaataaaaatgaagataagcctgaggaaaaatcagaaacagcaacagatgaggatttacaatcaaccgaagaagtacctgcaaatgaaaatactgaaaataatcaacatgaaattgatgaaataacaacaaaagatcaatcagacgatgatattaacacaccaaacgttgcagaagataaatcacaagacgacttgaaagatgatttaaaagaaaagcaacaatcaagtaaccatcatcaatccacgcaacctaagacctcaccatcaactgaaacaaacacgcaacaatcatttgctaattgtaagcaacttagacaagtatatccgaatggtgtcactgccgatcatccagcatatcgaccacatttagatagagataaagataaacgtgcatgtgaacctgataaatat

SEQ ID NO: 766 - protein, 216 aa, Staphylococcus aureus
  MISC_FEATURE (1)..(216): hypothetical protein
MKITYKYRGDLPLNTENNKNQNQSVKNSERRGMLKGCGGCLISFILLIILLSACSMMFSNNDNSTNNQSSKTQLTQKDENKNEDKPEEKSETATDEDLQSTEEVPANENTENNQHEIDEITTKDQSDDDINTPNVAEDKSQDDLKDDLKEKQQSSNHHQSTQPKTSPSTETNTQQSFANCKQLRQVYPNGVTADHPAYRPHLDRDKDKRACEPDKY

SEQ ID NO: 767 - DNA, 507 bp, Staphylococcus aureus
ttgtatttatttttagaggtgttgcttttgaaaaagtttttaaaattcaaggggatgaaaatatgtttaatgctatatctactgatttttttaagtagttgtagcacaaataataaaatagtaggccaacgatttgaaatacaacaacataatgaaacaataggtagtatttacttttcagcagactatgcacatataagaggtatagaaaaaggcactgcaaaatatttcatagacaaagtaggcagcaaacgttacttatttattgaatatattccggataatgtattgaattgcaagccggacttttggaaaacgttaaaatataaaaaggacaaggtaacatattatgtatatctcattgaaaatttagatgatgaagtattccatttaagtgcattacaagacatgaaccgtataccaattgacattgcagatgatgtggcaacaatgggtaaatcaccacatcaaaatgacagaatgacactaaaattaaataaaaataac

SEQ ID NO: 768 - protein, 169 aa, Staphylococcus aureus
  MISC_FEATURE (1)..(169): hypothetical protein
LYLFLEVLLLKKFLKFKGMKICLMLYLLIFLSSCSTNNKIVGQRFEIQQHNETIGSIYFSADYAHIRGIEKGTAKYFIDKVGSKRYLFIEYIPDNVLNCKPDFWKTLKYKKDKVTYYVYLIENLDDEVFHLSALQDMNRIPIDIADDVATMGKSPHQNDRMTLKLNKNN

SEQ ID NO: 769 - DNA, 1476 bp, Staphylococcus aureus
atggacttttggttatataaacaagcacaacaaaatggacatcatattgcgataacagacggtcaagaatcttatacttatcaaaatttatactgtgaagcgagtctattggctaaaagactcaaggcttatcaacaatctcgtgttgggctatacatagataattcgattcaatcgatcattttaatacatgcatgttggttggcaaatattgaaattgcgatgattaatacaaggttgacacctaatgagatgacgaatcagatgaagtcaatcgatgtacaattgattttttgtaccttgccactggaattacgagggtttcaaattgtatcgctggatgatattgaattcgctggaagggatattacaacgaacagtttgttggacaacacaatgggtatccaatatgaaacatcgaatgaaactgtggtgccgaaagagtcgccgtccaacatattaaatacatcatttaatttagatgacattgcatcgattatgtttacatcagggacaacgggccctcaaaaagcggtgccacaaacgtttcgtaatcattatgccagtgcaatcggatgtaaagagagcttgggatttgatcgtgacactaattggctatctgtcttgccgatttatcatatttcgggtctcagtgtacttttaagagctgttattgaaggttttactgtgcgcattgttgataaattcaatgccgaacaaattttaacgatgattaaaaatgaacgaatcacgcacatttcgcttgtgccacaaactttaaattggcttatgcaacaaggtttacatgaaccttataatttacaaaaaatattactcggcggtgctaaattatctgccactatgatagagacggcattacaatataacctgccaatttataattcatttggtatgactgagacatgttcgcaatttttaacagcaacaccggaaatgttgcatgcacgtcctgacactgtagggatgccaagtgccaatgttgacgtaaaaattaaaaatcctaataaagaaggtcatggagaattaatgattaaaggcgccaatgtgatgaatgtatatttgtatccaacagatttaacgggtacgtttgaaaatggttattttaatacgggtgacattgctgaaatagatcatgaaggttatgtcatgatttatgaccgacgtaaagatttaattattagtggcggtgaaaatatttatccatatcaaattgaaacggtagcgaagcaatttccaggtatcagtgacgcagtatgtgtagggcatcctgatgatacttggggccaagtgcctaaattatattttgtcagtgaaagtgacatttcaaaggcacaattgattgcatatttatcacaacatttagcgaaatataaagtaccgaaacactttgaaaaggttgatactttaccttatacatcaacaggtaaattacaaagaaataagttgtatagagga

SEQ ID NO: 770 - protein, 492 aa, Staphylococcus aureus
  MISC_FEATURE (1)..(492): O-succinylbenzoic acid-CoA
MDFWLYKQAQQNGHHIAITDGQESYTYQNLYCEASLLAKRLKAYQQSRVGLYIDNSIQSIILIHACWLANIEIAMINTRLTPNEMTNQMKSIDVQLIFCTLPLELRGFQIVSLDDIEFAGRDITTNSLLDNTMGIQYETSNETVVPKESPSNILNTSFNLDDIASIMFTSGTTGPQKAVPQTFRNHYASAIGCKESLGFDRDTNWLSVLPIYHISGLSVLLRAVIEGFTVRIVDKFNAEQILTMIKNERITHISLVPQTLNWLMQQGLHEPYNLQKILLGGAKLSATMIETALQYNLPIYNSFGMTETCSQFLTATPEMLHARPDTVGMPSANVDVKIKNPNKEGHGELMIKGANVMNVYLYPTDLTGTFENGYFNTGDIAEIDHEGYVMIYDRRKDLIISGGENIYPYQIETVAKQFPGISDAVCVGHPDDTWGQVPKLYFVSESDISKAQLIAYLSQHLAKYKVPKHFEKVDTLPYTSTGKLQRNKLYRG

SEQ ID NO: 771 - DNA, 1074 bp, Staphylococcus aureus
ttgaaaaggttgatactttaccttatacatcaacaggtaaattacaaagaaataagttgtatagaggatgatttgatgaagttgacagctttgcatttttataaatatagtgagccatttaagtcacaaattgtaacaccgaaagtcactttaacgcatcgtgattgtttgtttatcgaattgattgatgacaaaggaaatgcatatttcggggaatgtaacgcttttcaaacagattggtatgatcatgaaacaattgcctcagtgaaacatgtaattgagcaatggttcgaagataatagaaataaatcatttgaaacgtatgaagcagcactaaaattagtagattcattggaaaatacgcctgctgcaagggcaactattgtcatggcattgtatcaaatgtttcatgtactgccttcattttcagtagcatatggagcgacagcgagcggcttatcaaataaacaactagagtcattaaaagcaacaaagccgaccagaattaaattaaaatggacgcctcaaatcatgcatcaaattagagtgttacgggaattagactttcactttcaattggttatagatgcaaatgagtccttggatcgtcaagatttcacacagttacagttattagcgcgtgaacaggttctttatatcgaagagccatttaaagatatctccatgcttgatgaagtagcggatggaacaatacctccaatagcccttgatgaaaaggcaacatcgttgttggacataattaatttgatagaattatacaatgtgaaagttgttgtattaaaaccatttcgtctaggtggcattgataaagtgcaaacggcaattgatactttgaaaagtcatggtgcaaaagtggttattggcggcatgtacgaatatggtttaagccgctattttacagcgatgcttgctcgtaaaggtgattatccaggagatgttacaccagcaggttattattttgaacaagatgtggtggcgcattcaggcatattaaaagaggggcgactcgaatttcgcccccctttagtggatataactcaattacaaccatat

SEQ ID NO: 772 - protein, 358 aa, Staphylococcus aureus
  MISC_FEATURE (1)..(358): o-succinylbenzoic acid
LKRLILYLIHQQVNYKEISCIEDDLMKLTALHFYKYSEPFKSQIVTPKVTLTHRDCLFIELIDDKGNAYFGECNAFQTDWYDHETIASVKHVIEQWFEDNRNKSFETYEAALKLVDSLENTPAARATIVMALYQMFHVLPSFSVAYGATASGLSNKQLESLKATKPTRIKLKWTPQIMHQIRVLRELDFHFQLVIDANESLDRQDFTQLQLLAREQVLYIEEPFKDISMLDEVADGTIPPIALDEKATSLLDIINLIELYNVKVVVLKPFRLGGIDKVQTAIDTLKSHGAKVVIGGMYEYGLSRYFTAMLARKGDYPGDVTPAGYYFEQDVVAHSGILKEGRLEFRPPLVDITQLQPY

SEQ ID NO: 773 - DNA, 270 bp, Staphylococcus aureus
ttggaggcattaattatgaaaaagatattcttggcgatgattcatttttatcaacgtttcatttcgccactcactccaccaacttgtcgtttttatccaacatgttcagagtacactagagaagcgattcaataccacggtgctttcaaaggcctttatttaggtatccgtcgtattttaaaatgtcatccgcttcataaaggcggctttgaccctgttccgttaaaaaaagacaagtcagcaagcaagcattcacataaacataaccat

SEQ ID NO: 774 - protein, 90 aa, Staphylococcus aureus
  MISC_FEATURE (1)..(90): conserved hypothetical
LEALIMKKIFLAMIHFYQRFISPLTPPTCRFYPTCSEYTREAIQYHGAFKGLYLGIRRILKCHPLHKGGFDPVPLKKDKSASKHSHKHNH

SEQ ID NO: 775 - DNA, 477 bp, Staphylococcus aureus
atgcgcgtgaagtttagggataaagataatcgtcaagttaatttgacatttaaaaaggataatgagatagcagatggcaatcatgtgctagctattccaacgtttaaaaatcaattgctttttaccaaacataatttacgggggattgaatttcctggtggtaaaagggaacgcggggaaagtagtgctgaagcagttacacgtgaattatatgaagaaacaggcgccaaagttaaaaatatttattacatagcacaatataccattgaaacacatgatcaaactgattttgtaaaagatgtatattttatcgaagttgaatcattggtaagcaagaacgattatttagaaacagcagggccagtgttgtttaactgtatcaatgatattgaactcgcacaacggagtttcttactgcaagatagtaccattttaaaatgcgtagagagggtgcaatcacttgggttttatcaaacg

SEQ ID NO: 776 - protein, 159 aa, Staphylococcus aureus
  MISC_FEATURE (1)..(159): conserved hypothetical
MRVKFRDKDNRQVNLTFKKDNEIADGNHVLAIPTFKNQLLFTKHNLRGIEFPGGKRERGESSAEAVTRELYEETGAKVKNIYYIAQYTIETHDQTDFVKDVYFIEVESLVSKNDYLETAGPVLFNCINDIELAQRSFLLQDSTILKCVERVQSLGFYQT

SEQ ID NO: 777 - DNA, 768 bp, Staphylococcus aureus
ttgggttttatcaaacgtaaacgaatgccaattgaatattttacgcatcaattcgaagaaattacatatttgtcagatgacttacaagtaaaagctttaatgatgacaccacatcatgaagtaaatcgcattgtagtttatttgcgaggtggcaaaggtcaagtaggacgtgtgcgcgcaggtagattaatgcaattttcagatagtcaaactttagtgattgggccatactaccgaggtaacaatgggagtgaaggcaaagacgaattttaccgtggcgatttaaatgatgtgacgcaattattaaggttgctacatgataaatatccacatgcatttatccacatggttggtttttcgcgaggtggtttacaaggattgttgacatttcaagacttaccagtaacaagttatacaatctggggtggtgtctcagatattgatttaatgtatgaagaacgtgtcgatttaagaggcatgctacgaagaatgattggtcatccgaaaaaagatcgagcggcatatgaggcacgccaagcgattccaaacattaatgaaaacagtccgccaatattaattgtacatggagggaaagaccagcaagttggtattcatcatgcgtattatttagcggaccaactagagttaaaaggtgccacgcatgaaacattttatcaaatggcagaaggacatgtgccaagaccaccagcgatggttgaaacattgacttatattaaagagtttatgaaccaagttgagtcgcatagc

SEQ ID NO: 778 - protein, 256 aa, Staphylococcus aureus
  MISC_FEATURE (1)..(256): conserved hypothetical
LGFIKRKRMPIEYFTHQFEEITYLSDDLQVKALMMTPHHEVNRIVVYLRGGKGQVGRVRAGRLMQFSDSQTLVIGPYYRGNNGSEGKDEFYRGDLNDVTQLLRLLHDKYPHAFIHMVGFSRGGLQGLLTFQDLPVTSYTIWGGVSDIDLMYEERVDLRGMLRRMIGHPKKDRAAYEARQAIPNINENSPPILIVHGGKDQQVGIHHAYYLADQLELKGATHETFYQMAEGHVPRPPAMVETLTYIKEFMNQVESHS

SEQ ID NO: 779 - DNA, 483 bp, Staphylococcus aureus
atgtcatctgacacaaacagtttagcacatacaaaatggaattgtaagtatcatattgtctttgcacctaaatacagaagacaagtgatatatggaaaaataaaaaaagatatagggattatattgcgtcaattatgtgaaagaaaaggtgtagagataattgaagcagaggcatgtaaagatcatatccatatgttagttagtataccacccaaacttggggtatcatcatttgttggctatttaaaaggaaaaagtagtttaatgatatttgatagacatgctaacttaaagtatagatatggaaatagaaagttttggtgtaaaggattttatgtggatacagtaggtagaaataaaaaagtgattgaaaattatattcgtaatcaattacaagaggatatcgttgcagaccaaatctcaatggaagaatatttagatcctttcactggagagaaaaataaaaaaagaaagaaaaaagag

SEQ ID NO: 780 - protein, 161 aa, Staphylococcus aureus
MSSDTNSLAHTKWNCKYHIVFAPKYRRQVIYGKIKKDIGIILRQLCERKGVEIIEAEACKDHIHMLVSIPPKLGVSSFVGYLKGKSSLMIFDRHANLKYRYGNRKFWCKGFYVDTVGRNKKVIENYIRNQLQEDIVADQISMEEYLDPFTGEKNKKRKKKE

SEQ ID NO: 781 - DNA, 498 bp, Staphylococcus aureus
atgaaaaaattagtaacagcaactacgttaacagcaggaatcggcacagcattagtaggtcaagcacatcatgcagatgctgctgaaaattatacaaattacaacaactataactacaacacgactcaaactacaacgactacgacaactacgacaactacatcatcaatttcacattctggtaacttatacactgcaggacaatgtacttggtatgtatatgataaagttggcggagaaatcggttctacttggggaaatgctaataattgggctgctgctgcacaaggtgctggattcacagtaaatcatacaccttctaaaggcgctatcctacaatcttctgaaggaccatttggtcacgttgcatatgtagaaagtgtaaacagtgatggttcagttacaatttcagaaatgaattatagtggcggacctttctcagtaagttctagaactatttctgcaagtgaagcaggtaactacaactacatccatatt

SEQ ID NO: 782 - protein, 166 aa, Staphylococcus aureus
  MISC_FEATURE (1)..(166): hypothetical protein
MKKLVTATTLTAGIGTALVGQAHHADAAENYTNYNNYNYNTTQTTTTTTTTTTTSSISHSGNLYTAGQCTWYVYDKVGGEIGSTWGNANNWAAAAQGAGFTVNHTPSKGAILQSSEGPFGHVAYVESVNSDGSVTISEMNYSGGPFSVSSRTISASEAGNYNYIHI

SEQ ID NO: 783 - DNA, 1605 bp, Staphylococcus aureus
ttggagggatttaggatgtcagtagacacatacactgaaacaactaaaattgacaaattactgaaaaaaccaacgtcacattttcaactttcgacgacacaactttataataaaatcttagacaataacgaaggggtattaacagaacttggtgctgttaatgcaagtactggaaaatatactggtcgttcgcctaaagacaaattttttgtctctgaaccttcatatagagataacattgattggggagaaattaatcaacctatcgatgaagaaactttcttgaagttataccataaagtactagactatttagataaaaaagatgaactatacgtatttaaaggctacgctggtagcgataaagatacaatgttaaaacttacagtcatcaatgaattagcatggcataatttatttgctaaaaatatgtttattagacctgaatcaaaagaagaagctacaaagattaaacctaacttcactatcgtttctgcaccacattttaaagcagatccagaagttgatggtactaaatctgaaacctttgtcattatttcatttaaacacaaagtcattttaatcggcggtactgaatacgctggtgaaatgaaaaaaggtatcttctctgtaatgaattatctcttaccgatgcaagatattatgagcatgcattgctcagcaaacgttggtgaaaaaggcgatgttgcattattctttggtctatctggcactggtaaaacaaccttatcggctgacccacaccgtaaactaatcggtgatgatgaacacggctggaataaaaacggggtctttaatatcgaaggtggctgctatgcaaaagcaattaatctttccaaagaaaaagaaccacagatttttgacgcaatcaaatatggtgcaattttagagaacactgtagttgcagaagatggttcagtggactttgaagacaatcgttatacagaaaacacgcgtgccgcttatccaattaatcacattgacaatattgtagtaccatctaaagcagcacatccaaatacaattattttcttaactgcggatgcatttggtgttattccaccgatttcaaagttaaataaagaccaagcaatgtatcatttcttgagtggtttcacttctaaattagctggtacagagcgtggtgtgacagaacctgaaccatcattctcaacatgtttcggagcaccgttcttcccgttacaccctactgtttacgctgatctattaggtgaacttatcgatttacatgatgttgatgtttatcttgttaatactggatggactggcggaaaatatggtgtaggacgtagaatcagcttacattacacacgtcaaatggtaaaccaagcgatttctggcaaattgaaaaatgcagaatatacaaaagatagtacgtttggtttaagcattcctgtagaaattgaagatgtaccgaaaacaattttaaatccaattaatgcttggagcgacaaagagaaatataaagcacaagcagaagatttaattcaacgttttgaaaagaacttcgaaaaatttggtgaaaaagttgaacatattgctgaaaaaggtagcttcaacaaa

SEQ ID NO: 784 - protein, 535 aa, Staphylococcus aureus
  MISC_FEATURE (1)..(535): phosphoenolpyruvate
LEGFRMSVDTYTETTKIDKLLKKPTSHFQLSTTQLYNKILDNNEGVLTELGAVNASTGKYTGRSPKDKFFVSEPSYRDNIDWGEINQPIDEETFLKLYHKVLDYLDKKDELYVFKGYAGSDKDTMLKLTVINELAWHNLFAKNMFIRPESKEEATKIKPNFTIVSAPHFKADPEVDGTKSETFVIISFKHKVILIGGTEYAGEMKKGIFSVMNYLLPMQDIMSMHCSANVGEKGDVALFFGLSGTGKTTLSADPHRKLIGDDEHGWNKNGVFNIEGGCYAKAINLSKEKEPQIFDAIKYGAILENTVVAEDGSVDFEDNRYTENTRAAYPINHIDNIVVPSKAAHPNTIIFLTADAFGVIPPISKLNKDQAMYHFLSGFTSKLAGTERGVTEPEPSFSTCFGAPFFPLHPTVYADLLGELIDLHDVDVYLVNTGWTGGKYGVGRRISLHYTRQMVNQAISGKLKNAEYTKDSTFGLSIPVEIEDVPKTILNPINAWSDKEKYKAQAEDLIQRFEKNFEKFGEKVEHIAEKGSFNK

SEQ ID NO: 785 - DNA, 1191 bp, Staphylococcus aureus
atgttaaataacaaacgattatttacttcagagtctgttacagaaggacacccagataaaatcgctgaccaagtgtcagatgcaatattagatgctattttaaaagacgatccaaatgcacgtgtagcttgtgaaacaactgttacaacaggtatggcattgatcgccggcgaaatttctacaacaacatatgttgatattccgaaagttgttagagaaacaattaaagaaattggatacacaagagcaaaatatggttatgattatgaaacaatggcaattttaactgcgattgatgaacaatcacctgacattgcacaaggcgtggataaagcattagagtatcgtgataaagatagcgaagaagaaattgaagcaacaggtgcaggtgaccaaggtttaatgtttggttacgcaacgaatgaaacagagacgtatatgcctctagcaatttatttatcacatcaattggcaaaacgtttatcagatgtgcgtaaagatggtacgttaaattatttacgaccagacggtaaagttcaggtcactgttgaatatgatgaaaatgataacccagtacgtattgatacgattgtcgtatcaacacaacatgctgaggatgtgacacttgaacaaattcaagaagacattaaagcacatgtcatttatccaactgttccagaaaacttgattaatgaacaaactaaattctacatcaatcctacaggacgctttgtaatcggtggacctcaaggtgatgcaggattaacaggacgtaaaatcattgttgatacgtacggtggctatgcacgtcatggtggcggatgcttcagtggtaaggatcctacaaaagtagaccgttcagctgcatacgctgcacgttatgtggctaaaaatattgttgcagcaggtttagcagatcaatgtgaagtacaattggcatatgcgattggtgttgcagaaccagtgtcaattgcaattgatacatttggaacaggtaaagtttctgaagggcaacttgtcgaagcagttagaaaacactttgacctaagacctgcaggtattattaaaatgcttgatttgaaacaaccgatttacaaacaaactgctgcttatggtcattttggacgtacagatgtcttattcccatgggaaaaattagacaaagtggaagaattaaaagacgcagtaaaa

SEQ ID NO: 786 - protein, 397 aa, Staphylococcus aureus
  MISC_FEATURE (1)..(397): S-adenosylmethionine
MLNNKRLFTSESVTEGHPDKIADQVSDAILDAILKDDPNARVACETTVTTGMALIAGEISTTTYVDIPKVVRETIKEIGYTRAKYGYDYETMAILTAIDEQSPDIAQGVDKALEYRDKDSEEEIEATGAGDQGLMFGYATNETETYMPLAIYLSHQLAKRLSDVRKDGTLNYLRPDGKVQVTVEYDENDNPVRIDTIVVSTQHAEDVTLEQIQEDIKAHVIYPTVPENLINEQTKFYINPTGRFVIGGPQGDAGLTGRKIIVDTYGGYARHGGGCFSGKDPTKVDRSAAYAARYVAKNIVAAGLADQCEVQLAYAIGVAEPVSIAIDTFGTGKVSEGQLVEAVRKHFDLRPAGIIKMLDLKQPIYKQTAAYGHFGRTDVLFPWEKLDKVEELKDAVK

SEQ ID NO: 787 - DNA, 909 bp, Staphylococcus aureus
gtgatggatttatcttcaccgatagtcattggactcattattgcagtagtcattgcattaatcttttttgtcctttttttagttgccttaggtagtaagaaaaaagttaagcgacaaacagaagaaaagtatgaacaacaagaacaaaacattaaaaagtctcatgaagaagctttagagaaagagcgtattcaaaataaaaagacaattacaaaacaacaagaagattataatcacatggttagtacaaaagatcgtgagattgacgcattaaaattgttctcgaaaaatcatagtgaatatgtaacggacatgagattaattggtattcgtgaaagattagttaaagaaaaacgaattcgaccagaagatatgcacattatggcaaatatctttttaccaaaggatggctttaataatattgaacgaattagtcatttagtattaacaagaactggtctttatattattgattctcaattgttaaaaggtcatgtttataatggtattagtggcggtcaatttaaagatttaccaccaatggaacaagtatttgatacattggatttagataaatctagaccgcaaactattgtgatggatcaaaatgatgacaaacgttcattatcatttgtaaattattcagatcaaattgaggcgattaaacaattggctgaagacttacaaaaagaattaggtgccaaatatacaccaacttcaattttatactttaatcttaaaaatgaaggcgatgtaacgatttcaaattataatcaaaatagtgctgtcaaagtgcttgtcggtgctgaacaattagacgagttctttaacaaatttgtattccatggtcgtattcaatacaacgtggaagacttacaacaaatgatggataaaattgaatcattcaat

SEQ ID NO: 788 - protein, 303 aa, Staphylococcus aureus
  MISC_FEATURE (1)..(303): hypothetical protein
VMDLSSPIVIGLIIAVVIALIFFVLFLVALGSKKKVKRQTEEKYEQQEQNIKKSHEEALEKERIQNKKTITKQQEDYNHMVSTKDREIDALKLFSKNHSEYVTDMRLIGIRERLVKEKRIRPEDMHIMANIFLPKDGFNNIERISHLVLTRTGLYIIDSQLLKGHVYNGISGGQFKDLPPMEQVFDTLDLDKSRPQTIVMDQNDDKRSLSFVNYSDQIEAIKQLAEDLQKELGAKYTPTSILYFNLKNEGDVTISNYNQNSAVKVLVGAEQLDEFFNKFVFHGRIQYNVEDLQQMMDKIESFN

SEQ ID NO: 789 - DNA, 831 bp, Staphylococcus aureus
atggaggttaaaacattttataatggaaacacgatgccacaaattggtttagggacatttcgtgtggaaaatgatgaaaattgcatggaaagtgttaagtatgccattgaacaaggatatcgtagtattgataccgcaaaagtttatgggaatgaagaacaagtaggtgctggcattcgtgccggattggagtcaactggtattgctagagaagacttatttattacttcaaaattatattttgaggatttcggtcgtgaaaatgtagcagctgcttacgaagctagtttatctagattaggtttaaaatacttagatttgtatctagtacattggccaggtacgaacgaagccgtaatggttgatacatggaaaggtatggaagatttatataaaaataataatgttaaaaatataggtgtcagcaattttgaacctgaacatttggaagctttgttggcacaagtgtcaattaaacctgtaattaatcaagttgaatatcatccatatttaacccaacataaattgaaattatatttggcagcacaacgtatcgtgatggaatcttggtcaccattgatgaatgcacaaattttaaatgatgagacaattaaagacattgctcaagaattaggaaagtcacctgcccaagttgttttaagatggaatgtgcagcatgctgtggttacaatccctaaatcggtgacaccaaacagaatctctgaaaatttccaaatatttgatttcgaattatcagatgaacaaatgacgcgaattgatggtttaaatcaagataagagaattggacctgatccaaaaaaatttgaaggc

SEQ ID NO: 790 - protein, 277 aa, Staphylococcus aureus
  MISC_FEATURE (1)..(277): plant metabolite
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNNVKNIGVSNFEPEHLEALLAQVSIKPVINQVEYHPYLTQHKLKLYLAAQRIVMESWSPLMNAQILNDETIKDIAQELGKSPAQVVLRWNVQHAVVTIPKSVTPNRISENFQIFDFELSDEQMTRIDGLNQDKRIGPDPKKFEG

SEQ ID NO: 791 - DNA, 606 bp, Staphylococcus aureus
atggccattatagatgattttaataaaacgccacttattacgtatggcatgtttattaaagataaaactagaaagtttaaaagtgacattttcgacactcaaaattggaaatatgacgaacttaatgatgaatttatatgtcctaataacaaaagaataggttttaaaagatatgcataccgtaatgatagatatggttttaaacgagacttcaaactatatgaatgcgatgactgttcagcatgttctttgaggcaacaatgcatgaaaccaaattcaaaatccaataagaaaatcatgaagaattataattgggaatactttaaagtccaaattaatcaaaagctttctgaaccagaaacgaaaaaaatctatagtcaaagaaaaattgatgtagagcctgtttttggatttatgaaggctattttgggtttaactcgaacgtcagttcgaggaataaataaagttaaacgagagctaggttttgtattaatggcacttaatataaggaaaatagcagctcaacgagctgtacattataaaatacatatcaaaaaagctgatttctatcaaataattaatagaaatcagcttttttacattgcc

SEQ ID NO: 792 - protein, 202 aa, Staphylococcus aureus
  MISC_FEATURE (1)..(202): truncated transposase
MAIIDDFNKTPLITYGMFIKDKTRKFKSDIFDTQNWKYDELNDEFICPNNKRIGFKRYAYRNDRYGFKRDFKLYECDDCSACSLRQQCMKPNSKSNKKIMKNYNWEYFKVQINQKLSEPETKKIYSQRKIDVEPVFGFMKAILGLTRTSVRGINKVKRELGFVLMALNIRKIAAQRAVHYKIHIKKADFYQIINRNQLFYIA

SEQ ID NO: 793 - DNA, 822 bp, Staphylococcus aureus
atgatgttaaaaatcatcttatatgcatatactcaatctgtattttctggtcgaagaatagagaaattacttcatgacagtattcgaatgatgtggttagctcaaaatcaaacaccttcttataaaactattaatcgttttagagtgaatcctaatactgatgcgttaattgaatctttatttattcagttccatagtcaatgtttaaagcaaaatcttattgataataattcaatttttattgatggtacaaaagtagaagctaatgccaatagatatacatttgtgtggaagaaaagtattcaaaatcacgaatcgaaattgaacgaaaattcaaaagcattatatcgtgacttagttgaagaaaaaataataccagagataaaagaagatggagatagcgatttaacaatagaagaaatagatttaattggtagtcatttagataaagaaatcgaagatttaaatcattctattgagaacgaagattgtgctcaaattagaaaacagacccgtaaaaaaagaactgagattaagaagttcaaaaagaaatttgatgattattccgaaagaaaaaataaatatgaagaacaaaaatcgattcttaaagatagaaatagtttttctaaaactgatcatgatgcaacttttatgagaatgaaggaagaccatatgaaaaatggccaacttaagccaggatacaatttacaaatagcgacaaattctcaatttgttttatcctatgacctatttcaaaacccgacagatactagaactttaattccatttttaacaatgattcaaaataccttcggttatttg

SEQ ID NO: 794 - protein, 274 aa, Staphylococcus aureus
  MISC_FEATURE (1)..(274): truncated transposase
MMLKIILYAYTQSVFSGRRIEKLLHDSIRMMWLAQNQTPSYKTINRFRVNPNTDALIESLFIQFHSQCLKQNLIDNNSIFIDGTKVEANANRYTFVWKKSIQNHESKLNENSKALYRDLVEEKIIPEIKEDGDSDLTIEEIDLIGSHLDKEIEDLNHSIENEDCAQIRKQTRKKRTEIKKFKKKFDDYSERKNKYEEQKSILKDRNSFSKTDHDATFMRMKEDHMKNGQLKPGYNLQIATNSQFVLSYDLFQNPTDTRTLIPFLTMIQNTFGYL

SEQ ID NO: 795 - DNA, 330 bp, Staphylococcus aureus
atgattggcggcggttttggcgcaattgctagaagtgccattactgattattttaatcataaatttacttcaaagttacctatcgcaacattgatagtaaatctagttggtagttttttaattggattaactataggcttatcaatttcaatctcatggttccctgcgttctttgttaccggttttttaggtggcttaacaactttctcaacgttagccaaagaacttacactaatgatgacgccaaaatttaatattaacctttttctcaattattcacttttacaattcatcattggatttatagcttgttatattggctatcatatt

SEQ ID NO: 796 - protein, 110 aa, Staphylococcus aureus
  MISC_FEATURE (1)..(110): hypothetical protein
MIGGGFGAIARSAITDYFNHKFTSKLPIATLIVNLVGSFLIGLTIGLSISISWFPAFFVTGFLGGLTTFSTLAKELTLMMTPKFNINLFLNYSLLQFIIGFIACYIGYHI

SEQ ID NO: 797 - DNA, 447 bp, Staphylococcus aureus
ttgataatgcatcgacaatttttgtcgtcgcgttgccaaaacctcttttttaaattcaaactacttcttttcgaggtgaaccaaatgcaatatgtatatatttttatcggtggtgctttaggcgctttattacgttacctcatttcttttctgaatactgacggaggttttccaatcggaacactgatagccaatttgactggtgcctttgtaatgggattgctaacagccttaacaattgcatttttttcaaaccatccgaccctaaaaaaagctattacgactggttttcttggtgctttaacgactttttcaacatttcaattagaattaatacatatgtttgatcatcaacaatttataactttactactatatgctgtaacaagttatgtctttggtattttgttatgttacgtcggtataaaactaggtggtggtttatca

SEQ ID NO: 798 - protein, 149 aa, Staphylococcus aureus
  MISC_FEATURE (1)..(149): conserved hypothetical
LIMHRQFLSSRCQNLFFKFKLLLFEVNQMQYVYIFIGGALGALLRYLISFLNTDGGFPIGTLIANLTGAFVMGLLTALTIAFFSNHPTLKKAITTGFLGALTTFSTFQLELIHMFDHQQFITLLLYAVTSYVFGILLCYVGIKLGGGLS

SEQ ID NO: 799 - DNA, 300 bp, Staphylococcus aureus
atgtctcgttcaaaaaaatacttttacttatctagcttaatgattattttaagctttttctttaatacaaataacgttttcctaagtggactttttaattcttttattaaattaatacttttctgcagtgttattaactcaattgtactaattttgtctataatttttgcagatcgttcaattaaatcactaaagcctgatgcagattggattagaattgcgagtaaaagtttgccttggattattctaattgttattttagtacatatcttttcaattgttcgtacattcggttttatt

SEQ ID NO: 800 - protein, 100 aa, Staphylococcus aureus
  MISC_FEATURE (1)..(100): hypothetical protein
MSRSKKYFYLSSLMIILSFFFNTNNVFLSGLFNSFIKLILFCSVINSIVLILSIIFADRSIKSLKPDADWIRIASKSLPWIILIVILVHIFSIVRTFGFI

SEQ ID NO: 801 - DNA, 420 bp, Staphylococcus aureus
atgacaactgaaatgaacgacgtaacaaatcatcaaccgaatcgcaaatccaatgatgagaacattatggcgatgcttatctatttattaagtttattcacatctattattggtccactgataatatggttattgaaaaaagatgaatcgaaactagttgatcgtgctggaaaaaattatcttaactatacgatttcttatattatttggtctatcgttttagtcgttatcactttaataggcgttttcctaattgctacagatattgatttcattattattataggtttcatcattacgtttatcggtattttatccatattcgctttctcaatattatcttttgtattcacaattattgcgtgtgtcaaatattataatggccaagaatatataatacctttaacaattcgatttatt

SEQ ID NO: 802 - protein, 140 aa, Staphylococcus aureus
  MISC_FEATURE (1)..(140): conserved hypothetical
MTTEMNDVTNHQPNRKSNDENIMAMLIYLLSLFTSIIGPLIIWLLKKDESKLVDRAGKNYLNYTISYIIWSIVLVVITLIGVFLIATDIDFIIIIGFIITFIGILSIFAFSILSFVFTIIACVKYYNGQEYIIPLTIRFI

SEQ ID NO: 803 - DNA, 1086 bp, Staphylococcus aureus
ttgtttatgaaaatagcaattgtaggatcaggaaatggcgcagttacggcagcagtagatatggtgagcaaaggccacgatgttaaattatattgtcgtaatcaatctataagtaagtttcaaaacgcaatcgaaaagggcggatttgattttaataatgaaggtgatgaacgtttcgtaaaattcactgatattagtgatgatatggaatatgttttaaaagatgctgaaattgttcaagtgattattccatcttcatacatagagtattatgctgatgtaatggcagagcatgtaactgataatcagttgatattcttcaacatggctgcagcaatggggtcaattcgttttatgaatgttttagaagatagacatattgaaacaaaaccacaactagcggaagctaatacgttgacgtatggtacgcgtgtcgattttgaaaatgcagcagttgatttatctctaaatgtacgtcgtatcttcttttcaacatatgatagaagctgtctaaatgattgttatgacaaagtttcaagtatttatgatcatttagtaaaagaggaaagcttaattaaaacaaatcttgaaaatggtaatcctgaagtgcatccaggaccaacattattgaatgtcggtcgcattgattatgctggcgagttcgctttatataaagaaggaattactaaacatacagttagattacttcatgcaatcgaattagaacgtttgaatttaggccgtagattaggttttgaattatcaacagctaaagaatcacgtattgaacgtggttatttagaacgtgataaagaagatgaaccattaaatcgtttgtttaatacaagcccagtattttcacaaattccaggaccaaatcatgtagaaagcagatatttaactgaagatattgcatatggtttagtactatggtcaagcttaggtcgtgttattgatgtaccgacaccaaatatagatgcagtaattgtaattgcatcaaccattttagagagagacttctttgaggaaggcttaacagttgaagaaattggtttagataagcttgatttagaaaaatatttaaaa

SEQ ID NO: 804 - protein, 362 aa, Staphylococcus aureus
  MISC_FEATURE (1)..(362): hypothetical protein
LFMKIAIVGSGNGAVTAAVDMVSKGHDVKLYCRNQSISKFQNAIEKGGFDFNNEGDERFVKFTDISDDMEYVLKDAEIVQVIIPSSYIEYYADVMAEHVTDNQLIFFNMAAAMGSIRFMNVLEDRHIETKPQLAEANTLTYGTRVDFENAAVDLSLNVRRIFFSTYDRSCLNDCYDKVSSIYDHLVKEESLIKTNLENGNPEVHPGPTLLNVGRIDYAGEFALYKEGITKHTVRLLHAIELERLNLGRRLGFELSTAKESRIERGYLERDKEDEPLNRLFNTSPVFSQIPGPNHVESRYLTEDIAYGLVLWSSLGRVIDVPTPNIDAVIVIASTILERDFFEEGLTVEEIGLDKLDLEKYLK

SEQ ID NO: 805 - DNA, 711 bp, Staphylococcus aureus
atggctaaactaaatgtagaagtatttgcggacggtgcagatattgaagaaatgaaagcagcttataaaaacaaacaagtggatggttttacaacaaatcctagtttaatggctaaagcgggcgtaacagattacaaagcttttgctgaagaagctgtgaaagaaattccagatgcttcaatttcatttgaagtatttgcagacgatttagaaactatggaaaaagaagcagcaattttaaaacaatatggcgaaaatgtatttgttaaaattcctattgtaaatacaaaaggtgaatcaacgattcctttaattaaaaaactttcagctgacaatgtgagattaaacgttacggctgtttacacaattgaacaagttaaagaaataactgaagcagtaactgaaggtgtgccaacatatgtttcagtatttgcaggacgtattgcagatacaggcgtagatccattaccattaatgaaagaggctgtaaaagttacgcatagtaaagacggcgttaaattattatgggcaagttgccgcgaattattcaatgtgattcaagctgatgaaattggtgcagatattattacatgcccagcagatgttgtgaaaaaagtgaatacaaacttaggtcgcgatattaacgaattatcagtagatacagttaaaggctttgcgaaagatattcaatcttcaggtctttctattcta

SEQ ID NO: 806 - protein, 237 aa, Staphylococcus aureus
  MISC_FEATURE (1)..(237): hypothetical protein
MAKLNVEVFADGADIEEMKAAYKNKQVDGFTTNPSLMAKAGVTDYKAFAEEAVKEIPDASISFEVFADDLETMEKEAAILKQYGENVFVKIPIVNTKGESTIPLIKKLSADNVRLNVTAVYTIEQVKEITEAVTEGVPTYVSVFAGRIADTGVDPLPLMKEAVKVTHSKDGVKLLWASCRELFNVIQADEIGADIITCPADVVKKVNTNLGRDINELSVDTVKGFAKDIQSSGLSIL

SEQ ID NO: 807 - DNA, 633 bp, Staphylococcus aureus
atgcaaaaattcaaagactttttttacgatgatttatcggttacacgaggaaattattttttaactttaatggcagcattttttattactatcattttatttatcggcatagttgtcagtgaagtacatttactttatagcatgctaattgtattagtaggtttaattctattgaggctattcaaaatcaatttattctcttttaaaaaattaacattgtctcaagttatttatattataggcggtgcactattaatttatgggttagataatctttatttatattttcatgacgtaccggcaaatgaacaacaattagagcaagcaatacgaaatacaccattctatatttctattttcactgttaccatcatccccgctattgtggaagaaattgtttttcgcggtatgataataagggttatcttcagaaaacacttgtttttagggttaattgtgtctagtttagtttttgcatcattacacgaatctgacacttggattggttatttaccttacttatattctggtttgatttttggcctaatttatataaaaacaaaacgattagaagttgtaatattcatgcacttcttaaataacttgttagctctgctctttataatatggaga

SEQ ID NO: 808 - protein, 211 aa, Staphylococcus aureus
  MISC_FEATURE (1)..(211): hypothetical protein
MQKFKDFFYDDLSVTRGNYFLTLMAAFFITIILFIGIVVSEVHLLYSMLIVLVGLILLRLFKINLFSFKKLTLSQVIYIIGGALLIYGLDNLYLYFHDVPANEQQLEQAIRNTPFYISIFTVTIIPAIVEEIVFRGMIIRVIFRKHLFLGLIVSSLVFASLHESDTWIGYLPYLYSGLIFGLIYIKTKRLEVVIFMHFLNNLLALLFIIWR

SEQ ID NO: 809 - DNA, 441 bp, Staphylococcus aureus
atgaataaagcatcatttgataaaaaagttaaaaagcaattatggtttttgaacaagaaggagaaacaagcattagatcaacgattgtcttctatatctgatgatgacagcgttaacttaaataagcctgttacctttgctaatgcttacttaagacaaaatgtatttcgaaataaagaaacaaaaagttatagtatgtttgttacattagtagtgatgatgtttgcttatgttgctttattaggtttgtttttatttgggctaattacaagtctatctggcgtacaatttttcgttagtcctaaggtagatttatctacaactgttgttattttaacaattattggagcgattttattaatgtttgctagcatatattttataaaaattgtgacatcatactttactaagaaacttttagaaattaaatttaattcgaaa

SEQ ID NO: 810 - protein, 147 aa, Staphylococcus aureus
  MISC_FEATURE (1)..(147): hypothetical protein
MNKASFDKKVKKQLWFLNKKEKQALDQRLSSISDDDSVNLNKPVTFANAYLRQNVFRNKETKSYSMFVTLVVMMFAYVALLGLFLFGLITSLSGVQFFVSPKVDLSTTVVILTIIGAILLMFASIYFIKIVTSYFTKKLLEIKFNSK

SEQ ID NO: 811 - DNA, 441 bp, Staphylococcus aureus
ttgcaagacaattctactaaatatctactttatatccaaactgctacttcaaaccatctcgaaacaaattgtgtctttttacattgcgattacattcttaaagttccaattaacaaactcgtttcatattatgcgaaattgcatttatcatcacaaagtgtgctaattgagactgcaaaaaacatactaaatattaataaactggttcctatttacatcaacccaaaaactatactttttccgttaaaacataaacgtgcaccgatacaaatttatatcaatgcacattatattgttggtatgactgccatagagaattcaacattaatacattttcaagaaggcattcagctagaagttgatgagccattttctctagtttcaaaaaaatgtcatgaaagtttagctttgaagcacttcattgaaaatactatttcgaat

SEQ ID NO: 812 - protein, 147 aa, Staphylococcus aureus
  MISC_FEATURE (1)..(147): hypothetical protein
LQDNSTKYLLYIQTATSNHLETNCVFLHCDYILKVPINKLVSYYAKLHLSSQSVLIETAKNILNINKLVPIYINPKTILFPLKHKRAPIQIYINAHYIVGMTAIENSTLIHFQEGIQLEVDEPFSLVSKKCHESLALKHFIENTISN

SEQ ID NO: 813 - DNA, 546 bp, Staphylococcus aureus
atgaatgatttttctaaatattttattctaactttatccggaaatatttgttatacgtataacttggagaatgactacttgaaatttaatgacgtatacaacaaacaccagaaaatcatacactatcttttaaaaaaatataatattagctataattatgatgagtattatcaactactcttgataaaaatgtggcaattgagtcagatatataaaccctcaagcaagcaatctttatcctcttttttattcactcgattaaatttttaccttatcgatttattcagacaacaaaatcaattaaaagatgtcattttatgtgagaataattcaccaacattaactgaacaaccaacatactttaatgaacatgaccttcgtttacaagatatcttcaagcttttaaatcaaagagaaagactatggctcaaactataccttgaaggatacaagcaatttgaaattgctgaaatcatgtcattatcgctttcaacgattaaattaattaagatgtccgttaagcgtaaatgccaacataattttaat

SEQ ID NO: 814 - protein, 182 aa, Staphylococcus aureus
  MISC_FEATURE (1)..(182): hypothetical protein
MNDFSKYFILTLSGNICYTYNLENDYLKFNDVYNKHQKIIHYLLKKYNISYNYDEYYQLLLIKMWQLSQIYKPSSKQSLSSFLFTRLNFYLIDLFRQQNQLKDVILCENNSPTLTEQPTYFNEHDLRLQDIFKLLNQRERLWLKLYLEGYKQFEIAEIMSLSLSTIKLIKMSVKRKCQHNFN

SEQ ID NO: 815 - DNA, 222 bp, Staphylococcus aureus
atggattacgcacatttaaatttagaacatttttttgcacgaaacgacgatttagatgttataagagatcgcgctgatttcgtgatgataaataacttcactaatgaaatgatgtatcgtgatggtcaaattgaaggcacgattgatttaaatcagtactattataaaaatagatcaaatgcagcaagttttattatgatggattataaaaaagaaactaag

SEQ ID NO: 816 - protein, 74 aa, Staphylococcus aureus
  MISC_FEATURE (1)..(74): hypothetical protein
MDYAHLNLEHFFARNDDLDVIRDRADFVMINNFTNEMMYRDGQIEGTIDLNQYYYKNRSNAASFIMMDYKKETK

SEQ ID NO: 817 - DNA, 885 bp, Staphylococcus aureus
atgtataacaacaatgacctaagaggtgtggatatgaataaacacaagaaaggttctatttttggaataataggacttgttgtcatatttgctgttgtctcatttttatttttctcaatgatatccgatcagatatttttcaaacatgttaaatccgacattaagattgaaaagttaaatgttacattaaacgatgcagcaaagaaacaaataaataattatacgagtcaacaggtatcaaataaaaagaatgatgcatggagagatgcatctgcaactgaaattaaaagtgcaatggatagcggtacttttatcgataatgaaaagcaaaaatatcaatttttagatttatcaaagtatcaagggattgataaaaatagaattaaacgtatgttagtagatagaccaacgttattgaaacatacggatgatttcttaaaagctgctaaagataagcacgttaacgaagtttatttaatttcacatgcattattagaaactggcgcagttaaaagtgaattagctaatggagtcgaaattgatggcaaaaagtactacaatttctatggagtaggagcccttgataaagacccaattaaaacaggtgcagaatatgctaaaaagcatggttgggatacacctgaaaaagctatttcaggcggtgctgatttcattcataagcacttcttatcaagcacagatcaaaatacattgtatagtatgagatggaatccaaaaaatccaggagaacatcaatatgctacagatattaagtgggcagaaagtaatgcaacaattatcgctgacttttataagaacatgaagactgaaggaaaatacttcaaatactttgtgtataaagatgacagtaaacatttgaataag

SEQ ID NO: 818 - protein, 295 aa, Staphylococcus aureus
  MISC_FEATURE (1)..(295): conserved hypothetical
MYNNNDLRGVDMNKHKKGSIFGIIGLVVIFAVVSFLFFSMISDQIFFKHVKSDIKIEKLNVTLNDAAKKQINNYTSQQVSNKKNDAWRDASATEIKSAMDSGTFIDNEKQKYQFLDLSKYQGIDKNRIKRMLVDRPTLLKHTDDFLKAAKDKHVNEVYLISHALLETGAVKSELANGVEIDGKKYYNFYGVGALDKDPIKTGAEYAKKHGWDTPEKAISGGADFIHKHFLSSTDQNTLYSMRWNPKNPGEHQYATDIKWAESNATIIADFYKNMKTEGKYFKYFVYKDDSKHLNK

SEQ ID NO: 819 - DNA, 393 bp, Staphylococcus aureus
atgactaaaaaaacaatttattttatatgtacaggcaactcatgtcgaagtcaaatggctgaaggttgggctaaacaaatcttagcggatgattggaatgtatattctgctggtatcgaaacacacggtgttaatcccaaagcgatagaagctatgaaagaagtaggcattgatatatcaaatcatacatcagatttaatcgataataatattattaaaaattcaaatttagttgttacattatgtagtgatgcagacgtaaattgcccttctttaccaacaaatgttaagaaagaacattggggatttgatgatcctgcaggcaagccttggtcagagttccaacgtgtaagagatgaaattaaaatcgcaattgaaaatttcaaatcacga

SEQ ID NO: 820 - protein, 131 aa, Staphylococcus aureus
MTKKTIYFICTGNSCRSQMAEGWAKQILADDWNVYSAGIETHGVNPKAIEAMKEVGIDISNHTSDLIDNNIIKNSNLVVTLCSDADVNCPSLPTNVKKEHWGFDDPAGKPWSEFQRVRDEIKIAIENFKSR

SEQ ID NO: 821 - DNA, 1296 bp, Staphylococcus aureus
atgctaatgatgacaactttagcgacactcatttttctagtaactttattatttgtattatggcaacctaaaggcctagatattggcattaccgcactaactggtgcctttattgctgttattactggtgttgtaagtttttccgatgttttcgaagtaacaggtattgtttggaatgctactttgacttttgtctcagtcattcttatttcattaatattagataaagttggattattcgaatggtcagctattcacatgcttcatgcttcaaaaggcaatggtttaaaaatgttcgtttatatcatattattgggtgccattgttgctgcatttttcgcaaatgatggcgcagcgttaatcttaacgcctattgtattagcgatggttaaaaatataggttttagtaagcgggccatattcccttttattattgcgagtggttttatagctgacacaacttctttacctttaatcgtgagcaatctagtgaatattatatctgctgattattttcatgtaggattcgttcgatattttagtagaatgattatacctaatttattctcgcttttagcaagtattatagtattgtggttatattttagaaaagcgatacctaaaacgtttgatgataataatataaagcatcctaaagatgccattaatgatttaaagctatttaaaatttcatggattgttctagttatattacttttcggctatctaatcagtaaatttactaaaattccggtatcaattttcactggaatcattgcttttatttttctaatgttggctcgtaaatcaaatgctgtaaatattaagcaagtcattaagggcgcaccttggaatatagtattattttcaattggtatgtatatcgtcgtattcggcttaagaaatgctggcattactttaatattggctaaaatattagaatatatttccaattacggtctatttagcactattttgggaatgggcttcatttcagcgtttttatcatcaataatgaataatatgcctacagttttaatagatgcgattgctattggtcaatcaaatgtccatggcatgttaaaagaaggcctaatttatgcgaatgttatcggttctgatttaggtccaaaaattacaccgataggctctttagctacattactgtggttacacgtcttaacacaaaaagatgttaagatttcttggggcacatactttaaaactggtatcatcattacaattccagtactatttataaccctcatagggttgtatctaacacttatcatattt

SEQ ID NO: 822 - protein, 432 aa, Staphylococcus aureus
  MISC_FEATURE (1)..(432): aesenical pump membrane
MLMMTTLATLIFLVTLLFVLWQPKGLDIGITALTGAFIAVITGVVSFSDVFEVTGIVWNATLTFVSVILISLILDKVGLFEWSAIHMLHASKGNGLKMFVYIILLGAIVAAFFANDGAALILTPIVLAMVKNIGFSKRAIFPFIIASGFIADTTSLPLIVSNLVNIISADYFHVGFVRYFSRMIIPNLFSLLASIIVLWLYFRKAIPKTFDDNNIKHPKDAINDLKLFKISWIVLVILLFGYLISKFTKIPVSIFTGIIAFIFLMLARKSNAVNIKQVIKGAPWNIVLFSIGMYIVVFGLRNAGITLILAKILEYISNYGLFSTILGMGFISAFLSSIMNNMPTVLIDAIAIGQSNVHGMLKEGLIYANVIGSDLGPKITPIGSLATLLWLHVLTQKDVKISWGTYFKTGIIITIPVLFITLIGLYLTLIIF

SEQ ID NO: 823 - DNA, 1398 bp, Staphylococcus aureus
atgatgaaaagaaaacccacctttttagaatcaatttcgacaatgattgtaatggttattgttgttgtaacaggctttgtgttttttgatattccaattcaagtattattaattattgcctcagcatatgccacatggattgcaaaacgtgtaggcttaacatggcaagatttagaaaaaggcattgcagaacgtttaaatactgcaatgcctgcaattttaattatactagcggtaggaattatagtaggcagttggatgttttctggcacagtgccagccttgatttattatggcttagatttattgaatccaagctattttttaatatcagccttttttataagtgctgttacatctgtagcaactggtacagcatggggctctgcatcaactgcagggattgcacttatttctattggtaatcaattggggattcctccagggatggcagcgggtgctattatagcaggggctgtgtttggcgataaaatgtcaccattatcagatacaactaatttagcggcgcttgttactaaagttaatatatttaaacatatacattcgatgatgtggacgacgatacctgcatcaatcataggtttattagtatggtttattgctggatttcaatttaaagggcattcaaatgataaacagattcaaactttgttatcagagcttgcacagatttatcaaattaacatatgggtctgggttcccttaattgtgatcattgtttgtttgctatttaaaatggctacagtgccagctatgctaatatcaagcttttctgccattatagtggggacttttaatcatcatttcaaaatgacagatggtttcaaagcaacatttagtggttttaacgaatcaatgatacatcagtctcatatttcatccagtgtgaaaagcttgttagaacagggtggtatgatgagtatgacccaaatattagtaacgatattttgcggatatgcatttgcaggtattgtagaaaaagcaggatgtttagaagtcttattaactactatttctaaaggcatccattctgtaggaagtttaatatgtattactgttatttgttgtattgcgcttgtattcgctgcaggtgttgcttcgattgtaattattatggtcggtgtgttaatgaaagatttgttcgaaaaataccaagtctctcgttccgttttatcaagaacacttgaagactcaagtacgatggtcttacctttaataccatggggaacatcaggtatttactatacgaatcaacttcatgtctctgttgaagaatttttcatatggacagtaccatgttatttatgcgcaattatagcaattatctatggttttacagggataggtattaaaaagtcatcgaattcacgtttaact

SEQ ID NO: 824 - protein, 466 aa, Staphylococcus aureus
  MISC_FEATURE (1)..(466): hypothetical protein
MMKRKPTFLESISTMIVMVIVVVTGFVFFDIPIQVLLIIASAYATWIAKRVGLTWQDLEKGIAERLNTAMPAILIILAVGIIVGSWMFSGTVPALIYYGLDLLNPSYFLISAFFISAVTSVATGTAWGSASTAGIALISIGNQLGIPPGMAAGAIIAGAVFGDKMSPLSDTTNLAALVTKVNIFKHIHSMMWTTIPASIIGLLVWFIAGFQFKGHSNDKQIQTLLSELAQIYQINIWVWVPLIVIIVCLLFKMATVPAMLISSFSAIIVGTFNHHFKMTDGFKATFSGFNESMIHQSHISSSVKSLLEQGGMMSMTQILVTIFCGYAFAGIVEKAGCLEVLLTTISKGIHSVGSLICITVICCIALVFAAGVASIVIIMVGVLMKDLFEKYQVSRSVLSRTLEDSSTMVLPLIPWGTSGIYYTNQLHVSVEEFFIWTVPCYLCAIIAIIYGFTGIGIKKSSNSRLT

SEQ ID NO: 825 - DNA, 1500 bp, Staphylococcus aureus
atgcgtgtagcaataataggcatgggaactgctggtgtaagtgtattgagagagttagttaagcacccgaagtttaatcaattagatatagatttatacgatgataaagtaaatatgggacagggcgtaccatttcaaaatgatagttctgagctgctaattaatatgccttcgaaaaagatgagtttaaatttagatgatgagactgaattttggaagtggtataaacaacaaactgattttaattttgatgaacctgcatatttaccgagatttgtattcggacattatatgaaatcttatttatctatgttcacgaaaaaatatccaaatatatcaactaattataataaagttcaagagatttatacaaattctaatatcgatgaaacgaatttaacttattacatatgtactacaaattcaggacaatcatggcaagcgtacgattatgtatttttaacatgtggtacatttgcctaccatgatccatataacttaaagggtaaaaaaggatatatcgctacgccttatccaacatataatacgttagacgaagtaaatgaactggacgatattgcgattattggtacaggccttgccagtttagatgttgtccgttatgttgctgctcatcatccaaaattaccaattactatgacgagtcgttctgctcatttaccaagtgtaagaggtacaatgatagacgtgacattcaagtacttaactaaagacaaattaaatgacattaaaaaacatcatttcggcaatgcaccgcttgatactttagtttctttatttttaaaagaatgtgctgaatatgacattgattttaaaaaattagtacatagacgtacaggaaatcatattgcagatttgaagtatgatttagcgcgtccaacagaaatgggcattttccaaagtatgattgaacatttgaaagagaatttaaattggatatggaatagcttaagtattgaagaccaacatcaatttaatcaaaaatactcaaagatgattcaattaaattcaaatccaatgcctccaagaactgctgaactaattattgaattaatagaaaataagtctttaattttgaaaaaagatttagaagatgtgaaacatgatggcaagttgtattatttttcatacaaaaaccaagaatcagtagacatatataatgttgtcattaacgcgacaggtgcaaaaagtcatttaaatgaattggatcaagatgatcaattaattagaaatcttgaaaatagacaaattgtacaagcacacccaatgggaggcatacaaatcattccggaaaccaatcaagttattagtccaaggtttggaacattaacaaatatgattgcgataggtcaaatgacaaacggtgttaataaactacgaaacggtgtgaaaatgattgtagaacaagttgcgcatacagtatctcaattatatgatgctttagaatcgaatgagcaacaacagcgcagtgacaatcaa

SEQ ID NO: 826 - protein, 500 aa, Staphylococcus aureus
  MISC_FEATURE (1)..(500): hypothetical protein
MRVAIIGMGTAGVSVLRELVKHPKFNQLDIDLYDDKVNMGQGVPFQNDSSELLINMPSKKMSLNLDDETEFWKWYKQQTDFNFDEPAYLPRFVFGHYMKSYLSMFTKKYPNISTNYNKVQEIYTNSNIDETNLTYYICTTNSGQSWQAYDYVFLTCGTFAYHDPYNLKGKKGYIATPYPTYNTLDEVNELDDIAIIGTGLASLDVVRYVAAHHPKLPITMTSRSAHLPSVRGTMIDVTFKYLTKDKLNDIKKHHFGNAPLDTLVSLFLKECAEYDIDFKKLVHRRTGNHIADLKYDLARPTEMGIFQSMIEHLKENLNWIWNSLSIEDQHQFNQKYSKMIQLNSNPMPPRTAELIIELIENKSLILKKDLEDVKHDGKLYYFSYKNQESVDIYNVVINATGAKSHLNELDQDDQLIRNLENRQIVQAHPMGGIQIIPETNQVISPRFGTLTNMIAIGQMTNGVNKLRNGVKMIVEQVAHTVSQLYDALESNEQQQRSDNQ

SEQ ID NO: 827 - DNA, 90 bp, Staphylococcus aureus
gtgtctaacgaattgtcttttgttgcgtatactacttttgctatcttacaatcaattattttgttaacacagggtggtgttgaaccaaaa

SEQ ID NO: 828 - protein, 30 aa, Staphylococcus aureus
VSNELSFVAYTTFAILQSIILLTQGGVEPK

SEQ ID NO: 829 - DNA, 1029 bp, Staphylococcus aureus
atggattatgcgattcaacttgcaaatatggtacaaggtcaaacaggtgttaatccacccgttggcgctgttgtagttaaagaaggtaggattgttggtattggtgcacacttgagaaaaggtgacaagcatgcggaggttcaagcacttgatatggcacaacaaaatgctgaaggtgcgacgatttatattacgttagagccatgtagtcattttggttcaacaccaccctgtgttaacaaaataattgattgtaagatagcaaaagtagtatacgcaacaaaagacaattcgttagacacacatggtgatgagacgttacgggctcacggtattgaggttgaatgcgttgatgatgaacgggcatcacaattataccaagacttttttaaagcaaaagcaaagcaactgccacaaattacagtgaaagtatctgcaagtttagatggtaaacaagcgaatgataatggacaaagtcaatggattactaacaaagaggttaaacaagatgtctataagttaagacatcgacacgacgcagtgttaactggaagacgtacagttgaattagatgatccacaatatactacacgtattcaagatggaaaaaaccctataaaagtaatattgtctaagtctgggaatattcattttaatcagcaaatttatcaagatgaatcaacaccaatttggatatatactgaaaatccaaatttaacaaccaatcaaacacatattgaaattatttacttgaagtcttgcgatttaacaacaattcttcacaatttatataaaagaggagttggaactttgctagtcgaggcaggtccaaccactacttcagaatttctccaatctaattatatagatgaatttattctctattatgccccgaaattaattggcggatctggaaattatcaattttatcaaacaaatgatgtgattgagataccagatgcgaaccaatttgaaattgttcattccgagttattaaatcaaaatgttaaattaactttacgaaagaag

SEQ ID NO: 830 - protein, 343 aa, Staphylococcus aureus
  MISC_FEATURE (1)..(343): riboflavin specific
MDYAIQLANMVQGQTGVNPPVGAVVVKEGRIVGIGAHLRKGDKHAEVQALDMAQQNAEGATIYITLEPCSHFGSTPPCVNKIIDCKIAKVVYATKDNSLDTHGDETLRAHGIEVECVDDERASQLYQDFFKAKAKQLPQITVKVSASLDGKQANDNGQSQWITNKEVKQDVYKLRHRHDAVLTGRRTVELDDPQYTTRIQDGKNPIKVILSKSGNIHFNQQIYQDESTPIWIYTENPNLTTNQTHIEIIYLKSCDLTTILHNLYKRGVGTLLVEAGPTTTSEFLQSNYIDEFILYYAPKLIGGSGNYQFYQTNDVIEIPDANQFEIVHSELLNQNVKLTLRKK

SEQ ID NO: 831 - DNA, 630 bp, Staphylococcus aureus
atgtttactggcatcgttgaagaaataggtgtcgttaaaagtgttcaaattcgtcaatcagtcaggacgattgaaattgaagcacataagattacggcagatatgcatattggtgattccatcagtgttaatggtgcatgtttaacagtgattgattttaatcagacatcttttactgttcaagtaattaaaggcactgaaaataaaacctatttagcagatgttaagcgacaatcagaagtaaatttagagcgtgccatgagtggtaacggtaggtttggtggacattttgtcctcggtcatgtagatgaactaggaacagtttcaaaaataaatgaaacagccaatgcaaaaattattacgattcaatgtagccaacatattaataatcagttagttaagcaagggtctattactgtggatggtgttagtctaacggtatttgataagcatgataacagttttgacattcatcttattccagaaacgaggcgttcaacgattttatcatccaaaaaattaggagataaagtacatttagaaacagacgttttgtttaaatatgttgaaaatattttaaataaagataaagaccaattatctgtagataaattaagagcatttggtttt

SEQ ID NO: 832 - protein, 210 aa, Staphylococcus aureus
  MISC_FEATURE (1)..(210): riboflavin synthase alpha
MFTGIVEEIGVVKSVQIRQSVRTIEIEAHKITADMHIGDSISVNGACLTVIDFNQTSFTVQVIKGTENKTYLADVKRQSEVNLERAMSGNGRFGGHFVLGHVDELGTVSKINETANAKIITIQCSQHINNQLVKQGSITVDGVSLTVFDKHDNSFDIHLIPETRRSTILSSKKLGDKVHLETDVLFKYVENILNKDKDQLSVDKLRAFGF

SEQ ID NO: 833 - DNA, 1200 bp, Staphylococcus aureus
ttggtttttaggaggggtagcatgcaattcgataatattgacagtgctttaatggctttaaaaaatggagaaccaattattgtagtagatgatgagaatcgtgaaaatgaaggtgatttagtagcggttactgaatggatgaacgataataccattaattttatggcgaaagaagcaaggggattaatatgcgcaccagtgtctaaagatattgcacaacgtttggatttggtacaaatggttgatgataactccgacatctttggtacgcaatttacagtgagtattgatcatgtagatacaacaacaggaattagtgcttatgaacgtacattgactgccaaaaagctcattgatcctagtagtgaagctaaagattttaatcgtcctggtcatttatttccattagtagcacaagataaaggcgtattagctagaaatggacacacagaagcggctgttgatttagctaaacttactggtgccaagcccgctggtgtcatttgtgagattatgaatgatgacggcacgatggcgaaaggacaagatttacaaaagtttaaagaaaaacatcaattaaagatgattacgattgatgatttaattgaatatcgtaaaaaattagaaccagaaattgaatttaaggcaaaagtgaaaatgcctacagatttcggaacatttgatatgtatggttttaaagcgacatacacagatgaagagatagttgtactgacaaaaggtgcaattcgacaacatgaaaatgtacgcttacattctgcgtgccttacaggcgatattttccatagtcaacgttgtgattgtggtgctcaacttgaatcgtctatgaagtatatcaatgaacatggtggcatgattatttatctacctcaagaaggtcgtggcataggattgttaaacaaattacgcgcatatgaattaattgagcaaggatatgatacagtaactgcaaatttagcattaggttttgatgaagatttgcgagattatcatattgctgcacagattttaaaatattttaacatcgaacatatcaatttattaagtaataatccaagtaaatttgagggattaaaacaatatggcattgatattgcagaaagaattgaagttatcgtaccagaaacggtacataatcatgattatatggaaacgaaaaaaataaaaatgggtcatttaata

SEQ ID NO: 834 - protein, 400 aa, Staphylococcus aureus
  MISC_FEATURE (1)..(400): riboflavin biosynthesis
LVFRRGSMQFDNIDSALMALKNGEPIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQKFKEKHQLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMETKKIKMGHLI

SEQ ID NO: 835 - DNA, 462 bp, Staphylococcus aureus
atgaattttgaaggtaaattaattggaaaagatttgaaagttgcaatcgtagttagtcgatttaatgattttatcactggaagattacttgaaggtgcaaaagatactttgattcgacatgatgttaatgaagacaatattgatgtagcatttgtgccaggtgcgtttgaaattcctttagtagctaaaaaattagcctcatcaggaaattatgatgcagtaattacattaggatgcgtaattcgcggtgctacgtctcattatgattatgtttgtaatgaagtcgcgaaaggtgtttctaaagtgaatgatcaaactaatgtaccagtcatatttggtattttaacgactgaaagtattgaacaagctgtggaaagagcaggtacgaaagctggcaataaaggtgctgaagcagcagtaagtgcaattgaaatggctaatttattaaaatctataaaagca

SEQ ID NO: 836 - protein, 154 aa, Staphylococcus aureus
  MISC_FEATURE (1)..(154): lumazine synthase
MNFEGKLIGKDLKVAIVVSRFNDFITGRLLEGAKDTLIRHDVNEDNIDVAFVPGAFEIPLVAKKLASSGNYDAVITLGCVIRGATSHYDYVCNEVAKGVSKVNDQTNVPVIFGILTTESIEQAVERAGTKAGNKGAEAAVSAIEMANLLKSIKA

SEQ ID NO: 837 - DNA, 999 bp, Staphylococcus aureus
atggcactattaaagaatttttttatcggattatctaataatagttttttaaacaacgcagcaaaaaaagtgggcccacgtttgggcgccaataaagtcgttgccggaaatacaattccagagttaattaatacaatcgaatacttaaatgacaagaatatcgctgttacggtagacaatttaggggaatttgtcggtacagttgaagaaagtaatcatgctaaagaacaaattttaacaattatggacgcgcttcatcaacatggcgtaaaggcacatatgtctgttaaattgagtcagttaggtgcagaattcgacttagaattagcttaccaaaatttaagagagattttacttaaagcaaatacttacaacaatatgcatataaatattgatactgaaaaatatgctagcctgcaacaaattgttcaagttttagatcgcttaaaaggcgaatttagaaatgttggtactgtaattcaagcatatttatacgatagccacgaattagttgataagtaccaagatttacgattacgtttggttaaaggtgcatataaagaaaacgaatcaattgcatttcaatctaaggaagacgtagatgcaaattacatcaaaataattgaacaacgtttgttaaacgcacgcaatttcacttcaattgcaacacatgaccatcgcatcattaatcatgtaaaacaatttatgaaagaaaatcacattgaaaaagatcgtatggaattccaaatgctctatggttttagatcagagttagcagaagaaatcgcaaatgaaggctataatttcactatttatgtaccttatggcgatgattggtttgcgtattttatgagaagattagcagaacgcccacaaaacctatctcttgctgtaaaagaatttgtgaaacctgctggcttaaaacgtgttggcataattgcagctttaggagctacagttatgttaggtttaagtacaattaaaaaattatgccgtaaa

SEQ ID NO: 838 - protein, 333 aa, Staphylococcus aureus
  MISC_FEATURE (1)..(333): proline dehydrohenase
MALLKNFFIGLSNNSFLNNAAKKVGPRLGANKVVAGNTIPELINTIEYLNDKNIAVTVDNLGEFVGTVEESNHAKEQILTIMDALHQHGVKAHMSVKLSQLGAEFDLELAYQNLREILLKANTYNNMHINIDTEKYASLQQIVQVLDRLKGEFRNVGTVIQAYLYDSHELVDKYQDLRLRLVKGAYKENESIAFQSKEDVDANYIKIIEQRLLNARNFTSIATHDHRIINHVKQFMKENHIEKDRMEFQMLYGFRSELAEEIANEGYNFTIYVPYGDDWFAYFMRRLAERPQNLSLAVKEFVKPAGLKRVGIIAALGATVMLGLSTIKKLCRK

SEQ ID NO: 839 - DNA, 825 bp, Staphylococcus aureus
atgtggaagtgggaagctgaaaatgatgcgaaaggcgtcgttgttattgctcataatatattagaacatacgggaagatatgcatatgttattacgatgttaagaagaaatggctatcatgtgattatgggagatttgcctggtcaaggtcaaacttcaagagctaataaaggacaaattgaaaactttcaaacgtatcacgaaagtttgctagactggttaaagatagctaatgaatataaaattcctacttatgtattaggggtaggacttggcggtttgattttattaaatttacttgaaaaagtagaattgccaatcgaggggatgatgttaatttctcctatgctagaacttcaaaagaatggaaaaaatcgtaaagataaacttgtttcaaatataggtaaaatttcaaaagacacacgttttaatgttggtgtagaaccaaaagatttaacacgtaatttagaaattgttgaagaaacagttaacgatggtttaatgttaaaaaaagcaacgtatcattggtataatacaattaatgagacgatgaaagatacgatggctcatattcatgacattcaaccaatgccaacgctattaatgtatggaacgaaggatttaattgttgatactagggcaattgatgagtttaaagaaaaatatcaaacacctgaattatattttaaagcttggcaaggtttttaccacgaggttcacaatgagccagaacgtgatgaagtaatgcgttatattctgactttcttaaataacagcgtcaatacaatgggctttattgttgaagatgacgaaattgtagaaatt

SEQ ID NO: 840 - protein, 275 aa, Staphylococcus aureus
  MISC_FEATURE (1)..(275): lysophospholipase homolog
MWKWEAENDAKGVVVIAHNILEHTGRYAYVITMLRRNGYHVIMGDLPGQGQTSRANKGQIENFQTYHESLLDWLKIANEYKIPTYVLGVGLGGLILLNLLEKVELPIEGMMLISPMLELQKNGKNRKDKLVSNIGKISKDTRFNVGVEPKDLTRNLEIVEETVNDGLMLKKATYHWYNTINETMKDTMAHIHDIQPMPTLLMYGTKDLIVDTRAIDEFKEKYQTPELYFKAWQGFYHEVHNEPERDEVMRYILTFLNNSVNTMGFIVEDDEIVEI

SEQ ID NO: 841 - DNA, 489 bp, Staphylococcus aureus
atgtataaaaattataacatgaccccaacttacactaccaatagaaacttcgttagaattcctcaaaatgatatttcgcgatatgttaatgaaattgttgaaacgatacctgatagcgaattcgatgaattcagacatcatcgtggtgcaacatcctatcatccaaaaatgatgttaaaaatcatcttatatgcatatactcaatctgtattttctggtcgtagaatagagaaattacttcatgacagtattcgaatgatgtggttagcccaagatcaaacactttcttataaaactattaatcgttttagagtgaatcctaatactgatgcgttaattgaatctttatttattcagttctatagtcaatgtttaaagcaaaatcttattgatgataattcaatttttattgatggtacaaaagtagaagctagtgccaatagatatacattggtgcggaagaaagtattcaaaatcacgaatcgaaat

SEQ ID NO: 842 - protein, 163 aa, Staphylococcus aureus
  MISC_FEATURE (1)..(163): truncated transposase
MYKNYNMTPTYTTNRNFVRIPQNDISRYVNEIVETIPDSEFDEFRHHRGATSYHPKMMLKIILYAYTQSVFSGRRIEKLLHDSIRMMWLAQDQTLSYKTINRFRVNPNTDALIESLFIQFYSQCLKQNLIDDNSIFIDGTKVEASANRYTLVRKKVFKITNRN

SEQ ID NO: 843 - DNA, 639 bp, Staphylococcus aureus
atgatagaattaaaagatttaaccatacaaaaaggtaatacacatattttgaagaaacttaatttgaaatttcaatgtggaaaatcatatgcacttattggtaaaagtggatgcggtaaatctacattattaaatactattgctggacttgaaaaaacaggaaaacaatatgtctattttaatggtcaattagaacaatttaaatctaatttttacagagataaattaggatatttatttcaaaattatggattaatcgataatttgacagtaaatgaaaatttagatattggattagcatataaaaaaataagtaagaaagaaaaagaacaaataaagatacgttatatagaacagtttggtctgtcaaacagtttaaaaagaaaagttcatacgctaagtggaggtgaacaacaacgtgtcgctttaattagaatgatgttaaaagatccgattgttatgttagctgatgaaccaacgggtgcgttagatcctaaaacaggacagatgattattcaatcattatttggtttggtcgatgaaaataaagtgctgattttagcaacacatgatatggctattgcaaatcaatgtgacgaaataatagatttagaacagtatagaaaagtagcatctatg

SEQ ID NO: 844 - protein, 213 aa, Staphylococcus aureus
  MISC_FEATURE (1)..(213): conserved hypothetical
MIELKDLTIQKGNTHILKKLNLKFQCGKSYALIGKSGCGKSTLLNTIAGLEKTGKQYVYFNGQLEQFKSNFYRDKLGYLFQNYGLIDNLTVNENLDIGLAYKKISKKEKEQIKIRYIEQFGLSNSLKRKVHTLSGGEQQRVALIRMMLKDPIVMLADEPTGALDPKTGQMIIQSLFGLVDENKVLILATHDMAIANQCDEIIDLEQYRKVASM

SEQ ID NO: 845 - DNA, 222 bp, Staphylococcus aureus
ttgaacgagaattcaaaaacactatatcgtgacttagttgaagaaaaaataataccagagataaaagaagatggagatagcgatttaacaatagaagaaatagatttaattggtagtcatttagataaagaaatcgaagattgtgctcaaattagaaaacagacccgtaaaaaagaactgaaagatgagacagtagatgctcatctttttttagaacttttt

SEQ ID NO: 846 - protein, 74 aa, Staphylococcus aureus
LNENSKTLYRDLVEEKIIPEIKEDGDSDLTIEEIDLIGSHLDKEIEDCAQIRKQTRKKELKDETVDAHLFLELF

SEQ ID NO: 847 - DNA, 408 bp, Staphylococcus aureus
atgtttagcatgaaaaaagtaaataacgacactgtatttggaattttgcaattagaaacacttttgggtgacattaactcaattttcagcgagattgaaagcgaatacaaaatgtctagagaagaaattttaattttactaactttatggcaaaaaggttctatgacgcttaaagaaatggacagatttgttgaagttaaaccgtataagcgtacgagaacgtataataatttagttgaattagaatggatttacaaagagcgtcctgttgacgatgaaagaacagttattattcatttcaatgaaaagttacaacaagagaaagtagagttgttgaatttcatcagtgatgcgattgcaagtagagcaacagcaatgcaaaatagtttaaacgcaattattgctgtg

SEQ ID NO: 848 - protein, 136 aa, Staphylococcus aureus
  MISC_FEATURE (1)..(136): repressor of toxins Rot
MFSMKKVNNDTVFGILQLETLLGDINSIFSEIESEYKMSREEILILLTLWQKGSMTLKEMDRFVEVKPYKRTRTYNNLVELEWIYKERPVDDERTVIIHFNEKLQQEKVELLNFISDAIASRATAMQNSLNAIIAV

SEQ ID NO: 849 - DNA, 561 bp, Staphylococcus aureus
atgaaattagaacgtatactccctttttcaaaaacacttattaaacaacatataacaccagaaagtattgttgtagacgcaacttgcggtaacggcaatgacactttatttttagccgaacaagtaccagaaggacatgtttatggtttcgacattcaagatttagctttggaaaatacacgtgataaagttaaggatttcaatcatgtttctttaataaaagatggacatgaaaatattgaacatcatataaatgatgcacataaaggtcatattgatgcagccatctttaacctaggttatttgcctaaaggtgataaatctatcgtgacaaagcctgacacgacaatccaagctattaattcattgctatcattaatgtcaattgaaggtattattgtacttgttatatatcatggtcatagcgaaggacaaattgagaagcatgcattgcttgattacttgagtactttggatcaaaagcatgcgcaagttttgcaatatcaatttttaaaccaacgtaatcatgctccattcatttgtgccatagaaaaaatttct

SEQ ID NO: 850 - protein, 187 aa, Staphylococcus aureus
  MISC_FEATURE (1)..(187): conserved hypothetical
MKLERILPFSKTLIKQHITPESIVVDATCGNGNDTLFLAEQVPEGHVYGFDIQDLALENTRDKVKDFNHVSLIKDGHENIEHHINDAHKGHIDAAIFNLGYLPKGDKSIVTKPDTTIQAINSLLSLMSIEGIIVLVIYHGHSEGQIEKHALLDYLSTLDQKHAQVLQYQFLNQRNHAPFICAIEKIS

SEQ ID NO: 851 - DNA, 951 bp, Staphylococcus aureus
atgggcaatcatttccaatacgcttttgaaaacaaacgttatcacacatggaattaccatttaaaaaataaatttggacaaaaaatatttaaagttgcattggatggcgggtttgactgtcctaaccgcgatggcactgtagcacatggtggatgtacattttgttctgctgcaggtagcggagactttgcaggtaatcgtgcagattcaatcgcagtacaatttaaagaaattaaagaaaagatgcatgagaaatggcacgaaggaaaatatattgcttattttcaggcatttacaaatacacatgcaccggttgaagtattaaaagaaaaattcgaacctgtacttaaagaaccgggtgttgtgggattatctattggtacgcgtcctgactgtctaccagacgatgttgtcgaatatttagcagatttgaatcaacgaacatacttatgggttgaattaggactacaaacaatccatcagtcaacatctgatttaatcaatcgtgcccatgatatgaaaacttattatgatggtgtggcaaaattacgtaagcataatatcaatgtatgtacacacatcattaatggcttacctggcgaagactatgacatgatgatggctactgccaaagaagttgcacaaatggatgtacaaggtattaaaattcatttacttcatttgttaaaaggtacaccgatggtaaaacaatacgataaaggtttattaacttttatgactcaagaagagtacacaaacctagttgtggaccaattagaagtgattccccctgaaatgatcgttcaccgaattaccggtgatggtccaatagatatcatggtaggtccaatgtggagtgttaataaatgggaagtattaaatggcatcgatgctgaattagcacgtagaaattcttatcaaggcttgcgttacaagtctaaggtgaagcaa

SEQ ID NO: 852 - protein, 317 aa, Staphylococcus aureus
  MISC_FEATURE (1)..(317): conserved hypothetical
MGNHFQYAFENKRYHTWNYHLKNKFGQKIFKVALDGGFDCPNRDGTVAHGGCTFCSAAGSGDFAGNRADSIAVQFKEIKEKMHEKWHEGKYIAYFQAFTNTHAPVEVLKEKFEPVLKEPGVVGLSIGTRPDCLPDDVVEYLADLNQRTYLWVELGLQTIHQSTSDLINRAHDMKTYYDGVAKLRKHNINVCTHIINGLPGEDYDMMMATAKEVAQMDVQGIKIHLLHLLKGTPMVKQYDKGLLTFMTQEEYTNLVVDQLEVIPPEMIVHRITGDGPIDIMVGPMWSVNKWEVLNGIDAELARRNSYQGLRYKSKVKQ

SEQ ID NO: 853 - DNA, 1179 bp, Staphylococcus aureus
atgaatatacctaaatcagtctggtggctagtaattggcatggcgttaaatattactggttccagttttttgtggcctttaaatacaatttatatgaaacaagaacttggaaaaagtttaactgttgctggtttagtgctaatgataaattcatttggcatggttattggaaacttattaggtggttcactatttgataaattaggtggatacaagacgattttaattggaactttcacttgtctttgtagtacaacgctacttaatttctttcacgggtggccttggtatgctgtatggcttgtaatgttagggtttggtggcggaatgattattcctgcgatatacgctatggctggagcagtgtggccaaatggcggaagacaaacgtttaatgcgatatacttagcgcaaaatattggtgtggctgtcggtgctgcaatgggcggctttgtcgcagaatttagctttaactatatctttttagccaatcttattatgtatgttgtgtttgcgcttgtcgcggtaacgcaatttaatattgaaattaatgcgaaagttaaatatccaactcatttagatattactggtaaaaagaataaagcaagatttatttcattagtactaatttgtgcaatgtttgcaatttgttgggttgcatatattcaatgggagtctacaatcgcttcatttacacaatctattaatatttcaatggcacaatatagtgttttatggacaattaacggaataatgattttagtagcacaaccattaattaaaccgattctctatctgttaaaaggaaacttaaagaagcaaatgtttgtcggcatcatcatttttatgttgtcgttctttgtcacgagttttgccgaaaactttacaatatttgttgtcggtatgattattttaacttttggagaaatgtttgtatggccagcagttccaactatagccaatcagttagcgccagatggtaagcaaggacagtaccaaggttttgtgaattcagctgctacagtaggaaaagcatttggtccatttcttggtggtgtattagttgatgcgtttaatatgcgcatgatgtttatcggtatgatgctactacttgtatttgcattaatattattaatggttttcaaggagaataatacgcaacctaaaaaaatagatgca

SEQ ID NO: 854 - protein, 393 aa, Staphylococcus aureus
  MISC_FEATURE (1)..(393): multidrug resistance
MNIPKSVWWLVIGMALNITGSSFLWPLNTIYMKQELGKSLTVAGLVLMINSFGMVIGNLLGGSLFDKLGGYKTILIGTFTCLCSTTLLNFFHGWPWYAVWLVMLGFGGGMIIPAIYAMAGAVWPNGGRQTFNAIYLAQNIGVAVGAAMGGFVAEFSFNYIFLANLIMYVVFALVAVTQFNIEINAKVKYPTHLDITGKKNKARFISLVLICAMFAICWVAYIQWESTIASFTQSINISMAQYSVLWTINGIMILVAQPLIKPILYLLKGNLKKQMFVGIIIFMLSFFVTSFAENFTIFVVGMIILTFGEMFVWPAVPTIANQLAPDGKQGQYQGFVNSAATVGKAFGPFLGGVLVDAFNMRMMFIGMMLLLVFALILLMVFKENNTQPKKIDA

SEQ ID NO: 855 - DNA, 2415 bp, Staphylococcus aureus
gtgttgaattacaaccacaatcaaattgaaaagaaatggcaagactattgggacgaaaataaaacatttaaaacaaatgataacttaggtcaaaagaaattttatgctttagacatgtttccatatccatcaggtgctggtttacatgttggacatcctgagggctatacagcaacagatatcatttcaagatataaaagaatgcaaggatataatgtattacatccgatggggtgggatgcattcggattaccagcagagcaatatgctttagacactggcaacgacccacgtgaatttacaaagaaaaatatccaaacttttaaacgacaaattaaagaattagggttcagttatgattgggatcgtgaagttaatacaacagatccagaatactataaatggacacagtggattttcatacagttatataacaaaggtttagcatacgttgatgaagttgcagttaactggtgtccagcattaggcactgttttatctaacgaagaagtgattgatggtgtctctgaacgtggtggacatccagtttatcgtaagccgatgaaacaatgggtacttaaaatcacagaatatgcagatcaattattagcagatttagatgatttagattggcctgagtctttaaaagatatgcagcgcaattggattggacgttctgaaggggccaaagtttcatttgatgtagataatacggaaggaaaagtagaagtatttacgactagaccagatacaatctatggtgcatcattcttagtcttaagtcctgaacatgcattagttaattcaattacaacagatgaatataaagaaaaagtaaaagcttatcaaacagaagcttctaaaaagtcagatttagaacgtacagatttagcaaaagataaatcaggtgtatttactggtgcatatgcaactaatcctttatctggtgaaaaagtacaaatttggattgctgattatgtattatcaacatatggtactggagcaattatggcagtaccagcgcatgatgacagagattatgaatttgctaaaaagtttgatttgccaatcattgaagtcatcgaaggtggaaatgttgaagaagcagcatacactggtgaaggtaaacatattaattctggtgaacttgatggtttagaaaatgaagcggcaattactaaagctattcaattattagagcaaaaaggtgctggcgaaaagaaagttaattacaaattaagagattggttattcagtcgtcagcgttattggggcgaaccaattcctgtcattcattgggaagatggaacaatgacaactgttcctgaagaagagctaccattgttgttacctgaaacagatgaaatcaagccatcagggactggtgagtctccactagctaatattgattcatttgtaaatgttgtagatgaaaaaacaggtatgaaaggacgtcgtgaaacaaatacaatgccacaatgggcaggtagttgttggtattatttacgttacatcgatcctaaaaatgaaaatatgttagcagatcctgaaaaattaaaacattggttacctgttgatttatatatcggtggagtagaacatgcggttcttcacttattatatgcaagattttggcataaagtcctttatgatttggctatcgtacctactaaagaacctttccaaaaattatttaaccaaggtatgattttaggagaaggtaatgagaagatgagtaaatctaaaggaaatgtaatcaatcctgatgatatagtacagtctcatggtgcagatactttgcgtctttacgaaatgtttatgggacctttagatgctgcaattgcatggagtgaaaaaggattagatgggtctcgtcgattcttagatcgcgtatggcgtttaatggtaaatgaagatgggacattgagttcaaaaattgtaactacaaataataaatctttagataaagtttataaccaaactgttaaaaaggtaacagaagactttgaaacattaggatttaatactgctattagtcaattaatggtatttattaatgagtgttataaagttgatgaagtttataaaccttacattgaaggcttcgttaaaatgttagcacctattgcaccacatatcggtgaagaattatggtcaaaattaggacatgaagagtctattacgtaccaaccttggccaacttatgacgaagcactacttgtagatgatgaagtagaaatcgttgttcaagtgaatggtaaattgagagctaaaattaaaattgctaaagatacatcaaaagaagaaatgcaagaaattgccttatctaatgacaatgttaaagcgagtattgaaggtaaagacatcatgaaagtcatcgctgttcctcaaaaattagtcaatattgtagctaaa

SEQ ID NO: 856 - protein, 805 aa, Staphylococcus aureus
  MISC_FEATURE (1)..(805): leucyl-rRNA synthetase
VLNYNHNQIEKKWQDYWDENKTFKTNDNLGQKKFYALDMFPYPSGAGLHVGHPEGYTATDIISRYKRMQGYNVLHPMGWDAFGLPAEQYALDTGNDPREFTKKNIQTFKRQIKELGFSYDWDREVNTTDPEYYKWTQWIFIQLYNKGLAYVDEVAVNWCPALGTVLSNEEVIDGVSERGGHPVYRKPMKQWVLKITEYADQLLADLDDLDWPESLKDMQRNWIGRSEGAKVSFDVDNTEGKVEVFTTRPDTIYGASFLVLSPEHALVNSITTDEYKEKVKAYQTEASKKSDLERTDLAKDKSGVFTGAYATNPLSGEKVQIWIADYVLSTYGTGAIMAVPAHDDRDYEFAKKFDLPIIEVIEGGNVEEAAYTGEGKHINSGELDGLENEAAITKAIQLLEQKGAGEKKVNYKLRDWLFSRQRYWGEPIPVIHWEDGTMTTVPEEELPLLLPETDEIKPSGTGESPLANIDSFVNVVDEKTGMKGRRETNTMPQWAGSCWYYLRYIDPKNENMLADPEKLKHWLPVDLYIGGVEHAVLHLLYARFWHKVLYDLAIVPTKEPFQKLFNQGMILGEGNEKMSKSKGNVINPDDIVQSHGADTLRLYEMFMGPLDAAIAWSEKGLDGSRRFLDRVWRLMVNEDGTLSSKIVTTNNKSLDKVYNQTVKKVTEDFETLGFNTAISQLMVFINECYKVDEVYKPYIEGFVKMLAPIAPHIGEELWSKLGHEESITYQPWPTYDEALLVDDEVEIVVQVNGKLRAKIKIAKDTSKEEMQEIALSNDNVKASIEGKDIMKVIAVPQKLVNIVAK

SEQ ID NO: 857 - DNA, 309 bp, Staphylococcus aureus
atgaagtcaattactacagatgaattaaaaaataaacttttagaatctaaaccagttcaaattgttgatgttcgtactgatgaagaaacagcaatgggatatattcctaatgcaaagttaattccaatggataccattccggataatttaaattcatttaataaaaatgaaatatattatattgtatgtgctggtggagttcgaagcgctaaagttgtagaatatttagaggcaaatggcattgatgccgtaaatgtcgaaggcggcatgcacgcatggggcgatgaaggtttggaaataaaaagtatt

SEQ ID NO: 858 - protein, 103 aa, Staphylococcus aureus
  MISC_FEATURE (1)..(103): conserved hypothetical
MKSITTDELKNKLLESKPVQIVDVRTDEETAMGYIPNAKLIPMDTIPDNLNSFNKNEIYYIVCAGGVRSAKVVEYLEANGIDAVNVEGGMHAWGDEGLEIKSI

SEQ ID NO: 859 - DNA, 6558 bp, Staphylococcus aureus
atgaatttgttaaagaaaaataaatatagtattaggaagtataaagtaggcatattctctactttaatcggaacagttttattactttcaaacccaaatggtgcacaagccttaactacggataataatgtacaaagcgatactaatcaagcaacacctgtaaattcacaagataaagatgttgctaataatagaggtttagcaaatagtgcgcagaatacacctaatcaatctgcaacaaccaatcaagcaacgaatcaagcattggttaatcataataatggtagtatagtaaatcaagctacgccaacatcagtgcaatcaagtacgccttcagcacaaaacaataatcatacagatggcaatacaacagcaactgagacagtgtcaaacgctaataataatgatgtagtgtcgaataataccgcattaaatgtaccaactaaaacaaatgaaaatggttcaggaggacatctaactttaaaggaaattcaagaagatgttcgtcattcttcaaataaaccagagctagttgcaattgctgaaccagcatctaatagaccgaaaaagagaagtagacgtgcggcaccggcagatcctaatgcaactccagcagatccagcggctgcagcggtaggaaacggtggtgcaccagttgcaattacagcgccatatacgccaacaactgatcctaatgccaataatgcaggacaaaatgcacctaacgaagtgctgtcatttgatgacaatggtattagaccaagtaccaaccgttctgtgccaacagtaaacgttgttaataacttgccgggcttcacactaatcaatggtggcaaagtaggggtgtttagtcatgcaatggtaagaacgagcatgtttgattcaggagataataagaactatcaagcacaaggaaatgtaattgcattaggtcgtatacatggaactgatacgaatgaccatggcgattttaatggtatcgagaaagcattaacagtaaatccgaattctgaattaatctttgaatttaatacaatgactactaaaaacggtcaaggcgcaacaaatgttattatcaaaaatgctgatactaatgatacgattgctgaaaagactgttgaaggcggtccaactttgcgtttatttaaagtacctgataatgtgagaaatctcaaaattcaatttgtacctaaaaatgacgcaataacagatgcgcgtggcatttatcaactaaaagatggttacaaatactatagctttgttgactctatcggacttcattctgggtcacatgtttttgttgaaagacgaacaatggatccaacagcaacaaataataaagagtttactgtaacaacatcattaaagaataatggtaattctggtgcttctctagatacaaatgactttgtatatcaagttcaattacctgaaggtgttgaatatgtgaacaattcattgactaaagattttccaagtaacaattcaggcgttgatgttaatgatatgaatgttacatatgatgcagcaaatcgtgtgataacaattaaaagtactggaggaggtacagcaaactctccggcacgacttatgcctgataaaatactcgatttaagatataaattacgtgtaaataatgtgccgacaccaagaacagtaacatttaacgagacattaacgtataaaacatatacacaagatttcattaattcagctgcagaaagtcatactgtaagtacaaatccatatactatcgatatcatcatgaataaagatgcattacaagccgaagttgacagacgtattcaacaagctgattatacatttgcgtcattagatatctttaatggtctgaaacgacgcgcacaaacgattttagatgaaaatcgtaacaatgtaccattaaataaaagagtttctcaagcatatattgattcattaactaatcaaatgcaacatacgttaattcgaagtgttgatgctgaaaatgcagttaataaaaaagttgaccaaatggaagatttagttaatcaaaatgatgaattgacagatgaagaaaaacaagcagcaatacaagttatcgaggaacataaaaatgaaataattggtaatattggtgaccaaacgactgatgatggcgttactagaatcaaagatcaaggtatacagaccttaagtggggatactgcaacaccggttgttaaaccaaatgctaaaaaagcaatacgtgataaagcaacgaaacaaagggaaattatcaatgcaacaccagatgctactgaagacgagattcaagatgcactaaatcaattagctacggatgaaacagatgctattgataatgttacgaatgctactacaaatgctgacgttgaaacagctaaaaataatggcatcaatactattggagcagttgttcctcaagtaactcataaaaaagctgcaagagatgcaattaaccaagcaacagcaacgaaaagacaacaaataaatagtaatagagaagcaactcaggaagagaaaaatgcagcattgaacgaattaactcaagcaaccaaccatgctttagaacaaatcaatcaagcaacaacaaatgctaatgttgataacgccaaaggagatggtctaaatgccattaatccaattgctcctgtaactgttgttaagcaagctgcaagggatgccgtatcacatgatgcacaacaacatatcgcagagatcaatgctaatcctgatgcgactcaagaagaaagacaagcagcaattgacaaagtgaatgctgctgtaactgcagcaaacacaaacattttaaacgctaataccaatgctgatgttgaacaagtaaagacaaatgcgattcaaggaatacaagcaattacaccagctacaaaagtaaaaacagatgcaaaaaatgccatcgataaaagtgcggaaacgcaacataatacgatatttaataataatgatgcgacgctcgaagaacaacaagcagcacaacaattacttgatcaagctgtagccacagcgaagcaaaatattaatgcagcagatacgaatcaagaagttgcacaagcaaaagatcagggcacacaaaatatagtagtgattcaaccggcaacacaagttaaaacggatactcgcaatgttgtaaatgataaagcgcgagaggcgataacaaatatcaatgctacaactggcgcgactcgagaagagaaacaagaagcgataaatcgtgtcaatacacttaaaaatagagcattaactgatattggtgtgacgtctactactgcgatggtcaatagtattagagacgatgcagtcaatcaaatcggcgcagttcaaccgcatgtaacgaagaaacaaactgctacaggtgtattaaatgatttagcaactgctaaaaagcaagaaattaatcaaaacacaaatgcaacaactgaagaaaagcaagtggctttaaatcaagtggatcaagagttagcaacggcaattaataatataaatcaagctgatacaaatgcggaagtagatcaagcgcaacaattaggtacaaaagcaattaatgcgattcagccaaatattgttaaaaaacctgcagcattagcacaaatcaatcagcattataatgctaaattagctgaaatcaatgctacaccagatgcaacgaatgatgagaaaaatgctgcgatcaatactttaaatcaagacagacaacaagctattgaaagtattaaacaagctaacacaaatgcagaagtagaccaagctgcgacagtagcagagaataatatcgatgctgttcaagttgatgtagtaaaaaaacaagcagcgcgagataaaatcactgctgaagtggcgaagcgtattgaagcggttaaacaaacacctaatgcaactgacgaagaaaagcaggctgctgttaatcaaatcaatcaacttaaagatcaagcaattaatcaaattaatcaaaaccaaacaaatgatcaggtagacacaactacaaatcaagcggtaaatgctatagataatgttgaagctgaagtagtaattaaaacaaaggcaattgcagatattgaaaaagctgttaaagaaaagcaacagcaaattgataatagtcttgattcaacagataatgagaaagaagttgcttcacaagcattagctaaagaaaaagaaaaagcacttgcagctattgaccaagctcaaacgaatagtcaggtgaatcaagcagcaacaaatggtgtatcagcgattaaaattattcaacctgaaacaaaagttaaaccagctgcacgtgaaaaaatcaatcaaaaagcgaatgaattacgtgctaagattaatcaggataaagaagcaacagcagaagaaagacaagtagcactagataaaatcaatgaatttgtaaatcaagccatgacagatattacgaataatagaacaaatcaacaagttgatgatacaacaagtcaagcgcttgatagcattgctttagtgacgcctgaccatattgttagagcagctgctagagatgcagttaagcaacaatatgaagctaaaaagcgcgaaattgagcaagcggaacatgcgactgatgaagaaaaacaagttgctttaaatcaattagcgaataatgaaaaacgtgcattacaaaacatcgatcaagcaatagcgaataatgatgtgaaacgtgttgaaacaaatggcattgctacactaaaaggtgtacaacctcatattgtaattaagcctgaagcacaacaagcaataaaagcaagtgcagaaaatcaagtagaatcaataaaagatacaccacatgcaacagttgatgaattagatgaagcgaatcaattaattagcgacacactcaaacaagcgcaacaagaaatagaaaatacaaatcaagatgctgctgttactgatgttagaaatcaaacaatcaaggcaatagagcaaataaaacctaaagtaagacgtaaacgagctgcgcttgatagcattgaagaaaataataaaaatcaactcgatgcaatccgaaatacgttggatactactcaagatgaaagagatgttgctattgatactttaaataaaattgtaaatacaattaaaaatgacattgcacaaaacaaaacgaatgcagaagtggatcgaactgagactgatggcaacgacaacatcaaagtgattttacctaaagttcaagttaaaccagcagcgcgtcaatctgttggtgtaaaagccgaagctcaaaatgcactaatcgatcaaagcgatttatcaactgaagaagaaagactagctgctaaacatttagtagaacaagcacttaatcaggctattgatcagatcaatcatgcagataagactgcccaagttaatcaagatagtataaatgctcaaaatattatttcaaaaattaaaccagcgacaacagttaaagcaacagcattacaacaaattcaaaatatcgctacaaataaaattaatttaattaaagcaaataacgaagcgacagatgaagaacaaaatattgcaatagcacaagttgaaaaagagttaattaaagctaaacaacaaattgctagtgcagtgactaatgcagatgtggcatatttattgcatgatgagaaaaacgaaattcgtgaaatcgaacctgttattaacagaaaggcgtctgctcgagaacaattgacaacattattcaacgataaaaaacaagcaattgaagcgaatattcaagcaacggtagaagaaagaaatagtatattagcacagttacaaaatatttatgacactgctattggacaaattgatcaagatcgtagcaatgcacaagttgataaaacagcatcattaaatctacaaacaatacatgatttagatgtacatcctattaaaaagccagatgctgaaaaaacgattaatgatgatcttgcacgcgtcactgctttagtgcaaaattatcgaaaagtaagtaatcgtaataaggctgatgcattaaaagctataactgctttaaaattacaaatggatgaagaattaaaaacagcacgcactaatgctgatgttgatgcagttttaaaacgatttaatgttgcattaagcgatatagaagcagtaattactgaaaaagaaaatagcttactgcgaattgataacattgctcaacaaacatatgcgaaattcaaagcgatcgcaacaccagaacaattagctaaagtaaaagtattaattgatcaatatgttgcagatggcaatagaatgattgatgaagatgcgacattaaatgacatcaaacaacacacgcaattcattgttgatgaaattttagcaattaaattaccagctgaagcgacgaaagtatcaccaaaagaaattcagccagctccaaaagtttgtacgcctattaaaaaagaagagacacatgaatcgcgcaaagttgaaaaagaacttccaaatacaggttctgaaggaatggatttaccattgaaagaatttgcactgattacaggtgcggctttgttagctagaagacgtactaaaaacgaaaaagaatca

SEQ ID NO: 860 - protein, 2186 aa, Staphylococcus aureus
  MISC_FEATURE (1)..(2186): Mrp protein [Staphylococcus
MNLLKKNKYSIRKYKVGIFSTLIGTVLLLSNPNGAQALTTDNNVQSDTNQATPVNSQDKDVANNRGLANSAQNTPNQSATTNQATNQALVNHNNGSIVNQATPTSVQSSTPSAQNNNHTDGNTTATETVSNANNNDVVSNNTALNVPTKTNENGSGGHLTLKEIQEDVRHSSNKPELVAIAEPASNRPKKRSRRAAPADPNATPADPAAAAVGNGGAPVAITAPYTPTTDPNANNAGQNAPNEVLSFDDNGIRPSTNRSVPTVNVVNNLPGFTLINGGKVGVFSHAMVRTSMFDSGDNKNYQAQGNVIALGRIHGTDTNDHGDFNGIEKALTVNPNSELIFEFNTMTTKNGQGATNVIIKNADTNDTIAEKTVEGGPTLRLFKVPDNVRNLKIQFVPKNDAITDARGIYQLKDGYKYYSFVDSIGLHSGSHVFVERRTMDPTATNNKEFTVTTSLKNNGNSGASLDTNDFVYQVQLPEGVEYVNNSLTKDFPSNNSGVDVNDMNVTYDAANRVITIKSTGGGTANSPARLMPDKILDLRYKLRVNNVPTPRTVTFNETLTYKTYTQDFINSAAESHTVSTNPYTIDIIMNKDALQAEVDRRIQQADYTFASLDIFNGLKRRAQTILDENRNNVPLNKRVSQAYIDSLTNQMQHTLIRSVDAENAVNKKVDQMEDLVNQNDELTDEEKQAAIQVIEEHKNEIIGNIGDQTTDDGVTRIKDQGIQTLSGDTATPVVKPNAKKAIRDKATKQREIINATPDATEDEIQDALNQLATDETDAIDNVTNATTNADVETAKNNGINTIGAVVPQVTHKKAARDAINQATATKRQQINSNREATQEEKNAALNELTQATNHALEQINQATTNANVDNAKGDGLNAINPIAPVTVVKQAARDAVSHDAQQHIAEINANPDATQEERQAAIDKVNAAVTAANTNILNANTNADVEQVKTNAIQGIQAITPATKVKTDAKNAIDKSAETQHNTIFNNNDATLEEQQAAQQLLDQAVATAKQNINAADTNQEVAQAKDQGTQNIVVIQPATQVKTDTRNVVNDKAREAITNINATTGATREEKQEAINRVNTLKNRALTDIGVTSTTAMVNSIRDDAVNQIGAVQPHVTKKQTATGVLNDLATAKKQEINQNTNATTEEKQVALNQVDQELATAINNINQADTNAEVDQAQQLGTKAINAIQPNIVKKPAALAQINQHYNAKLAEINATPDATNDEKNAAINTLNQDRQQAIESIKQANTNAEVDQAATVAENNIDAVQVDVVKKQAARDKITAEVAKRIEAVKQTPNATDEEKQAAVNQINQLKDQAINQINQNQTNDQVDTTTNQAVNAIDNVEAEVVIKTKAIADIEKAVKEKQQQIDNSLDSTDNEKEVASQALAKEKEKALAAIDQAQTNSQVNQAATNGVSAIKIIQPETKVKPAAREKINQKANELRAKINQDKEATAEERQVALDKINEFVNQAMTDITNNRTNQQVDDTTSQALDSIALVTPDHIVRAAARDAVKQQYEAKKREIEQAEHATDEEKQVALNQLANNEKRALQNIDQAIANNDVKRVETNGIATLKGVQPHIVIKPEAQQAIKASAENQVESIKDTPHATVDELDEANQLISDTLKQAQQEIENTNQDAAVTDVRNQTIKAIEQIKPKVRRKRAALDSIEENNKNQLDAIRNTLDTTQDERDVAIDTLNKIVNTIKNDIAQNKTNAEVDRTETDGNDNIKVILPKVQVKPAARQSVGVKAEAQNALIDQSDLSTEEERLAAKHLVEQALNQAIDQINHADKTAQVNQDSINAQNIISKIKPATTVKATALQQIQNIATNKINLIKANNEATDEEQNIAIAQVEKELIKAKQQIASAVTNADVAYLLHDEKNEIREIEPVINRKASAREQLTTLFNDKKQAIEANIQATVEERNSILAQLQNIYDTAIGQIDQDRSNAQVDKTASLNLQTIHDLDVHPIKKPDAEKTINDDLARVTALVQNYRKVSNRNKADALKAITALKLQMDEELKTARTNADVDAVLKRFNVALSDIEAVITEKENSLLRIDNIAQQTYAKFKAIATPEQLAKVKVLIDQYVADGNRMIDEDATLNDIKQHTQFIVDEILAIKLPAEATKVSPKEIQPAPKVCTPIKKEETHESRKVEKELPNTGSEGMDLPLKEFALITGAALLARRRTKNEKES

SEQ ID NO: 861 - DNA, 1281 bp, Staphylococcus aureus
ttggaggaagcgtatatgtatcaaacaattattatcggaggcggacctagcggcttaatggcggcagtagctgcaagcgaacaaagtagcagtgtgttactcattgaaaaaaagaaaggtctaggtcgtaaactcaaaatatctggtggcggtagatgtaacgtaactaatcgattaccatatgctgaaattattaagaacattcctggaaatgggaaatttttatatagtcccttttcaatttttgataatgaatccatcatagatttttttgagtctaggggtgttaaattaaaagaagaagatcacgggcgtatgtttccagtttccaacaaagcacaagacgtggttgatacattagtgacaactatcgaacgccaacatgtaacgattaaagaagaagaagctgttagtagaatcgaagttaatacagaccaaactttcactgtacatactcaaaataatagttatgaaagccattcgctagtgattgctacaggtggtacaagtgtccctcaaactggttcaactggtgatggttataagttcgcacaagatttaggtcataccattactgagttattcccgaccgaagttccaattacatcagctgaacctttcatcaaatccaatcgtctaaaaggtttaagtttaaaagatgttgaattgtcagtacttaagaaaaatggtaaaaaacgcatcagtcatcaaatggatatgttatttactcattttggtatcagtggtccagctgcattaagatgtagtcagtttgtttataaagaacaaaaaaatcaaaagacacagcacatttctatggcaatcgatgcatttcctgaattaaaccatgaacaattaaaacaacacatcacatcattattatcggacacaccagataaaatcattaaaaacagtttgcatggtctaattgaagagcgctacttactgttcatgctggaacaagcaggaatcgatgaaaataccacatcacatcacttatcaaatcaacaattgaacgacttagtaaatatgtttaaagggtttgtatttaaggtgaacgggacattacctatagataaggcatttgtcacaggtggtggtgtgtcacttaaagaaattcaacctaaaacaatgatgtctaaattagttccgggattatttttatgtggtgaagtattagatatacatggttatactggtggttataatattacaagtgcactcgtaacaggacatgtcgctggattatatgccggacattactcacatgcatcaatggaa

SEQ ID NO: 862 - protein, 427 aa, Staphylococcus aureus
  MISC_FEATURE (1)..(427): hypothetical protein
LEEAYMYQTIIIGGGPSGLMAAVAASEQSSSVLLIEKKKGLGRKLKISGGGRCNVTNRLPYAEIIKNIPGNGKFLYSPFSIFDNESIIDFFESRGVKLKEEDHGRMFPVSNKAQDVVDTLVTTIERQHVTIKEEEAVSRIEVNTDQTFTVHTQNNSYESHSLVIATGGTSVPQTGSTGDGYKFAQDLGHTITELFPTEVPITSAEPFIKSNRLKGLSLKDVELSVLKKNGKKRISHQMDMLFTHFGISGPAALRCSQFVYKEQKNQKTQHISMAIDAFPELNHEQLKQHITSLLSDTPDKIIKNSLHGLIEERYLLFMLEQAGIDENTTSHHLSNQQLNDLVNMFKGFVFKVNGTLPIDKAFVTGGGVSLKEIQPKTMMSKLVPGLFLCGEVLDIHGYTGGYNITSALVTGHVAGLYAGHYSHASME

SEQ ID NO: 863 - DNA, 1659 bp, Staphylococcus aureus
atgagtgaaagtaaagaaatggtgcgtggaacctttttaattaccattagtatattaattaccaaggtattgggcgtactttttatcattccattcaactatttaattggtggacaagaaaatatggcgccgttcacatacgcttatgcaccatataatattgcaattgcagttgcgacagcaggtgtaccattagcagcttcgaaatatgttgcgaaatataatgctattggggcatataaagtaagtcagaaattttataaatcgagttttattgtaatgagtattaccggtgttttaggtttcttggtactgtatttcttagcaccttatatttctgaattaacattagctagaaacattcatgataaaaacggttggtcagtcgatgatattacttggattataagaatcattagtatggttgttatctttattcctgtattagcgacatggagagggatattccaaggttataaatctatggggccaacagcagtgtcagaagtaactgagcaaattgcacgcgtgattttcatattaatcggaagttatttagtactaaatgtctttgatggctctattttattagccaatggtattgctacttttgcagcagcagttggtgcgattattggtatattcacactctggtattactggagaaagcgtaagcataatattgatcgtatggtcgaatctgattacacagatatagatgtgtcatatggcaagatgtataaagaaattattgcttatagtataccgttcgttattgtaagtttgaattatccattatttaacttagtagatcaatttacacataacggtgctttatctttagttggtataccttcacagttacaagatatattctttaatatgctaaatatgtcaactaataaaattgtaatgattccgacatcattaagtgctggttttgcagtgagtttaattccttatattacaaaaacatttgcagaaggtcgcttacatgaaatgcatcatcaaattagaacatctattggtgtattaatgtttataactgttccagctagtattggaattatggccttggcacaaccattattcacagttttctatggttacgatccaattgttttaggtcatgaccctaaccatgatggtagtcgcttattattctattatgcgcctgtagcaatactaatttcactattaagtgtaacggcatcaatgttacaaggtatagataaacagaaattaacagtttatgttattttagcttctgtagttatcaagttagcgttaaactatccattaattatgttattccatacacctggtgcaattttaagtactagtatcgcattattatttgcaattggatgtaatttctatattcttaaaaaatatgcgaagtttaaattcagctatagttggattcattttgcaaaaatattcttgtattcatttattatgatgctaggtgtagaattagtatttttccttgcaaatctattcttagaacctactaaacttggttacttaatcattattattttaggtgttacagtaggtattctaatttacggtacaatcacaattaaaacgcgtcttgcggacgaattcttaggtgaaattcctgaaaaattaagacgtagagttaggtttttacga

SEQ ID NO: 864 - protein, 553 aa, Staphylococcus aureus
  MISC_FEATURE (1)..(553): spore cortex protein
MSESKEMVRGTFLITISILITKVLGVLFIIPFNYLIGGQENMAPFTYAYAPYNIAIAVATAGVPLAASKYVAKYNAIGAYKVSQKFYKSSFIVMSITGVLGFLVLYFLAPYISELTLARNIHDKNGWSVDDITWIIRIISMVVIFIPVLATWRGIFQGYKSMGPTAVSEVTEQIARVIFILIGSYLVLNVFDGSILLANGIATFAAAVGAIIGIFTLWYYWRKRKHNIDRMVESDYTDIDVSYGKMYKEIIAYSIPFVIVSLNYPLFNLVDQFTHNGALSLVGIPSQLQDIFFNMLNMSTNKIVMIPTSLSAGFAVSLIPYITKTFAEGRLHEMHHQIRTSIGVLMFITVPASIGIMALAQPLFTVFYGYDPIVLGHDPNHDGSRLLFYYAPVAILISLLSVTASMLQGIDKQKLTVYVILASVVIKLALNYPLIMLFHTPGAILSTSIALLFAIGCNFYILKKYAKFKFSYSWIHFAKIFLYSFIMMLGVELVFFLANLFLEPTKLGYLIIIILGVTVGILIYGTITIKTRLADEFLGEIPEKLRRRVRFLR

SEQ ID NO: 865 - DNA, 801 bp, Staphylococcus aureus
atgaagaaaatcgctacagctactatcgcaactgcaggattcgctacaatcgcaattgcatcaggaaatcaagctcatgcttctgagcaagataactacggttataatccaaacgacccaacatcatatagctatacttacactattgatgcacaaggtaactaccattacacatggaaaggtaactggcatccaagtcaattaaaccaagataatggctactacagctattactactacaatggttacaataactataacaattacaacaacggttatagctacaataactacagccgttacaacaactactcaaataataatcaatcatataactacaataactataatagttacaacacaaacagctaccgtactggtggtttaggtgcaagctacagcacttcaagcaacaatgttcaagtaactacaactatggctccatcatcaaatggccgttcaatctcaagtggttatacttcaggacgtaacttatacacttctggtcaatgtacatactacgtatttgatcgtgtaggtggtaaaatcggttcaacttggggcaatgcaagtaactgggctaacgcagctgcaagagctggttacacagtgaacaatacaccaaaagctggtgcaattatgcaaacaactcaaggtgcatacggtcacgttgcatacgttgaaagtgttaacagcaatggttcagtaagagtttcagaaatgaactatggttatggcccaggtgttgtaacttcacgtacaatctcagctagccaagctgctggttataacttcattcac

SEQ ID NO: 866 - protein, 267 aa, Staphylococcus aureus
  MISC_FEATURE (1)..(267): secretory antigen precursor
MKKIATATIATAGFATIAIASGNQAHASEQDNYGYNPNDPTSYSYTYTIDAQGNYHYTWKGNWHPSQLNQDNGYYSYYYYNGYNNYNNYNNGYSYNNYSRYNNYSNNNQSYNYNNYNSYNTNSYRTGGLGASYSTSSNNVQVTTTMAPSSNGRSISSGYTSGRNLYTSGQCTYYVFDRVGGKIGSTWGNASNWANAAARAGYTVNNTPKAGAIMQTTQGAYGHVAYVESVNSNGSVRVSEMNYGYGPGVVTSRTISASQAAGYNFIH

SEQ ID NO: 867 - DNA, 1953 bp, Staphylococcus aureus
atgacagataattattcactacatatttataaaagtatgaaaatgagtagtgtgaaggaagcgaacttaaaaattatatattggctacaaggtacaggtgtagtttcaatcaatctacaacaatatgatgtaaaaagaaatgatgtcaccattattatgttgaatgatttgtatcaaattgatggtaatgatgatagtgtatgttgtgttgttgaagtaagtgcaaagacatttttgaagtttatgaatgcaaactatatgatgcgtggcaagatattaacaaatgaggttgctagcacttttagaatcttgattaagtatttaatctacagcaaaattaaacaacagtcttataatgctaatgataagattattaattacatgtgtgttgaattaatgtcattaaatacatacgatggtagtcgtcatttagtagccgaagaagtgcacgattatttaacaaacaaccaccataaaaagataaataggaaagatgtcattaatcaagttagtattacaaacaaagctttaagtgacatgtttaaagcgacaccttatagtaattttattcaatatttaaatcatattagactggagcattgcttaattgatattttaacttctaagaagcctattgaagaaatcgcaagtagtcatggttttaatcattattctcgttttatacacctctttaaagaaacgtatggtaacactcctaaattaattagaaaaagatatagtccaacatctcattcaattaaccattcccaattagttgaaattgataaaaatataattgaattatttgatgatactaatcaaagttcttcaagtatgcgcgagattgatataccttttgagcctacaaaaaggagtcaaatgtatcaacctaaaaacatttatattaaaggaagtaatttttattggatggattattatactattaaacaaatcattcaaagattaggtgttaatcctgaaaacttgcatataattgttacaatcgacacaagcaatgagctatcgattgaacaaatcactttattacttcaaaagatagtgaattacaatgtaaatgtagtgtttcgtattaaacatgaatataaggaattgttaacgagtgctgaaagaggcaagatagaaaagctagtagctacaatttttaatatgacttttgagagtaatagatgtaagattgcatttttaattaacgacttaaatactactgcaattcaaaaactgaaacgtttaatagataattatataggagtatttgaattaatatatcatctggaaccaaaagagttgaatacgcgctatgataaagaaattgatcatctaatagactattttatcttaccgctaagacaaatagaacaggtgtctattgcacgttctaaaattatatgtgatgtagatttgattaatgagaataatgacttaaaagaaaaaatcacaatgtctgatattaataaggtttctgaacttttgacaaattatacaaaatttcgaggacttattatgcacatgtcaattataagtgaatcgagcaaagaaataaatttaactagattatcaatattcatttttatcataaatatacttaatcaattacgagggattgttatttatcaaaatgacacgatgattgtaacgaagttcaaacatgaagtacaatgtgtcatttgtttgccagccgcattgttaaatgagaattcagacgctatacgtttatcgtgtaagggtcttcaacaatttagccatgctaaaactaaacaaattgttttaagtatagataaagataatcatacttccgaaaatggtgtacttgtgaatgatattatgcaacaacacagttattggaaagctaattttatagaaagaaatatttatgatcattcattaatggtctcaagcaatagtattgttcatttgaaatatcatcttgagata

SEQ ID NO: 868 - protein, 651 aa, Staphylococcus aureus
  MISC_FEATURE (1)..(651): hypothetical protein
MTDNYSLHIYKSMKMSSVKEANLKIIYWLQGTGVVSINLQQYDVKRNDVTIIMLNDLYQIDGNDDSVCCVVEVSAKTFLKFMNANYMMRGKILTNEVASTFRILIKYLIYSKIKQQSYNANDKIINYMCVELMSLNTYDGSRHLVAEEVHDYLTNNHHKKINRKDVINQVSITNKALSDMFKATPYSNFIQYLNHIRLEHCLIDILTSKKPIEEIASSHGFNHYSRFIHLFKETYGNTPKLIRKRYSPTSHSINHSQLVEIDKNIIELFDDTNQSSSSMREIDIPFEPTKRSQMYQPKNIYIKGSNFYWMDYYTIKQIIQRLGVNPENLHIIVTIDTSNELSIEQITLLLQKIVNYNVNVVFRIKHEYKELLTSAERGKIEKLVATIFNMTFESNRCKIAFLINDLNTTAIQKLKRLIDNYIGVFELIYHLEPKELNTRYDKEIDHLIDYFILPLRQIEQVSIARSKIICDVDLINENNDLKEKITMSDINKVSELLTNYTKFRGLIMHMSIISESSKEINLTRLSIFIFIINILNQLRGIVIYQNDTMIVTKFKHEVQCVICLPAALLNENSDAIRLSCKGLQQFSHAKTKQIVLSIDKDNHTSENGVLVNDIMQQHSYWKANFIERNIYDHSLMVSSNSIVHLKYHLEI

SEQ ID NO: 869 - DNA, 693 bp, Staphylococcus aureus
atgagaatagataaatttttagcaaatatgggcgtcggtacacgtaatgaggtcaaacagttacttaaaaaaggccttgtaaatgtcaacgaacaagtaattaaatcaccaaaaacacatatagaaccagaaaacgataagataacagttcgtggagaattaatagaatacattgaaaatgtctatattatgttaaataagccaaaaggttatatatcagcaactgaagatcatcattcaaaaaccgttattgatttaatacctgaataccaacatctaaatatttttccggttggtcgtcttgataaagatacagaagggcttttattgataacgaatgatggtgattttaatcatgaattaatgagtccaaacaaacatgtttctaaaaaatatgaagttatttcagcaaatcctatcactgaagacgacattcaagcttttaaagagggtgtaacactgactgatggcaaggttaagcctgcaatattaacttatattgataatcaaacgtcacacgtaacaatttatgaaggaaaatatcatcaagttaaacgaatgtttcatagcattcaaaatgaggtattacatttaagacgtatcaaaattgctgatttagaattggacagcaatttagattcaggagaatatcgtttattaactgaaaatgattttgacaaattaaattataaa

SEQ ID NO: 870 - protein, 231 aa, Staphylococcus aureus
  MISC_FEATURE (1)..(231): hypothetical protein
MRIDKFLANMGVGTRNEVKQLLKKGLVNVNEQVIKSPKTHIEPENDKITVRGELIEYIENVYIMLNKPKGYISATEDHHSKTVIDLIPEYQHLNIFPVGRLDKDTEGLLLITNDGDFNHELMSPNKHVSKKYEVISANPITEDDIQAFKEGVTLTDGKVKPAILTYIDNQTSHVTIYEGKYHQVKRMFHSIQNEVLHLRRIKIADLELDSNLDSGEYRLLTENDFDKLNYK

SEQ ID NO: 871 - DNA, 420 bp, Staphylococcus aureus
atggcaaaaggtaatttatttaaagcgattttaggtataggtggcgctgtagcagctgtacttgttacacgtaaagatagtcgtgacaagctgaaagcagaatataataaatataaacaagatcctcaaagctataaagataatgctaaggataaagcgacgcaattaggaacaattgctaatgaaacaattaaagaagtaaaaacaaatccgaaagaatatgctaatagattaaaaaataatccaaaagcatttttcaaagaagaaaaatcaaaatttaccgaatatgacaataagactgacgaaagtattgaaaaaggtaaatttgatgatgaaggtggcgcagcaccaaataataatttacgtatcgtcactgaagaagatttaaaaaagaataaaaatgcattatctgataaagaa

SEQ ID NO: 872 - protein, 140 aa, Staphylococcus aureus
  MISC_FEATURE (1)..(140): hypothetical protein
MAKGNLFKAILGIGGAVAAVLVTRKDSRDKLKAEYNKYKQDPQSYKDNAKDKATQLGTIANETIKEVKTNPKEYANRLKNNPKAFFKEEKSKFTEYDNKTDESIEKGKFDDEGGAAPNNNLRIVTEEDLKKNKNALSDKE

SEQ ID NO: 873 - DNA, 1407 bp, Staphylococcus aureus
atgtggaaagaaaaagttcaacaatacgaagatcaaatcattaatgacttaaaaggattattagcaattgaaagtgtgagagatgatgcaaaagcatcagaagacgcaccagttggtccaggtcctcgtaaggcattagactacatgtatgaaattgcacatagagatggatttacaacacatgatgtggatcatattgcaggaagaattgaggcaggtaaaggaaatgacgtattaggtatcttatgtcatgttgacgttgttcctgctggtgatggatgggatagtaatccgttcgagccggttgtaacagaagatgctatcatagctagaggtacacttgatgacaaaggtccaacaattgctgcttattatgcaattaagatattagaagatatgaatgtggattggaagaaacgtattcatatgattattggtacggatgaagaatctgattggaaatgtacggatcgctattttaaaacagaagaaatgccaacattaggttttgcaccagatgcagaatttccatgtattcatggtgaaaaaggcattacaacatttgatttagttcaaaataaacttactgaagatcaagatgaacctgattatgaattaataacttttaaatctggtgaacgttacaacatggtacctgatcatgcagaagcaagagtgcttgttaaagaaaatatgacagatgttattcaagactttgagtactttttagaacaaaatcatttacaaggtgatagtactgttgatagtggcattctagttttaacagttgaaggtaaagcggttcatggtatggatccatctatcggtgtgaatgcgggtctttacttactaaaattcttagcatcattaaatcttgataataatgcacaagcgtttgtagcatttagtaatcgctacttatttaattcagattttggtgaaaagatgggaatgaaattccatacagatgtcatgggtgacgtgacaactaacattggtgttattacatatgataatgaaaacgcaggtcttttcggtatcaacttacgctacccagaaggatttgaatttgaaaaagctatggatcgttttgcaaatgagattcaacaatatggctttgaagtgaaattaggtaaagtccaaccaccacattatgttgataaaaatgatccttttgtacaaaagttagttactgcatatagaaatcaaacaaatgatatgactgaaccttatactataggtggcggtacttatgcgagaaacttagacaagggtgtagcatttggcgcaatgtttagtgattctgaagatttaatgcatcagaaaaatgaatatatcactaaaaaacagttatttaacgcaactagtatttacttagaagcaatttattcattatgcgtggaggaa

SEQ ID NO: 874 - protein, 469 aa, Staphylococcus aureus
  MISC_FEATURE (1)..(469): Xaa-His dipeptidase homolog
MWKEKVQQYEDQIINDLKGLLAIESVRDDAKASEDAPVGPGPRKALDYMYEIAHRDGFTTHDVDHIAGRIEAGKGNDVLGILCHVDVVPAGDGWDSNPFEPVVTEDAIIARGTLDDKGPTIAAYYAIKILEDMNVDWKKRIHMIIGTDEESDWKCTDRYFKTEEMPTLGFAPDAEFPCIHGEKGITTFDLVQNKLTEDQDEPDYELITFKSGERYNMVPDHAEARVLVKENMTDVIQDFEYFLEQNHLQGDSTVDSGILVLTVEGKAVHGMDPSIGVNAGLYLLKFLASLNLDNNAQAFVAFSNRYLFNSDFGEKMGMKFHTDVMGDVTTNIGVITYDNENAGLFGINLRYPEGFEFEKAMDRFANEIQQYGFEVKLGKVQPPHYVDKNDPFVQKLVTAYRNQTNDMTEPYTIGGGTYARNLDKGVAFGAMFSDSEDLMHQKNEYITKKQLFNATSIYLEAIYSLCVEE

SEQ ID NO: 875 - DNA, 846 bp, Staphylococcus aureus
atggaaaaaatttttttaaatggtgagtttgtaagtccaagtgaagcaaaggtttcatacaacgacagaggatacgtatttggcgatggtatttatgaatacattcgagtatataatggtaagttatttacagtaacagaacattatgaaagatttttacgtagtgccaatgagattggtttagatttaaattattctgtagaagaattaattgaactatctcgtaaattagttgatatgaatcaaattgaaactggggcaatttatattcaagcaacgcgtggtgtagctgaaaggaatcatagcttcccgacacctgaagtagaaccagcaattgttgcttatacaaagagttatgatcgtccttatgatcatttagaaaatggtgtgaatggtgttaccgttgaagatatccgatggttacgttgcgacattaaaagcttgaacttattaggaaatgtattagcaaaagaatatgctgtgaaatataatgcagttgaagcaattcaacatcgaggtgaaactgtaactgaaggatcttcaagtaatgcttatgcaattaaagacggtgtgatttatacacatccgattaacaactatattcttaatggtattacacgaattgtaattaaaaaaattgccgaagactataacatcccatttaaagaagaaacgtttactgtagatttcttgaaaaacgcagatgaagttattgtttcaagtacttcagctgaggttacacctgttattaaattagatggtgaaccagttaatgatggtaaagttggcccaattacacgtcaactacaagaaggatttgaaaagtatatagagtcacacagtatt

SEQ ID NO: 876 - protein, 282 aa, Staphylococcus aureus
  MISC_FEATURE (1)..(282): D-alanine aminotransferase
MEKIFLNGEFVSPSEAKVSYNDRGYVFGDGIYEYIRVYNGKLFTVTEHYERFLRSANEIGLDLNYSVEELIELSRKLVDMNQIETGAIYIQATRGVAERNHSFPTPEVEPAIVAYTKSYDRPYDHLENGVNGVTVEDIRWLRCDIKSLNLLGNVLAKEYAVKYNAVEAIQHRGETVTEGSSSNAYAIKDGVIYTHPINNYILNGITRIVIKKIAEDYNIPFKEETFTVDFLKNADEVIVSSTSAEVTPVIKLDGEPVNDGKVGPITRQLQEGFEKYIESHSI

SEQ ID NO: 877 - DNA, 798 bp, Staphylococcus aureus
gtggacgagttggagcagttttatcaattagggtggacacttgattcagcaggtggtgcatctggtgaagcatatatggctgaacaagatggacaaaagttgtttttaaaacgaaattcaaatccatttattgcggcattatcagcagaaggtattgtgcccaaattagtatggacgaaacgcatagaaacaggcgaggttgttacagcacaacattggaaaaatgggcgtgaactatcttcaaacgaaatgaagcaaacaagagttgcacatttattaaagaagatacacaattctagacctttattaagtatgttaaagcgtatggaaatggaacctattactcctgagattatgcttaataaaattaatgcctctttatcaagagaagttttaacacatcatattgtgagaaaatcattaacctatttagaagagcatataccgagtttagattcgcgttttttcactgttgtacatggtgatgtgaatcataataattggttattatccgatcgagatgaactatttttagttgattgggaaggtgcaatgattgcagacccggcaattgatatcggaatgctgctttacaactatgttccacaacaacaatggtctgaatggcttgaaacatatggtgttcaagagagcttgaatttaaataaacgtatgaaatggtatacggtaattcaatctataggtcttgttcaatggtatgaagagcaaaaaagatataaggatatgaacacttggcttaaattcctaaatgaagttatgaatagtaacatgtttatt

SEQ ID NO: 878 - protein, 266 aa, Staphylococcus aureus
  MISC_FEATURE (1)..(266): conserved hypothetical
VDELEQFYQLGWTLDSAGGASGEAYMAEQDGQKLFLKRNSNPFIAALSAEGIVPKLVWTKRIETGEVVTAQHWKNGRELSSNEMKQTRVAHLLKKIHNSRPLLSMLKRMEMEPITPEIMLNKINASLSREVLTHHIVRKSLTYLEEHIPSLDSRFFTVVHGDVNHNNWLLSDRDELFLVDWEGAMIADPAIDIGMLLYNYVPQQQWSEWLETYGVQESLNLNKRMKWYTVIQSIGLVQWYEEQKRYKDMNTWLKFLNEVMNSNMFI

SEQ ID NO: 879 - DNA, 642 bp, Staphylococcus aureus
atgagagttcgatacaaaccatgggctgaagattatttaaaagatcatcctgaattggttgacatggacggtcaacatgcagggaaaatgactgaatggtttgataaaacgcaaccgatacacattgaaattggttcgggtatggggcagtttattacaacattagctgctcaaaatcctcatattaactatatttcaatggaacgtgagaaaagtatcgtttataaagtattggataaagttaaagagatgggtttaacaaatttaaagattatttgtaatgacgccattgaattaaatgaatattttaaagacggcgaagtttcgcgtatttatttgaacttttcagatccatggccaaaaaatcgtcatgcaaaacgacgtttaacgtatcatacgtttttagcgttgtatcaacaaatcttaaatgatgaaggagatttacattttaaaactgataacagaggactatttgcctacagtttagaaagtatgtctcaatttggaatgtattttacaaaaataaatctaaatttacatcaagaagacgatggcagtaatattttaacagaatatgaaaagaaattttcggataaagggtcacgtatttatcgtatggaagcgaaattccattcacaaaaa

SEQ ID NO: 880 - protein, 214 aa, Staphylococcus aureus
  MISC_FEATURE (1)..(214): conserved hypothetical
MRVRYKPWAEDYLKDHPELVDMDGQHAGKMTEWFDKTQPIHIEIGSGMGQFITTLAAQNPHINYISMEREKSIVYKVLDKVKEMGLTNLKIICNDAIELNEYFKDGEVSRIYLNFSDPWPKNRHAKRRLTYHTFLALYQQILNDEGDLHFKTDNRGLFAYSLESMSQFGMYFTKINLNLHQEDDGSNILTEYEKKFSDKGSRIYRMEAKFHSQK

SEQ ID NO: 881 - DNA, 882 bp, Staphylococcus aureus
atgctaattgtaataacgaatacagaaagaataggtgatgttatgaaaatcggggatatatctattcattatctaaatggtggcaatacaaaaatggatggcggtgcaatgtttggtgttgttccgaagccgttgtggtcaaagcaatacaatgcaaatgaacgaaatcaaatcaatttaccgacacatccaattttgattcaaacggctcaatataatttgattatagatgcaggtattggtaatggtaaattatctgaaaagcaattacgtaattttggagtagatgaagaaagtcatataattgctgatttggcaaattataatttaacgccaaaggatattgattatgtgctaatgacacatatgcattttgatcatgctgccggtttgactgatcaagcaggacatgcaatttttgaaaatgcgattcatgttgtgcaacaagatgagtggcatgagtttattgcacctaatataagaagtaaatcaacttactgggataagaataaaggcgattatagtaacaagttgattttattcgaaaaacattttgaaccggttctgggtatcaagatgcaacatagtggaggtcatagctttggccacacgattattacgattgaaagtcaaggagataaagcagttcatatgggtgatatattcccaactactgcacataaaaatcctctatgggtaacggcatatgatgattatcctatgcaatcgattcgtgaaaaagaacgcatgataccatattttattcagcaacaatattggttcttgttttatcatgatgaaaactactttgctgtaaaatacagcgataatggtgaaaacatagatgcatatattttacgtgaaacattagttgataataac

SEQ ID NO: 882 - protein, 294 aa, Staphylococcus aureus
  MISC_FEATURE (1)..(294): conserved hypothetical
MLIVITNTERIGDVMKIGDISIHYLNGGNTKMDGGAMFGVVPKPLWSKQYNANERNQINLPTHPILIQTAQYNLIIDAGIGNGKLSEKQLRNFGVDEESHIIADLANYNLTPKDIDYVLMTHMHFDHAAGLTDQAGHAIFENAIHVVQQDEWHEFIAPNIRSKSTYWDKNKGDYSNKLILFEKHFEPVLGIKMQHSGGHSFGHTIITIESQGDKAVHMGDIFPTTAHKNPLWVTAYDDYPMQSIREKERMIPYFIQQQYWFLFYHDENYFAVKYSDNGENIDAYILRETLVDNN

SEQ ID NO: 883 - DNA, 171 bp, Staphylococcus aureus
atgaatgtcaaaggctcatatatcgtttatgaaccattcgttcatcctgaaactgataaataccgtttagtttatcaaggtggaattacaactattaaaaatggtcaaaatattcattatgatttttatgcagatgcatatactggtgaagtcattaacattgtagagcgt

SEQ ID NO: 884 - protein, 57 aa, Staphylococcus aureus
  MISC_FEATURE (1)..(57): hypothetical protein
MNVKGSYIVYEPFVHPETDKYRLVYQGGITTIKNGQNIHYDFYADAYTGEVINIVER

SEQ ID NO: 885 - DNA, 108 bp, Staphylococcus aureus
atgattgaaatggtagaaataattacaatggctactgcaattattgttggaattatatatttcagtttagtcatcatttatgctcccttgatttcaaattcatatcat

SEQ ID NO: 886 - protein, 36 aa, Staphylococcus aureus
MIEMVEIITMATAIIVGIIYFSLVIIYAPLISNSYH

SEQ ID NO: 887 - DNA, 1086 bp, Staphylococcus aureus
gtgagaacttttatgaacataaataaaaaagtaacattacaacgaattcaaactttaactgagcttcatggggcaccaggttttgaagaagaagtaaaaaattatatgactcagcaaatggcgccgtacgtagatgaatttattgaaaatcgtatgggtggattttttggtgtgaaaaaatctaaaaatccaaatgcaaaacgtgtaatgattgcagcacatatggatgaaatcggatttatgattacaaatatcactaaaaatggaatgattcaattcacaaatttaggtggtgttgcaaatgatatttggcaaggacaacgcttagtaattaaaaatagaaatggcgataaaattatcggtgttgtttctaatatacctaaacattttcgtactggtagtgaaggtgcaccggaaattaaagatttaacattagatataggtgctcaaaatgaagatgaggtgcgtgagcgcggaatagatataggagatacaattgtacctcacacgccattcacacagttatctgaacatcgatatagtgctaaagcatgggataatcgttatggttgtgtcttggcaattgaaatactagaattattaaaagatatagaattagatgtagacttgtatgttggcgcaaatgttcaagaagaggttggattacgaggtgcgaaagcatctgcagagatgatagacccagacgttgcatttgtagttgattgttcacctgccaatgacgttaaaggaaaccaaccattatctggtgaacttggtaaagggacgttaattcgcataaaagacggtacaatgattttaaagcctgtatttagagactatttattaaagttagtagaagcacatgacattgaacatcaatactatatgtcaccaggtggaacagatggtggagaaattcataaagctaatattggtattccgactgcagttattggtgtatgtgcacgatatattcatagtacagactcagtatttgatataagagactattttgcagctagatctttactttcagaagccatttgtaatttagataataatcaaatagaaacattacaatataaa

SEQ ID NO: 888 - protein, 362 aa, Staphylococcus aureus
  MISC_FEATURE (1)..(362): endo-1,4-beta-glucanase
VRTFMNINKKVTLQRIQTLTELHGAPGFEEEVKNYMTQQMAPYVDEFIENRMGGFFGVKKSKNPNAKRVMIAAHMDEIGFMITNITKNGMIQFTNLGGVANDIWQGQRLVIKNRNGDKIIGVVSNIPKHFRTGSEGAPEIKDLTLDIGAQNEDEVRERGIDIGDTIVPHTPFTQLSEHRYSAKAWDNRYGCVLAIEILELLKDIELDVDLYVGANVQEEVGLRGAKASAEMIDPDVAFVVDCSPANDVKGNQPLSGELGKGTLIRIKDGTMILKPVFRDYLLKLVEAHDIEHQYYMSPGGTDGGEIHKANIGIPTAVIGVCARYIHSTDSVFDIRDYFAARSLLSEAICNLDNNQIETLQYK

SEQ ID NO: 889 - DNA, 777 bp, Staphylococcus aureus
ttgagatataggcatggtttaagagaggttttaaagatgtctaaatttaaagttaagcgtttaactgcacacatactaatgttgaaagtcattaatgatatgttgaaatattcatttcatctcactttgactcaagtgaaactattaaatctattagttaaatatgataattctgattccaatagcgcttcaatagatagtttattaaaaatgaaagaaatccaatctaagatggcccttcttcaaatgttaagttatttaaacaatcatcaatggctattgaaaggaagagatcaaagggatcaacgtaaattgactatttcgattaataaaatgcatatagataaaatagaatatatgaataatgagcttagtgactatattgaacgttattttggtcaatatacatttgattttagttgtgactatgtatcgtatttattgtcgtcacaagaattattgcggaatctaaagtgttatttaaatatgtgtcaattatcattagaagagttatacgttttaggaatattaaatctgcataaaggtcaattgacggttaaagaattacagggtgaattccatcacccgatatttgcggttagcccgattttaaagtgtttaattttgaagggattagttaaaaaagagagatgtgaattagatgaaaggcgtgttattgtaacaatcaagcgagaaaagttttctaaaggcactatgcttattcaagcatgttataattatcttgaaaagggaataccagttaagcttaataataaa

SEQ ID NO: 890 - protein, 259 aa, Staphylococcus aureus
  MISC_FEATURE (1)..(259): hypothetical protein
LRYRHGLREVLKMSKFKVKRLTAHILMLKVINDMLKYSFHLTLTQVKLLNLLVKYDNSDSNSASIDSLLKMKEIQSKMALLQMLSYLNNHQWLLKGRDQRDQRKLTISINKMHIDKIEYMNNELSDYIERYFGQYTFDFSCDYVSYLLSSQELLRNLKCYLNMCQLSLEELYVLGILNLHKGQLTVKELQGEFHHPIFAVSPILKCLILKGLVKKERCELDERRVIVTIKREKFSKGTMLIQACYNYLEKGIPVKLNNK

SEQ ID NO: 891 - DNA, 309 bp, Staphylococcus aureus
atgaaacaacttgaatcagaacaacaatttgaatctttaaaacaaggtgctacagtatttgaattcactgcaggctggtgtccagattgtagagtgatagaaccagatttaccggaattagaagcgagatatcctatgtttgacttcgtatcagtagaccgtgataaatttatggatatttgtattgaaaatggtattatgggtattccaagttttctagtatataaaaatggagaactgcttggaagttatattggaaaagaacgaaaatcaattgaacagatagatgcatttttagctcaatacgtg

SEQ ID NO: 892 - protein, 103 aa, Staphylococcus aureus
  MISC_FEATURE (1)..(103): thioredoxin homolog
MKQLESEQQFESLKQGATVFEFTAGWCPDCRVIEPDLPELEARYPMFDFVSVDRDKFMDICIENGIMGIPSFLVYKNGELLGSYIGKERKSIEQIDAFLAQYV

SEQ ID NO: 893 - DNA, 864 bp, Staphylococcus aureus
gtgttacatatgaatacctttcaaatgagagataaattaaaggaacgtttaagccatttagacgttgattttaaatttaatcgtgaagaagaaactttgcgtatttatcgaacagataataacaaaggtatcacgattaaacttaacgctatagtcgcaaaatatgaagataaaaaagaaaaaattgtagatgaaattgtttattacgttgatgaagctattgcacaaatggcagataaaacccttgagagtatatcatctagtcaaattatgcctgtcattagagcgactagctttgataaaaaaactaaacaaggtgttccttttatctatgatgagcatactgcagaaacagcagtttattatgcagtcgatttagggaaatcatatcgtctaattgacgaaagcatgttagaggatttgaagttaactgaacaacaaataagagaaatgtctctgtttaatgttagaaaattgtcaaattcatatacgactgatgaagtaaaaggtaatattttttattttattaactcaaatgacgggtatgatgcaagtaggatactaaatactgcatttttaaatgaaattgaggcacaatgtcaaggcgaaatgctcgtagcagtgccacaccaagatgtgttaattattgcagatatacgcaataaaacaggatatgatgtgatggcacatttaacaatggaatttttcactaaaggtctagttccaattacatcattatcctttggatataaacagggtcatcttgaaccgatatttattttaggtaaaaataataaacaaaaaagagatccaaacgtgattcagcgtttagaagcaaatcgtcgtaaatttaataaagataaa

SEQ ID NO: 894 - protein, 288 aa, Staphylococcus aureus
  MISC_FEATURE (1)..(288): conserved hypothetical
VLHMNTFQMRDKLKERLSHLDVDFKFNREEETLRIYRTDNNKGITIKLNAIVAKYEDKKEKIVDEIVYYVDEAIAQMADKTLESISSSQIMPVIRATSFDKKTKQGVPFIYDEHTAETAVYYAVDLGKSYRLIDESMLEDLKLTEQQIREMSLFNVRKLSNSYTTDEVKGNIFYFINSNDGYDASRILNTAFLNEIEAQCQGEMLVAVPHQDVLIIADIRNKTGYDVMAHLTMEFFTKGLVPITSLSFGYKQGHLEPIFILGKNNKQKRDPNVIQRLEANRRKFNKDK

SEQ ID NO: 895 - DNA, 594 bp, Staphylococcus aureus
atgaatttattttacaatcctaaatatgtaggagatgtcgcatttttacaaattgaaccagttgaaggtgaattaaactacaataaaaaaggtaatgttgttgaaattactaatgaaggtaatgttgtaggttataatatttttgaaatttcaaaagatataacaattgaagaaaaaggtcatattaaattaactgatgaacttgtaaatgtattccaaaagcgtatttcagaagctggttttgattataaattaaatgctgatctatcaccgaaatttgtagttggctacgttgaaactaaagacaaacatcctgatgcagataaattaagtgtactaaatgtaaacgttggaaatgacacattacaaattgtatgtggcgcgcctaacgttgaagctggacagaaagttgttgttgctaaagtaggtgcagtgatgcctagcggtatggtaattaaagatgctgaattacgtggtgttgcctcaagcggtatgatttgttcaatgaaagaattgaatttacctaatgcacctgaagaaaaaggtattatggtattaaatgacagctatgaaattggacaagcattttttgaa

SEQ ID NO: 896 - protein, 198 aa, Staphylococcus aureus
  MISC_FEATURE (1)..(198): phenylalanyl-tRNA
MNLFYNPKYVGDVAFLQIEPVEGELNYNKKGNVVEITNEGNVVGYNIFEISKDITIEEKGHIKLTDELVNVFQKRISEAGFDYKLNADLSPKFVVGYVETKDKHPDADKLSVLNVNVGNDTLQIVCGAPNVEAGQKVVVAKVGAVMPSGMVIKDAELRGVASSGMICSMKELNLPNAPEEKGIMVLNDSYEIGQAFFE

SEQ ID NO: 897 - DNA, 3822 bp, Staphylococcus aureus
atgagctggtttgataaattattcggcgaagataatgattcaaatgatgacttgattcatagaaagaaaaaaagacgtcaagaatcacaaaatatagataacgatcatgactcattactgcctcaaaataatgatatttatagtcgtccgaggggaaaattccgttttcctatgagcgtagcttatgaaaatgaaaatgttgaacaatctgcagatactatttcagatgaaaaagaacaataccatcgagactatcgcaaacaaagccacgattctcgttcacaaaaacgacatcgccgtagaagaaatcaaacaactgaagaacaaaattatagtgaacaacgtgggaattctaaaatatcacagcaaagtataaaatataaagatcattcacattaccatacgaataagccaggtacatatgtttctgcaattaatggtattgagaaggaaacgcacaagccaaaaacacataatatgtattctaataatacaaatcatcgtgctaaagattcaactccagattatcacaaagaaagtttcaagacttcagaggtaccgtcagctatttttggcacaatgaaacctaaaaagttagaaaatggtcgtatccctgtaagtaaaccttcagaaaaagttgagtcagataaacaaaaatatgataaatatgtagctaagacgcaaacgtctcaaaataaacaattagaacaagaaaaacaaaatgatagtgttgtcaaacaaggaactgcatctaaatcatctgatgaaaatgtatcatcaacaacaaaatcaatgcctaattattcaaaagttgataatactatcaaaattgaaaatatttatgcttcacaaattgttgaagaaattagacgtgaacgagaacgtaaagtgcttcaaaagcgtcgatttaaaaaagcgttgcaacaaaagcgtgaagaacataaaaacgaagagcaagatgcaatacaacgtgcaattgatgaaatgtatgctaaacaagcggaacgctatgttggtgatagttcattaaatgatgatagtgacttaacagataatagtacagatgctagtcagcttcatacaaatggcatagagaatgaaactgtatcaaatgatgaaaataaacaagcgtcaatacaaaatgaagacactaatgacactcatgtagatgaaagtccatacaattatgaggaagttagtttgaatcaagtatcgacaacaaaacaattgtcagatgatgaagttacggtttcgaatgtaacgtctcaacatcaatcagcactacaacataacgttgaagtaaatgataaagatgaactaaaaaatcaatccagattaattgctgattcagaagaagatggagcaacgaataaagaagaatattcaggaagtcaaatcgatgatgcagaattttatgaattaaatgatacagaagtagatgaggatactacttcaaatatcgaagataataccaatagaaacgcgtctgaaatgcatgtagacgctcctaaaacgcaagagtacgcagtaactgaatctcaagtaaataatatcgataaaacggttgataatgaaattgaattagcaccgcgtcataaaaaagatgaccaaacaaacttaagtgtcaactcattgaaaacgaatgatgtgaatgataatcatgttgtggaagattcaagcatgaatgaaatagaaaagaataacgcagaaattacagaaaatgtgcaaaacgaagcagctgaaagtgaacaaaatgtcgaagagaaaactattgaaaacgtaaatccaaagaaacagactgaaaaggtttcaactttaagtaaaagaccatttaatgttgtcatgacgccatctgataaaaagcgtatgatggatcgtaaaaagcattcaaaagtcaatgtgcctgaattaaagcctgtacaaagtaagcaagctgtgagtgaaagaatgcctgcgagtcaagccacaccatcatcaagatctgattcacaagagtcaaatacaaatgcatataaaacaaataatatgacatcaaacaatgttgagaacaatcaacttattggtcatgcagaaacagaaaatgattatcaaaatgcacaacaatattcagagcagaaaccttctgttgattcaactcaaacggaaatatttgaagaaagtcaagatgataatcaattggaaaatgagcaagttgatcaatcaacttcgtcttcagtttcagaagtaagcgacataactgaagaaagcgaagaaacaacacatccaaacaatactagtggacaacaagataatgatgatcaacaaaaagatttacagtcatcattttcaaataaaaatgaagatacagctaatgaaaatagacctcggacgaaccaacaagatgttgcaacaaatcaagctgtacaaacatctaagccgatgattcgtaaaggcccaaatattaaattgccaagtgtttcattactagaagaaccacaagttattgagtcggacgaggactggattacagataaaaagaaagaactgaatgacgcattattttactttaatgtacctgcagaagtacaagatgtaactgaaggtccaagtgttacaagatttgaattatcagttgaaaaaggtgttaaagtttcaagaattacggcattacaagatgacattaaaatggcattggcagcgaaagatattcgtatagaagcgcctattccaggaactagtcgtgttggtattgaagttccgaaccaaaatccaacgacagtcaacttacgttctattattgaatctccaagttttaaaaatgctgaatctaaattaacagttgcgatggggtatagaattaataatgaaccattacttatggatattgctaaaacgccacacgcactaattgcaggtgcaactggatcagggaaatcagtttgtatcaatagtattttgatgtctttactatataaaaatcatcctgaggaattaagattattacttatcgatccaaaaatggttgaattagctccttataatggtttgccacatttagttgcaccggtaattacagatgtcaaagcagctacacagagtttaaaatgggccgtagaagaaatggaacgacgttataagttatttgcacattaccatgtacgtaatataacagcatttaacaaaaaagcaccatatgatgaaagaatgccaaaaattgtcattgtaattgatgagttggctgatttaatgatgatggctccgcaagaagttgaacagtctattgctagaattgctcaaaaagcgagagcatgtggtattcatatgttagtagctacgcaaagaccatctgtcaatgtaattacaggtttaattaaagccaacataccaacaagaattgcatttatggtatcatcaagtgtagattcgagaacgatattagacagtggtggagcagaacgcttgttaggatatggcgatatgttatatcttggtagcggtatgaataaaccgattagagttcaaggtacatttgtttctgatgacgaaattgatgatgttgttgattttatcaaacaacaaagagaaccggactatctatttgaagaaaaagaattgttgaaaaaaacacaaacacaatcacaagatgaattatttgatgatgtttgtgcatttatggttaatgaaggacatatttcaacatcattaatccaaagacatttccaaattggctataatagagcagcaagaattatcgatcaattagagcaactcggttatgtttcgagtgctaatggttcaaaaccaagggatgtttatgttacggaagcagatttaaataaagaa

SEQ ID NO: 898 - protein, 1274 aa, Staphylococcus aureus
  MISC_FEATURE (1)..(1274): DNA translocase stage III
MSWFDKLFGEDNDSNDDLIHRKKKRRQESQNIDNDHDSLLPQNNDIYSRPRGKFRFPMSVAYENENVEQSADTISDEKEQYHRDYRKQSHDSRSQKRHRRRRNQTTEEQNYSEQRGNSKISQQSIKYKDHSHYHTNKPGTYVSAINGIEKETHKPKTHNMYSNNTNHRAKDSTPDYHKESFKTSEVPSAIFGTMKPKKLENGRIPVSKPSEKVESDKQKYDKYVAKTQTSQNKQLEQEKQNDSVVKQGTASKSSDENVSSTTKSMPNYSKVDNTIKIENIYASQIVEEIRRERERKVLQKRRFKKALQQKREEHKNEEQDAIQRAIDEMYAKQAERYVGDSSLNDDSDLTDNSTDASQLHTNGIENETVSNDENKQASIQNEDTNDTHVDESPYNYEEVSLNQVSTTKQLSDDEVTVSNVTSQHQSALQHNVEVNDKDELKNQSRLIADSEEDGATNKEEYSGSQIDDAEFYELNDTEVDEDTTSNIEDNTNRNASEMHVDAPKTQEYAVTESQVNNIDKTVDNEIELAPRHKKDDQTNLSVNSLKTNDVNDNHVVEDSSMNEIEKNNAEITENVQNEAAESEQNVEEKTIENVNPKKQTEKVSTLSKRPFNVVMTPSDKKRMMDRKKHSKVNVPELKPVQSKQAVSERMPASQATPSSRSDSQESNTNAYKTNNMTSNNVENNQLIGHAETENDYQNAQQYSEQKPSVDSTQTEIFEESQDDNQLENEQVDQSTSSSVSEVSDITEESEETTHPNNTSGQQDNDDQQKDLQSSFSNKNEDTANENRPRTNQQDVATNQAVQTSKPMIRKGPNIKLPSVSLLEEPQVIESDEDWITDKKKELNDALFYFNVPAEVQDVTEGPSVTRFELSVEKGVKVSRITALQDDIKMALAAKDIRIEAPIPGTSRVGIEVPNQNPTTVNLRSIIESPSFKNAESKLTVAMGYRINNEPLLMDIAKTPHALIAGATGSGKSVCINSILMSLLYKNHPEELRLLLIDPKMVELAPYNGLPHLVAPVITDVKAATQSLKWAVEEMERRYKLFAHYHVRNITAFNKKAPYDERMPKIVIVIDELADLMMMAPQEVEQSIARIAQKARACGIHMLVATQRPSVNVITGLIKANIPTRIAFMVSSSVDSRTILDSGGAERLLGYGDMLYLGSGMNKPIRVQGTFVSDDEIDDVVDFIKQQREPDYLFEEKELLKKTQTQSQDELFDDVCAFMVNEGHISTSLIQRHFQIGYNRAARIIDQLEQLGYVSSANGSKPRDVYVTEADLNKE

SEQ ID NO: 899 - DNA, 1332 bp, Staphylococcus aureus
atgagtaaggagttttatataatgacacactatcattttgtcggaattaaaggttctggcatgagttcattagcacaaatcatgcatgatttaggacatgaagttcaaggatcggatattgagaactacgtatttacagaagttgctcttagaaataaggggataaaaatattaccatttgatgctaataacataaaagaagatatggtagttatacaaggtaatgcattcgcgagtagccatgaagaaatagtacgtgcacatcaattgaaattagatgttgtaagttataatgattttttaggacagattattgatcaatatacttcagtagctgtaactggtgcacatggtaaaacttctacaacaggtttattatcacatgttatgaatggtgataaaaagacttcatttttaattggtgatggcacaggtatgggattgcctgaaagtgattatttcgcttttgaggcatgtgaatatagacgtcactttttaagttataaacctgattacgcaattatgacaaatattgatttcgatcatcctgattattttaaagatattaatgatgtttttgatgcattccaagaaatggcacataatgttaaaaaaggtattattgcttggggtgatgatgaacatctacgtaaaattgaagcagatgttccaatttattattatggatttaaagattcggatgacatttatgctcaaaatattcaaattacggataaaggtactgcttttgatgtgtatgtggatggtgagttttatgatcacttcctgtctccacaatatggtgaccatacagttttaaatgcattagctgtaattgcgattagttatttagagaagctagatgttacaaatattaaagaagcattagaaacgtttggtggtgttaaacgtcgtttcaatgaaactacaattgcaaatcaagttattgtagatgattatgcacaccatccaagagaaattagtgctacaattgaaacagcacgaaagaaatatccacataaagaagttgttgcagtatttcaaccacacactttctctagaacacaggcatttttaaatgaatttgcagaaagtttaagtaaagcagatcgtgtattcttatgtgaaatttttggatcaattagagaaaatactggcgcattaacgatacaagatttaattgataaaattgaaggtgcatcgttaattaatgaagattctattaatgtattagaacaatttgataatgctgttattttatttatgggtgcaggtgatattcaaaaattacaaaatgcatatttagataaattaggcatgaaaaatgcgttt

SEQ ID NO: 900 - protein, 444 aa, Staphylococcus aureus
MSKEFYIMTHYHFVGIKGSGMSSLAQIMHDLGHEVQGSDIENYVFTEVALRNKGIKILPFDANNIKEDMVVIQGNAFASSHEEIVRAHQLKLDVVSYNDFLGQIIDQYTSVAVTGAHGKTSTTGLLSHVMNGDKKTSFLIGDGTGMGLPESDYFAFEACEYRRHFLSYKPDYAIMTNIDFDHPDYFKDINDVFDAFQEMAHNVKKGIIAWGDDEHLRKIEADVPIYYYGFKDSDDIYAQNIQITDKGTAFDVYVDGEFYDHFLSPQYGDHTVLNALAVIAISYLEKLDVTNIKEALETFGGVKRRFNETTIANQVIVDDYAHHPREISATIETARKKYPHKEVVAVFQPHTFSRTQAFLNEFAESLSKADRVFLCEIFGSIRENTGALTIQDLIDKIEGASLINEDSINVLEQFDNAVILFMGAGDIQKLQNAYLDKLGMKNAF

SEQ ID NO: 901 - DNA, 489 bp, Staphylococcus aureus
atggattggattttaccaattgctggaattatcgctgcgattgcattcttaattttatgtatcggtatcgtagctgtattaaattctgttaagaaaaacttagattatgttgcaaaaacacttgacggtgtagaaggtcaagttcaaggtattactcgtgaaacaacagatttacttcataaagtaaaccgtttaactgaggatatccaaggtaaagtagatcgtttaaactcagttgtagatgctgttaaaggtatcggtgactcagtacaaacgttaaacagctctgtagatcgtgtaacaaattcaattacacataatatttctcaaaatgaagataaaatctcacaagttgttcaatggtcaaatgttgcaatggaaattgcagacaaatggcaaaatagacactaccgtcgtggaagtgcaaattacaaagctaataatgtagcaactgatgcaaatcatagctatacttctagagtagataaa

SEQ ID NO: 902 - protein, 163 aa, Staphylococcus aureus
  MISC_FEATURE (1)..(163): hypothetical protein
MDWILPIAGIIAAIAFLILCIGIVAVLNSVKKNLDYVAKTLDGVEGQVQGITRETTDLLHKVNRLTEDIQGKVDRLNSVVDAVKGIGDSVQTLNSSVDRVTNSITHNISQNEDKISQVVQWSNVAMEIADKWQNRHYRRGSANYKANNVATDANHSYTSRVDK

SEQ ID NO: 903 - DNA, 1515 bp, Staphylococcus aureus
atgacgcagcaacaaaatgataaaagaacattaaaaaataaacacacttatcaaaatgaaccactaccaaaccgtaaagattttgttgttagttttataactggcgcgcttgttggttcagctttaggtttgtattttaaaaataaagtttatcaaaaagcagatgatttaaaagtcaaagaacaagaactgtcgcaaaagtttgaagaaagaaaaacgcaacttgaagaaacggttgcctatacaaaagaacgtgttgaaggatttttaaacaaatctaaaaatgagcaagcggcattaaaggcacaacaagcagcgataaaagaagaagcaagtgcaaataatttaagtgatacatcacaagaagcacaagagattcaagaagctaaaagagaagcacaagcagaagcggataaaagtgtggctgtatcaaataaagaatcaaaagcagtggcattgaaagcacaacaagcagcgataaaagaagaagcaagtgcaaataatttgagtgatacatcacaagaggcacaagagattcaagaagctaaaaaagaagcacaagcagaaacagataaaagtgcagctgtatcaaatgaagaaccaaaagcagtggcattgaaagcacaacaagcagcgataaaagaagaagcaagtgcaaataatttaagtgatacatcacaagaggcacaagaggttcaagaagctaaaaaagaagcacaagcagaaacagataaaagtgcagctgtatcaaatgaagaaccaaaagcagtggcattgaaagcacaacaagcagcgataaaagaagaagcaagtgcaaataatttaagtgatatatcacaagaggcacaagaggttcaagaagctaaaaaagaagcacaagcagagaaagacagtgacacattaactaaagatgcaagtgcagcaaaggtagaagtatcaaaaccagagtcacaagctgaaagattagcaaacgctgcaaaacagaagcaagctaaattaacaccaggttcaaaagagagtcaattaactgaagcgttatttgcagaaaaaccagttgctaaaaatgacttgaaagaaattcctcaattagttactaaaaagaatgatgtatcagagacagagacggttaatatagataataaagacactgttaaacaaaaagaagctaaatttgaaaatggtgttattacacgtaaagctgatgaaaaaacaactaataatacagctgttgacaagaaatcaggtaaacaatctaaaaaaacaacaccttcaaataaacgaaatgcatcaaaagcatctacaaataaaacttcaggtcagaaaaagcaacataataagaaatcatcacaaggtgcaaagaaacaaagtagttcaagtaagtcaactcaaaagaataatcaaactagtaataagaattcaaaaacaacaaatgctaaatcatccaatgcatcaaaaacgccaaatgctaaagttgagaaagctaaaagtaaaatagagaaacgtacattcaatgac

SEQ ID NO: 904 - protein, 505 aa, Staphylococcus aureus
  MISC_FEATURE (1)..(505): hypothetical protein
MTQQQNDKRTLKNKHTYQNEPLPNRKDFVVSFITGALVGSALGLYFKNKVYQKADDLKVKEQELSQKFEERKTQLEETVAYTKERVEGFLNKSKNEQAALKAQQAAIKEEASANNLSDTSQEAQEIQEAKREAQAEADKSVAVSNKESKAVALKAQQAAIKEEASANNLSDTSQEAQEIQEAKKEAQAETDKSAAVSNEEPKAVALKAQQAAIKEEASANNLSDTSQEAQEVQEAKKEAQAETDKSAAVSNEEPKAVALKAQQAAIKEEASANNLSDISQEAQEVQEAKKEAQAEKDSDTLTKDASAAKVEVSKPESQAERLANAAKQKQAKLTPGSKESQLTEALFAEKPVAKNDLKEIPQLVTKKNDVSETETVNIDNKDTVKQKEAKFENGVITRKADEKTTNNTAVDKKSGKQSKKTTPSNKRNASKASTNKTSGQKKQHNKKSSQGAKKQSSSSKSTQKNNQTSNKNSKTTNAKSSNASKTPNAKVEKAKSKIEKRTFND

SEQ ID NO: 905 - DNA, 1089 bp, Staphylococcus aureus
atgagtaataaattagaatcatacagaagtgagattgtatcactgaatcatcaaattttagacttattatctaaacgtggtgaactagcacaaaaaattggggaagaaaaattaaaacaaggtacacgtatttatgatccacaacgtgaaaaagaaatgcttaacgacttaatcgatagtaacaaaggaccattcaacgataatactattaagcaattatttaaagaaattttcaaagcctctacagatttacaaaaatctgaaaatgaaaaacatttatatgtatcacgtaagttgaaacctgaagatacgattgtaacatttgataatgggggcattataggagacggcaataaatcatttgtatttgggccatgttcagttgaatcatttgaacaagttgaagctgttgctaaaaacttacatgctaaaggtgaaaaatttattcgtggcggtgcatttaaaccacgtacatcaccatatgatttccaaggcctaggtgttgaaggacttaaaatacttaaacagattaaagataaatatgatttaaatgttgtcagcgaaatcgtaaatccaaatgattttgaagtggctgatgagtatttagacgtattccaaattggtgcacgtaatatgcaaaacttcgagttattaaaagaagctggccgtacgaaaaagcctattctattaaaacgtggtttatctgctacaatcgaagagtttgtttatgcagctgaatacattgcttcacaaggtaatcaaaacattattttatgtgaacgtggaatccgaacttatgaaaaggcgacacgtaacactttagatatttcagcagtaccaattttaaaacaaggtacacacttaccagtcatggtagatgttacgcatagtacaggtcgtaaagatatcatgttaccaactgcgaaagcagcattagcagttggtgctgatggagttatggctgaggtgcatccagatccatctgttgcacttagtgatgcgggtcaacaaatggatttagatgaattccaagcattttatgatgaattaaagcctttagctgatttatataacgctaaaaagttaaaa

SEQ ID NO: 906 - protein, 363 aa, Staphylococcus aureus
  MISC_FEATURE (1)..(363): chorismate mutase homolog
MSNKLESYRSEIVSLNHQILDLLSKRGELAQKIGEEKLKQGTRIYDPQREKEMLNDLIDSNKGPFNDNTIKQLFKEIFKASTDLQKSENEKHLYVSRKLKPEDTIVTFDNGGIIGDGNKSFVFGPCSVESFEQVEAVAKNLHAKGEKFIRGGAFKPRTSPYDFQGLGVEGLKILKQIKDKYDLNVVSEIVNPNDFEVADEYLDVFQIGARNMQNFELLKEAGRTKKPILLKRGLSATIEEFVYAAEYIASQGNQNIILCERGIRTYEKATRNTLDISAVPILKQGTHLPVMVDVTHSTGRKDIMLPTAKAALAVGADGVMAEVHPDPSVALSDAGQQMDLDEFQAFYDELKPLADLYNAKKLK

SEQ ID NO: 907 - DNA, 111 bp, Staphylococcus aureus
atgaaaaaagtttatataaaattaaaatatatcgttcgttatcatttagcgtttgtttttatttcaagcttttcgctaaatttttccaaacaaaaatatgttactgtaaat

SEQ ID NO: 908 - protein, 37 aa, Staphylococcus aureus
MKKVYIKLKYIVRYHLAFVFISSFSLNFSKQKYVTVN

SEQ ID NO: 909 - DNA, 987 bp, Staphylococcus aureus
atgacagttactatatatgatgtagcaagagaagcgcgtgtctctatggccacagtgtcgcgtgttgttaatgggaaccaaaatgttaaagcagaaactaaaaataaagttaacgaagtcattaagcgtttgaattatcgtccaaatgctgttgctagaggtttagctagtaaaaagacaacaacagtaggtgtgatcattccagatatatctaatatctattattcacaacttgctcgtggacttgaagatattgcaacaatgtataaatatcactcaattatttcaaattcagataacgatcctgaaaaggaaaaagaaatttttaataacttattaagtaaacaggttgatggtattattttccttggtggtacaattactgaagaaatgaaagaattgataaatcaatcatctgtacctgtagtagtatcaggaacaaatggtaaggatgcacatatagcatcagttaatattgattttactgaagctgcgaaagaaattacgggagaattaattgaaaaaggcgctaaatcatttgctttagtaggtggagaacattctaaaaaagctcaagaagatgttttagaaggtttaactgaagtgttaaataaaaatggccttcaattaggtgatacattgaattgttctggtgctgaaagttataaagaaggcgtaaaagcttttgccaaaatgaaaggcaatttgccagatgccattttatgtatcagcgacgaagaagcaattggtattatgcatagtgcaatggatgctggtattaaagttccagaggaattacaaattattagtttcaataatacacgattagttgagatggttagaccacaactttctagtgttattcaaccattatatgatatcggtgcagtagggatgcgcttattaacaaaatatatgaacgatgaaaagatagaagaaccaaatgtagttttacctcacagaattgaataccgaggaactacaaaa

SEQ ID NO: 910 - protein, 329 aa, Staphylococcus aureus
  MISC_FEATURE (1)..(329): catabolite control protein
MTVTIYDVAREARVSMATVSRVVNGNQNVKAETKNKVNEVIKRLNYRPNAVARGLASKKTTTVGVIIPDISNIYYSQLARGLEDIATMYKYHSIISNSDNDPEKEKEIFNNLLSKQVDGIIFLGGTITEEMKELINQSSVPVVVSGTNGKDAHIASVNIDFTEAAKEITGELIEKGAKSFALVGGEHSKKAQEDVLEGLTEVLNKNGLQLGDTLNCSGAESYKEGVKAFAKMKGNLPDAILCISDEEAIGIMHSAMDAGIKVPEELQIISFNNTRLVEMVRPQLSSVIQPLYDIGAVGMRLLTKYMNDEKIEEPNVVLPHRIEYRGTTK

SEQ ID NO: 911 - DNA, 243 bp, Staphylococcus aureus
atgccattaattggtaaaattttcggatcagttgattttgctaaagaatggtcattctggggtattaaatacggtttatttatccaatctgttatcgactttattatcatcgcgtttgctttattcatctttgttaagattgcaaatacattaatgaagaaagaagaagccgaagaagaagcagttgtggaagaaaatgttgtgttattaactgaaatcagagatttattacgtgagaaaaaa

SEQ ID NO: 912 - protein, 81 aa, Staphylococcus aureus
  MISC_FEATURE (1)..(81): large-conductance
MPLIGKIFGSVDFAKEWSFWGIKYGLFIQSVIDFIIIAFALFIFVKIANTLMKKEEAEEEAVVEENVVLLTEIRDLLREKK

SEQ ID NO: 913 - DNA, 1188 bp, Staphylococcus aureus
ttggaatatcggagggattatatgcaacaacattcatcaaaaactgcatatgtttattcagataagttattacaatatcgatttcatgaccaacatcccttcaatcaaatgcgtttaaaattaacaacagagctacttttgaatgcaaatttattgtctccagaacaaatagtacaacctagaattgcaacagatgacgaattaatgttaattcataaatatgattacgtcgaagctattaagcatgcttcacatggcattatcagtgaagatgaggctaagaaatatggattaaatgatgaagagaatggtcaatttaagcatatgcaccgccatagtgccacaattgttggaggcgctttaactttagcagatcttattatgtcaggcaaagtattaaatggttgtcacttaggtggtggtttgcatcacgctcaacctggtcgagcaagtggtttttgtatatacaatgatattgcaattaccgcacaatacttagctaaagaatacaatcaacgcgttttaatcatagataccgatgcacatcatggagatggtacacaatggagtttctatgccgataaccatgttactacttattctatccatgaaaccggaaaatttcttttcccaggctctggtcactatactgagcgcggtgaagatatcggctatggacacactgtaaatgtcccacttgaaccgtatacagaagatgcatcatttttggagtgttttaaattaacagttgagcctgtcgtaaagagttttaaacctgatattattctaagcgtaaatggtgtcgatatacattatcgtgatccactaactcatctaaattgtacgttacattcattatatgaaattccatattttgtaaaatatttagctgattcttatacgaatggaaaggtaattatgtttggtggcggaggctacaatatttggagagtcgtaccacgtgcatggagtcatgtattcttaagtttaattgatcaaccaattcaaagtggttatttaccgttagaatggattaataaatggaaacattattcatctgaattattacctaaaagatgggaagatcgtttaaatgattatacctatgtcccccgcacaaaagaaattagtgaaaaaaataaaaaattagctttacatatagcgagttggtacgaatctactcgtcaa

SEQ ID NO: 914 - protein, 396 aa, Staphylococcus aureus
  MISC_FEATURE (1)..(396): acetoin utilization protein
LEYRRDYMQQHSSKTAYVYSDKLLQYRFHDQHPFNQMRLKLTTELLLNANLLSPEQIVQPRIATDDELMLIHKYDYVEAIKHASHGIISEDEAKKYGLNDEENGQFKHMHRHSATIVGGALTLADLIMSGKVLNGCHLGGGLHHAQPGRASGFCIYNDIAITAQYLAKEYNQRVLIIDTDAHHGDGTQWSFYADNHVTTYSIHETGKFLFPGSGHYTERGEDIGYGHTVNVPLEPYTEDASFLECFKLTVEPVVKSFKPDIILSVNGVDIHYRDPLTHLNCTLHSLYEIPYFVKYLADSYTNGKVIMFGGGGYNIWRVVPRAWSHVFLSLIDQPIQSGYLPLEWINKWKHYSSELLPKRWEDRLNDYTYVPRTKEISEKNKKLALHIASWYESTRQ

SEQ ID NO: 915 - DNA, 630 bp, Staphylococcus aureus
atgaatcatttaaagacgtatcaatccgaagattattacattcatgacaagcaatttgttattgaaggtcctttaacacacgaagatttgaaagcgcttactttcgatgcgcatttaaccgcatttagagatgctgaagatcagtataaagctttgttagaaattacaacattaccagaaggtagaatttatgttgctcgccaagatcaactcattgtgggttatgtcactttccactatcctgatgaaattgagcgctggtctacaggtaagcttccatatttaatcgaattgggggcaattgaagtcagcatcaattttaggcaattacaacttgcagaaaagctgatacaacttagcctttctacaccagaattcgagaattatatcgttataactacagaatattactggcattgggatttaaaaaattcaaagttagatgtatttgactataaaaaattaatgcagcggttaatggcaactggtggacttgaaatattcgctacagatgatccagaaataacaagtcatccagctaattgtttaatggcaagaattggcaaaaacattacattagaacagcaacaagcgtttgatgatattcgttatatgaatcggtttttcttt

SEQ ID NO: 916 - protein, 210 aa, Staphylococcus aureus
  MISC_FEATURE (1)..(210): acetoin dehydrogenase
MNHLKTYQSEDYYIHDKQFVIEGPLTHEDLKALTFDAHLTAFRDAEDQYKALLEITTLPEGRIYVARQDQLIVGYVTFHYPDEIERWSTGKLPYLIELGAIEVSINFRQLQLAEKLIQLSLSTPEFENYIVITTEYYWHWDLKNSKLDVFDYKKLMQRLMATGGLEIFATDDPEITSHPANCLMARIGKNITLEQQQAFDDIRYMNRFFF

SEQ ID NO: 917 - DNA, 1704 bp, Staphylococcus aureus
atgaaagtcgaagtttataaaggagcgcaaggtaaacataaccttaaagattatgaagaaacatataatacttttgattggaaagacgtagaacaagcattttcttggagtgaaactggaaaaatgaacatggcatatgaatgcatagatcgccatgtagatcaaggattaggggataaaatagcgttaaattacaaagatgagcacagaaaagaatcgtatacttataaagatatgcaacggttatctaataaagcagcgaatgttttgtctgaacatgcagaagttgacaaaggtgacagagtatttatatttatgtcgcgtacacctgaactatattttgcgttgttaggtgttttaaaaattggtgcaattgttgggccgttatttgaagcatttatggaaaaggcagttgcggatagattagagaacagtgaagctaaagtgttaattactaataaggcattgttacctcgagtacctgtagataaattaccaaacttgaaaaaaattgttgtcgtagatgaggatgtagaagacaattacatagacttcattagtttgatggaaactgctagcgatgaatttgacattgaatggttaaagtcggatgatggtttgattttacattatacatcaggttctactgggcaacctaaaggtgtattgcatgttcaacaagcaatgttagtgcactatatttctggaaaatatgtattagatttacaagaagatgatgtttattggtgtacagcagatccaggttgggttacaggaacatcttatggtatttttgcaccatggttaaatggcgctacaaattgtatagctggtggtcgcttttcgccagaacagtggtatagtatgattgaagattttaaagtgacgatttggtatacggcaccaacagctttaagaatgttaatgagtgctggtgacgatattgttgagaaatatgacttgtcatcgttacgttcgattctatcagtaggtgagcctttaaatcctgaagttataaaatgggcgaaaaaagtatacggtttaacggtgttagatacttggtggatgacagaaacaggtggacatatgattgttaactatccaacgatggacgtcaagcttggctcaatgggcaaaccattacctggtattcaagctgcaattatcgatgatgcagggaatgaattaccaccaaatcgaatgggcaaccttgctataaaaaaaggctggccatcaatgatgtatcgtatctggaagaatccagaaaaatataaatcatattttattggagactggtatgtatctggtgattcggcatataaagatgaagatggttacttctggttccaaggacgtgttgatgatgtaattatgacagctggtgaacgagttggaccatttgaggttgagtctaaattggttgaacacgaagcagttgccgaagcaggaattattggtaaacctgatccggttcgcggtgaaataattaaggcgtttgttgcactgagaaaaggatatgaaccaacagacgaattaaaagaagaaattcgtatatttgttaaagaaggtttgtcggcacatgcagcaccacgtgaaatcgaatttaaagataaattacctaaaacacggtcaggtaaaattatgagacgtgtattaaaagcttgggaattaaatttagatgctggggatttaagtacaatggaa

SEQ ID NO: 918 - protein, 568 aa, Staphylococcus aureus
  MISC_FEATURE (1)..(568): acetyl-CoA synthetase
MKVEVYKGAQGKHNLKDYEETYNTFDWKDVEQAFSWSETGKMNMAYECIDRHVDQGLGDKIALNYKDEHRKESYTYKDMQRLSNKAANVLSEHAEVDKGDRVFIFMSRTPELYFALLGVLKIGAIVGPLFEAFMEKAVADRLENSEAKVLITNKALLPRVPVDKLPNLKKIVVVDEDVEDNYIDFISLMETASDEFDIEWLKSDDGLILHYTSGSTGQPKGVLHVQQAMLVHYISGKYVLDLQEDDVYWCTADPGWVTGTSYGIFAPWLNGATNCIAGGRFSPEQWYSMIEDFKVTIWYTAPTALRMLMSAGDDIVEKYDLSSLRSILSVGEPLNPEVIKWAKKVYGLTVLDTWWMTETGGHMIVNYPTMDVKLGSMGKPLPGIQAAIIDDAGNELPPNRMGNLAIKKGWPSMMYRIWKNPEKYKSYFIGDWYVSGDSAYKDEDGYFWFQGRVDDVIMTAGERVGPFEVESKLVEHEAVAEAGIIGKPDPVRGEIIKAFVALRKGYEPTDELKEEIRIFVKEGLSAHAAPREIEFKDKLPKTRSGKIMRRVLKAWELNLDAGDLSTME

SEQ ID NO: 919 - DNA, 1698 bp, Staphylococcus aureus
atgcataaattaaacaaaaaggggcgaaaaaagttgactcatttatcagatttagatattgcgaatcaatcaacactacaaccaattaaggatattgctgcatcagtaggtatttcagaggatgcattagaaccttatggtcattacaaagctaaaatcgacattaataaaattacgccaagagaaaacaaagggaaagttgttttagtaactgcgatgagcccaacaccagctggtgaaggtaaatcaacggttacagttggtttagctgatgcattccatgagttaaataaaaacgttatggttgcattaagagagcctgctttaggaccaacatttggtatcaaaggtggtgcgactggtggtggttatgcgcaagtcttacctatggaagatatcaacttacatttcaacggagatttccatgcgattacaactgcaaataatgcattgtctgcgtttatcgataatcatattcaccaaggtaacgaattaggaatcgatcaaagacgtattgagtggaaacgtgtattagatatgaatgatcgtgcacttagacatgtaaacgttgggttaggtggacctacaaatggtgtaccacgtgaagatggctttaatattacagtagcgtctgaaattatggcgattttatgtttaagtagaagtattaaagacttaaaagataaaattagtcgtattactattggttacactagagatcgcaagccagttacagttgcagatttaaaagtggaaggtgcacttgcaatgattttaaaagatgcaataaaaccaaacttagtacaatcaattgaagggacacctgcattagttcatggtggaccatttgcgaatatcgcacacggttgtaactcaattttagcaactgaaacagcacgtgatttagctgatatcgttgtaacggaagctggatttggttcagacttaggcgctgaaaaattcatggacattaaagcgcgtgaagcaggatttgatccggcagctgtcgttgttgttgcgacaattcgtgcgttaaaaatgcatggtggtgtagcgaaagataatttaaaagaagaaaatgtagaagcagtaaaagcaggaattgttaatttagagcgtcatgttaataatattaaaaaattcggtgtagaaccggttgttgcaattaatgcatttatacatgataccgatgcagaagtagaatatgtaaaatcttgggctaaagaaaataacgtacgaattgccttaactgaagtttgggaaaaaggtggtaaaggtggcgttgacttagcaaatgaagtattagaagtcattgatcaacctaattcatttaaacctttatatgaattagaattaccattagagcaaaagattgaaaagattgtgactgaaatctatggcggttcaaaagtaacgtttagcagtaaagcgcaaaaacaattaaaacaatttaaagaaaatggttgggataattacccagtatgtatggcgaaaacacaatattcattctcagatgatcaaacgttgttaggtgcaccatcaggatttgaaattacaattcgtgaattagaagcgaaaacaggtgcaggatttatcgtagcgttgacaggtgcaatcatgactatgcctggtttacctaaaaaaccagcagcattaaacatggatgttactgatgatggtcatgcaattgggttattc

SEQ ID NO: 920 - protein, 566 aa, Staphylococcus aureus
  MISC_FEATURE (1)..(566): formyltetrahydrofolate
MHKLNKKGRKKLTHLSDLDIANQSTLQPIKDIAASVGISEDALEPYGHYKAKIDINKITPRENKGKVVLVTAMSPTPAGEGKSTVTVGLADAFHELNKNVMVALREPALGPTFGIKGGATGGGYAQVLPMEDINLHFNGDFHAITTANNALSAFIDNHIHQGNELGIDQRRIEWKRVLDMNDRALRHVNVGLGGPTNGVPREDGFNITVASEIMAILCLSRSIKDLKDKISRITIGYTRDRKPVTVADLKVEGALAMILKDAIKPNLVQSIEGTPALVHGGPFANIAHGCNSILATETARDLADIVVTEAGFGSDLGAEKFMDIKAREAGFDPAAVVVVATIRALKMHGGVAKDNLKEENVEAVKAGIVNLERHVNNIKKFGVEPVVAINAFIHDTDAEVEYVKSWAKENNVRIALTEVWEKGGKGGVDLANEVLEVIDQPNSFKPLYELELPLEQKIEKIVTEIYGGSKVTFSSKAQKQLKQFKENGWDNYPVCMAKTQYSFSDDQTLLGAPSGFEITIRELEAKTGAGFIVALTGAIMTMPGLPKKPAALNMDVTDDGHAIGLF

SEQ ID NO: 921 - DNA, 2685 bp, Staphylococcus aureus
atgaacaaacatcacccaaaattaaggtctttctattctattagaaaatcaactctaggcgttgcatcggtcattgtcagtacactatttttaattacttctcaacatcaagcacaagcagcagaaaatacaaatacttcagataaaatctcggaaaatcaaaataataatgcaactacaactcagccacctaaggatacaaatcaaacacaacctgctacgcaaccagcaaacactgcgaaaaactatcctgcagcggatgaatcacttaaagatgcaattaaagatcctgcattagaaaataaagaacatgatataggtccaagagaacaagtcaatttccagttattagataaaaacaatgaaacgcagtactatcactttttcagcatcaaagatccagcagatgtgtattacactaaaaagaaagcagaagttgaattagacatcaatactgcttcaacatggaagaagtttgaagtctatgaaaacaatcaaaaattgccagtgagacttgtatcatatagtcctgtaccagaagaccatgcctatattcgattcccagtttcagatggcacacaagaattgaaaattgtttcttcgactcaaattgatgatggagaagaaacaaattatgattatactaaattagtatttgctaaacctatttataacgatccttcacttgtaaaatcagatacaaatgatgcagtagtaacgaatgatcaatcaagttcagtcgcaagtaatcaaacaaacacgaatacatctaatcaaaatatatcaacgatcaacaatgctaataatcaaccgcaggcaacgaccaatatgagtcaacctgcacaaccaaaatcgtcaacgaatgcagatcaagcgtcaagccaaccagctcatgaaacaaattctaatggtaatactaacgataaaacgaatgagtcaagtaatcagtcggatgttaatcaacagtatccaccagcagatgaatcactacaagatgcaattaaaaacccggctatcatcgataaagaacatacagctgataattggcgaccaattgattttcaaatgaaaaatgataaaggtgaaagacagttctatcattatgctagtactgttgaaccagcaactgtcatttttacaaaaacaggaccaataattgaattaggtttaaagacagcttcaacatggaagaaatttgaagtttatgaaggtgacaaaaagttaccagtcgaattagtatcatatgattctgataaagattatgcctatattcgtttcccagtatctaatggtacgagagaagttaaaattgtgtcatctattgaatatggtgagaacatccatgaagactatgattatacgctaatggtctttgcacagcctattactaataacccagacgactatgtggatgaagaaacatacaatttacaaaaattattagctccgtatcacaaagctaaaacgttagaaagacaagtttatgaattagaaaaattacaagagaaattgccagaaaaatataaggcggaatataaaaagaaattagatcaaactagagtagagttagctgatcaagttaaatcagcagtgacggaatttgaaaatgttacacctacaaatgatcaattaacagatttacaagaagcgcattttgttgtttttgaaagtgaagaaaatagtgagtcagttatggacggctttgttgaacatccattctatacagcaactttaaatggtcaaaaatatgtagtgatgaaaacaaaggatgacagttactggaaagatttaattgtagaaggtaaacgtgtcactactgtttctaaagatcctaaaaataattctagaacgctgattttcccatatatacctgacaaagcagtttacaatgcgattgttaaagtcgttgtggcaaacattggttatgaaggtcaatatcatgtcagaattataaatcaggatatcaatacaaaagatgatgatacatcacaaaataacacgagtgaaccgctaaatgtacaaacaggacaagaaggtaaggttgctgatacagatgtagctgaaaatagcagcactgcaacaaatcctaaagatgcgtctgataaagcagatgtgatagaaccagagtctgacgtggttaaagatgctgataataatattgataaagatgtgcaacatgatgttgatcatttatccgatatgtcggataataatcacttcgataaatatgatttaaaagaaatggatactcaaattgccaaagatactgatagaaatgtggataaagatgccgataatagcgttggtatgtcatctaatgtcgatactgataaagactctaataaaaataaagacaaagtcatacagctgaatcatattgccgataaaaataatcatactggaaaagcagcaaagcttgacgtagtgaaacaaaattataataatacagacaaagttactgacaaaaaaacaactgaacatctgccgagtgatattcataaaactgtagataaaacagtgaaaacaaaagaaaaagccggcacaccatcgaaagaaaacaaacttagtcaatctaaaatgctaccaaaaactggagaaacaacttcaagccaatcatggtggggcttatatgcgttattaggtatgttagctttattcattcctaaattcagaaaagaatctaaa

SEQ ID NO: 922 - protein, 895 aa, Staphylococcus aureus
  MISC_FEATURE (1)..(895): hypothetical protein
MNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNISTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLPKTGETTSSQSWWGLYALLGMLALFIPKFRKESK

SEQ ID NO: 923 - DNA, 90 bp, Staphylococcus aureus
ttgaaaataatcttactgctgtttttaatatttggattcattgttgtggttactttaaaaagtgagcatcaattaacgcttttttcgatt

SEQ ID NO: 924 - protein, 30 aa, Staphylococcus aureus
LKIILLLFLIFGFIVVVTLKSEHQLTLFSI

SEQ ID NO: 925 - DNA, 903 bp, Staphylococcus aureus
atgacgaatcaagacaacaatcatcaattgaatcatcgtatatatcattttgaaaagatatataaagctatcaaacatgtcattgtttttatatttatgattttcattgccatcgttgctatcgctgtgattgcgatgtctttatattttcatcatttaactaaaacgtccgactcattatcagatgatgctttaataaaaaaagttcgacaaatacctggcgatgaattattagatcataataacaaaaatttattatatgagtataaccattctcaaaactcactcattataggccctaaaacatcaagtccaaatgtcattaaagcattaacgtcatctgaagacactttattttataaacatgatggcatcttaccaaaggcgattttaagagcaatgatacaagatatttttaatactgatcaaagttcaggtggtagcacaattacacaacaacttgttaaaaatcaagttcttaccaacgaaaaaacatatagtagaaaagcaaatgaacttcgcctagcaattagattagaacacctactctcaaaagatgaaattatatatacatatttaaatatagttcccttcggtagagattataatggcgctaatatttccggaattgcatccgcttcatatagtctatttggtattccaccaaaagatttatcaattgcacaatctgcataccttatcggtttgttgcaaagcccatatggctatacaccctacgaaaaagatggaacgttaaaatcggataaagatttgaaatatagtattcaaagacaacattatgtattaaagcgtatgttaatcgaagatcaaatcactgaaaaagaatacaacgacgcattaaaatatgatattaaatcacatttgttaaatcgaaaaaagcgt

SEQ ID NO: 926 - protein, 301 aa, Staphylococcus aureus
  MISC_FEATURE (1)..(301): probable transglycosylase
MTNQDNNHQLNHRIYHFEKIYKAIKHVIVFIFMIFIAIVAIAVIAMSLYFHHLTKTSDSLSDDALIKKVRQIPGDELLDHNNKNLLYEYNHSQNSLIIGPKTSSPNVIKALTSSEDTLFYKHDGILPKAILRAMIQDIFNTDQSSGGSTITQQLVKNQVLTNEKTYSRKANELRLAIRLEHLLSKDEIIYTYLNIVPFGRDYNGANISGIASASYSLFGIPPKDLSIAQSAYLIGLLQSPYGYTPYEKDGTLKSDKDLKYSIQRQHYVLKRMLIEDQITEKEYNDALKYDIKSHLLNRKKR

SEQ ID NO: 927 - DNA, 1260 bp, Staphylococcus aureus
atgacgaatgtattaattgaagatttaaaatggagaggtcttatttatcaacaaactgatgaacaaggtattgaagatttattaaataaagaacaagtgacgttatactgcggtgccgatccaacggcagatagtttacatattggtcacttactaccattcttaacattaagacgttttcaagaacatggacatcgtcctatcgttttaattggcggtggtacaggtatgattggtgatccatcaggtaaatcagaagaacgtgtgctacaaacagaagaacaagtagataaaaatatcgaaggtattagtaagcaaatgcacaatatttttgaatttggaacagaccatggtgcagtgcttgttaataatagagactggttaggacaaatctcattaattagttttttacgtgactatggtaaacacgtcggcgttaattacatgttaggtaaagattcaatccaaagtcgtttagaacatggtatttcatatacagaattcacatacacgattttacaagctattgatttcggtcatttgaatagagaattgaattgtaagattcaagtaggtggatcagatcaatggggtaatatcacaagtggtattgaattaatgcgtcgtatgtatggtcaaacagacgcatacggtttaactattccgcttgtaactaaatcagatggtaagaaatttggtaagtctgagtcaggtgctgtttggttagatgctgaaaaaacaagtccttatgaattttatcaattctggattaatcaatcagacgaagatgtaattaaattcttaaaatactttactttcttaggaaaagaagaaattgatcgcttagaacaatctaaaaatgaagcaccgcatttacgtgaagctcaaaaaacattagctgaagaagtaactaaatttattcatggtgaagatgcattaaatgatgcaatccgtatttcacaagcattatttagtggtgatttaaaatcattatcagcgaaagaattaaaagatggatttaaagatgtgcctcaagtgacattatcaaatgacacaacaaatatcgttgaagtccttattgaaacaggcatttctccttctaaacgacaagcacgtgaagatgttaacaatggtgcgatttatattaatggtgagagacaacaagatgttaattatgctttagcaccagaagataaaattgatggcgaatttacgattattcgtcgcggtaagaaaaaatacttcatggttaactatcaa

SEQ ID NO: 928 - protein, 420 aa, Staphylococcus aureus
  MISC_FEATURE (1)..(420): tyrosyl-tRNA synthetase
MTNVLIEDLKWRGLIYQQTDEQGIEDLLNKEQVTLYCGADPTADSLHIGHLLPFLTLRRFQEHGHRPIVLIGGGTGMIGDPSGKSEERVLQTEEQVDKNIEGISKQMHNIFEFGTDHGAVLVNNRDWLGQISLISFLRDYGKHVGVNYMLGKDSIQSRLEHGISYTEFTYTILQAIDFGHLNRELNCKIQVGGSDQWGNITSGIELMRRMYGQTDAYGLTIPLVTKSDGKKFGKSESGAVWLDAEKTSPYEFYQFWINQSDEDVIKFLKYFTFLGKEEIDRLEQSKNEAPHLREAQKTLAEEVTKFIHGEDALNDAIRISQALFSGDLKSLSAKELKDGFKDVPQVTLSNDTTNIVEVLIETGISPSKRQAREDVNNGAIYINGERQQDVNYALAPEDKIDGEFTIIRRGKKKYFMVNYQ

SEQ ID NO: 929 - DNA, 1272 bp, Staphylococcus aureus
atgtcagattttaatcatacagatcattctacaacaaaccatagccaaacacctagatacagaagacctaaatttccatggtttaaaacagtcatcgttgcattgattgctggaattattggtgcacttctagtacttggtataggcaaagtattaaatagtacaattttaaataaagatggttcaactgttcagacaacaaataataaaggtggcaatcaattagacggtcaaagcaagaaattcggtaccgttcatgaaatgataaaatctgtctcccctacaattgttggagttattaacatgcaaaaagcatcaagtgtagacgacttattaaaaggcaaatcatctaaaccatctgaagctggagtaggttcaggtgttatctatcaaataaacaacaattcagcttatatcgttacaaacaatcatgttattgatggcgcaaatgaaattagagtccaattacataataaaaaacaagttaaagcgaaattagttggtaaagatgcagtaactgatattgctgtacttaaaattgaaaatacaaaaggtattaaagcgattcaatttgccaactcttcaaaagtacaaactggcgatagcgtattcgcaatgggtaacccattaggattacaatttgctaactctgtaacatctggtatcatttcagcaagcgaacgtacgattgacgctgagacaactggtggcaatacaaaagttagcgttcttcaaacagatgctgctattaacccaggtaactcaggtggcgcattagtagatattaatggtaatttagttggtattaactcaatgaaaattgctgcgacacaagttgaaggtatcgggtttgctattccaagtaatgaagttaaagtaacaattgaacaacttgtaaaacatggtaaaattgaccgcccttcgattggtattggtttaattaatttgaaagatattcctgaagaagagcgcgagcaacttcatactgatagagaagacggtatttatgtcgccaaagctgatagtgatattgatcttaaaaaaggtgatattattacagaaattgatggcaagaaaattaaagatgatgttgatttaagaagctatttatatgaaaataaaaaacctggtgaatcagtcactgttaccgttatccgtgatggtaaaacaaaagaagttaaagtgaaattaaaacaacaaaaagaacaaccaaaacgtcaaagccgatcagaacgtcaatcacctggccaaggcgatagagatttctttaga

SEQ ID NO: 930 - protein, 424 aa, Staphylococcus aureus
  MISC_FEATURE (1)..(424): hypothetical protein
MSDFNHTDHSTTNHSQTPRYRRPKFPWFKTVIVALIAGIIGALLVLGIGKVLNSTILNKDGSTVQTTNNKGGNQLDGQSKKFGTVHEMIKSVSPTIVGVINMQKASSVDDLLKGKSSKPSEAGVGSGVIYQINNNSAYIVTNNHVIDGANEIRVQLHNKKQVKAKLVGKDAVTDIAVLKIENTKGIKAIQFANSSKVQTGDSVFAMGNPLGLQFANSVTSGIISASERTIDAETTGGNTKVSVLQTDAAINPGNSGGALVDINGNLVGINSMKIAATQVEGIGFAIPSNEVKVTIEQLVKHGKIDRPSIGIGLINLKDIPEEEREQLHTDREDGIYVAKADSDIDLKKGDIITEIDGKKIKDDVDLRSYLYENKKPGESVTVTVIRDGKTKEVKVKLKQQKEQPKRQSRSERQSPGQGDRDFFR

SEQ ID NO: 931 - DNA, 615 bp, Staphylococcus aureus
atgtattcagtgattagtaagattttgaatttcattttagttaaaatgtcaaaatcattatacgtaatcggtaaagataatattcctaaggatagtaaatatgtcgtaacttgtacgcatgaaagttataacgaagtcattatgctaggtatggcattatatcctaatcaaattcattatatggctaaaaaagaattattcaaaaataaatggattggtaaatttttaacgtctttaaatgcatttcctgtagatcgtgaaaatccaggacctagtactttaaaacgcccaatcaatttgttgaaagataataagacagttggtatcttcccaacaggttctcgcacatcgcaagaaggtgcacctttgaaacgtggtgcttcaacaattgcaatgttaagtaagtcaccaatattacctgttgcttatgttggtcctactaagattcacggtcttttaacaggacaagcatacataaatattggcaaaccaatcgatattaacgatttacctaaagatttaaaacgaaacgagcgtatcgattatattacaaaagagattgaaacacgaacagcaaagttacaacaagaattgcatgaaattgtaaaaagttta

SEQ ID NO: 932 - protein, 205 aa, Staphylococcus aureus
  MISC_FEATURE (1)..(205): hypothetical protein
MYSVISKILNFILVKMSKSLYVIGKDNIPKDSKYVVTCTHESYNEVIMLGMALYPNQIHYMAKKELFKNKWIGKFLTSLNAFPVDRENPGPSTLKRPINLLKDNKTVGIFPTGSRTSQEGAPLKRGASTIAMLSKSPILPVAYVGPTKIHGLLTGQAYINIGKPIDINDLPKDLKRNERIDYITKEIETRTAKLQQELHEIVKSL

SEQ ID NO: 933 - DNA, 1464 bp, Staphylococcus aureus
atgtataaatttttccaaaatttagggcgttcgttaatgttaccagttgccattttaccggctgcagcaattattgccggaattggtaatacgttaaatgcacttcatgcgacgccgaaaatcgcaatgttctttactacggtaggtactacgattttagagcaattaggtattttatttgcaattggtgtagctataggaatggcaaagaaaaatgatggtgcagtcgcgcttgcagctacgttaggatattttttagttacagttgtattatcaccaatgaaattagcgcctttattaggaatgaaagcttcggaaataaattcagcttttgaaaagatgaataatggcaatgtctttgttggtattgtaataggtttaatagcagcttatgcatacaataagtttagtgaaacagaattaccattagcattatcattttttagtggtaaacgtctagttccaattatgactgcattttactgtacatttttagttgtcatattgttattcttatggccactactttattcatggattgtaaaatttggtgaatctatagtcggtttaggatcgtttggagctttcatatatggtgttgccaatagattattaattcctacaggattacatcatgcactgaatagtgtgttctggtttgatacgattggtattaatgatattggtaaattccaaagtggcaaagatgctataaaaggtattacaggacgctatcaagcgggattcttcccaatcatgatgttcggtattccagcggctgcgttagcaatgtatcatacagctaaaactactcagaaaaaacaagtttacggttggttcctagcgagttcagttgcagcatttttcgttggtgttacagagccgattgagtttgcatttatgtttgttgtgccaatcttatatgttgttcatgcgttattaacaggattatctttatttatcgcagctacattccattggacagctggattttcatttagtgcaggtttgatagattatgtgttatcactaattaatccagtatcaaatcatccattgatgttgcttgttcaaggtgttgtatttttcatcttatactatgtgattttccgtgtagtaatccaagtatttaacttgaatacgattggtagaggtgaaaatgaattagttgacccaacagttgtaaaagataatattgctcctggtgaaaatgatattaaacaaagtaaatatcatcaacatgctatacaaatattagaaggtttaggcggtcaagagaatattgttaatttaaccaattgtgcaacaaggttgcgtctagagttaaaagacacatctattattgataaacagaagattaaaaacgccggtgcagttggtgttactgttaatggcaaacattcaactcaagttattgtcggtacacacgtacagcaggttgctgatgaaattgaaaaacattta

SEQ ID NO: 934 - protein, 488 aa, Staphylococcus aureus
  MISC_FEATURE (1)..(488): PTS system,
MYKFFQNLGRSLMLPVAILPAAAIIAGIGNTLNALHATPKIAMFFTTVGTTILEQLGILFAIGVAIGMAKKNDGAVALAATLGYFLVTVVLSPMKLAPLLGMKASEINSAFEKMNNGNVFVGIVIGLIAAYAYNKFSETELPLALSFFSGKRLVPIMTAFYCTFLVVILLFLWPLLYSWIVKFGESIVGLGSFGAFIYGVANRLLIPTGLHHALNSVFWFDTIGINDIGKFQSGKDAIKGITGRYQAGFFPIMMFGIPAAALAMYHTAKTTQKKQVYGWFLASSVAAFFVGVTEPIEFAFMFVVPILYVVHALLTGLSLFIAATFHWTAGFSFSAGLIDYVLSLINPVSNHPLMLLVQGVVFFILYYVIFRVVIQVFNLNTIGRGENELVDPTVVKDNIAPGENDIKQSKYHQHAIQILEGLGGQENIVNLTNCATRLRLELKDTSIIDKQKIKNAGAVGVTVNGKHSTQVIVGTHVQQVADEIEKHL

SEQ ID NO: 935 - DNA, 1137 bp, Staphylococcus aureus
gtggggattgtgaagaaaattttatttgatgttgatggcgtttttttaagtgaagaacgttgtttcgatgtctctgcattaacggtatatgaattattaatggataagtgttatttaggtcttcattcacatatagattgggaaactttgactgataacgatatacaagacattaggaatcgaatttttcaaaaagataagattttaaacaaattaaaatcgctagggctgaattcaaattgggatatgttatttatcgtttttagtattcatttaattgatattttgaaaaagttatcacatgatgaaattgaggcattcatgtatcaagatgagcctgtcgaattgaagttgcaaaatataagcacaaacttagcagactgttttaatttaaatgaacaactacctttacaatttttggataatgtaaaagttggtaaaaataatatttatgctgctttggaagagtttgcaacaacagagttacatgtttcggatgctactttatttagtttgaagggtgcattatggacgttagcgcaagaagtttatcaagaatggtatttaggatcgaagttgtatgaagatgttgaaaagaaaatagcacgaactacttttaagacaggttatatttatcaagaaattattttgagaccagtagatgaagttaaggtacttctgaatgatttaaaaggtgctggtttcgaattaggtattgcaacaggtcgtccttatactgagactgttgtgccatttgaaaatttaggattgttaccatattttgaagctgattttattgcaacagcaagtgatgttttagaagcagagaatatgtatccgcaagcacgaccattaggaaagccgaatccttttagttatatcgcagctttatatggtaataatcgcgataaatatgaatcttatatcaataagcaagataacattgtaaataaagatgacgtatttatagtaggcgattcgttagctgacttattaagtgctcaaaaaataggtgcaacgtttattggaacattaacaggtttaaaaggtaaggatgctgcaggtgagttagaagcgcatcatgccgactatgttattaatcatttaggtgaacttagaggtgtactagataatttg

SEQ ID NO: 936 - protein, 379 aa, Staphylococcus aureus
  MISC_FEATURE (1)..(379): hypothetical protein
VGIVKKILFDVDGVFLSEERCFDVSALTVYELLMDKCYLGLHSHIDWETLTDNDIQDIRNRIFQKDKILNKLKSLGLNSNWDMLFIVFSIHLIDILKKLSHDEIEAFMYQDEPVELKLQNISTNLADCFNLNEQLPLQFLDNVKVGKNNIYAALEEFATTELHVSDATLFSLKGALWTLAQEVYQEWYLGSKLYEDVEKKIARTTFKTGYIYQEIILRPVDEVKVLLNDLKGAGFELGIATGRPYTETVVPFENLGLLPYFEADFIATASDVLEAENMYPQARPLGKPNPFSYIAALYGNNRDKYESYINKQDNIVNKDDVFIVGDSLADLLSAQKIGATFIGTLTGLKGKDAAGELEAHHADYVINHLGELRGVLDNL

SEQ ID NO: 937 - DNA, 1602 bp, Staphylococcus aureus
atgaagcaatttaatgtactcgttgcagatcccatatcaaaagatggtatcaaagcattattagatcacgaacaattcaatgtagatattcaaactggcttgtccgaagaagcattaatcaaaattataccttcataccatgctttaatcgttcgtagtcaaactacggttactgaaaatatcataaatgctgctgattctttaaaagtaatcgcacgcgccggtgttggtgtagataatattaatattgatgctgcaacattaaaaggtattttagttattaatgccccagatggtaatacgatttcagctactgaacatacactggcaatgttattatcaatggcacgaaatattccgcaagcacaccaatcacttacaaataaagaatggaatcgaaatgcatttaaaggtactgagctttatcataaaacattaggtgtcattggtgctggtagaattggtttaggtgttgctaaacgtgcgcaaagtttcggaatgaaaatactagcttttgacccttacttaacggatgaaaaagcaaaatctttaagcattacgaaggcaacagttgatgagattgcccaacattctgatttcgttacattacatacaccactaacacctaaaacaaaaggcttaattaatgctgtcttttttgccaaagcaaaacctagtttgcaaataatcaatgtggcacgtggtggtattattgatgaaaaggcgctaataaaagcattagacgaaggacaaattagtcgggcagctatcgatgtgtttgaacatgaacctgcaactgactcgcctcttgttgcacatgataaaattattgttacacctcatttgggtgcttcaacagtcgaagctcaagaaaaagtggcaatttctgtttcaaatgaaatcatcgaaattttaattgatggtactgtaacgcatgcagtgaatgcacctaaaatggacttaagcaatatagatgatactgtaaaatcattcatcaatttaagccaaacagttggtgaattagctattcaattaatgtacaatgcaccaagctctattaaaattacgtacggtggcgacttagcctctattgatagtagtttattaacacgtacaattattactcatattttaaaagatgatcttggtcctgaagtcaatattatcaatgctctaatgttgttaaatcaacaacaagtgacattaaatattgaaaataataaagcagagacaggttttagtaactacttagaggtagaactatcaaacgatagcgattccgttaaagttggcgcttctgtctttacaggtttcggtccaagaattgttagaattaataatttttctgtagacttaaagccaaatcaatatcaaattgtgtcatatcataatgatactccaggtatggtaggaaaaactggcgcattgttaggtaaatacaatatcaacattgcatctatgactttaggtagaactgaagcgggcggagatgcgctaatgattttatccgttgatcaacctgtttcaaacaatataattgatgaacttaaacaagttggtgaatacaatcaaattttcacaactgaattgacggtacagtca

SEQ ID NO: 938 - protein, 534 aa, Staphylococcus aureus
  MISC_FEATURE (1)..(534): D-3-phosphoglycerate
MKQFNVLVADPISKDGIKALLDHEQFNVDIQTGLSEEALIKIIPSYHALIVRSQTTVTENIINAADSLKVIARAGVGVDNINIDAATLKGILVINAPDGNTISATEHTLAMLLSMARNIPQAHQSLTNKEWNRNAFKGTELYHKTLGVIGAGRIGLGVAKRAQSFGMKILAFDPYLTDEKAKSLSITKATVDEIAQHSDFVTLHTPLTPKTKGLINAVFFAKAKPSLQIINVARGGIIDEKALIKALDEGQISRAAIDVFEHEPATDSPLVAHDKIIVTPHLGASTVEAQEKVAISVSNEIIEILIDGTVTHAVNAPKMDLSNIDDTVKSFINLSQTVGELAIQLMYNAPSSIKITYGGDLASIDSSLLTRTIITHILKDDLGPEVNIINALMLLNQQQVTLNIENNKAETGFSNYLEVELSNDSDSVKVGASVFTGFGPRIVRINNFSVDLKPNQYQIVSYHNDTPGMVGKTGALLGKYNINIASMTLGRTEAGGDALMILSVDQPVSNNIIDELKQVGEYNQIFTTELTVQS

SEQ ID NO: 939 - DNA, 1158 bp, Staphylococcus aureus
atgtattatcatcaaccgttgttattaacacctggcccaacccctgtacctgatgccattatgagagaaattcaagcacctatggttggtcatcgttctaaagattttgaagacatcgcacaacaagcatttcaaggtctaaagccaatatttgggagtcaaaatgatgtacttattttaacatctagcggtacaagcgtcttggaggctagtatgttgaacattgtaaaccctgaagatcacttcgttgtcattgtttcaggtgcctttggtaaccgatttaaacaaattgcacaaacttattacaaaaatgtgcatatttatgacgtaacatggggagaagctgtagatgtcaaagatttcatcaatttcctttcaactttaaatgttgaagttaaagcagtatttagtcaatattgcgaaacatctacgacagtgctacaccctattcacgagttaggaaatgccattaatcaatttaatagtaatatttattttgtagttgacggcgtaagttgcattggtgctgttgatgttgacattaacaaagataaaattgatgtacttgtttctggtagtcaaaaagcaattatgttacctccaggattagcttttgtagcttatagccaccgtgcaaaagaacatttcaaagaagtaactacgccaaaattttatctagacttaaataaatacatttcgtcacaagctgacaattctacaccgttcacaccaaatgtgtctttatttagaggtgtaaatgcatacgttgaaaccgtaaaagcagaaggtttcaatcacgtaatagcacgacactatgcaattagaaatgcattaagaagcgccttaaaagcattagatttaactttattagtcaatgataaagatgcatctccaacggttacagcattcaaacctaatacaaatgatgaagtgaaaataatcaaagatgaacttaaaaatcgctttaaaataacaattgctggtggtcaaggccatcttaaaggtcaaattttaagaattggtcatatggggaaaattagtcctttcgatattttatcggtagtatctgctttagaaattattttaactgaacaccgtaaagttaactatatcggtaaaggtatatcaaaatatatggaggttattcatgaagcaatt

SEQ ID NO: 940 - protein, 386 aa, Staphylococcus aureus
  MISC_FEATURE (1)..(386): hypothetical protein
MYYHQPLLLTPGPTPVPDAIMREIQAPMVGHRSKDFEDIAQQAFQGLKPIFGSQNDVLILTSSGTSVLEASMLNIVNPEDHFVVIVSGAFGNRFKQIAQTYYKNVHIYDVTWGEAVDVKDFINFLSTLNVEVKAVFSQYCETSTTVLHPIHELGNAINQFNSNIYFVVDGVSCIGAVDVDINKDKIDVLVSGSQKAIMLPPGLAFVAYSHRAKEHFKEVTTPKFYLDLNKYISSQADNSTPFTPNVSLFRGVNAYVETVKAEGFNHVIARHYAIRNALRSALKALDLTLLVNDKDASPTVTAFKPNTNDEVKIIKDELKNRFKITIAGGQGHLKGQILRIGHMGKISPFDILSVVSALEIILTEHRKVNYIGKGISKYMEVIHEAI

SEQ ID NO: 941 - DNA, 444 bp, Staphylococcus aureus
ttgcatcaacatgactttaaagtccaaacttcttggcaaggtggtcgtaacaatgtcggaaacgttcaaggcgacatactttcagagaatatttctatacctgcttctttaggtggtgttggtataggaacaaatcccgatgaaatgttagtatcagccgcttcatcatgttatatcatctcattagcagctactcttgaacgtgcaaagttcacagatatttcaattgaacaacaatcgattggaacagcttgtttaaataacggaaaattcagtatgtcaaaaattgtgcaccatcctcaaattcaaattccaagtgatcaaatagcacaattagaaaagcgattaccaaaattgataacaattgcagataataattgcatgatttcaaatgctgtaagaaataatgtggacataaaaatctatcccatcattcaggccaaa

SEQ ID NO: 942 - protein, 148 aa, Staphylococcus aureus
  MISC_FEATURE (1)..(148): conserved hypothetical
LHQHDFKVQTSWQGGRNNVGNVQGDILSENISIPASLGGVGIGTNPDEMLVSAASSCYIISLAATLERAKFTDISIEQQSIGTACLNNGKFSMSKIVHHPQIQIPSDQIAQLEKRLPKLITIADNNCMISNAVRNNVDIKIYPIIQAK

SEQ ID NO: 943 - DNA, 741 bp, Staphylococcus aureus
atgactctgaataaactgaaagatgaattacaaattgtttcgcaccgtggattgccgagtgattttcctgaaaatacaatggtcggttatcgagaggtaatggggctcaatgttgctatgttagaaatagatgttcatttgaccaaagaccaacattttgttgtgatacatgatgaaacaattgatagaacatcggatggtaaggggcgtattgctgattacacattatcgcaattaaaatcatttgattttggtagttataaagatgttgcttttaagggagaacgaatacccacgttagatgaagtactttcattatgcttaaagtatgataaaaagctattgattgaattgaaaagtccgaatttatatccagaaatagaatgtaaattgctggcatttttggaagaaaagaaagtcgatgcgacacaagtagttatacaatcttttgatatcgaatgcatcgaaaagttaaacacattgggcagtatatatgaattaggtgtgctttgtagtaaacgtaattattggtataaaaagccaaacttttcaagaattgctcaaattgctagttatgttaatcctaattatgcattagtgaccagaaaatttgttgataaagcacatcatcatcaattacaggttatgccatacacagttaataaattgaaaactggagaaaaattaagacaaatgggtgtagatggattaattacagataatccgaaattatttattaag

SEQ ID NO: 944 - protein, 247 aa, Staphylococcus aureus
  MISC_FEATURE (1)..(247): hypothetical protein
MTLNKLKDELQIVSHRGLPSDFPENTMVGYREVMGLNVAMLEIDVHLTKDQHFVVIHDETIDRTSDGKGRIADYTLSQLKSFDFGSYKDVAFKGERIPTLDEVLSLCLKYDKKLLIELKSPNLYPEIECKLLAFLEEKKVDATQVVIQSFDIECIEKLNTLGSIYELGVLCSKRNYWYKKPNFSRIAQIASYVNPNYALVTRKFVDKAHHHQLQVMPYTVNKLKTGEKLRQMGVDGLITDNPKLFIK

SEQ ID NO: 945 - DNA, 177 bp, Staphylococcus aureus
  MISC_FEATURE (1)..(177): n = g, a, t, or c
gtgaaaaaactcaaaattaaacatcatcgttgnaatcagttgnaaatcaacaatttcgtacctgnatacttaaactttgatgctgacagcttaactggtactttcgtacgtttaccagaacgtagcgaattacctgctgaaattaacgaacaattaatcgttgagtactactcaaga

SEQ ID NO: 946 - protein, 59 aa, Staphylococcus aureus
  MISC_FEATURE (1)..(59): Xaa = any amino acid
  MISC_FEATURE (1)..(59): 30S ribosomal protein S4
VKKLKIKHHRXNQLXINNFVPXYLNFDADSLTGTFVRLPERSELPAEINEQLIVEYYSR

SEQ ID NO: 947 - DNA, 186 bp, Staphylococcus aureus
atgggtaaacaatgtttcgtaacaggtcgtaaagcttcgactggtaacagacgttcacacgctttaaactctactaaacgtagatggaacgctaaccttcaaaaagttagaatcctagttgacggtaaacctaaaaaagtttgggtttctgcacgtgctttaaaatctggtaaagtaactagagtt

SEQ ID NO: 948 - protein, 62 aa, Staphylococcus aureus
  MISC_FEATURE (1)..(62): 50S ribosomal protein L28
MGKQCFVTGRKASTGNRRSHALNSTKRRWNANLQKVRILVDGKPKKVWVSARALKSGKVTRV

SEQ ID NO: 949 - DNA, 105 bp, Staphylococcus aureus
atggttgggattatttcacatgtgagcgaattgaaaaatagaatacctttagttttagaagtgaaatcagatcaatatcagagttcaacaagattcaaaagaaat

SEQ ID NO: 950 - protein, 35 aa, Staphylococcus aureus
  MISC_FEATURE (1)..(35): hypothetical protein
MVGIISHVSELKNRIPLVLEVKSDQYQSSTRFKRN

SEQ ID NO: 951 - DNA, 645 bp, Staphylococcus aureus
gtgtatatgcatataaatttattatgttctgatcgacacttgccgcaagatatttgggccaaaagtaatgaaggtaaatggggcggcgttgatagaggtgctttgattttattgaagcatcaaattatcccttttttctcagtgggagactttgattcagtcagtaaagaagaacgccaacttctaacagaacagttacaaatcaaaccagttcaagctgaaaaagctgatacggatttagctttagcggttgataaagctgttgcacttggatttgatagtattacaatttatggtgcaacaggcggacgattagatcacttttttggggcaattcagttattattgaaaaaagcatattataaacatgatgttcatatagaagttatcgatcaacaaaataaaattgaattattgcctaaaggtcaacatacagttgaaaaagataagagttatccgtacatttcatttataccgatgactgatgatgtagaactttctctagcaggttttaaatataatttagctagacaaatgcttaatataggttctactttaactatttcaaatgaaattgagtctttgcaagcgaaagtaactgtacatgatgggttgattttgcaaattagaagtacagatttaaat

SEQ ID NO: 952 - protein, 215 aa, Staphylococcus aureus
  MISC_FEATURE (1)..(215): conserved hypothetical
VYMHINLLCSDRHLPQDIWAKSNEGKWGGVDRGALILLKHQIIPFFSVGDFDSVSKEERQLLTEQLQIKPVQAEKADTDLALAVDKAVALGFDSITIYGATGGRLDHFFGAIQLLLKKAYYKHDVHIEVIDQQNKIELLPKGQHTVEKDKSYPYISFIPMTDDVELSLAGFKYNLARQMLNIGSTLTISNEIESLQAKVTVHDGLILQIRSTDLN

SEQ ID NO: 953 - DNA, 642 bp, Staphylococcus aureus
atgacaaaactatatccatcattattatctgttgattttttggatttacaacatgaattaaaacgacttgaagaagcaggcgtcgacggagttcattttgatgttatggatggtcaatttgtgcctaatatatctattggtttaccaatattagatgcagtaagaaaaggcacaacattacctatagacgtacatttgatgattgaaaatccagaaaagtatattgcatcatttgcagaacatggtgccgatatgatttcaattcatgtcgaatcaacgcctcatattcatcgtgctattcaaatgattaaacatttagataaaaaagctggtgtagtaattaatcctggtacaccaatatcacaaattgaacctattttagacattgttgattatgtactagtgatgacagttaacccagggtttggtggtcaatcatttattgatcaatgcgtagaaaaaatagcgggtcttaatgctattaaaatggaacgtcaattaaactttgatattgaagttgatggaggcgtaaataccgatacagcgaaagtttgtgttgaaaatggtgctacaatgctagtaacaggttcatttttctttaaacaagaggattataaaaaagtcacacaagcattgaaaggt

SEQ ID NO: 954 - protein, 214 aa, Staphylococcus aureus
  MISC_FEATURE (1)..(214): ribulose-5-phosphate
MTKLYPSLLSVDFLDLQHELKRLEEAGVDGVHFDVMDGQFVPNISIGLPILDAVRKGTTLPIDVHLMIENPEKYIASFAEHGADMISIHVESTPHIHRAIQMIKHLDKKAGVVINPGTPISQIEPILDIVDYVLVMTVNPGFGGQSFIDQCVEKIAGLNAIKMERQLNFDIEVDGGVNTDTAKVCVENGATMLVTGSFFFKQEDYKKVTQALKG

SEQ ID NO: 955 - DNA, 873 bp, Staphylococcus aureus
ttgaagacaggtcgaatagtgaaatcaattagtggggtatatcaagtagacgttaatggcgaacgtttcaatacaaaaccacgaggattatttagaaagaaaaaattttcaccggtagttggtgatatagtggaatttgaagttcaaaacattaacgaaggttatattcatcaagtgtttgagcgggaaaatgagttgaaaagaccacctgtaagtaatatagatacactagtaattgtaatgagtgctgtcgagccaaatttttcaacgcaattattagatcgatttttagttattgcacattcgtatcagttaaatgcgagaattttggtgactaaaaaagataaaacaccaattgaaaagcagttcgaaataaatgagttgttgaaaatatatgaaaatattggctatgagactgaatttattggaaatgatgatgatcgaaaaaaaattgtagaagcttggccagctggacttatagtacttagtggtcaatcaggtgtcggtaagtccactttcttaaatcattatcgtccagaacttaatcttgagacaaatgatatatcaaaatcattaaatcgaggaaagcatactacaagacatgtcgaactattcgaacgtcaaaacggttatattgcagacacacctggattcagtgctttagattttgatcatatagataaagatgaaataaaagattattttcttgaattaaatcgatatggtgaaacatgtaagtttaggaattgtaatcatatcaaagaacctaattgtaatgttaagcatcaattagagatagggaatattgcgcaatttagatacgaccattatttacaactatttaatgaaatttcaaatagaaaggttagatat

SEQ ID NO: 956 - protein, 291 aa, Staphylococcus aureus
  MISC_FEATURE (1)..(291): conserved hypothetical
LKTGRIVKSISGVYQVDVNGERFNTKPRGLFRKKKFSPVVGDIVEFEVQNINEGYIHQVFERENELKRPPVSNIDTLVIVMSAVEPNFSTQLLDRFLVIAHSYQLNARILVTKKDKTPIEKQFEINELLKIYENIGYETEFIGNDDDRKKIVEAWPAGLIVLSGQSGVGKSTFLNHYRPELNLETNDISKSLNRGKHTTRHVELFERQNGYIADTPGFSALDFDHIDKDEIKDYFLELNRYGETCKFRNCNHIKEPNCNVKHQLEIGNIAQFRYDHYLQLFNEISNRKVRY

SEQ ID NO: 957 - DNA, 1992 bp, Staphylococcus aureus
atgataggtaaaataataaatgaacgatataaaattgtagataagcttggcggcggtggcatgagtaccgtttatcttgctgaagatacgatacttaacattaaagttgcaattaaggcgatttttataccacctagagaaaaagaagaaacattaaaacgttttgaacgagaagtacataactcatcacagctatcacatcaaaatatagtaagtatgatcgatgttgatgaagaagatgactgttactacttagtaatggaatatatcgaaggtccgactttgtctgagtatattgaaagtcatgggccattaagtgttgacacagcgattaattttacgaatcaaatattggatggcattaaacatgcgcatgatatgcgtattgtacatagagatattaagccacaaaatatattaattgacagcaataaaacgttgaaaatatttgattttggaattgctaaagctttaagtgagacgtctttaactcagactaatcatgtgttaggtactgtgcagtacttttcgccagaacaagcaaaaggtgaggcaacggatgaatgtacagatatttattctataggtattgtgttatatgaaatgcttgttggtgaaccaccctttaatggagaaactgcagttagcattgcgattaaacatattcaggattctgtgccaaatgtgacaacagatgtacgtaaggatattccgcaatctttaagtaatgtcattttacgcgctacagaaaaagacaaagcgaatcgttacaaaacaattcaagaaatgaaagatgatttgagtagtgttttacatgaaaatcgagcgaatgaagatgtctatgaactcgataaaatgaaaacgatagcggtacctttgaaaaaagaagatctagcaaagcatattagtgaacataagtcgaatcaacctaaacgtgaaacgacgcaagtacctattgtaaatgggcctgctcatcatcagcaattccaaaagccagaaggtacggtgtacgaaccaaaacctaaaaagaaatcaacacgaaagattgtgctcttatcactaatcttttcgttgttaatgattgcacttgtttcttttgtggcaatggcaatgtttggtaataaatacgaagagacacctgatgtaatcgggaaatctgtaaaagaagcagagcaaatattcaataaaaacaacctgaaattgggtaaaatttctagaagttatagtgataaatatcctgaaaatgaaattattaagacaactcctaatactggtgaacgtgttgaacgtggtgacagtgttgatgttgttatatcaaagggccctgaaaaggttaaaatgccaaatgtcattggtttacctaaggaggaagccttgcagaaattaaaatcgttaggtcttaaagatgttacgattgaaaaagtatataataatcaagcgccaaaaggatacattgcaaatcaaagtgtaaccgcaaatactgaaatcgctattcatgattctaatattaaactatatgaatctttaggcattaagcaagtttatgtagaagactttgaacataaatcctttagcaaagctaaaaaagccttagaagaaaaagggtttaaagttgaaagtaaggaagagtatagtgacgatattgatgagggtgatgtgatttctcaatctcctaaaggaaaatcagtagatgaggggtcaacgatttcatttgttgtttctaaaggtaaaaaaagtgactcatcagatgtcaaaacgacaactgaatcggtagatgtaccatacactggtaaaaatgataagtcacaaaaagttaaagtttatattaaagataaagataatgacggttcaactgaaaaaggtagtttcgatattactagtgatcaacgtatagacattcctttaagaattgaaaaaggaaaaacagcaagttatattgttaaagttgacggtaaaactgtagctgaaaaagaagtcagctatgatgatgta

SEQ ID NO: 958 - protein, 664 aa, Staphylococcus aureus
  MISC_FEATURE (1)..(664): protein kinase
MIGKIINERYKIVDKLGGGGMSTVYLAEDTILNIKVAIKAIFIPPREKEETLKRFEREVHNSSQLSHQNIVSMIDVDEEDDCYYLVMEYIEGPTLSEYIESHGPLSVDTAINFTNQILDGIKHAHDMRIVHRDIKPQNILIDSNKTLKIFDFGIAKALSETSLTQTNHVLGTVQYFSPEQAKGEATDECTDIYSIGIVLYEMLVGEPPFNGETAVSIAIKHIQDSVPNVTTDVRKDIPQSLSNVILRATEKDKANRYKTIQEMKDDLSSVLHENRANEDVYELDKMKTIAVPLKKEDLAKHISEHKSNQPKRETTQVPIVNGPAHHQQFQKPEGTVYEPKPKKKSTRKIVLLSLIFSLLMIALVSFVAMAMFGNKYEETPDVIGKSVKEAEQIFNKNNLKLGKISRSYSDKYPENEIIKTTPNTGERVERGDSVDVVISKGPEKVKMPNVIGLPKEEALQKLKSLGLKDVTIEKVYNNQAPKGYIANQSVTANTEIAIHDSNIKLYESLGIKQVYVEDFEHKSFSKAKKALEEKGFKVESKEEYSDDIDEGDVISQSPKGKSVDEGSTISFVVSKGKKSDSSDVKTTTESVDVPYTGKNDKSQKVKVYIKDKDNDGSTEKGSFDITSDQRIDIPLRIEKGKTASYIVKVDGKTVAEKEVSYDDV

SEQ ID NO: 959 - DNA, 741 bp, Staphylococcus aureus
atgctagaggcacaattttttactgatactggacaacatagagataagaatgaagatgcgggtggtattttttataatcaaactaatcaacaacttttagttctgtgtgatggtatgggtggccataaagcaggagaagttgcaagtaaatttgttacagatgagttgaaatcccgttttgaagcggaaaatcttatagaacaacatcaagctgaaaattggttgcgtaataatataaaagatataaattttcagttatatcactatgcacaagaaaatgcagaatataaaggtatgggtacaacatgtgtttgtgcacttgtttttgaaaaatcagttgtgatagcaaatgtcggtgattctagagcctatgttattaatagtcgacaaattgaacaaattactagtgatcactcatttgttaatcatcttgttttaacgggtcaaattacgccggaagaagcatttacacatccacaacgtaatattattacgaaggtgatgggcacagataaacgtgtgagtccagatttgtttattaagcgattaaatttttatgattatttattattaaattcagatggattaactgattatgttaaagacaatgaaattaagcgtttgttagtaaaagaaggtacaatagaagatcatggtgatcaattaatgcaattggcattagataaccattcgaaagataacgttactttcatactcgcggctattgaaggtgataaagta

SEQ ID NO: 960 - protein, 247 aa, Staphylococcus aureus
  MISC_FEATURE (1)..(247): conserved hypothetical
MLEAQFFTDTGQHRDKNEDAGGIFYNQTNQQLLVLCDGMGGHKAGEVASKFVTDELKSRFEAENLIEQHQAENWLRNNIKDINFQLYHYAQENAEYKGMGTTCVCALVFEKSVVIANVGDSRAYVINSRQIEQITSDHSFVNHLVLTGQITPEEAFTHPQRNIITKVMGTDKRVSPDLFIKRLNFYDYLLLNSDGLTDYVKDNEIKRLLVKEGTIEDHGDQLMQLALDNHSKDNVTFILAAIEGDKV

SEQ ID NO: 961 - DNA, 1092 bp, Staphylococcus aureus
atgataactgctgaaaagaaaaagaagaataaatttcttccaaattttgacaagcaatcaatatattcattgcgatttgacgaaatgcaaaactggctcgttgaacaagggcaacaaaaatttcgagcgaaacagatttttgaatggttatatcaaaaaagagtagattcgattgatgaaatgacgaacttatcgaaagacttacgacagcttttaaaagataactttactgttacaactttaacaactgtagtaaaacaagaaagtaaagacggtacaattaaattcttatttgaattacaagatggctatacaattgaaactgttttaatgagacatgattatggaaattcagtatgtgtaacgacacaagtaggttgtcgcatcggatgtacgttttgtgcttctacacttggcggcttaaaaagaaaccttgaagctggcgaaattgtttcacaagttttaacagttcaaaaagcccttgatgctacagaagagcgcgtatctcaaattgtcataatgggtatcggtgaaccatttgaaaattatgatgaaatgatggactttttaagaatcgtcaatgatgataacagtttaaatattggtgcacgtcacattacagtatcaacatcaggtatcattcctagaatatatgactttgcggatgaagatattcaaattaattttgctgtaagcttacacgccgcaaaagatgaagtgcgatcacgcttgatgccaattaaccgtgcatataatgttgagaagttaatcgaagcaattcaatattatcaagaaaaaacaaatcgtcgtgttacttttgaatatggtctgtttggtggtgtgaatgaccaactagaacatgcaagagaattagcacatttaataaaaggcttaaactgccatgttaacttaattcctgtcaaccatgttccagaaagaaattatgtgaaaacggctaaaaatgatatctttaaatttgaaaaagaattaaagagactaggaattaatgccacaatacgtcgtgaacaaggttcggatattgacgcagcttgtggtcaattaagagcaaaggaacgacaagtagaaacgagg

SEQ ID NO: 962 - protein, 364 aa, Staphylococcus aureus
  MISC_FEATURE (1)..(364): conserved hypothetical
MITAEKKKKNKFLPNFDKQSIYSLRFDEMQNWLVEQGQQKFRAKQIFEWLYQKRVDSIDEMTNLSKDLRQLLKDNFTVTTLTTVVKQESKDGTIKFLFELQDGYTIETVLMRHDYGNSVCVTTQVGCRIGCTFCASTLGGLKRNLEAGEIVSQVLTVQKALDATEERVSQIVIMGIGEPFENYDEMMDFLRIVNDDNSLNIGARHITVSTSGIIPRIYDFADEDIQINFAVSLHAAKDEVRSRLMPINRAYNVEKLIEAIQYYQEKTNRRVTFEYGLFGGVNDQLEHARELAHLIKGLNCHVNLIPVNHVPERNYVKTAKNDIFKFEKELKRLGINATIRREQGSDIDAACGQLRAKERQVETR

SEQ ID NO: 963 - DNA, 1305 bp, Staphylococcus aureus
atgatagaaaacgtgagaagtcttgcttttgacacgattcaagatatattaaatgaaggtgcgtatagtaacttgcgtatcaatgaagtgttgtcagaaaatgaattaaatgcaatggataaggctttatttacagaaattgtctacggaaccgttaaaagaaaatatacgttagatttttatttaaagccttttgtgaaaacaaagattaaggcatgggttaggcaattattatggatgagtatttatcaatatgtttatttagataaagttccaaatcatgccattattaatgaagcagttgaaatagcaaaagaacgcggtggctatcataatggtaatgtcgtaaatggtattttacgtacaatgatgcgtagtgacttacctgattttaatgaaattgcagatcctaaaaaaagaatggcaatcgagtatagtatgccgaagtggattatagatcattgggcaacacattatggtctcgaagaaactgaaaaaattttacagtcatttttagaaacgacatcaacaactgtgcgtgccaacctgacgcgagcatcattagatgatattattgaaaagttgcaagacgaaggttatgacgttgaaaaagatcatgacttaccttattgtctccatataggaggacaaccaattattcattctcgttcatttaaagatggattcgtttcaattcaagataaaagctcaatgtttgttgcacacattatgaatgtagaccgacatgatcacgtattagatgcatgtagtgcacctggcggtaaagcttgtcacattgctgaagttttaatgccagaagggcaagttgacgcttcagatatacatgatcacaaaatagacttaattaattttaatataaaaaaattacgattaacaaatattaaagcttttcaacatgatgcgacaaaaccttatgataaaacatacgataagatacttgttgatgcaccatgtagcggattaggtgtaatgagacataagccggagattaagtatactcaaagcaaacaacatattgagtcactagttgaattacagcttgaaatattggaaaatgtaaaaaacaatgtaaaaataggtggagaaatcatctattcaacatgtacaattgagcaactagaaaatgaaaacgtgatttatacgtttttgaaaaataataaaaacttcgaatttgaaccgtttcaacatccgataactggagagttggtcaaaacgttacaaatcatgccgcaagactttaattcagatggattctttatcactaagataaaaagaaaggacaat

SEQ ID NO: 964 - protein, 435 aa, Staphylococcus aureus
  MISC_FEATURE (1)..(435): hypothetical protein
MIENVRSLAFDTIQDILNEGAYSNLRINEVLSENELNAMDKALFTEIVYGTVKRKYTLDFYLKPFVKTKIKAWVRQLLWMSIYQYVYLDKVPNHAIINEAVEIAKERGGYHNGNVVNGILRTMMRSDLPDFNEIADPKKRMAIEYSMPKWIIDHWATHYGLEETEKILQSFLETTSTTVRANLTRASLDDIIEKLQDEGYDVEKDHDLPYCLHIGGQPIIHSRSFKDGFVSIQDKSSMFVAHIMNVDRHDHVLDACSAPGGKACHIAEVLMPEGQVDASDIHDHKIDLINFNIKKLRLTNIKAFQHDATKPYDKTYDKILVDAPCSGLGVMRHKPEIKYTQSKQHIESLVELQLEILENVKNNVKIGGEIIYSTCTIEQLENENVIYTFLKNNKNFEFEPFQHPITGELVKTLQIMPQDFNSDGFFITKIKRKDN

SEQ ID NO: 965 - DNA, 933 bp, Staphylococcus aureus
atgactaaaataatatttatgggtacaccagacttttcaacaactgttttagaaatgcttattgcagaacatgatgtcattgcagtcgtaacgcaaccagatcgacctgttggacgtaaacgtgttatgacaccaccaccagttaaaaaagttgcaatgaaatatgatttacctgtatatcaacctgaaaaattaagtggatcagaagaattagaacaattgcttcaattagatgtagatttaattgtaactgctgcttttggacaattattacctgaatcattgttggcattaccaaatcttggggcaattaatgtacatgcatcattgttaccgaagtatagaggtggtgcaccaattcatcaggcaattatcgatggtgaacaagaaaccggcataacaattatgtatatggttaaaaaattagatgcgggtaatattatttcgcaacaagcaattaaaatagaagaaaatgataatgtcggtacgatgcatgataaattaagtgtattaggggcagatttattaaaagaaactttaccatctattatagagggcacaaatgaaagcgtacctcaagatgatacgcaagcaacatttgcttccaatattcgacgcgaagatgagcgaattagctggaataaaccaggaagacaagtgtttaatcaaattcgtggattatcaccatggccagttgcttatacaactatggatgacactaacttgaaaatatacgatgctgaactcgttgagactaataagataaacgagcctggaaccattatagaaacgactaaaaaagccattattgttgctacaaatgataatgaagctgttgcaattaaagatatgcaattagctgggaaaaagagaatgttagctgccaattatttaagtggtgcgcaaaacacactagtagggaagaaacttata

SEQ ID NO: 966 - protein, 311 aa, Staphylococcus aureus
  MISC_FEATURE (1)..(311): methionyl-tRNA
MTKIIFMGTPDFSTTVLEMLIAEHDVIAVVTQPDRPVGRKRVMTPPPVKKVAMKYDLPVYQPEKLSGSEELEQLLQLDVDLIVTAAFGQLLPESLLALPNLGAINVHASLLPKYRGGAPIHQAIIDGEQETGITIMYMVKKLDAGNIISQQAIKIEENDNVGTMHDKLSVLGADLLKETLPSIIEGTNESVPQDDTQATFASNIRREDERISWNKPGRQVFNQIRGLSPWPVAYTTMDDTNLKIYDAELVETNKINEPGTIIETTKKAIIVATNDNEAVAIKDMQLAGKKRMLAANYLSGAQNTLVGKKLI

SEQ ID NO: 967 - DNA, 486 bp, Staphylococcus aureus
atggcgattaaaaagttagtaccagcatcgcatcctattttaacgaaaaaagcgcaagcagttaaaacatttgatgattcgttaaaaagattattacaagatttagaagatacaatgtatgcacaagaagctgctggcttatgtgcacctcaaattaatcagtcattgcaagtggcaattattgatatggaaatggaaggattattacaacttgttaatccgaaaattattagtcaatcaaatgaaacaataacagacttagaaggttcaattacattgccagatgtttacggcgaagtgacaagaagtaaaatgatagttgtcgaaagttatgacgtcaatgggaacaaagttgaactaactgcacatgaagatgtagcaagaatgattttgcatattatagatcaaatgaacggtatcccttttacagaacgtgcggaccgtattttaacagataaagaagtggaggcatattttataaatgac

SEQ ID NO: 968 - protein, 162 aa, Staphylococcus aureus
  MISC_FEATURE (1)..(162): hypothetical protein
MAIKKLVPASHPILTKKAQAVKTFDDSLKRLLQDLEDTMYAQEAAGLCAPQINQSLQVAIIDMEMEGLLQLVNPKIISQSNETITDLEGSITLPDVYGEVTRSKMIVVESYDVNGNKVELTAHEDVARMILHIIDQMNGIPFTERADRILTDKEVEAYFIND

SEQ ID NO: 969 - DNA, 276 bp, Staphylococcus aureus
atgtttgaactaaaagtgggtataataaaaagagaagctaatgtcattataagcaattcaactggagggaaagaaatgcaagtaaacaaagttatttatattttattagcattgttcttaggtagttttggtattcataaattttatgccggcaagaatatgcaaggtattctacacttaatattctgttggacaggtatcccacacattttagcaattattagtgcagtgattactgttttcaaacctgctgatgaacaaggtaatgtcacttta

SEQ ID NO: 970 - protein, 92 aa, Staphylococcus aureus
  MISC_FEATURE (1)..(92): conserved hypothetical
MFELKVGIIKREANVIISNSTGGKEMQVNKVIYILLALFLGSFGIHKFYAGKNMQGILHLIFCWTGIPHILAIISAVITVFKPADEQGNVTL

SEQ ID NO: 971 - DNA, 741 bp, Staphylococcus aureus
atgaaaatcaacctagaaacttacaataatgacttagaattgaatgaacagtctattgaaatggaaatgtcgaggctgaatttaactgatgacaatgatatagatgaaataatagcctggaggggcgagcaagaggaattagagcagaaaagggatacttataaaaaacgttatcatgaatttgaaatggaaatagctaggttagaatcattaactaaggataaagagttattggactctgataaattaaaagatgaatatgagctaaaaaaaggaaagatgaatacactgatagatgaatactctgctgttcattatcaatgtcaaaataatattaataaaacacaatctatagtttcgcatattaattacttaaatcaagaattaaaggatcaacaagaaatatttcaattggctgaaattgtcagtggtaagaataacaaaaatcttacattggaaaactttgtcttaatttactatttagatcaaattattgctcaagcaaatctgagattagcaacaatgtcagataatcgataccaactaattaggcgagaagcggtttctcatggtcttagtggcctagaaattgatgtatttgatttgcattcaaataagtctagacatattagctcgttatcaggtggagaaactttccaatcgtcgcttgcattagctttagggttaagcgaaattgtacagcagcaatcaggaggtatttcactagacatcaatatttat

SEQ ID NO: 972 - protein, 247 aa, Staphylococcus aureus
  MISC_FEATURE (1)..(247): hypothetical protein
MKINLETYNNDLELNEQSIEMEMSRLNLTDDNDIDEIIAWRGEQEELEQKRDTYKKRYHEFEMEIARLESLTKDKELLDSDKLKDEYELKKGKMNTLIDEYSAVHYQCQNNINKTQSIVSHINYLNQELKDQQEIFQLAEIVSGKNNKNLTLENFVLIYYLDQIIAQANLRLATMSDNRYQLIRREAVSHGLSGLEIDVFDLHSNKSRHISSLSGGETFQSSLALALGLSEIVQQQSGGISLDINIY

SEQ ID NO: 973 - DNA, 951 bp, Staphylococcus aureus
atgaaaaagacactgggatgtttacttttaattatgcttttagtcgtagcaggttgttcttttggtgggaatcataaattatcatcaaagaaatcagaagaatcaaaacaagaaactgtaaaaaaagaatcggaagaagagaaagatccagatttagagaaatatgaagaaatagagaagaaaatgaaaggaattaaagatgcgccatctcttgataagttggatccattaatgacagaaaagtcgtttacgaatagtaaagggattcaaggatggaaagattacaaagaattaatgggtaaagtggaacttgcagattatagatttactaaagattcaaaaggatcttcaataaaagatgttgatgcattctttaaaggtaagaaaggtataaaaaggaaagtgattgaaacacacgatgatgtaaaacaagttgattattggtatgtagatccagatggaaagaaaattggcaattcaaacacacctgttttttacgcagaaattatgacaaaatataaagatggaaagttagtttatgcatcagtcgaaccaggatcttacgtaatacataaagatgatgcaattaaatatgacgattattctaagttaaaaaaattaagtcagctaactaaacttgatcatccaaaaccagttccatatagcgtagctcaaatcaaatctttcggagtacctttaacaagcgtttcatttatgacacatggatcaaaggatactaaagatgaagtgttgccggcattggcctatttcactttttcaccaaaaaattatgaagacaagtctaatccagatccaaaagttttaaatttagtacatatggatttcttaaatgcatctagtgattttggtaacgcacattttgttgttttaagtaaatatattaaagagtatgaatcaaactatgaaacagcgtcagatgattctttaaaa

SEQ ID NO: 974 - protein, 317 aa, Staphylococcus aureus
  MISC_FEATURE (1)..(317): hypothetical protein
MKKTLGCLLLIMLLVVAGCSFGGNHKLSSKKSEESKQETVKKESEEEKDPDLEKYEEIEKKMKGIKDAPSLDKLDPLMTEKSFTNSKGIQGWKDYKELMGKVELADYRFTKDSKGSSIKDVDAFFKGKKGIKRKVIETHDDVKQVDYWYVDPDGKKIGNSNTPVFYAEIMTKYKDGKLVYASVEPGSYVIHKDDAIKYDDYSKLKKLSQLTKLDHPKPVPYSVAQIKSFGVPLTSVSFMTHGSKDTKDEVLPALAYFTFSPKNYEDKSNPDPKVLNLVHMDFLNASSDFGNAHFVVLSKYIKEYESNYETASDDSLK

SEQ ID NO: 975 - DNA, 2415 bp, Staphylococcus aureus
gtggcaataatgatagcgaaagtcatagtcgatgtcgcgtcgaagagcgttgactataaatttgattatataattcccgaacaactcgaatctgtcatccaacctggtgtgcgtgtaattgtaccttttggaccaagaacgattcaaggttatgtaatggaagtaacagcagaacctgatgcacaacttgacgtttcgaagttaaaaaaaatcatagaagtgaaagatatacaaccagaattaacatcagaattaatagctttaagtgagtggatgggttcaactcatgtcattaaacgtatttctatgctagaagtgatgcttccgagtgctattaaagcgaagtataaaaaagcatttaagatgaaagatgacatagagctaccttcagctttattacaaaaatttgataagcatggttactattattataaagatgcgcaaaaaaataatgatattcaattgcttatgaagttgttaaaagatgatatcgttgaagaaaaaacgattctcacacaaaatataactaaaaaaaccaagcgtgctgttcgtgtcattgaagggtatcatcctgatgaagtattagctaagttggagaaagttattaaacaatacgatttgtatgcttacttgtctgaagaacaacataaaacaatatttttaactgatattgaggatatgggcttttcaaaatccagtttagatggacttatcaaaaaaggttatgttgaaaaatatgacgcggttgttgaaagagacccatttaaagatcgtgttttcgaacaagaatcaaaacagcaattaacagaagaccaatataaagcatatgaagcgattaaagctaaaattgtaagccaagagcaagaaacatttttacttcatggtgtgacgggatcaggtaaaacagaagtatatttacaaacgatagaagatgttttaagccaaggaaaacaggcgatgatgttagttcctgaaatcgctctaacaccgcaaatggttttacgcttcaaacgtcgatttggtgatgacgttgctgtattacattctggcttatctaatggggaacgttatgatgaatggcaaaaaattagggatggtcgtgcgagagtaagtgttggtgcaaggtcaagtgtgttcgcacctttcaaaaatttagggttaatcatcattgatgaagaacatgaatctacatataaacaagaagattatccgagatatcacgctagagaaattgcccaatggcgaagtgaatatcatcactgtccagtcattttaggaagtgcaacaccatgtcttgaaagttatgcacgagctgaaaaaggcgtttatcatttgctatcattaccaaacagagtgaaccaacaagctttacctgaaattgatatagtagacatgcgtgaagaattgagtgaaggtaatcggtcaatgttttcaaaagatttacgtgaagccatacaattaagattagatcgacaggaacaagttgttttatttttaaatcgacgtggttatgcatcgtttatgttatgtcgggattgtggatatgtaccgcaatgtccaaactgtgatatttcattaacgtatcataaaacgacagacttattaaaatgtcactattgtggttaccaagagacgccaccgaatcaatgtccaaattgtgagagtgaacacattcgacaagtaggtactggtactcagaaagttgaagaactattgcaacaagaatttgaagatgcgcgcataattaggatggatgtagatacaacctcaaagaaaggtgcacatgaaaagttattgactgaattcgaaaaaggtaacggtgacattttactaggtactcagatgattgcgaaaggattagattatccaaatattactttagttggtgtgctgaatgcagatacaatgttaaatttacctgattttcgggcgagcgaacgtacttatcaactattaacgcaagtggctggtagagctggtcgtcatgaaaaggcaggtcaagtcatcattcaaacgtataatccagatcattattcaatattggatgttcaaaaaaatgattatttaacattttatcgtcaggaaatggaatatcgtaaattaggaaagtatccaccgtattattatttgattaatttcacaatctcacataaagaaatgaagaaggttatggtagcatcgcagcatgttcataaaattttattacagcatttaacagaaaaagcgcttgtactaggtccatctccggcagcacttgcgagaatcaacaatgaatttagattccaaattttagtgaaatataaaagtgaacctggattattacaagccattcagtttttagatgactattaccatgaaaaatttataaaagaaaaattagcattgaagattgatattgatccacagatgatgatg

SEQ ID NO: 976 - protein, 805 aa, Staphylococcus aureus
  MISC_FEATURE (1)..(805): primosomal protein
VAIMIAKVIVDVASKSVDYKFDYIIPEQLESVIQPGVRVIVPFGPRTIQGYVMEVTAEPDAQLDVSKLKKIIEVKDIQPELTSELIALSEWMGSTHVIKRISMLEVMLPSAIKAKYKKAFKMKDDIELPSALLQKFDKHGYYYYKDAQKNNDIQLLMKLLKDDIVEEKTILTQNITKKTKRAVRVIEGYHPDEVLAKLEKVIKQYDLYAYLSEEQHKTIFLTDIEDMGFSKSSLDGLIKKGYVEKYDAVVERDPFKDRVFEQESKQQLTEDQYKAYEAIKAKIVSQEQETFLLHGVTGSGKTEVYLQTIEDVLSQGKQAMMLVPEIALTPQMVLRFKRRFGDDVAVLHSGLSNGERYDEWQKIRDGRARVSVGARSSVFAPFKNLGLIIIDEEHESTYKQEDYPRYHAREIAQWRSEYHHCPVILGSATPCLESYARAEKGVYHLLSLPNRVNQQALPEIDIVDMREELSEGNRSMFSKDLREAIQLRLDRQEQVVLFLNRRGYASFMLCRDCGYVPQCPNCDISLTYHKTTDLLKCHYCGYQETPPNQCPNCESEHIRQVGTGTQKVEELLQQEFEDARIIRMDVDTTSKKGAHEKLLTEFEKGNGDILLGTQMIAKGLDYPNITLVGVLNADTMLNLPDFRASERTYQLLTQVAGRAGRHEKAGQVIIQTYNPDHYSILDVQKNDYLTFYRQEMEYRKLGKYPPYYYLINFTISHKEMKKVMVASQHVHKILLQHLTEKALVLGPSPAALARINNEFRFQILVKYKSEPGLLQAIQFLDDYYHEKFIKEKLALKIDIDPQMMM

SEQ ID NO: 977 - DNA, 1203 bp, Staphylococcus aureus
ttgaatatgaagaaaatattattagccgttacaggtggcattgcggcatataaagcaattgatttgacaagtaagttaacacaatctgggtatgaagttcgcgttatgttaacgaatcacgcacaaaaatttgtgacaccattagcatttcaagcaataagtcgaaatgctgtttatacagatacttttatagaagaaaatccttcagaaatacagcatattgcattaggtgattgggcagatgcaatcattgttgcacctgcaacggcaaatacaattgcaaaattgagtgtaggtattgctgatgatttggtgacatcaacgttgctagcaacagagacaccgaaatttattgcgcctgctatgaatgtgcatatgtatgaaaataaacgtacgcagcaaaatattaatattttaaaagaagatgggtatcattttatcgaaccaggaagcggatttctagcatgtggttatgttgctaaaggacgtatggaagaaccgcttcaaatcgtttctgtaattgatgctcattttcaaaatagtaatcgtttagctaatagttcatttcaagataaacgcgcattggttacagcaggaccaactattgaagttatcgatccagtcagatttgtatccaatcgttcttctggaaaaatgggctatgcaatagctgaagcattgcgaaatcgaggagctatcgtgacgttagttgctggtcctacaacactagaggatccaaaagatattgaagttattcatgttcaaagtgctgaagaaatgtttgaacaagtgacaagccgatttgacgaacaagatattgttgtaaaagcagcagccgtatctgactatacaccggttgatgtattagaacataagatgaaaaagcaggatggtgatttgtcagtatcttttaaacgtactaaagacattcttaaatatttaggtgaacataaaacatcacagtatttaataggctttgcagcagagactgaagatattgaaaattatgcacaacaaaaattacgcaagaaaaatgcagatgtgattatttcaaataatgttggggatatgtctatcggatttagttctgatgataatgaattgacaatgcattttaaaaataatgaaaaagtaaatatcaagaaaggaaaaaaagtagtattagctgcacaaattttagatgaactagaaactaggtggcaa

SEQ ID NO: 978 - protein, 401 aa, Staphylococcus aureus
  MISC_FEATURE (1)..(401): pantothenate metabolism
LNMKKILLAVTGGIAAYKAIDLTSKLTQSGYEVRVMLTNHAQKFVTPLAFQAISRNAVYTDTFIEENPSEIQHIALGDWADAIIVAPATANTIAKLSVGIADDLVTSTLLATETPKFIAPAMNVHMYENKRTQQNINILKEDGYHFIEPGSGFLACGYVAKGRMEEPLQIVSVIDAHFQNSNRLANSSFQDKRALVTAGPTIEVIDPVRFVSNRSSGKMGYAIAEALRNRGAIVTLVAGPTTLEDPKDIEVIHVQSAEEMFEQVTSRFDEQDIVVKAAAVSDYTPVDVLEHKMKKQDGDLSVSFKRTKDILKYLGEHKTSQYLIGFAAETEDIENYAQQKLRKKNADVIISNNVGDMSIGFSSDDNELTMHFKNNEKVNIKKGKKVVLAAQILDELETRWQ

SEQ ID NO: 979 - DNA, 216 bp, Staphylococcus aureus
atgttaaatccacctttaaaccaattaacgtcacaaattaaatcaaagtatttaattgcaacaactgcagcgaaaagagcgcgtgaaattgatgaacaacctgaaactgaattattaagtgaatatcattcatttaaaccagttggtagagcgttagaagaaattgctgacggtaaaattcgccctgttatttcaagtgattattatggtaaagaa

SEQ ID NO: 980 - protein, 72 aa, Staphylococcus aureus
  MISC_FEATURE (1)..(72): conserved hypothetical
MLNPPLNQLTSQIKSKYLIATTAAKRAREIDEQPETELLSEYHSFKPVGRALEEIADGKIRPVISSDYYGKE

SEQ ID NO: 981 - DNA, 621 bp, Staphylococcus aureus
atggataatgaaaaaggattgttaatcgttttatcaggaccatctggagtaggtaaaggtactgttagaaaacgaatatttgaagatccaagtacatcatataagtattctatttcaatgacaacacgtcaaatgcgtgaaggtgaagttgatggcgtagattacttttttaaaactagggatgcgtttgaagctttaatcaaagatgaccaatttatagaatatgctgaatatgtaggcaactattatggtacaccagttcaatatgttaaagatacaatggacgaaggtcatgatgtatttttagaaattgaagtagaaggtgcaaagcaagttagaaagaaatttccagatgcgctatttattttcttagcacctccaagtttagaacacttgagagagcgattagtaggtagaggaacagaatctgatgagaaaatacaaagtcgtattaacgaagcgcgtaaagaagttgaaatgatgaatttatacgattacgttgtagttaatgatgaagtagaacttgcgaagaatagaattcaatgtattgtagaagctgagcacttaaaaagagagcgcgtagaagctaagtatagaaaaatgattttggaggctaaaaaa

SEQ ID NO: 982 - protein, 207 aa, Staphylococcus aureus
  MISC_FEATURE (1)..(207): guanylate kinase homolog
MDNEKGLLIVLSGPSGVGKGTVRKRIFEDPSTSYKYSISMTTRQMREGEVDGVDYFFKTRDAFEALIKDDQFIEYAEYVGNYYGTPVQYVKDTMDEGHDVFLEIEVEGAKQVRKKFPDALFIFLAPPSLEHLRERLVGRGTESDEKIQSRINEARKEVEMMNLYDYVVVNDEVELAKNRIQCIVEAEHLKRERVEAKYRKMILEAKK

SEQ ID NO: 983 - DNA, 1695 bp, Staphylococcus aureus
atggcttatgatggcttatttacaaagaaaatggttgagtctctacaatttttaacaacaggacgtgttcacaaaatcaatcaacctgataatgacacgatactaatggttgtacgtcaaaatagacaaaaccatcaattgttattgtcaatccatccaaacttttcaagattacaattgactactaaaaaatatgataatccatttaatccacccatgtttgcgcgtgtttttagaaaacacttagaaggtggtattatcgaatcgattaagcaaattggtaatgatcgtcgcattgaaatcgatataaagagtaaagatgaaattggcgatactatttaccgcactgtcatccttgagattatgggtaaacatagtaacttaattttagtagatgaaaatcgcaaaataattgaaggatttaaacacttaacaccaaatacgaatcactatcgtacagtaatgccaggatttaattatgaagcaccacctactcagcacaaaataaatccgtatgatattacaggtgcagaggtgttgaaatatatcgattttaacgcaggtaatattgctaaacaattattgaatcagtttgaaggatttagccctttaattacgaatgaaatcgttagtcgtcgtcaatttatgacttcatcaacattaccagaagcatttgacgaagtaatggcagaaaccaagttaccacctactcctatttttcataaaaatcatgaaacaggtaaagaggatttctattttataaagttaaatcaatttaatgatgatacagttacatacgattcattaaatgatttgcttgatcgtttttatgatgcgcgtggcgaacgtgaacgcgttaaacaacgtgcgaatgatttagttcgatttgttcaacagcagttgcacaaatatcaaaataaattagcgaagttgattgaagaatatgagcagtctaaaaataaagatactgaacagttatatggtgaattgatcactgctaatatatatcgaattaagcaaggcgataaagaagtgacggcattgaattattatacgaatgaagaagttgtcattcctttaaatcctacaaaatccccatcagcaaatgctcaatattattataaacaatataatcgtatgaaaacgagagaacgtgaattacaacatcaaattcaattgacgaaagacaatatagattatttttcaacaatcgaacaacaattacatcatatttctgtccatgacattgatgaaattagagatgaattagcagaacaaggctttatgaaacagcgtaaaaatcaaactaagaaaaagaaagcgcagattcaattacaacattatgtatcaactgatggcgacgatatatatgttggtaagaataacaagcaaaatgattatttaacaaataaaaaagctaaaaaaactcacacatggttacacacaaaagatattcctggttcacatgtcgttatatttaatgatgcaccaagtgatacgacaatcaaggaagcggctatgttagcaggatacttttcaaaagctggtaattctggacaaatacctgttgattatacattaattaaaaatgtgcataaaccatcaggtgcaaagcctgggtttgtaacatatgacaatcaaaaaactttgtatgctacacctgattatgaacttattcaaaaaatgaaacaatca

SEQ ID NO: 984 - protein, 565 aa, Staphylococcus aureus
  MISC_FEATURE (1)..(565): hypothetical protein
MAYDGLFTKKMVESLQFLTTGRVHKINQPDNDTILMVVRQNRQNHQLLLSIHPNFSRLQLTTKKYDNPFNPPMFARVFRKHLEGGIIESIKQIGNDRRIEIDIKSKDEIGDTIYRTVILEIMGKHSNLILVDENRKIIEGFKHLTPNTNHYRTVMPGFNYEAPPTQHKINPYDITGAEVLKYIDFNAGNIAKQLLNQFEGFSPLITNEIVSRRQFMTSSTLPEAFDEVMAETKLPPTPIFHKNHETGKEDFYFIKLNQFNDDTVTYDSLNDLLDRFYDARGERERVKQRANDLVRFVQQQLHKYQNKLAKLIEEYEQSKNKDTEQLYGELITANIYRIKQGDKEVTALNYYTNEEVVIPLNPTKSPSANAQYYYKQYNRMKTRERELQHQIQLTKDNIDYFSTIEQQLHHISVHDIDEIRDELAEQGFMKQRKNQTKKKKAQIQLQHYVSTDGDDIYVGKNNKQNDYLTNKKAKKTHTWLHTKDIPGSHVVIFNDAPSDTTIKEAAMLAGYFSKAGNSGQIPVDYTLIKNVHKPSGAKPGFVTYDNQKTLYATPDYELIQKMKQS

SEQ ID NO: 985 - DNA, 399 bp, Staphylococcus aureus
atggatattccaaaaatcacgacatttttaatgtttaataaccaagctgaagaagctgttaaactatacacaagcttatttgaagatagtgagattataacaatggctaagtatggtgaaaatggacctggtgatcccgggactgtacaacactcaatatttacattaaatggacaagtattcatggcgattgatgctaatagtggcacagaattaccaatgaatcctgcgatttcattatttgttacagtaaaagatactattgaaatggaacgactatttaatggattaaaagatgaaggtgccattttaatgccaaaaacgaatatgccaccatacagagagtttgcttgggttcaagataagtttggagtaagttttcaattagcattacctgag

SEQ ID NO: 986 - protein, 133 aa, Staphylococcus aureus
  MISC_FEATURE (1)..(133): conserved hypothetical
MDIPKITTFLMFNNQAEEAVKLYTSLFEDSEIITMAKYGENGPGDPGTVQHSIFTLNGQVFMAIDANSGTELPMNPAISLFVTVKDTIEMERLFNGLKDEGAILMPKTNMPPYREFAWVQDKFGVSFQLALPE

SEQ ID NO: 987 - DNA, 210 bp, Staphylococcus aureus
atgaatgacaaaacatctaatgatttatatgggaagataaaacattgtaacgaatttatcaatcattcaaatgattccaatctatctagtagtcacgatgtcgacgaaagttcaacgaagcaaaaacatataaaaaataaaacaactatagatcataatgatgatttatttaaacatgtaaaggatatattacgtaaacaaggacaaatt

SEQ ID NO: 988 - protein, 70 aa, Staphylococcus aureus
  MISC_FEATURE (1)..(70): hypothetical protein
MNDKTSNDLYGKIKHCNEFINHSNDSNLSSSHDVDESSTKQKHIKNKTTIDHNDDLFKHVKDILRKQGQI

SEQ ID NO: 989 - DNA, 621 bp, Staphylococcus aureus
ttggttagtataatggctaaagaaattgcaaaatcattattagatattgaagctgtaacattatcaccaaatgatttatatacatggagttcaggtattaaatcaccgatttactgtgataaccgtgttacgttaggttatcctttagttcgaggcgcaatccgcgatggtttaattaacttaattaaagaacactttcctgaagtagaagttatttctggtactgcaacagctggtattccacatgcagcttttattgctgaaaaattaaaattaccaatgaattatgttcgttcatcaaataagagtcatggtaagcaaaatcaaatcgaaggtgctaaaagtgaaggtaaaaaagtagttgtgatagaagatttaatttcgacagggggatcttcagtcacagcagttgaagccttaaaactagcaggtgcagaagtattaggtgttgtagctatctttacttacggtttgaaaaaagcagatgatacatttagcaatattcaactacctttttacactttaagtgattacaatgaattaattgaagtagctgaaaatgaaggtaaaatttctagtgaagatatccaaacattagttgaatggagagacaacttagca

SEQ ID NO: 990 - protein, 207 aa, Staphylococcus aureus
  MISC_FEATURE (1)..(207): orotate
LVSIMAKEIAKSLLDIEAVTLSPNDLYTWSSGIKSPIYCDNRVTLGYPLVRGAIRDGLINLIKEHFPEVEVISGTATAGIPHAAFIAEKLKLPMNYVRSSNKSHGKQNQIEGAKSEGKKVVVIEDLISTGGSSVTAVEALKLAGAEVLGVVAIFTYGLKKADDTFSNIQLPFYTLSDYNELIEVAENEGKISSEDIQTLVEWRDNLA

SEQ ID NO: 991 - DNA, 2046 bp, Staphylococcus aureus
atgaaaccattacatttaaagttgaataatttcggcccctttttaaaagaagaaattgatttttctaaaattgataataatgaattgtttttaataagtggtaagactggatcgggtaaaacaatgatttttgatgcaatgacttatgccttgtttggtaaagcatcaactgaacaaagagaagaaaatgatttgagaagtcatttcgctgatggtaaacagccgatgtcagtaacatttgaatttcaattaaatcatcgaatttataaagtgcatagacaaggcccttatatcaaagaaggtaatacaacaaaaacgaacgctaaatttgatgtatttgagatggtggatggcaagtatgaaattagagaaagtaaagtaatttcaggtacccaattcattattgaattattaggagtaaatgcagatcaattccgacaattgtttattttgcctcaaggtgaattcaaacgctttttaatatcaaacagtcgtgaaaagcaagggatattaagaacactgtttgacagtgaaaaatttgaagctatacgagaaatattaaaagaagaagtaaaaaaagaaaaagctcaaatcgagaatagatatcaacaaattgaccttttatggcaagaaattgaatcatttgatgatgacaatataaaaggcttattagaggttgccactcaacagatagacaaattgattgaaaatataccacttttacaagctaggtcgaaagaaatactagcatctgtaaatgaaagtaaagaaactgctattaaagaatttgaaataatagaaaagaaaacattagaaaataatatattaaaagataatattaatcaactcaacaaaaataaaattgatttcgttcaattgaacgaacaacaacctgaaatagagggaattgaagctaagttaaagttgttacaagatattacaaacctattgaattatattgaaaatagagaaaaaattgaaactaaaattgctaatagcaaaaaagatatttctaaaaccaataataaaatattgaatcttgattgtgataagcgaaacatagacaaagagaaaaaaatgttagaagaaaatggagatttaattgaaagtaaaatctcttttattgataaaactagagtattatttaacgatattaataagtatcaacaaagttatctcaatattgaacgcttgagaactgagggtgaacaattaggtgatgaattaaatgatctaattaaaggtttagaaacggtcgaagattcaataggtaataaccaaagtgattacgagaaaattatcgaactaaataatacgataacgaacataaataatgaaattaatataattaaagaaaatgaaaaagctaaagctgaattagataaactattaggtagtaagcaagagttagagaatcaaattaatgaagaaacatctatattgaagaatctcgaaataaaattagatcgctacgataaaacaaaattggacttaaatgataaagaaagctttataagtgaaattaaatctgctgtaaatattggagatcaatgtccgatatgtggtaatgaaattcaggatttagggcatcatattgattttgacagtattgctaaacgtcaaaatgaaattaaagaaattgaagcaaatatccacgctataaaatcgaatattgctgtgcataattctgaaattaaatttgttaatgaaaaaatatcgaatattaatattaaaacgcaaagtgatttttcacttgaagtattgaataagcgtctgctagaaaatgaaaatgcattgaataatcaaagagatcttaataaatttatagaacaaatgaaagaagaaaaagataatctaacgttgcaaattcataataaacaattgcgtctaaataaaaatgaatctgagttgaaattatgtcgagatctcatcactgaatttgaaacactctcgaaatataataatatcactaattttgaggtggattataagaagtatgttcaagatgtgaatcagcatcaagaactctcaaaggagattgaagat

SEQ ID NO: 992 - protein, 682 aa, Staphylococcus aureus
  MISC_FEATURE (1)..(682): hypothetical protein
MKPLHLKLNNFGPFLKEEIDFSKIDNNELFLISGKTGSGKTMIFDAMTYALFGKASTEQREENDLRSHFADGKQPMSVTFEFQLNHRIYKVHRQGPYIKEGNTTKTNAKFDVFEMVDGKYEIRESKVISGTQFIIELLGVNADQFRQLFILPQGEFKRFLISNSREKQGILRTLFDSEKFEAIREILKEEVKKEKAQIENRYQQIDLLWQEIESFDDDNIKGLLEVATQQIDKLIENIPLLQARSKEILASVNESKETAIKEFEIIEKKTLENNILKDNINQLNKNKIDFVQLNEQQPEIEGIEAKLKLLQDITNLLNYIENREKIETKIANSKKDISKTNNKILNLDCDKRNIDKEKKMLEENGDLIESKISFIDKTRVLFNDINKYQQSYLNIERLRTEGEQLGDELNDLIKGLETVEDSIGNNQSDYEKIIELNNTITNINNEINIIKENEKAKAELDKLLGSKQELENQINEETSILKNLEIKLDRYDKTKLDLNDKESFISEIKSAVNIGDQCPICGNEIQDLGHHIDFDSIAKRQNEIKEIEANIHAIKSNIAVHNSEIKFVNEKISNINIKTQSDFSLEVLNKRLLENENALNNQRDLNKFIEQMKEEKDNLTLQIHNKQLRLNKNESELKLCRDLITEFETLSKYNNITNFEVDYKKYVQDVNQHQELSKEIED

SEQ ID NO: 993 - DNA, 693 bp, Staphylococcus aureus
atgatgaaagatttaccaattattgcattagattttgaatcaaaagaaaaagtaaatcaatttttagatttatttgatgaatcattattcgtaaaagtaggtatggaacttttttatcaagaaggtcctcaattaattaatgagataaaagaaagaggccatgatgtatttttagatttaaaactgcatgatattcctaatacagttggtaaggcgatggaaggactagctaaattgaatgttgatctggtaaatgttcatgctgctggtggcgtaaaaatgatgtctgaggccattaaaggattaagaaaacataatcaagatacaaaaattattgcagtaacacagcttacgtcaacaacagaagacatgttacgacacgaacaaaatatacaaacatcgattgaagaggccgttttaaattatgccaagttagcaaatgcagctggtttagatggcgttgtttgttcacctcttgaaagtcgtatgttgactgaaaagttaggtacatcatttttaaaagtaacaccaggtattagacctaaaggtgcatctcaaaatgaccaacaccgtattacgacaccggaagaagcaagacagcttggttcgacgcatattgtagtcggtagaccgattacacaaagtgacaatccagtcgaaagttatcataaaattaaagaaagttggttagta

SEQ ID NO: 994 - protein, 231 aa, Staphylococcus aureus
  MISC_FEATURE (1)..(231): orotidine-5-phosphate
MMKDLPIIALDFESKEKVNQFLDLFDESLFVKVGMELFYQEGPQLINEIKERGHDVFLDLKLHDIPNTVGKAMEGLAKLNVDLVNVHAAGGVKMMSEAIKGLRKHNQDTKIIAVTQLTSTTEDMLRHEQNIQTSIEEAVLNYAKLANAAGLDGVVCSPLESRMLTEKLGTSFLKVTPGIRPKGASQNDQHRITTPEEARQLGSTHIVVGRPITQSDNPVESYHKIKESWLV

SEQ ID NO: 995 - DNA, 3171 bp, Staphylococcus aureus
atgcctaaacgtaatgatatcaaaacaattttagtaatagggtctgggccaattatcataggtcaagcagctgaatttgattatgctggaacacaagcatgtctagctttaaaagaagagggatatcgagttattcttgtaaattcaaatccagcgacaatcatgactgataaggaaattgcggataaagtatatatcgaaccgttaactcatgattttatagcgcgaattatacgtaaagagcaacctgacgctttacttccaactttaggtggtcaaacaggtttaaacatggcgattcaactacacgaaagtggtgtgcttcaagataataacgtccaattattaggaactgagctaacatcaattcaacaagcagaagaccgtgaaatgtttagaacattaatgaatgatttaaacgttcctgtaccagagagtgacattgtaaatacagtagagcaagcctttaaattcaaagagcaagtgggatacccgctaattgttagaccggcatttacgatgggtggtaccggaggcggtatttgtcataatgatgaagaattacatgaaatcgtctcaaatggtcttcattatagtccagcaacgcaatgtttattagaaaaatctatcgcaggttttaaagaaatcgaatacgaagtaatgcgtgataaaaacgataatgccatcgttgtatgtaacatggaaaatattgatccagttggtattcatacaggcgattcaattgttgtggctcctagtcaaacattatcagatgttgagtatcaaatgttacgtgatgtttcattaaaagttattcgagctttaggtatcgaaggtggttgtaatgttcaattagcattagatccccattcattcgattattatattatagaagtaaatccgcgtgtatcacgttcatcagcgttagcttcaaaagcaacaggatatcctattgcaaaattagctgctaaaatcgcggttggtctaacattagatgaaatgttaaatccaattacaggaacatcttatgcagcgtttgaaccaactttagactatgtgatttcaaaaataccaagatttccttttgataaatttgaaaaaggagaacgagagcttggcacacaaatgaaagcaacaggtgaagttatggccattggtcgaacttacgaagaatcattgttaaaagcaattcgatcacttgagtatggtgtgcatcacttaggattaccaaatggtgaaagcttcgatcttgattatattaaagaacgtatttcacaccaagatgatgaacgattatttttcatcggcgaagcaattagaagaggcacaacattagaagaaattcataatatgactcagattgattacttcttcttacacaagttccaaaacattattgatattgagcatcaattaaaagagcatcaaggtgatttagaatatcttaaatatgcaaaagattatggatttagtgataaaacaatagcgcatcgctttaatatgacggaagaagaagtatatcaattgcgtatggaaaatgatattaaacctgtttacaagatggttgatacttgcgcagctgaatttgaatcttcaacaccatattattatggtacatacgaaactgaaaatgaatccatagttactgacaaagaaaaaatcttagtattaggctctggaccaattcgaatcggccaaggtgtagaatttgactatgcgacagttcacgccgtttgggcaattcaaaaagcagggtacgaagcgataattgtgaataacaatccagaaacagtttcaacagacttctcaatttctgacaaattatactttgaacctttaactgaagaagatgtgatgaatatcattaatttagaaaaacctaaaggtgtcgttgtacaatttggaggacaaacagcgattaatttagcagacaaattggctaaacatggtgttaaaatacttggtacttcactagaaaatctaaatcgtgctgaagatagaaaagaatttgaagcactattaagaaaaattaacgtgccacagccacaagggaaaacagctacatcacctgaggaagcattagcgaatgctgcagaaatcggatatccggttgtagtaagaccttcttatgtattaggtggtcgcgcaatggaaattgtagacaatgacaaagagttagaaaactatatgacccaggctgtaaaagcgagtccggaacatccggtactagtcgatagatatttaactggtaaagaaattgaagttgatgcgatttgtgatggagaaacggtcattattccaggaatcatggaacatattgaacgtgctggtgtgcatagtggtgactcaatcgctgtatatccaccacaaactttgacagaagacgagttagcaacacttgaggactatactataaaattagctaaaggtttaaacatcattggcttaatcaacattcaattcgttatagctcacgatggtgtgtatgttttagaagtaaatccacgttctagtagaacggtaccattcttaagtaaaattactgatattccaatggcacaattagctatgcgagcaatcattggggaaaaactaacagatatgggttatcaagaaggggttcaaccatatgctgagggtgtctttgtgaaagcaccagtatttagttttaataaattgaaaaatgttgatattactttaggacctgaaatgaagtcaacaggtgaagtgatggggaaagatactacattagaaaaggcgttattcaaagggttaacaggtagtggcgttgaagttaaagatcacggtacagtattaatgaccgtcagtgacaaagataaagaggaagttgttaaattggcacaacgcttaaatgaagttggctataaaattttagcaacgtctggaacagctaataaattagctgagtatgacatacctgcagaagtagtaggcaaaattggtggcgaaaatgatttattaacacgtattcaaaatggtgatgttcaaatcgttataaatacaatgactaaaggtaaagaagtagaaagggatggcttccaaattagacgtactacagttgaaaatggtattccatgtttgacatctttagatacagctaatgccttaacgaatgtaattgaaagtatgacatttacaatgcgtcaaatg

SEQ ID NO: 996 - protein, 1057 aa, Staphylococcus aureus
  MISC_FEATURE (1)..(1057): carbamoyl-phosphate synthase
MPKRNDIKTILVIGSGPIIIGQAAEFDYAGTQACLALKEEGYRVILVNSNPATIMTDKEIADKVYIEPLTHDFIARIIRKEQPDALLPTLGGQTGLNMAIQLHESGVLQDNNVQLLGTELTSIQQAEDREMFRTLMNDLNVPVPESDIVNTVEQAFKFKEQVGYPLIVRPAFTMGGTGGGICHNDEELHEIVSNGLHYSPATQCLLEKSIAGFKEIEYEVMRDKNDNAIVVCNMENIDPVGIHTGDSIVVAPSQTLSDVEYQMLRDVSLKVIRALGIEGGCNVQLALDPHSFDYYIIEVNPRVSRSSALASKATGYPIAKLAAKIAVGLTLDEMLNPITGTSYAAFEPTLDYVISKIPRFPFDKFEKGERELGTQMKATGEVMAIGRTYEESLLKAIRSLEYGVHHLGLPNGESFDLDYIKERISHQDDERLFFIGEAIRRGTTLEEIHNMTQIDYFFLHKFQNIIDIEHQLKEHQGDLEYLKYAKDYGFSDKTIAHRFNMTEEEVYQLRMENDIKPVYKMVDTCAAEFESSTPYYYGTYETENESIVTDKEKILVLGSGPIRIGQGVEFDYATVHAVWAIQKAGYEAIIVNNNPETVSTDFSISDKLYFEPLTEEDVMNIINLEKPKGVVVQFGGQTAINLADKLAKHGVKILGTSLENLNRAEDRKEFEALLRKINVPQPQGKTATSPEEALANAAEIGYPVVVRPSYVLGGRAMEIVDNDKELENYMTQAVKASPEHPVLVDRYLTGKEIEVDAICDGETVIIPGIMEHIERAGVHSGDSIAVYPPQTLTEDELATLEDYTIKLAKGLNIIGLINIQFVIAHDGVYVLEVNPRSSRTVPFLSKITDIPMAQLAMRAIIGEKLTDMGYQEGVQPYAEGVFVKAPVFSFNKLKNVDITLGPEMKSTGEVMGKDTTLEKALFKGLTGSGVEVKDHGTVLMTVSDKDKEEVVKLAQRLNEVGYKILATSGTANKLAEYDIPAEVVGKIGGENDLLTRIQNGDVQIVINTMTKGKEVERDGFQIRRTTVENGIPCLTSLDTANALTNVIESMTFTMRQM

SEQ ID NO: 997 - DNA, 1098 bp, Staphylococcus aureus
atgcaaagcaaacgttatctagtgttagaagacggttctttttacgaaggctaccgtttaggatctgataacttaactgtaggagaaattgtatttaatacagcgatgacaggttatcaagaaactatttcagatccatcatatacaggtcagatcattacttttacgtatccattaatcggtaattatggtatcaatagagacgattttgaatcattagtacctacattaaacggtattgtagtgaaagaagcgagtgcgcatccaagtaattttagacagcaaaagacacttcatgacgttttagaattgcatcaaattccagggattgcaggtgttgatacaagaagtattacgcgtaaaattcgacaacacggtgtgttaaaagctggttttactgatcgaaaagaagatattgatcaacttgtcaaacatttacaacaagtagaattacctaaaaacgaagtagaaatcgtttcgactaaaacaccgtatgtttcgacaggtaaggatctaagtgtcgtacttgtagactttggtaagaagcaaaatattgttcgagaattaaacgtcagaggttgtaacgtcacagttgtaccatatacaactactgccgaagaaattttagcaatggctccagatggcgttatgctatcaaacggaccaggtaatcctgaagttgtagaatgtgcgattccaatgattcaaggaattttagggaaaattccgttctttggtatctgtctaggacatcaactttttgcattatctcaaggagcaagctcatttaaaatgaagtttggtcatcgtggtgcgaaccatccagttaaaaatttagagactggaaaagttgatattacgagtcaaaaccatggatatgcaatagatatagattcgttaaaaagtactgatttagaagttactcatcttgcattaaatgatggtactgtagaaggtttaaaacataaaacattaccagcattttctgttcaataccatcctgaagcaaatccaggaccgtcagattcaaactatctatttgatgattttgtagcaatgatgactaattttaaggaaaaggagcgtcatatcaatgcc

SEQ ID NO: 998 - protein, 366 aa, Staphylococcus aureus
  MISC_FEATURE (1)..(366): carbamoyl-phosphate
MQSKRYLVLEDGSFYEGYRLGSDNLTVGEIVFNTAMTGYQETISDPSYTGQIITFTYPLIGNYGINRDDFESLVPTLNGIVVKEASAHPSNFRQQKTLHDVLELHQIPGIAGVDTRSITRKIRQHGVLKAGFTDRKEDIDQLVKHLQQVELPKNEVEIVSTKTPYVSTGKDLSVVLVDFGKKQNIVRELNVRGCNVTVVPYTTTAEEILAMAPDGVMLSNGPGNPEVVECAIPMIQGILGKIPFFGICLGHQLFALSQGASSFKMKFGHRGANHPVKNLETGKVDITSQNHGYAIDIDSLKSTDLEVTHLALNDGTVEGLKHKTLPAFSVQYHPEANPGPSDSNYLFDDFVAMMTNFKEKERHINA

SEQ ID NO: 999 - DNA, 1275 bp, Staphylococcus aureus
atgatgaaattaattaaaaacggtaaagtattacaaaatggcgaattacaacaagcagatattttaattgatggtaaggtaattaaacaaattgcacctgcaattgaaccaagcaatggtgttgacatcatagatgcgaaaggtcactttgtgtcacctggatttgtcgatgttcatgttcatttacgtgaacctggtggtgaatataaagagacaattgaaactggtactaaagctgctgctagaggcggatttacaactgtatgtccaatgcctaacacaagaccggtaccagattctgtagaacattttgaagctttacaaaaattaatcgatgacaatgctcaagtacgtgtattaccttatgcttcaattacaacacgtcaattaggtaaagaattggttgatttcccagcactagtaaaagaaggtgcctttgcgtttacagatgacggtgtaggagtacaaactgcaagcatgatgtatgaaggcatgattgaagctgcaaaagtaaacaaagccatcgtagcacactgtgaagataattcattaatctatggtggtgcaatgcatgaagggaaacgcagtaaagagttaggtataccaggtattccaaacatttgtgaatctgttcaaatcgcaagagatgtactattagctgaagcagcaggttgtcattatcatgtatgtcatgtttctactaaagaaagtgttagagtcattcgtgacgctaaacgcgcaggcattcatgttacagctgaagttacaccacaccatttattgttaacagaagatgatattcctggtaataatgccatttataaaatgaatccaccattgagaagtactgaagatagagaggctttgttagaagggttactagacggtacaattgactgtatcgcaacagaccatgcaccacatgcacgtgatgaaaaagcacaaccaatggaaaaagcaccattcggaattgttggtagtgaaacagcattcccattattatatacgcattttgtaaaaaatggtgattggacattacaacaattagtagattacttaacaattaaaccatgtgagacatttaatttagaatacggcacattaaaagaaaatggttatgcagatttaacaatcattgatttagatagtgaacaagaaattaaaggagaagatttcttatcaaaagcagataatacaccatttatcggctataaagtttatggaaatccgatcttaacaatggttgaaggcgaagttaaatttgagggggataaa

SEQ ID NO: 1000 - protein, 425 aa, Staphylococcus aureus
  MISC_FEATURE (1)..(425): dihydroorotase
MMKLIKNGKVLQNGELQQADILIDGKVIKQIAPAIEPSNGVDIIDAKGHFVSPGFVDVHVHLREPGGEYKETIETGTKAAARGGFTTVCPMPNTRPVPDSVEHFEALQKLIDDNAQVRVLPYASITTRQLGKELVDFPALVKEGAFAFTDDGVGVQTASMMYEGMIEAAKVNKAIVAHCEDNSLIYGGAMHEGKRSKELGIPGIPNICESVQIARDVLLAEAAGCHYHVCHVSTKESVRVIRDAKRAGIHVTAEVTPHHLLLTEDDIPGNNAIYKMNPPLRSTEDREALLEGLLDGTIDCIATDHAPHARDEKAQPMEKAPFGIVGSETAFPLLYTHFVKNGDWTLQQLVDYLTIKPCETFNLEYGTLKENGYADLTIIDLDSEQEIKGEDFLSKADNTPFIGYKVYGNPILTMVEGEVKFEGDK

SEQ ID NO: 1001 - DNA, 879 bp, Staphylococcus aureus
atgaatcatttattatcaatggaacatttatctacagatcaaatatacaaacttatccaaaaggcaagtcaatttaaatctggtgaacgtcaactaccaaactttgaagggaaatatgtcgcaaatttattctttgaaaattctactcgaacaaaatgtagttttgaaatggcagaacttaagctagggttaaaaacgattagctttgaaacatcaacatcatctgtttcaaaaggtgaatctttatatgacacatgtaaaactttagaaagtattggctgtgatttattagtcattagacatccgtttaataactactatgaaaaattagcgaatattaacatcccaattgcgaatgctggtgatggtagtggacaacatccaacacaaagtttacttgatttaatgacgatatatgaagaatatggatattttgaaggcttgaatgtattgatttgtggagacattaaaaattcacgtgtcgcacgtagtaattaccatagtttaaaagcattaggtgcaaacgtaatgtttaatagcccaaatgcttggattgatgattctttagaagcaccttatgtaaatatagatgatgttatagaaacagtagatatagttatgttattaagaattcaacatgaaaggcatgggcttgcagaagaaactagatttgcagcagatgattatcatcaaaagcatggcttaaatgaagtacgctataacaaattacaagaacatgctattgttatgcatccggcacctgtgaatagaggagtagaaatacaaagcgatttagtagaagcttcaaaatcaagaatttttaagcaaatggaaaatggcgtttacttaagaatggcagtcattgatgaattattaaaa

SEQ ID NO: 1002 - protein, 293 aa, Staphylococcus aureus
  MISC_FEATURE (1)..(293): aspartate transcarbamoylase
MNHLLSMEHLSTDQIYKLIQKASQFKSGERQLPNFEGKYVANLFFENSTRTKCSFEMAELKLGLKTISFETSTSSVSKGESLYDTCKTLESIGCDLLVIRHPFNNYYEKLANINIPIANAGDGSGQHPTQSLLDLMTIYEEYGYFEGLNVLICGDIKNSRVARSNYHSLKALGANVMFNSPNAWIDDSLEAPYVNIDDVIETVDIVMLLRIQHERHGLAEETRFAADDYHQKHGLNEVRYNKLQEHAIVMHPAPVNRGVEIQSDLVEASKSRIFKQMENGVYLRMAVIDELLK

SEQ ID NO: 1003 - DNA, 1314 bp, Staphylococcus aureus
atgaatattatgcaaaatgatgaaatgtttgaacgaacagtaaaacccgtactagatgtaaatgaaaaaccacaaccagcgcaatgggcatttttaagcttacaacatttatttgcgatgtttggcgcaacagtactagtaccattcttaacaggactaccaatatcagcagcgttactagcttcgggaatcggtacattactttatatcttaataacgaaggcgcaaataccagcatacttgggatctagctttgcatttatcacgccaattatcacgggattaagtacgcatagcttaggagacatgcttgtagcattattcatgagtggtgttatgtacgtcatcatcgggattctaatcaaattaagtgggacagcatggttaatgaaattattaccaccagttgttgttggaccagtcatcatggtaattggtttaagcttagcgcctactgcagtcaatatggcaatgtatgaaaatcctggagatatgaaaggttacaatatcagtttcttaattgttgcaatgataaccttgcttgtaacaatagtcgttcaaggattttttaaaggattcctatctttaattccagttcttgtaggtattatcgtaggttatgtggtagcgatttttatggggattgtgaaatttgatgcaattatgtcagcaaaatggatagatttccctcatatttatctgccatttaaagattatgtaccttcatttcacttaggacttgtacttgtaatgattccgattgtgttcgtaacagtaagtgaacatattgggcaccaaatggtattgaataaaatcgtaggtagaaacttctttgaaaagccaggacttgataaatcaatcattggtgatggtgtttctacaatgtttgccagtattattggtggaccaccaagtacaacatacggtgaaaatatcggtgtattagcgattaccagaatatacagtatttacgtcattggtggtgcagcagttatagcaattgttttagcattcattggtaagttcactgcattaatttcttctatacctacaccagttatgggaggagtatctatattacttttcggtattattgcagcaagtggcttaagaatgttagttgaaagcaaagtagattttgcgaacaatcgaaatttagttatagcttctgtaattttagttgtaggtatcggtaatttagtatttaacttaaaagaaattggtatcaaccttcaaattgaggggatggcattagctgcactttcaggaattattttgaacttaatcttacctaaagagaaaaaacaaaacaat

SEQ ID NO: 1004 - protein, 438 aa, Staphylococcus aureus
  MISC_FEATURE (1)..(438): uracil permease
MNIMQNDEMFERTVKPVLDVNEKPQPAQWAFLSLQHLFAMFGATVLVPFLTGLPISAALLASGIGTLLYILITKAQIPAYLGSSFAFITPIITGLSTHSLGDMLVALFMSGVMYVIIGILIKLSGTAWLMKLLPPVVVGPVIMVIGLSLAPTAVNMAMYENPGDMKGYNISFLIVAMITLLVTIVVQGFFKGFLSLIPVLVGIIVGYVVAIFMGIVKFDAIMSAKWIDFPHIYLPFKDYVPSFHLGLVLVMIPIVFVTVSEHIGHQMVLNKIVGRNFFEKPGLDKSIIGDGVSTMFASIIGGPPSTTYGENIGVLAITRIYSIYVIGGAAVIAIVLAFIGKFTALISSIPTPVMGGVSILLFGIIAASGLRMLVESKVDFANNRNLVIASVILVVGIGNLVFNLKEIGINLQIEGMALAALSGIILNLILPKEKKQNN

SEQ ID NO: 1005 - DNA, 525 bp, Staphylococcus aureus
atgtctgaacgtatcataatggatgatgccgcaatacaacgtacagtgacgagaatcgctcacgaaattttggagtataacaaaggtactgataatttaattcttttaggtatcaaaacaagaggtgaatatttagcgaatcgtatacaagataaaattcatcaaattgagcaacaacgtatacctactggaacaattgatattacatactttagagatgatatagagcacatgtcatcacttacgacaaaagacgcaatagacatcgacacagatattacagataaagtagtcatcattattgacgatgtgctgtatactggtcgaacggttcgtgcttcacttgatgctattttgctaaatgctagacctattaaaattggtttagctgctttggttgatcgaggacatcgtgagttaccaattcgagcagattttgttggtaaaaatatacctacttctaaagaggaaacggtaagtgtctatttagaagaaatggatcaaagaaatgcagttataattaaa

SEQ ID NO: 1006 - protein, 175 aa, Staphylococcus aureus
  MISC_FEATURE (1)..(175): pyrimidine operon repressor
MSERIIMDDAAIQRTVTRIAHEILEYNKGTDNLILLGIKTRGEYLANRIQDKIHQIEQQRIPTGTIDITYFRDDIEHMSSLTTKDAIDIDTDITDKVVIIIDDVLYTGRTVRASLDAILLNARPIKIGLAALVDRGHRELPIRADFVGKNIPTSKEETVSVYLEEMDQRNAVIIK

SEQ ID NO: 1007 - DNA, 915 bp, Staphylococcus aureus
atggagacttatgaatttaacattacagataaagaacaaacaggtatgcgtgtagataagttgctgcctgaattaaataatgattggtctcgtaaccagatacaagattggattaaagcaggtttagtcgttgcaaacgataaagttgttaaatctaattataaagtgaaacttaatgatcatatagttgtcactgaaaaagaagtggttgaagctgatattctacctgaaaatttaaatttagatatttattatgaagatgacgatgttgcagttgtatataaaccgaaaggcatggtagttcatccatcaccagggcattataccaatacattagttaatggtttaatgtatcaaattaaaaatttgtcaggtattaatggagaaattcgtccaggtattgttcaccgtatagatatggatacttctggtttattaatggttgctaaaaatgatattgctcatcgtgggcttgtagaacaattaatggataaatctgttaaaagaaaatatatcgctttagttcacgggaatattcctcatgattacggtacaatcgatgcgccaattggtagaaacaaaaatgatcgtcaatctatggctgttgttgatgatggtaaggaagcagtgacacattttaacgtactagaacattttaaagattatacgcttgttgaatgtcaacttgaaacaggacgtacgcatcaaatccgtgttcacatgaaatatattggcttcccattagttggtgatccaaagtatggaccgaaaaagacattggatattggtggtcaagctctacatgctggacttattggattcgaacatccagtaacaggtgaatatattgaaagacatgctgaattaccacaagactttgaagatttattagatacaattcgaaaaagagatgca

SEQ ID NO: 1008 - protein, 305 aa, Staphylococcus aureus
  MISC_FEATURE (1)..(305): conserved hypothetical
METYEFNITDKEQTGMRVDKLLPELNNDWSRNQIQDWIKAGLVVANDKVVKSNYKVKLNDHIVVTEKEVVEADILPENLNLDIYYEDDDVAVVYKPKGMVVHPSPGHYTNTLVNGLMYQIKNLSGINGEIRPGIVHRIDMDTSGLLMVAKNDIAHRGLVEQLMDKSVKRKYIALVHGNIPHDYGTIDAPIGRNKNDRQSMAVVDDGKEAVTHFNVLEHFKDYTLVECQLETGRTHQIRVHMKYIGFPLVGDPKYGPKKTLDIGGQALHAGLIGFEHPVTGEYIERHAELPQDFEDLLDTIRKRDA

SEQ ID NO: 1009 - DNA, 522 bp, Staphylococcus aureus
ttgtctcatggacgattgattggaggaacgaaaatgcacaaaaaatattttattggcacttccattttaatagcagtatttgtcgttatatttgaccaagttactaaatatattatagctactacaatgaaaattggagattcatttgaagtgataccgcactttttaaacataacatcacatcgaaataatggtgctgcatggggaatattgagtggaaaaatgacatttttctttattattaccattattatattaatagccttagtatatttctttattaaagatgctcaatataatttgtttatgcaagttgctattagtttactttttgcaggtgcacttggaaactttattgatagaattttaacaggagaagttgttgactttattgatacaaatatttttggttatgattttccaatatttaatatcgcagattcaagtttaacaattggtgtaatattaattattattgccttattaaaggatacttccaataaaaaggagaaggaggttaag

SEQ ID NO: 1010 - protein, 174 aa, Staphylococcus aureus
  MISC_FEATURE (1)..(174): lipoprotein signal
LSHGRLIGGTKMHKKYFIGTSILIAVFVVIFDQVTKYIIATTMKIGDSFEVIPHFLNITSHRNNGAAWGILSGKMTFFFIITIIILIALVYFFIKDAQYNLFMQVAISLLFAGALGNFIDRILTGEVVDFIDTNIFGYDFPIFNIADSSLTIGVILIIIALLKDTSNKKEKEVK

SEQ ID NO: 1011 - DNA, 1140 bp, Staphylococcus aureus
atgttctatatggaggcagtaatgaaaattatacatacagcagactggcacttagggaaaatattaaatggcaaacagcttttagaagatcaagcgtatattttagatatgttcgtagaaaaaatgaaagaagaagaacctgatatcattgtgatagctggagatttatatgacacaacatatccaagtaaagatgcaatcatgttattagaacaagcgattggaaagttaaatttagaactgcgtataccaataattattattagtggaaatcacgatggtaaagagaggttaaactatggggcgagttggtttgaacataatcagttatttataagaacagattttacatcgattaattcaccaatagagataaatggggttaatttttatacactcccttatgctactgtgagcgaaatgaaacactactttgaagatgacaccattgaaacacatcaacagggaattacgcgctgtattgaaacaatagcaccggaaattgatgaagatgccgtcaatattttaattagtcatctgactgttcaaggtggaaagacatctgattctgaaagaccattaactattggaacggttgaatcagttcagaaaggtgtttttgatatatttgattatgtcatgctaggtcacttgcatcatccatttagtatagaagacgacaaaattaaatatagtggctccttattgcagtattcattttcggaagcgggtcaagctaaagggtatagacgtgtaacaattaatgatggcattattaacgatgtatttattcctcttaagccacttagacaattggaaattatctcaggcgaatataatgatgttattaatgaaaaagttcatgtgaaaaataaagataattatttacattttaaacttaaaaatatgtctcatattactgatccaatgatgagtttaaaacaaatttatcctaatactttagcgctgacgaatgaaacttttaattacaatgaagaaaataatgctatagaaataagtgaaaaagatgacatgtcaattatcgaaatgttttataaacatataactgataaagaattatcggatatccaatctaaaaagataaaaaatattttagaaaacgaattgagaaaggaggat

SEQ ID NO: 1012 - protein, 380 aa, Staphylococcus aureus
  MISC_FEATURE (1)..(380): hypothetical protein
MFYMEAVMKIIHTADWHLGKILNGKQLLEDQAYILDMFVEKMKEEEPDIIVIAGDLYDTTYPSKDAIMLLEQAIGKLNLELRIPIIIISGNHDGKERLNYGASWFEHNQLFIRTDFTSINSPIEINGVNFYTLPYATVSEMKHYFEDDTIETHQQGITRCIETIAPEIDEDAVNILISHLTVQGGKTSDSERPLTIGTVESVQKGVFDIFDYVMLGHLHHPFSIEDDKIKYSGSLLQYSFSEAGQAKGYRRVTINDGIINDVFIPLKPLRQLEIISGEYNDVINEKVHVKNKDNYLHFKLKNMSHITDPMMSLKQIYPNTLALTNETFNYNEENNAIEISEKDDMSIIEMFYKHITDKELSDIQSKKIKNILENELRKED

SEQ ID NO: 1013 - DNA, 207 bp, Staphylococcus aureus
ttgagtttcactcgaatgtcagttcgaggaataaataaagttaaacgagagctaggttttgtattaatggcaattaatataaggaaaatagcagctcaacgagctgtacattataaaatacatatcaaaaaagctgatttctatcaaataattaatagaaatcagctttttacattgcctaagaacttaatgtcccagcctccttca

SEQ ID NO: 1014 - protein, 69 aa, Staphylococcus aureus
  MISC_FEATURE (1)..(69): truncated transposase
LSFTRMSVRGINKVKRELGFVLMAINIRKIAAQRAVHYKIHIKKADFYQIINRNQLFTLPKNLMSQPPS

SEQ ID NO: 1015 - DNA, 795 bp, Staphylococcus aureus
atgtatcataacagtaacgcaaactttgtcaatggtatcactttaaatgtgagagataagaatgaattaaagccattttatgaggacatattaggattaaatattataaatgagacattaacatcgatacaatatgaagtaggtcaaaataatcatgtcattacacttgttgaattacaaaatggacgtgaacctttaatgtccgaagcgggactgtttcatatcgcaattaaactacctcaaattagtgatttagctaatttactaattcatttaagcgaatatgatattccagttaacggaggtatacagcctgcttcgttatcattattttttgaagacccggaaggaaacggttttaaattttatgttgataaagacgaagcgcaatggacgaggcaaaataatttagtaaaaattgatattagaccattaaatgtaccgagattagtgagtcatgcaacaaaattgttatggttaggtattccagatgacgctattataggtgcattgcatattaagacaattcatttatcagaggtaaaagagtactacctcgattattttggattagagcaatcggcatatatggatgattattcaatatttttagcatcgaatggctattatcaacatttggccatgaatgattgggtatcagcaacgaaacgtgtagaaaattttgatacgtatggattagcaattgttgactttcattatcctgaaacaacacatttaaatttacaaggtccggatggtatctattatcgctttaatcatatcgaagttgaagat

SEQ ID NO: 1016 - protein, 265 aa, Staphylococcus aureus
  MISC_FEATURE (1)..(265): conserved hypothetical
MYHNSNANFVNGITLNVRDKNELKPFYEDILGLNIINETLTSIQYEVGQNNHVITLVELQNGREPLMSEAGLFHIAIKLPQISDLANLLIHLSEYDIPVNGGIQPASLSLFFEDPEGNGFKFYVDKDEAQWTRQNNLVKIDIRPLNVPRLVSHATKLLWLGIPDDAIIGALHIKTIHLSEVKEYYLDYFGLEQSAYMDDYSIFLASNGYYQHLAMNDWVSATKRVENFDTYGLAIVDFHYPETTHLNLQGPDGIYYRFNHIEVED

SEQ ID NO: 1017 - DNA, 2760 bp, Staphylococcus aureus
gtgaaaaaaatggattacaaagaaacgttattaatgcctaaaacagatttcccaatgcgaggtggtttaccaaacaaggaaccgcaaattcaagaaaaatgggatgcagaagatcaataccataaagcgttagaaaaaaataaaggtaacgaaacattcattttacatgatggcccaccatacgcgaatggtaacttacatatgggacatgccttgaacaaaattttaaaagactttattgtacgttataaaactatgcaagggttctatgcaccatacgtaccaggttgggatacacatggtttaccaattgaacaagcattaacgaaaaaaggtgttgaccgaaagaaaatgtcaacagctgaattccgtgagaaatgtaaagaatttgctttagaacaaattgaattacagaaaaaagattttagacgtttaggtgttcgtggtgactttaatgatccatatattacattaaaacctgaatacgaagctgcacaaattcgtatttttggagaaatggcagataaaggtttaatttataaaggtaaaaagccagtttattggtctccttcaagtgagtcttcattagcagaagcagaaattgaatatcacgataaacgttcagcatcaatttacgttgcatttgacgttaaagatgacaaaggtgtcgttgatgcagatgctaaatttattatctggacaacaacgccatggacaattccatcaaatgttgcgattaccgttcatcctgaattaaaatatggtcaatacaatgtaaatggcgaaaaatatattattgcagaagccttgtctgacgctgtagcagaagcactggattgggataaagcatcaatcaaattagaaaaagaatacacaggtaaagaattagagtatgttgtagcacaacatccattcttagacagagaatcgttagtgattaatggtgatcatgttactacagatgctggtacaggttgtgtacatacagcaccaggtcacggggaagatgactatattgttggtcaaaaatatgaattgccagtaattagtccaatcgatgataaaggtgtatttactgaagaaggcggccaatttgaagggatgttctatgataaagctaataaagccgttactgatttattaacagaaaaaggtgcactattaaaattagactttattacacatagctatccacacgactggagaacaaaaaaacctgtaatcttccgtgctacaccacaatggtttgcctcaatcagtaaagtaagacaagatattttagatgcaatcgaaaatacaaacttcaaagtaaattggggtaaaacacgtatttacaatatggttcgtgaccgtggcgaatgggttatttctcgtcaacgtgtgtggggtgtaccgttaccagtattttatgctgaaaatggcgaaattatcatgacgaaagaaacagtgaatcatgttgctgatttatttgcagaacacggttcaaatatttggtttgaaagagaagcgaaagacttactaccagaaggatttacacatccaggcagccctaacggtacatttactaaagaaacagacattatggacgtttggtttgattctggttcatcacaccgtggcgtgttggaaacaagaccggaattaagtttcccagcggatatgtatttagaaggtagtgaccaatatcgtggttggttcaactcttctatcacaacttcagttgctacaagaggagtatcaccttataaattcttactttctcatggttttgttatggacggtgaaggtaagaaaatgagtaaatctttaggtaatgtgattgtacctgaccaagtggttaaacaaaaaggtgctgatattgcgagactttgggtaagtagtacggactatttagctgatgttagaatttctgatgaaattttaaaacaaacatctgatgtttatcgtaaaatcagaaatacattaagatttatgttaggtaacattaacgatttcaatcctgacacagatagcattcctgaatcagagttattagaagtggatcgttacttgctaaatcgtttacgtgaatttactgcaagtacgattaacaactatgaaaactttgactacttaaatatttatcaagaagttcaaaactttatcaatgttgagttaagtaatttctatttggattacggtaaagatattttatatattgaacaacgtgattctcatatccgtcgtagtatgcaaacagtgttatatcaaattttagttgatatgacgaagttgttagcaccaatcttagtgcatacagctgaagaagtttggtctcatacaccacatgttaaagaagaaagtgttcacttagcagacatgcctaaagttgtagaagtagatcaagctttattggataaatggcgtacatttatgaatttacgtgatgatgtgaaccgtgcattagaaactgctcgtaatgaaaaagttattggtaaatcattagaagctaaagttacgattgctagtaacgataaatttaatgcatctgaattcttaacttcatttgatgcattacatcaattatttatcgtgtcacaagttaaagttgtagataagttagacgatcaggcaacagcttatgaacatggtgatattgtcatcgaacatgcagatggtgaaaaatgtgaaagatgttggaactattcagaggatcttggtgctgttgatgaattgacgcatctatgtccacgatgccaacaagttgtaaaatcacttgta

SEQ ID NO: 1018 - protein, 920 aa, Staphylococcus aureus
  MISC_FEATURE (1)..(920): Ile-tRNA synthetase
VKKMDYKETLLMPKTDFPMRGGLPNKEPQIQEKWDAEDQYHKALEKNKGNETFILHDGPPYANGNLHMGHALNKILKDFIVRYKTMQGFYAPYVPGWDTHGLPIEQALTKKGVDRKKMSTAEFREKCKEFALEQIELQKKDFRRLGVRGDFNDPYITLKPEYEAAQIRIFGEMADKGLIYKGKKPVYWSPSSESSLAEAEIEYHDKRSASIYVAFDVKDDKGVVDADAKFIIWTTTPWTIPSNVAITVHPELKYGQYNVNGEKYIIAEALSDAVAEALDWDKASIKLEKEYTGKELEYVVAQHPFLDRESLVINGDHVTTDAGTGCVHTAPGHGEDDYIVGQKYELPVISPIDDKGVFTEEGGQFEGMFYDKANKAVTDLLTEKGALLKLDFITHSYPHDWRTKKPVIFRATPQWFASISKVRQDILDAIENTNFKVNWGKTRIYNMVRDRGEWVISRQRVWGVPLPVFYAENGEIIMTKETVNHVADLFAEHGSNIWFEREAKDLLPEGFTHPGSPNGTFTKETDIMDVWFDSGSSHRGVLETRPELSFPADMYLEGSDQYRGWFNSSITTSVATRGVSPYKFLLSHGFVMDGEGKKMSKSLGNVIVPDQVVKQKGADIARLWVSSTDYLADVRISDEILKQTSDVYRKIRNTLRFMLGNINDFNPDTDSIPESELLEVDRYLLNRLREFTASTINNYENFDYLNIYQEVQNFINVELSNFYLDYGKDILYIEQRDSHIRRSMQTVLYQILVDMTKLLAPILVHTAEEVWSHTPHVKEESVHLADMPKVVEVDQALLDKWRTFMNLRDDVNRALETARNEKVIGKSLEAKVTIASNDKFNASEFLTSFDALHQLFIVSQVKVVDKLDDQATAYEHGDIVIEHADGEKCERCWNYSEDLGAVDELTHLCPRCQQVVKSLV

SEQ ID NO: 1019 - DNA, 615 bp, Staphylococcus aureus
atgccttttacaccaaatgaaattaagaataaagagttttcacgtgtaaagaatggtttagaacctactgaagttgctaattttttggagcaactaagcactgaaattgaacgtcttaaagaagataaaaaacaacttgaaaaagtaatcgaagagagagatactaatattaagtcttatcaagacgtgcatcaatctgtaagtgatgctttgatacaagctcaaaaagctggtgaagaaactaagcaagctgcagagaaacaagctgaagcgattatagctaaggcagaagcgcaagctaatcaaatggttggtgacgcggtagaaaaagcacgccgtttagcattccagactgaagatatgaaacgtcaatcaaaagtatttagatcgcgtttccgtatgttagttgaagcgcaattagacttattaaaaaacgaagattgggattacttgttgaattatgatttagacgctgaacaagtgacgcttgaaaatattcatcatttgcatgaaaatgatttaaagccagatgaagttgcagcaaatgcacaaaataatgcatcaaatacaccagacaataatcaacaatccaatgattcagaaacaactaagaag

SEQ ID NO: 1020 - protein, 205 aa, Staphylococcus aureus
  MISC_FEATURE (1)..(205): hypothetical protein
MPFTPNEIKNKEFSRVKNGLEPTEVANFLEQLSTEIERLKEDKKQLEKVIEERDTNIKSYQDVHQSVSDALIQAQKAGEETKQAAEKQAEAIIAKAEAQANQMVGDAVEKARRLAFQTEDMKRQSKVFRSRFRMLVEAQLDLLKNEDWDYLLNYDLDAEQVTLENIHHLHENDLKPDEVAANAQNNASNTPDNNQQSNDSETTKK

SEQ ID NO: 1021 - DNA, 804 bp, Staphylococcus aureus
atggtattttataatttttttaaggtagtgattaacatagatatttatcaacactttagacaggaagaatacgaattaattgatcagctaacggataaatgtgatcaagcggaacagcattatgcaccagtattaacgcattttttagatccaagagggcaatatatattggaagtgatttgtggcagttatgaagatttaaacgtatctttttatggtggacctaatgctgaaagaaaaagagcaatcatttcgccgaactattatgaacctaaagaaagcgactttgaattaactttaatggaaatagattatcctgaaaaattcgtcactttaaaacatcaacatattttagggacattaatgtctttaggtatcgaacgcgaacaagttggagatataattgtgaatgaacgaattcaatttgttttgacaagtagattggaatcatttattatgttagaattacaacgtattaaaggcgcatcagttaaactttatactattccagtaacagatatgatacaatctaatgagaattggaaaaatgaaagtgcaacagttagttctttaaggttagatgttgttattaaagaaatgatacgtaaatcacgtacgattgcgaaacaactaatcgaaaaaaaacgtgttaaagtgaatcacactattgttgattcagcagattttcaattacaagcaaatgatttaatatccatccaaggttttggtagagcacacattactgacttaggtggtaaaactaaaaaagataaaacgcacattacctatagaacattattcaaa

SEQ ID NO: 1022 - protein, 268 aa, Staphylococcus aureus
  MISC_FEATURE (1)..(268): hypothetical protein
MVFYNFFKVVINIDIYQHFRQEEYELIDQLTDKCDQAEQHYAPVLTHFLDPRGQYILEVICGSYEDLNVSFYGGPNAERKRAIISPNYYEPKESDFELTLMEIDYPEKFVTLKHQHILGTLMSLGIEREQVGDIIVNERIQFVLTSRLESFIMLELQRIKGASVKLYTIPVTDMIQSNENWKNESATVSSLRLDVVIKEMIRKSRTIAKQLIEKKRVKVNHTIVDSADFQLQANDLISIQGFGRAHITDLGGKTKKDKTHITYRTLFK

SEQ ID NO: 1023 - DNA, 288 bp, Staphylococcus aureus
atggatataaatgtgctagctacaatatttaaattcatcctttttgttgttgaaatttattatttcggcatgattatatatttctttacatcttgggtaccaagtattagagaaactaaggtaggttattttttagcgaaaatatatgaacctttcttacaaccatttagaaaagtaattccacctattggaattatcgacatatcatcaatcgctgcaattatcgttttagtattattccaaaaagggttactccaaatctttaattggattttaattcaattacaa

SEQ ID NO: 1024 - protein, 96 aa, Staphylococcus aureus
  MISC_FEATURE (1)..(96): conserved hypothetical
MDINVLATIFKFILFVVEIYYFGMIIYFFTSWVPSIRETKVGYFLAKIYEPFLQPFRKVIPPIGIIDISSIAAIIVLVLFQKGLLQIFNWILIQLQ

SEQ ID NO: 1025 - DNA, 561 bp, Staphylococcus aureus
gtgagccacttggctttaaaagatttatttagtggattttttgtaatagatgatgaagaggaagtagaagtacctgacaaacaacaacaggtaaatgaagcgccagcaaaagagcagtcacaacaaacaacaaaacaaaacgcaatcaaatcagtccctcaaaaatctgcatcaagatatacaacaacgtcagaagaaaggaataaccgtatgtctaattattcaaaaaataattcacgtaatgttgtaactatgaacaatgctacaccaaacaatgcatcacaagaaagttcaaaaatgtgtttattcgaaccacgtgttttttcagatacacaagatattgctgatgagcttaaaaaccgccgtgcgacacttgtcaatttacaacgtattgataaagtatcagcgaaaagaattattgattttttaagcggtactgtttatgcaatcggtggagatatccaacgtgtaggtactgatattttcttatgtacgcctgataatgtggaagtagctggaagcattacagaccatattgaaaatatggaacattcattcgac

SEQ ID NO: 1026 - protein, 187 aa, Staphylococcus aureus
  MISC_FEATURE (1)..(187): conserved hypothetical
VSHLALKDLFSGFFVIDDEEEVEVPDKQQQVNEAPAKEQSQQTTKQNAIKSVPQKSASRYTTTSEERNNRMSNYSKNNSRNVVTMNNATPNNASQESSKMCLFEPRVFSDTQDIADELKNRRATLVNLQRIDKVSAKRIIDFLSGTVYAIGGDIQRVGTDIFLCTPDNVEVAGSITDHIENMEHSFD

SEQ ID NO: 1027 - DNA, 672 bp, Staphylococcus aureus
ttgcgtgtgaaagataatttacaacaaatctcaacacaaattaatgacaaaagtgaaaaaaataatttttcaacaaaaccaaacgtgattgcagttacaaaatatgttacaatagagcgagctaaagaagcgtatgaggctggaataagacattttggtgagaatagattggaaggcttttttcaaaagaaagaagcattaccatcagatgcggtgatccattttataggatcattacaatctcgaaaagttaaggacgttataaacgacgtagattatttccatgctttagatcgattgagcttagccaaagaaattaacaaacgtgcagaacataaaattaaatgtttcttgcaagtgaacgtttcgggagaagcttctaaacatggtattgctttagaagatgttgatcagtttatagatgatcttaaaaaatatgacaaaatcgaaattgtaggtttaatgacgatggcaccattgacagatgatgaagcatatattagatcgttatttaaacagttacgtttgaaaaaagaagaaatacaacgactcaatttagaatatgcgccttgtgatgaattatcaatgggaatgagtaatgactatcttattgcagttgaagaaggtgcgacgtttgttagaattgggactaaacttgtaggagaagaggag

SEQ ID NO: 1028 - protein, 224 aa, Staphylococcus aureus
  MISC_FEATURE (1)..(224): conserved hypothetical
LRVKDNLQQISTQINDKSEKNNFSTKPNVIAVTKYVTIERAKEAYEAGIRHFGENRLEGFFQKKEALPSDAVIHFIGSLQSRKVKDVINDVDYFHALDRLSLAKEINKRAEHKIKCFLQVNVSGEASKHGIALEDVDQFIDDLKKYDKIEIVGLMTMAPLTDDEAYIRSLFKQLRLKKEEIQRLNLEYAPCDELSMGMSNDYLIAVEEGATFVRIGTKLVGEEE

SEQ ID NO: 1029 - DNA, 789 bp, Staphylococcus aureus
gtgaatgataattttaaaaagcaaccgcatcatttaatatatgaagagttattacaacaaggtattactctaggtattacaactagaggagatggtttaagtgactatcctaaaaatgcttttaatatggcgagatatattgatgatcgcccatataatattactcaacatcaattgcaattagctgaagaaattgcgtttgatagaaaaaattgggtgtttcccattcaaacacatgaaaataaagtcgcttgtattacaaaggatgatataggcacaaatatagacactttaactgatgcgcttcatggtattgatgcgatgtacacatatgatagtaatgtcttattaacgatgtgttatgcagactgtgtaccagtatatttttatagtacaaaacatcattttattgcattggcgcatgcaggttggcgtggtacctatactgaaattgtaaaagaagtgctaaaacatgtgaactttgatttgaaagacttacatgtcgttattggaccatctacatcatcaagttatgaaattaatgatgatattaaaaataaatttgaaacattgccaattgatagtgccaactatattgaaactagaggacgagatcgtcatggtattgatttgaaaaaagccaatgctgcattattaatttattatggtgttcctaaagaaaatatttatacgacagcgtatgctacatctgaacatttagaattatttttctcttatcgattagaaaaaggtcaaacaggacgcatgttagcattcattggtcaacag

SEQ ID NO: 1030 - protein, 263 aa, Staphylococcus aureus
  MISC_FEATURE (1)..(263): conserved hypothetical
VNDNFKKQPHHLIYEELLQQGITLGITTRGDGLSDYPKNAFNMARYIDDRPYNITQHQLQLAEEIAFDRKNWVFPIQTHENKVACITKDDIGTNIDTLTDALHGIDAMYTYDSNVLLTMCYADCVPVYFYSTKHHFIALAHAGWRGTYTEIVKEVLKHVNFDLKDLHVVIGPSTSSSYEINDDIKNKFETLPIDSANYIETRGRDRHGIDLKKANAALLIYYGVPKENIYTTAYATSEHLELFFSYRLEKGQTGRMLAFIGQQ

SEQ ID NO: 1031 - DNA, 465 bp, Staphylococcus aureus
gtgctctatttaatattttcaatcattgtagctttatttatgggaactatagttatagttattcgtatgaaagctcaaaattatccggtaaatgagaaaaaaatagttttgccaccgttttttatggcgaccggtgcattgatgtacgtcgttccatattttaggctaacaggatcggaaatgctagaagcctttataattggtttgcttttttctacagttctaatttggacttctcgatttgaagtcaaaggtacagaaatttatatgaaacgatctaaagcatttccagttattttgatttcattacttatcattcgtactgtgatgaaaatattcattagtaatgaaatagatcctggagaattaggcggcatgttctttttattagcattctgtatgattgttccttggagagcagcaatgctatataaatacaaaaaactaaagaaaacattaatcaat

SEQ ID NO: 1032 - protein, 155 aa, Staphylococcus aureus
  MISC_FEATURE (1)..(155): conserved hypothetical
VLYLIFSIIVALFMGTIVIVIRMKAQNYPVNEKKIVLPPFFMATGALMYVVPYFRLTGSEMLEAFIIGLLFSTVLIWTSRFEVKGTEIYMKRSKAFPVILISLLIIRTVMKIFISNEIDPGELGGMFFLLAFCMIVPWRAAMLYKYKKLKKTLIN

SEQ ID NO: 1033 - DNA, 1170 bp, Staphylococcus aureus
atgttagaatttgaacaaggatttaatcatttagcgactttaaaggtcattggtgtaggtggtggcggtaacaacgccgtaaaccgaatgattgaccacggaatgaataatgttgaatttatcgctatcaacacagacggtcaagctttaaacttatctaaagctgaatctaaaatccaaatcggtgaaaaattaacacgtggtttaggagcaggagctaatcctgaaatcggtaaaaaagctgcagaggaatctcgtgaacaaattgaagatgcaatccaaggtgcagacatggtatttgttacttctggtatgggtggcggaactggtactggtgcagcaccagtcgttgctaaaattgcaaaagaaatgggcgcattaactgttggtgttgtaactcgtccatttagttttgaaggacgtaaacgtcaaactcaagctgctgctggagtagaagctatgaaagctgcagtagatacattaatcgttataccaaatgaccgtttattagatatcgttgacaaatctacgccaatgatggaagcatttaaagaagctgacaacgtgttacgccaaggtgtacaaggtatctcagacttaatcgctgtttctggtgaagtaaacttagactttgcagacgttaagacaattatgtctaaccaaggttctgcattaatgggtattggtgtttcttctggtgaaaatagagcggtagaagctgctaaaaaagcaatctcttctccattacttgaaacatctatcgttggtgcacaaggtgtgcttatgaatattactggtggcgagtcattgtcattatttgaagcacaagaggctgctgatattgtccaagatgctgcagatgaagacgttaatatgattttcggtacagttattaatcctgaattacaagatgagattgttgtaacagttattgcaactggttttgatgacaaaccaacatcacatggtcgtaaatctggtagcactggattcggaacaagcgtaaatacttctagcaatgcaacttctaaagatgaatcattcacttcaaattcatcaaatgcacaagcaactgatagtgtaagtgaaagaacacatacaactaaagaagatgatattcctagcttcattagaaatagagaagaaagacgttcaagaagaacaagacgt

SEQ ID NO: 1034 - protein, 390 aa, Staphylococcus aureus
  MISC_FEATURE (1)..(390): cell division protein
MLEFEQGFNHLATLKVIGVGGGGNNAVNRMIDHGMNNVEFIAINTDGQALNLSKAESKIQIGEKLTRGLGAGANPEIGKKAAEESREQIEDAIQGADMVFVTSGMGGGTGTGAAPVVAKIAKEMGALTVGVVTRPFSFEGRKRQTQAAAGVEAMKAAVDTLIVIPNDRLLDIVDKSTPMMEAFKEADNVLRQGVQGISDLIAVSGEVNLDFADVKTIMSNQGSALMGIGVSSGENRAVEAAKKAISSPLLETSIVGAQGVLMNITGGESLSLFEAQEAADIVQDAADEDVNMIFGTVINPELQDEIVVTVIATGFDDKPTSHGRKSGSTGFGTSVNTSSNATSKDESFTSNSSNAQATDSVSERTHTTKEDDIPSFIRNREERRSRRTRR

SEQ ID NO: 1035 - DNA, 1410 bp, Staphylococcus aureus
atggaagaacattactacgtaagtattgatattggatcatcaagcgtaaaaacaatagtaggcgagaaatttcacaatggtataaatgtgataggtacaggacaaacctacacgagcggtataaaaaatggtttaattgatgattttgatattgcgcgacaagcaatcaaagacacaattaaaaaggcatcaatcgcttcgggtgttgatattaaagaagttttcctgaaattacctatcattggaacggaagtttatgatgaatcaaatgaaatcgacttttatgaggatacagaaatcaacggttcacatatcgaaaaagtattagaaggtattagagaaaaaaatgatgtgcaagaaacagaagtaattaatgtgttcccgattcgttttatagtcgataaagaaaatgaggtttcagaccctaaagaattaattgccagacattcattaaaggttgaagcaggcgtaattgctattcaaaaatcgattttaattaatatgattaaatgcgtagaagcatgtggtgttgatgtattagatgtttactctgatgcatataactatggttcaatcctaacagctactgaaaaagagttaggtgcatgtgtcattgatattggtgaagacgttacgcaagttgctttttatgaacgcggtgaattagtagatgctgattctatcgaaatggcagggcgtgatattacagacgatattgcacaaggattaaacacttcttatgaaactgctgaaaaagttaaacaccaatatggtcatgcattctatgattctgcttcagatcaagatatcttcactgttgaacaggttgatagtgatgaaacagtacagtatactcaaaaagatttgagtgactttattgaagcgcgtgtagaagaaatattcttcgaagtatttgatgttttacaagatttaggattaacaaaagtaaatggtgggtttattgtaactggtggatctgcaaacttacttggcgtaaaagaattattatcagatatggtaagtgaaaaagttagaattcacacgccatcacaaatgggaattagaaaacctgaattttcttcagcaatttctacaatttctagtagtatcgcttttgatgagttattagattatgttacaattaattatcatgataatgaagaaactgaagaagatgttattgatgtgaaagacaaagataacgaatctaaattaggcggatttgattggtttaaacgtaaaacaaacaaaaaagatactcatgaaaatgaagtagagtcaacagatgaagaaatttatcaatcagaagataatcatcaggaacataaacagaatcatgaacatgttcaagacaaagataaagataaagaagaaagtaaattcaaaaaactaatgaaatctctatttgaa

SEQ ID NO: 1036 - protein, 470 aa, Staphylococcus aureus
  MISC_FEATURE (1)..(470): cell division protein
MEEHYYVSIDIGSSSVKTIVGEKFHNGINVIGTGQTYTSGIKNGLIDDFDIARQAIKDTIKKASIASGVDIKEVFLKLPIIGTEVYDESNEIDFYEDTEINGSHIEKVLEGIREKNDVQETEVINVFPIRFIVDKENEVSDPKELIARHSLKVEAGVIAIQKSILINMIKCVEACGVDVLDVYSDAYNYGSILTATEKELGACVIDIGEDVTQVAFYERGELVDADSIEMAGRDITDDIAQGLNTSYETAEKVKHQYGHAFYDSASDQDIFTVEQVDSDETVQYTQKDLSDFIEARVEEIFFEVFDVLQDLGLTKVNGGFIVTGGSANLLGVKELLSDMVSEKVRIHTPSQMGIRKPEFSSAISTISSSIAFDELLDYVTINYHDNEETEEDVIDVKDKDNESKLGGFDWFKRKTNKKDTHENEVESTDEEIYQSEDNHQEHKQNHEHVQDKDKDKEESKFKKLMKSLFE

SEQ ID NO: 1037 - DNA, 1320 bp, Staphylococcus aureus
ttgatggatgataaaacgaagaacgatcaacaagaatcaaatgaagataaagatgaattagaattatttacgaggaatacatctaagaaaagacggcaaagaaaaagatcaaaggctacacatttttctaatcaaaataaagatgatacatctcaacaagctgattttgatgaagaaatttacttgataaataaagacttcaaaaaagaagaaagcaatgataaaaataatgattctgcttctagtcatgcgaatgataataatatcgatgattctacagactctaatattgaaaatgaggattatagatataatcaagaaattgacgaccaaaatgaatcgaatgtaatttcagtcgacaacgaacaacctcaatcagctcctaaagaacaaaatagcgactcgattgatgaggaaacagtaacgaaaaaagaacgaaaaagtaaagtaacacaattaaagccattaacacttgaagaaaagcggaagttaagacgtaagcgacaaaagcgaatccaatacagtgttattacaatattggtattgttgattgctgttatattaatttacatgttttcaccacttagtaaaattgcgcatgtaaatataaatggaaataatcacgttagtacttcaaagataaacaaagttttaggtgttaaaaatgattcaaggatgtatacgtttagtaaaaaaaatgctattaatgatctcgaagagaatccattaatcaaaagtgttgagatacacaagcaattaccaaacacattaaacgtagatatcacagaaaatgaaattattgctttagtgaaatataaaggtaaatatttacctttattagaaaatggtaaattgcttaaaggttcaaatgatgtcaaaattaatgatgcacctgtcatggatggtttcaaaggtacaaaagaagatgatatgattaaggcgttatctgaaatgacacctgaagttagacgatatattgccgaagtgacatacgccccaagtaaaaacaaacaaagcagaattgaattgtttacgacagatggacttcaagtaatcggtgatatttcgacgatatctaagaaaatgaaatattatccgcagatgtcacaatcattatcaagggatagttcgggtaaactaaaaacacgaggctatattgatttatcagtcggtgcttcatttatcccataccgtggaaacacgtctagtcaatcagaaagcgataaaaatgtgactaaatcatctcaagaggaaaatcaagcaaaagaagaattacaaagcgttttaaacaaaattaacaaacaatcaagtaagaataat

SEQ ID NO: 1038 - protein, 440 aa, Staphylococcus aureus
  MISC_FEATURE (1)..(440): cell division protein
LMDDKTKNDQQESNEDKDELELFTRNTSKKRRQRKRSKATHFSNQNKDDTSQQADFDEEIYLINKDFKKEESNDKNNDSASSHANDNNIDDSTDSNIENEDYRYNQEIDDQNESNVISVDNEQPQSAPKEQNSDSIDEETVTKKERKSKVTQLKPLTLEEKRKLRRKRQKRIQYSVITILVLLIAVILIYMFSPLSKIAHVNINGNNHVSTSKINKVLGVKNDSRMYTFSKKNAINDLEENPLIKSVEIHKQLPNTLNVDITENEIIALVKYKGKYLPLLENGKLLKGSNDVKINDAPVMDGFKGTKEDDMIKALSEMTPEVRRYIAEVTYAPSKNKQSRIELFTTDGLQVIGDISTISKKMKYYPQMSQSLSRDSSGKLKTRGYIDLSVGASFIPYRGNTSSQSESDKNVTKSSQEENQAKEELQSVLNKINKQSSKNN

SEQ ID NO: 1039 - DNA, 1362 bp, Staphylococcus aureus
ttggagtgcattaagatgcttaattatacagggttagaaaataaaaatgtattagttgtcggtttggcaaaaagtggttatgaagcagctaaattattaagtaaattaggtgcgaatgtaactgtcaatgatggaaaagacttatcacaagatgctcatgcaaaagatttagaatctatgggcatttctgttgtaagtggaagtcatccattaacgttgcttgataataatccaataattgttaaaaatcctggaataccttatacagtatctattattgatgaagcagtgaaacgaggtttgaaaattttaacagaagttgagttaagttatctaatctctgaagcaccaatcatagctgtaacgggtacaaatggtaaaacgacagttacttctctaattggagatatgtttaaaaaaagtcgcttaactggaagattatccggcaatattggttatgttgcatctaaagtagcacaagaagtaaagcctacagattatttagttacagagttgtcgtcattccagttacttggaatcgaaaagtataaaccacacattgctataattactaacatttattcggcgcatctagattaccatgaaaatttagaaaactatcaaaatgctaaaaagcaaatatataaaaatcaaacggaagaggattatttgatttgtaattatcatcaaagacaagtgatagagtcggaagaattaaaagctaagacattgtatttctcaactcaacaagaagttgatggtatttatattaaagatggttttatcgtttataaaggtgttcgtattattaacactgaagatctagtattgcctggtgaacataatttagaaaatatattagcagctgtgcttgcttgtattttagctggtgtacctattaaagcaattattgatagtttaactacattttcaggaatagagcatagattgcaatatgttggtactaatagaactaataaatattataatgattccaaagcaacaaacacgctagcaacacagtttgccttaaattcatttaatcaaccaatcatttggttatgtggtggtttggatcgagggaatgaatttgacgaactcattccttatatggaaaatgttcgcgcgatggttgtattcggacaaacgaaagctaagtttgctaaactaggtaatagtcaagggaaatcggtcattgaagcgaacaatgtcgaagacgctgttgataaagtacaagatattatagaaccaaatgatgttgtattattgtcacctgcttgtgcgagttgggatcaatatagtacttttgaagagcgtggagagaaatttattgaaagattccgtgcccatttaccatcttat

SEQ ID NO: 1040 - protein, 454 aa, Staphylococcus aureus
LECIKMLNYTGLENKNVLVVGLAKSGYEAAKLLSKLGANVTVNDGKDLSQDAHAKDLESMGISVVSGSHPLTLLDNNPIIVKNPGIPYTVSIIDEAVKRGLKILTEVELSYLISEAPIIAVTGTNGKTTVTSLIGDMFKKSRLTGRLSGNIGYVASKVAQEVKPTDYLVTELSSFQLLGIEKYKPHIAIITNIYSAHLDYHENLENYQNAKKQIYKNQTEEDYLICNYHQRQVIESEELKAKTLYFSTQQEVDGIYIKDGFIVYKGVRIINTEDLVLPGEHNLENILAAVLACILAGVPIKAIIDSLTTFSGIEHRLQYVGTNRTNKYYNDSKATNTLATQFALNSFNQPIIWLCGGLDRGNEFDELIPYMENVRAMVVFGQTKAKFAKLGNSQGKSVIEANNVEDAVDKVQDIIEPNDVVLLSPACASWDQYSTFEERGEKFIERFRAHLPSY

SEQ ID NO: 1041 - DNA, 963 bp, Staphylococcus aureus
atgatttttgtatatgcgttattagcgctagtgattacatttgttttggtacctgttttaatacctacattaaaaaggatgaaatttggtcaaagtattcgagaagaaggtccacaaagccatatgaagaagactggtacaccaacgatgggtggactaacatttctattaagtattgtgataacgtctttggtggctattatatttgtagatcaagctaatccaatcatactgttattatttgtgacgattggttttgggttaattggttttatagatgattatattattgttgttaaaaagaataaccaaggtttaacaagtaaacagaagtttttggcgcaaattggtattgcgattatattctttgttttaagtaatgtgtttcatttggtgaatttttctacgagcatacatattccatttacgaatgtagcaatcccactatcatttgcatatgttattttcattgttttttggcaagtaggtttttctaatgcagtaaatttaacagatggtttagatggattagcaactggactgtcaattatcggatttacaatgtatgccatcatgagctttgtgttaggagaaacggcaattggtattttctgtatcattatgttgtttgcacttttaggatttttaccatataacattaaccctgctaaagtgtttatgggagatacaggtagcttagctttaggtggtatatttgctaccatttcaatcatgcttaatcaggaattatcattaatttttataggtttagtattcgtaattgaaacattatctgttatgttacaagtcgctagctttaaattgactggaaagcgtatatttaaaatgagtccgattcatcatcattttgaattgataggatggagcgaatggaaagtagttacagtattttgggctgttggtctgatttcaggtttaatcggtttatggattggagtgcat

SEQ ID NO: 1042 - protein, 321 aa, Staphylococcus aureus
  MISC_FEATURE (1)..(321): phospho-N-muramic
MIFVYALLALVITFVLVPVLIPTLKRMKFGQSIREEGPQSHMKKTGTPTMGGLTFLLSIVITSLVAIIFVDQANPIILLLFVTIGFGLIGFIDDYIIVVKKNNQGLTSKQKFLAQIGIAIIFFVLSNVFHLVNFSTSIHIPFTNVAIPLSFAYVIFIVFWQVGFSNAVNLTDGLDGLATGLSIIGFTMYAIMSFVLGETAIGIFCIIMLFALLGFLPYNINPAKVFMGDTGSLALGGIFATISIMLNQELSLIFIGLVFVIETLSVMLQVASFKLTGKRIFKMSPIHHHFELIGWSEWKVVTVFWAVGLISGLIGLWIGVH

SEQ ID NO: 1043 - DNA, 2232 bp, Staphylococcus aureus
atggcgaagcaaaaaattaaaattaaaaaaaataaaataggggcagtcctacttgttggtttattcggactgctcttttttatattggttttaagaatttcatatatcatgattactggacattctaatggtcaagatttagtcatgaaggcaaatgaaaagtatttagttaagaatgcacaacaaccagaacgaggaaagatatatgatcgtaatggtaaagtgctagcagaagatgtagaaagatataaacttgttgcagtaatagataaaaaggcgagtgccaattctaaaaaacctaggcatgtagttgataaaaaagagactgcaaagaaattatctacagtcattaatatgaagccagaggaaattgaaaagagacttagtcaaaagaaagctttccaaattgaatttggacgcaaaggaacaaatttaacgtatcaggacaaattgaaaatagagaaaatgaatttgcctggtatttctttattgcctgaaacagaacgcttttatccaaatggcaattttgcatcacacttaattggtagagctcagaaaaatccggatactggtgaacttaaaggtgcacttggagttgaaaagatttttgatagttatttaagtggatctaaaggatcattgagatatattcatgatatttggggatatatcgcaccaaatactaaaaaagagaagcagcctaaacgtggtgatgatgtccatttaacaatcgattcaaatattcaagtatttgttgaagaagctttagatggcatggttgaaagataccagccgaaagatttatttgcggttgtcatggatgccaaaactggagaaattttagcatacagtcagcgaccaacatttaatcctgaaactggtaaagactttggtaaaaagtgggcaaatgacctttatcaaaacacatacgagcctggatcaacatttaaatcatatgggttagcagctgctattcaagaaggtgcttttgatcctgataagaaatataaatctggacatagagatattatgggttcacgtatttcagactggaatagagtcggttggggtgaaatcccaatgtcactcggatttacttattcatctaatacattgatgatgcatttacaagatttagttggtgcagacaaaatgaaatcttggtatgaacgatttggatttggaaaatcaactaaaggtatgtttgatggagaagcacctggtcaaattggatggagtaatgagttgcaacaaaaaacgtcatcatttggtcaatcgacaacagtaacacctgttcaaatgttacaagcgcaatcagcgttctttaatgatggtaatatgttaaaaccatggtttgtgaatagcgttgaaaatcctgttagtaaaagacaattttataaagggcaaaaacaaatcgcaggcaaaccaataacaaaagatactgctgaaaaagttgaaaagcaattggatttagttgtgaatagtaagaagagtcacgctgcaaactatcgtattgatggttatgaggtcgaaggtaagactggtacagcacaagtcgctgcacctaatggtggtggatacgttaaaggtccaaacccatattttgtaagttttatgggtgacgcgccgaagaaaaatcctaaagttattgtatacgctggtatgagcttggcacaaaaaaatgaccaagaagcttatgaattaggtgttagtaaagcgtttaaaccaataatggaaaatactttgaaatatttaaatgtaggtaaatcaaaagatgacacatctaatgcagagtatagtaaagtgccagatgttgaaggtcaagacaaacaaaaagctattgataatgtgagtgcaaaatcattagaaccagttactattggttctggcacacaaataaaagcacaatctataaaagcagggaataaagtcttacctcatagtaaagtactgttattaacagatggagacttaactatgcctgacatgtcaggatggacgaaagaagatgtcattgcttttgaaaacctaacaaatattaaagtaaatttaaaaggtagcggttttgtgtcccaccaatcaattagtaagggacaaaaacttactgaaaaagataaaatagacgtagaattttcatcagagaatgtagacagcaattcgacgaataattctgattcaaattcagatgataagaagaaatctgacagtaaaactgacaaggataagtcggac

SEQ ID NO: 1044 - protein, 744 aa, Staphylococcus aureus
  MISC_FEATURE (1)..(744): penicillin-binding protein
MAKQKIKIKKNKIGAVLLVGLFGLLFFILVLRISYIMITGHSNGQDLVMKANEKYLVKNAQQPERGKIYDRNGKVLAEDVERYKLVAVIDKKASANSKKPRHVVDKKETAKKLSTVINMKPEEIEKRLSQKKAFQIEFGRKGTNLTYQDKLKIEKMNLPGISLLPETERFYPNGNFASHLIGRAQKNPDTGELKGALGVEKIFDSYLSGSKGSLRYIHDIWGYIAPNTKKEKQPKRGDDVHLTIDSNIQVFVEEALDGMVERYQPKDLFAVVMDAKTGEILAYSQRPTFNPETGKDFGKKWANDLYQNTYEPGSTFKSYGLAAAIQEGAFDPDKKYKSGHRDIMGSRISDWNRVGWGEIPMSLGFTYSSNTLMMHLQDLVGADKMKSWYERFGFGKSTKGMFDGEAPGQIGWSNELQQKTSSFGQSTTVTPVQMLQAQSAFFNDGNMLKPWFVNSVENPVSKRQFYKGQKQIAGKPITKDTAEKVEKQLDLVVNSKKSHAANYRIDGYEVEGKTGTAQVAAPNGGGYVKGPNPYFVSFMGDAPKKNPKVIVYAGMSLAQKNDQEAYELGVSKAFKPIMENTLKYLNVGKSKDDTSNAEYSKVPDVEGQDKQKAIDNVSAKSLEPVTIGSGTQIKAQSIKAGNKVLPHSKVLLLTDGDLTMPDMSGWTKEDVIAFENLTNIKVNLKGSGFVSHQSISKGQKLTEKDKIDVEFSSENVDSNSTNNSDSNSDDKKKSDSKTDKDKSD

SEQ ID NO: 1045 - DNA, 399 bp, Staphylococcus aureus
atggctgtagaaaaagtgtaccaaccatatgacgaacaagtttataatagtataccgaagcaacaaccacaaactaagcccgaaaagaagactgtttcgagaaaagtggttgtacaattaactaaatttgaaaaagttttatacataactttgattactgtaattgctatgttaagtatttatatgctatctttaaaaatggatgcgtatgatacgcgaggaaagattgcagatttagattataaaatagataaacaatcaagtgaaaacagtgctttacaatctgaaatcaaaaagaattcttcttatgaacgcatatacgaaaaggctaagaaacaggggatgagccttgagaacgataatgtaaaggtagtgcgtagtaatggcgaagcaaaaaat

SEQ ID NO: 1046 - protein, 133 aa, Staphylococcus aureus
  MISC_FEATURE (1)..(133): cell division protein
MAVEKVYQPYDEQVYNSIPKQQPQTKPEKKTVSRKVVVQLTKFEKVLYITLITVIAMLSIYMLSLKMDAYDTRGKIADLDYKIDKQSSENSALQSEIKKNSSYERIYEKAKKQGMSLENDNVKVVRSNGEAKN

SEQ ID NO: 1047 - DNA, 933 bp, Staphylococcus aureus
gtgtttcatcatatcagcgttatgttaaacgaaaccattgattatttaaatgtaaaagaaaatggtgtgtacattgactgtacgctaggtggagcgggacatgccctttatttactaaatcaattaaatgacgacggaagattaatagcaatcgatcaagaccaaactgcaattgataatgctaaagaggtattaaaggatcatttgcataaggtgacttttgttcatagcaacttccgtgaattaactcaaatattaaaagacttaaacattgaaaaagtagatggaatttattacgacttgggtgtttcaagcccacaactcgacattccagaacgaggattcagttatcaccatgacgcaacattagacatgcgtatggaccaaacacaagaactaacagcatatgaaattgttaacaattggtcatatgaagcgttagtgaagattttttatcgctatggcgaggagaaattttcaaaacagatagctcgaagaatcgaagcacatcgcgaacaacaaccaataacaacaacattagaattagttgacattataaaagaaggtattcctgcaaaagcaagaagaaaaggcggacatcctgcaaaacgagtatttcaagcactacgaattgcagtaaacgatgaattgtcagcttttgaagattcaatagaacaagcgattgaattagtgaaagtagatggcaggatttcggtaatcactttccattctttagaagatcgtttatgtaaacaggtgttccaagaatatgaaaaaggtccagaggtaccaagaggattaccagttataccagaagcatatacacctaagttaaagcgtgttaatcgtaaaccgattaccgctacagaagaagatttagatgacaataacagagcacgaagcgcgaaattacgtgtagctgaaatacttaaa

SEQ ID NO: 1048 - protein, 311 aa, Staphylococcus aureus
  MISC_FEATURE (1)..(311): conserved hypothetical
VFHHISVMLNETIDYLNVKENGVYIDCTLGGAGHALYLLNQLNDDGRLIAIDQDQTAIDNAKEVLKDHLHKVTFVHSNFRELTQILKDLNIEKVDGIYYDLGVSSPQLDIPERGFSYHHDATLDMRMDQTQELTAYEIVNNWSYEALVKIFYRYGEEKFSKQIARRIEAHREQQPITTTLELVDIIKEGIPAKARRKGGHPAKRVFQALRIAVNDELSAFEDSIEQAIELVKVDGRISVITFHSLEDRLCKQVFQEYEKGPEVPRGLPVIPEAYTPKLKRVNRKPITATEEDLDDNNRARSAKLRVAEILK

SEQ ID NO: 1049 - DNA, 429 bp, Staphylococcus aureus
atgttcatgggagaatacgatcatcaattagatacaaaaggacgtatgattataccgtccaagtttcgttatgacttaaatgagcgttttattatcacaagaggccttgataaatgtttattcggttacactctagacgaatggcaacagattgaagagaaaatgaaaaccttacctatgacaaaaaaagacgcacgtaagtttatgcgtatgttcttctctggtgctgttgaagtagaacttgataagcaagggcgtattaacatccctcaaaacttgaggaaatacgctaatttaactaaagaatgtacagtaatcggtgtttcaaatcgtattgagatttgggatagagaaacttggaatgatttctatgaagaatctgaagaaagtttcgaagatattgctgaagatttaatagattttgatttt

SEQ ID NO: 1050 - protein, 143 aa, Staphylococcus aureus
  MISC_FEATURE (1)..(143): conserved hypothetical
MFMGEYDHQLDTKGRMIIPSKFRYDLNERFIITRGLDKCLFGYTLDEWQQIEEKMKTLPMTKKDARKFMRMFFSGAVEVELDKQGRINIPQNLRKYANLTKECTVIGVSNRIEIWDRETWNDFYEESEESFEDIAEDLIDFDF

SEQ ID NO: 1051 - DNA, 96 bp, Staphylococcus aureus
gtgcgaaaaagtaaattcgcaattgatagaggctattttccagatatggaaatggcctctttttataatcaaattaataagaataaatatgtttat

SEQ ID NO: 1052 - protein, 32 aa, Staphylococcus aureus
VRKSKFAIDRGYFPDMEMASFYNQINKNKYVY

SEQ ID NO: 1053 - DNA, 318 bp, Staphylococcus aureus
atgaaatttatcattgcaatattattaggattaatattatccattactattgcttttacaatcatacatcatcctatacttgatcgttttaatcctttcttaaaaacggagtatagttatgccaaagtgccaaaaggtacgcaacaatatgttaatattacggcttatagtgaaagaggggaaaagcttgattataaattaacatttaatggattttcacctagtagaacgtatgtcgaaataaagcataaagggcaatatgtcatatcgatcacatatgttgaaaaagaggatacaccaaaagaggtaagacaagaa

SEQ ID NO: 1054 - protein, 106 aa, Staphylococcus aureus
  MISC_FEATURE (1)..(106): conserved hypothetical
MKFIIAILLGLILSITIAFTIIHHPILDRFNPFLKTEYSYAKVPKGTQQYVNITAYSERGEKLDYKLTFNGFSPSRTYVEIKHKGQYVISITYVEKEDTPKEVRQE

SEQ ID NO: 1055 - DNA, 1359 bp, Staphylococcus aureus
gtgattggtggacaacaagcagggcttttcgggggaccattgtatacattccataaaatattttcaatcattactttatctaaggaattaacggatacacataagcaacaagtagtaccagttttttggattgcaggagaagatcatgatttcgatgaagtgaatcatacatttgtttataacgaaaatcatgggtcgctgcataaggttaaatatcatacaatggagatgccagagacgactgtctctagatattatcctgataaggctgagttgaaacaaactttaaaaacgatgttcattcatatgaaagaaactgttcatacacaaggtctactggagatttgtgacagaattattgaccaatatgactcgtggactgatatgtttaaagcactactgcatgaaacatttaaagcatatggcgttctatttatagatgcgcagtttgagccgttaagaaaaatggaagcgcctatgtttaaaaagattttgaaaaaacatcagttgcttgatgatgcttttagagcaacacaacaacgtactcaaaatcaaggcttgaatgcgatgatacaaacagatacaaatgttcatttattcttacatgatgaaaatatgcgtcaattagtttcgtatgatggtaagcattttaaattaaataaaacagataagacatatataaaggaagaaattataaatattgcggaaaatcaacctgaattattttctaataatgtagtgacaagaccattaatggaagaatggttatttaacacggtggcatttgttggaggaccgagtgaaattaagtactgggctgaactaaaagatgtatttgaactatttgatgttgaaatgcctatcgtgatgccaaggcttagaattacttatttaaatgaccgtatagaaaaattactttcgaaatacaatattccattagaaaaagtgttagtcgatggtgttgaaggagaaagaagtaagtttattagagaacaagcatcacatcaatttattgaaaaggtagaaggtatgattgaacaacagcgtcgtctaaacaaagacttattagatgaagtggcggggaatcaaaataatattaaccttgtgaataaaaataatgaaattcatatacaacagtatgattatttgttaaaacgttatcttttaaacattgaaagagaaaacgacatcagtatgaagcaatttagagaaattcaagaaacactccatccaatgggaggattacaagaaagaatatggaatccacttcaaattttgaatgattttgggacagatgtgttcaagccctccacctatccaccactttcttacacttttgatcatattattataaaacct

SEQ ID NO: 1056 - protein, 453 aa, Staphylococcus aureus
  MISC_FEATURE (1)..(453): conserved hypothetical
VIGGQQAGLFGGPLYTFHKIFSIITLSKELTDTHKQQVVPVFWIAGEDHDFDEVNHTFVYNENHGSLHKVKYHTMEMPETTVSRYYPDKAELKQTLKTMFIHMKETVHTQGLLEICDRIIDQYDSWTDMFKALLHETFKAYGVLFIDAQFEPLRKMEAPMFKKILKKHQLLDDAFRATQQRTQNQGLNAMIQTDTNVHLFLHDENMRQLVSYDGKHFKLNKTDKTYIKEEIINIAENQPELFSNNVVTRPLMEEWLFNTVAFVGGPSEIKYWAELKDVFELFDVEMPIVMPRLRITYLNDRIEKLLSKYNIPLEKVLVDGVEGERSKFIREQASHQFIEKVEGMIEQQRRLNKDLLDEVAGNQNNINLVNKNNEIHIQQYDYLLKRYLLNIERENDISMKQFREIQETLHPMGGLQERIWNPLQILNDFGTDVFKPSTYPPLSYTFDHIIIKP

SEQ ID NO: 1057 - DNA, 225 bp, Staphylococcus aureus
atggactgtaaagtagttagtttaaatgaaaaagatcagtttataccaaaaataaagagcagtgaccctgtaataacaggattatttcaatatgatgcagctcaacaaactagttttgaaaaaaggatgtctaaagaaaataatggaagagaagcggcattagcgaatgttattcgtgaatatatgagtgatttaaagctttcaagctttcaagtgaacaagaat

SEQ ID NO: 1058 - protein, 75 aa, Staphylococcus aureus
  MISC_FEATURE (1)..(75): conserved hypothetical
MDCKVVSLNEKDQFIPKIKSSDPVITGLFQYDAAQQTSFEKRMSKENNGREAALANVIREYMSDLKLSSFQVNKN

SEQ ID NO: 1059 - DNA, 438 bp, Staphylococcus aureus
atgagtgaaatcaaacgtcttgaaattaattacaaaactgacgaattattcgaaaactttagagcgtttggcaacaaagacttatacatggtcaatgagttaaacggtcaaatgattgatgcaagttcagattcaccattttatggcatatttgtcggagatcaattaggagctagaatggcattactaaaaaaaggtgatgtcgaagaaatctacttcccagattttgaagattatatattattatggaagttagaagtattaccaaaatatcaaaacagagggtacgcttcagaattgattgattttgcaaagagtttcaatatgccaattaaagccattggcagaaatgattctaaggatttctttttacatcatggatttacagatgtggaagctaaaaatatagagggacatgatgtcttattgtggaaacca

SEQ ID NO: 1060 - protein, 146 aa, Staphylococcus aureus
  MISC_FEATURE (1)..(146): conserved hypothetical
MSEIKRLEINYKTDELFENFRAFGNKDLYMVNELNGQMIDASSDSPFYGIFVGDQLGARMALLKKGDVEEIYFPDFEDYILLWKLEVLPKYQNRGYASELIDFAKSFNMPIKAIGRNDSKDFFLHHGFTDVEAKNIEGHDVLLWKP

SEQ ID NO: 1061 - DNA, 693 bp, Staphylococcus aureus
atggggaaattgggatataaaaatattttgatagactttgatgatacaattgttgatttttatgatgcagaagaatgggcgtttcactatatggcgaatgtttttaatcataaagcaacaaaggatgattttttaacatttaaaaaaatcaatcaccaacattgggaagcttttcaacaaaataaattaacgaagtctgaagtattatcagaacgatttgtgaattacttcaaacatcatcaaatggaagttgatgggcatcgtgcagatgtgttatttagaaatggattagcagaagctaaagttaaatactttgatcaaacattagaaacaattgtcgaattatcgaaaagacatgatttatatattgttactaatggtgtaaccgaaacgcaaaagagaaggttaaatcagacgccgttgcataaatatattaaaaagatatttatatctgaagaaacaggatatcaaaaacctaatccggaattttttaattatgtttttaatgatattggtgaggatgaaagacagcactcgattatagttggagattctttaacatctgacattctaggtggaatcaatgcgggtatagctacttgctggtttaattttagaggatttgatcataatccaggaattatacctgattatgaaattaattcatggaaacaactaaatgatattgtacgt

SEQ ID NO: 1062 - protein, 231 aa, Staphylococcus aureus
  MISC_FEATURE (1)..(231): conserved hypothetical
MGKLGYKNILIDFDDTIVDFYDAEEWAFHYMANVFNHKATKDDFLTFKKINHQHWEAFQQNKLTKSEVLSERFVNYFKHHQMEVDGHRADVLFRNGLAEAKVKYFDQTLETIVELSKRHDLYIVTNGVTETQKRRLNQTPLHKYIKKIFISEETGYQKPNPEFFNYVFNDIGEDERQHSIIVGDSLTSDILGGINAGIATCWFNFRGFDHNPGIIPDYEINSWKQLNDIVR

SEQ ID NO: 1063 - DNA, 132 bp, Staphylococcus aureus
atgactggactagcagaagcaatcgcaaatactgtgcaagctgcacaacaacatgatagtgtgaaattaggcacaagtatcgtagacatcgttgctaacggtgtgggtttactaggtaaattatttggattc

SEQ ID NO: 1064 - protein, 44 aa, Staphylococcus aureus
MTGLAEAIANTVQAAQQHDSVKLGTSIVDIVANGVGLLGKLFGF

SEQ ID NO: 1065 - DNA, 141 bp, Staphylococcus aureus
gtgttttcaatggaaggtttatttaacgcaattaaagataccgtaactgcagcaattaataatgatggcgcaaaattaggcacaagcattgtgagcatcgttgaaaatggcgtaggtttattaggtaaattattcggattc

SEQ ID NO: 1066 - protein, 47 aa, Staphylococcus aureus
VFSMEGLFNAIKDTVTAAINNDGAKLGTSIVSIVENGVGLLGKLFGF

SEQ ID NO: 1067 - DNA, 213 bp, Staphylococcus aureus
ttgaagatttacaagggggtgtacaaaatgagaaatcaaattcaaaaactattagacagtgatttgagcagtttacatatatcgaaacaaacaggagttccacaaagcacaatacacagaatgagaaaaaatgaaagatcattagacaatatgtcattgaaaaacgctgaactactttataaatttgccaatagtatatttagcaatgaaaat

SEQ ID NO: 1068 - protein, 71 aa, Staphylococcus aureus
  MISC_FEATURE (1)..(71): hypothetical protein
LKIYKGVYKMRNQIQKLLDSDLSSLHISKQTGVPQSTIHRMRKNERSLDNMSLKNAELLYKFANSIFSNEN

SEQ ID NO: 1069 - DNA, 945 bp, Staphylococcus aureus
atgagacttcaaaaagcacctctagtaacgtcaggactagtcttaggattattaggcctgggtaatctattaaaagacttatctcttactttaaacgctgtttgcggaatctttgctttcttgatttggattcaccttttatgtactatgatcaaatattttaataatgtgaaagaacaattaaacagtcctctagtttcatcagtgttcacaacatttttcatgtctggctttttaggtactacttatttaaatacattttttagtaacataacttttatcaatagcttaataacgcctatttggattttatgccttgtgggaattatgacgcatatgattattttttcaataaaatatttaaaagatttttcacttgaaaatgtttatccttcgtggactgtactttttattggtattgctatcgcaggattgacggcacccgttagcggatattttttcataggtcaattaacagtaatatatggctttgtagctacttgtattgtcttacctatagttttcaagcgattaaaagcatttccattgcagacgtcaatcaaaccgaacacatcgacaatttgtgcaccattttctttagtcgctgcagcatatgttatagcttttcctaaggcgaatgcttttatcgtaattatatttttactattagctcaaatattttatttttatatcattatacaattgcctaaattactaaaagaacctttttcgcccgtattttcagctttcacattccctttagtaatctcagcaactgctttaaagaacagtttgcctgtacttatgtttccagacatttggaaaggtcttttgtttatcgaagtgttattagccactgtaatagtacttagagtctttataggatatcttcacttctttttaaaaaaggaaaaacaagataaatttcttcgtaatgcgtctcag

SEQ ID NO: 1070 - protein, 315 aa, Staphylococcus aureus
  MISC_FEATURE (1)..(315): conserved hypothetical
MRLQKAPLVTSGLVLGLLGLGNLLKDLSLTLNAVCGIFAFLIWIHLLCTMIKYFNNVKEQLNSPLVSSVFTTFFMSGFLGTTYLNTFFSNITFINSLITPIWILCLVGIMTHMIIFSIKYLKDFSLENVYPSWTVLFIGIAIAGLTAPVSGYFFIGQLTVIYGFVATCIVLPIVFKRLKAFPLQTSIKPNTSTICAPFSLVAAAYVIAFPKANAFIVIIFLLLAQIFYFYIIIQLPKLLKEPFSPVFSAFTFPLVISATALKNSLPVLMFPDIWKGLLFIEVLLATVIVLRVFIGYLHFFLKKEKQDKFLRNASQ

SEQ ID NO: 1071 - DNA, 90 bp, Staphylococcus aureus
gtgttaattcttggtaatagtgttactgagacgcattacgaagaaatttatcttgtttttccttttttaaaaagaagtgaagatatccta

SEQ ID NO: 1072 - protein, 30 aa, Staphylococcus aureus
VLILGNSVTETHYEEIYLVFPFLKRSEDIL

SEQ ID NO: 1073 - DNA, 288 bp, Staphylococcus aureus
gtgatgaatttagcaaaattcagtaggataaagaaagcgggtgaaacaatggcaacttgggtagcaattatttttatagtagctgcattaattttaggtttaattggaggtttccttttagctagaaaatatatgatggactacttgaagaaaaacccaccaatcaacgaagaaatgcttcgtatgatgatgatgcaaatgggtcaaaaaccttctcagaagaaaattaatcaaatgatgacgatgatgaataaaaatatggatcaaaatatgaagagtgcgaaaaag

SEQ ID NO: 1074 - protein, 96 aa, Staphylococcus aureus
  MISC_FEATURE (1)..(96): conserved hypothetical
VMNLAKFSRIKKAGETMATWVAIIFIVAALILGLIGGFLLARKYMMDYLKKNPPINEEMLRMMMMQMGQKPSQKKINQMMTMMNKNMDQNMKSAKK

SEQ ID NO: 1075 - DNA, 225 bp, Staphylococcus aureus
atgacacatttgacaaaggttttagatacactaactggaatatgcgtagtattattatttagtaaatattttgtggcgtatgcaaatatggtgtttgattggaatttaagatggtatttgctagaaaacataccacatttgccaattatattatttattctgatgtttattttcggagtaccttctgaaatgataaaagataggcaaaggaaaaataacggtgtt

SEQ ID NO: 1076 - protein, 75 aa, Staphylococcus aureus
  MISC_FEATURE (1)..(75): hypothetical protein
MTHLTKVLDTLTGICVVLLFSKYFVAYANMVFDWNLRWYLLENIPHLPIILFILMFIFGVPSEMIKDRQRKNNGV

SEQ ID NO: 1077 - DNA, 1554 bp, Staphylococcus aureus
gtggaaaatacaattaatgaaagtgaaaagaaaaaacgatttaaattaaaaatgccaggtgcatttatgattttattcattttaacggttgttgcagttatagcaacatgggttattcctgctggtgcatattctaaactttcttacgaaccttcatcccaagaactaaagatagttaaccctcataaccaagtgaaaaaggttccgggtacgcaacaggaactagacaaaatgggggttaaaattaagattgaacaatttaaatcaggtgcaattaataagccggtatcaattccgaatacttatgaaagattaaagcaacatccagctggaccagaacaaataacaagtagcatggttgaaggtacgatagaagcggtcgatatcatggtattcattcttgtactagggggacttattggcgtagttcaagccagtggttcttttgaatcgggattgttagctttaacgaagaaaacaaaagggcatgaatttatgctaattgtgtttgtatcaatactaatgattatcggcgggacattatgtggtattgaagaagaagctgtagcattttatccgattttagtccctatatttatagcgttaggatacgattctatcgtttcagttggtgccatattccttgccagctctgtcggtagtacattttcaactattaacccgttctcggttgtaattgcctctaatgccgctggtacaacttttacggatggcttgtattggagaataggtgcttgtattgtcggtgcgatttttgttattagttatttatattggtactgtaaaaaaattaaaaacgatcctaaagcgtcatattcttatgaagacaaagatgcttttgaacagcaatggtctgtattaaaagatgacgatagtgcccattttactttgcgtaagaagataatccttacattatttgtactaccatttccaattatggtatggggagttatgacgcaaggttggtggttcccagttatggcttcagcatttttaatatttacaattataataatgtttattgctgggacaggtaaatctggattgggagaaaaaggaactgtagatgcatttgtcaatggtgcatcaagtttagtaggtgtatctttaattattggtttagctcgaggtattaatttagtgttgaatgaaggtatgatttcagatacaatcttacacttttcatcatctttagttcaacatatgagtggaccattatttatcatcgtattactatttattttcttctgtttaggttttatcgtgccatcatcttctggcttagcggtattatcaatgcctatctttgcaccactagctgatacagtaggtataccaagattcgtcatcgttacgacatatcaatttggtcaatatgcgatgttattcttagcgccgactggacttgttatggccacactacaaatgttaaacatgcgatattcacattggttccgatttgtatggccggtagttgcttttgtattgattttcggtggcggagtactaattacgcaagtactaatttattca

SEQ ID NO: 1078 - protein, 518 aa, Staphylococcus aureus
  MISC_FEATURE (1)..(518): conserved hypothetical
VENTINESEKKKRFKLKMPGAFMILFILTVVAVIATWVIPAGAYSKLSYEPSSQELKIVNPHNQVKKVPGTQQELDKMGVKIKIEQFKSGAINKPVSIPNTYERLKQHPAGPEQITSSMVEGTIEAVDIMVFILVLGGLIGVVQASGSFESGLLALTKKTKGHEFMLIVFVSILMIIGGTLCGIEEEAVAFYPILVPIFIALGYDSIVSVGAIFLASSVGSTFSTINPFSVVIASNAAGTTFTDGLYWRIGACIVGAIFVISYLYWYCKKIKNDPKASYSYEDKDAFEQQWSVLKDDDSAHFTLRKKIILTLFVLPFPIMVWGVMTQGWWFPVMASAFLIFTIIIMFIAGTGKSGLGEKGTVDAFVNGASSLVGVSLIIGLARGINLVLNEGMISDTILHFSSSLVQHMSGPLFIIVLLFIFFCLGFIVPSSSGLAVLSMPIFAPLADTVGIPRFVIVTTYQFGQYAMLFLAPTGLVMATLQMLNMRYSHWFRFVWPVVAFVLIFGGGVLITQVLIYS

SEQ ID NO: 1079 - DNA, 939 bp, Staphylococcus aureus
gtgaatatgatggcgaaaatagtagtagcattaggtggtaatgctttaggaaaatcacctcaagaacaactcgagcttgttaaaaatactgcgaaatcattagtaggattaataacaaaaggacatgagattgttattagtcatggtaatggaccacaggttggaagcattaatttgggacttaactatgctgcagaacataaccaaggtccggcatttccatttgctgaatgtggcgcaatgagtcaagcttacatcggctatcaattacaagaaagcttacaaaatgaattgcattctattggaatggataaacaagtggtaacactagtgacacaagttgaagttgatgaaaatgatccggcatttaacaatccttcaaaaccaattgggttattttacaacaaagaagaagctgaacaaattcaaaaagaaaaaggatttatatttgttgaagatgctggaagaggatatagacgcgttgttccttcaccacaacccatctctattattgaattagagagtattaaaacacttattaaaaatgatacactcgttattgctgctggtggtggaggtataccagtaattagagagcaacatgatggttttaaaggtattgatgcagttatagacaaagataaaacaagtgcgttgttgggtgctaatattcaatgcgatcaattgattattttaacagcaattgattatgtatatattaattttaacactgaaaaccaacagcctttgaaaacaacaaatgttgatgaattaaaacgatatatagacgaaaatcaatttgcaaaaggaagtatgttaccaaaaattgaagcagccatatcatttattgaaaacaatccaaaaggaagtgtgcttataacatcattaaatgaattagatgctgccttagagggtaaagtaggtactgtgattaaaaag

SEQ ID NO: 1080 - protein, 313 aa, Staphylococcus aureus
  MISC_FEATURE (1)..(313): hypothetical protein
VNMMAKIVVALGGNALGKSPQEQLELVKNTAKSLVGLITKGHEIVISHGNGPQVGSINLGLNYAAEHNQGPAFPFAECGAMSQAYIGYQLQESLQNELHSIGMDKQVVTLVTQVEVDENDPAFNNPSKPIGLFYNKEEAEQIQKEKGFIFVEDAGRGYRRVVPSPQPISIIELESIKTLIKNDTLVIAAGGGGIPVIREQHDGFKGIDAVIDKDKTSALLGANIQCDQLIILTAIDYVYINFNTENQQPLKTTNVDELKRYIDENQFAKGSMLPKIEAAISFIENNPKGSVLITSLNELDAALEGKVGTVIKK

SEQ ID NO: 1081 - DNA, 1008 bp, Staphylococcus aureus
ttgttattaatgaaaaatttacgaaacagaagttttttaactttattagacttttcacgacaagaggtagaattcttattaacactctccgaggatttaaaacgtgctaaatatattggcactgaaaagcctatgttaaaaaataaaaatattgcactgttatttgaaaaagattctacaagaacgcgatgtgcatttgaagttgcagcgcatgatcaaggtgcaaatgtaacttatttaggcccaactggatcacaaatgggtaaaaaagaaacaactaaagatactgcacgtgtgcttggtggaatgtatgatggcattgaataccgtggtttttcacaaagaacagtagaaactttagctgagtattcaggcgtaccagtgtggaatggtttaactgatgaagatcatcctactcaagttcttgctgatttcttaacagcaaaagaagtcttaaaaaaagattatgcagatattaactttacatatgttggagatggtcgtaataacgttgcaaatgcattaatgcaaggtgctgccattatgggtatgaacttccatttagtttgtccaaaagaattaaatccaacagatgaattattaaatcgctgtaaaaatattgccgctgaaaatggtggcaacatattaatcacagatgatattgaccaaggtgtaaaaggttcggatgtaatttacactgatgtttgggtatcaatgggtgaacctgatgaagtatggaaagaacgacttgaattattgaaaccatatcaagtaaataaagaaataatggataaaactggtaatccaaatgttatttttgagcattgcttaccatctttccataatgctgatacgaaaataggtcaacaaatttttgaaaaatatggtattcgagaaatggaagttacagatgaagtattcgaaagtaaagcttcagttgtattccaagaagctgagaacagaatgcatacaatcaaagcagtcatggttgctacattgggtgaattt

SEQ ID NO: 1082 - protein, 336 aa, Staphylococcus aureus
  MISC_FEATURE (1)..(336): ornithine
LLLMKNLRNRSFLTLLDFSRQEVEFLLTLSEDLKRAKYIGTEKPMLKNKNIALLFEKDSTRTRCAFEVAAHDQGANVTYLGPTGSQMGKKETTKDTARVLGGMYDGIEYRGFSQRTVETLAEYSGVPVWNGLTDEDHPTQVLADFLTAKEVLKKDYADINFTYVGDGRNNVANALMQGAAIMGMNFHLVCPKELNPTDELLNRCKNIAAENGGNILITDDIDQGVKGSDVIYTDVWVSMGEPDEVWKERLELLKPYQVNKEIMDKTGNPNVIFEHCLPSFHNADTKIGQQIFEKYGIREMEVTDEVFESKASVVFQEAENRMHTIKAVMVATLGEF

SEQ ID NO: 1083 - DNA, 723 bp, Staphylococcus aureus
atgaaaaagaacatcatgaataaattagttttatcaacagcattgttacttttagaaactacatcaacacaacttcctaaaacaccaatcagtttttcatctgaagcaaaagcctataatatcagtgaaaacgagactaatatcaatgaactaatcaaatattacactcagccgcatttttcattatctggaaaatggttatggcaaaagcccaatggtagcattcatgcaacattgcaaacgtgggtttggtatagtcatattcaagtgtttggatccgagagttggggaaacattaatcagttaagaaataaatacgttgatatatttggaactaaagatgaggacacagttgaaggttactggacttatgatgaaacatttactggtggtgttacgccagcagctacttcatctgataagccttatagactatttttaaaatatagtgataaacaacaaactatcatcggtggacatgaattttacaaaggaaataaaccagtattaactttaaaagaattagatttccgtattcgtcaaacattaataaaaaataaaaagttatataacggagaatttaataaaggtcaaattaagataactgctgatggaaataattacacgattgatttaagtaaaaagttaaaattaactgacacaaaccgttatgttaaaaatcctcgtaatgcagaaattgaagtcatactcgaaaaatctaac

SEQ ID NO: 1084 - protein, 241 aa, Staphylococcus aureus
  MISC_FEATURE (1)..(241): hypothetical protein
MKKNIMNKLVLSTALLLLETTSTQLPKTPISFSSEAKAYNISENETNINELIKYYTQPHFSLSGKWLWQKPNGSIHATLQTWVWYSHIQVFGSESWGNINQLRNKYVDIFGTKDEDTVEGYWTYDETFTGGVTPAATSSDKPYRLFLKYSDKQQTIIGGHEFYKGNKPVLTLKELDFRIRQTLIKNKKLYNGEFNKGQIKITADGNNYTIDLSKKLKLTDTNRYVKNPRNAEIEVILEKSN

SEQ ID NO: 1085 - DNA, 723 bp, Staphylococcus aureus
atgaacaataacatcacgaaaaaaattattttatcaacaacattgttactattaggtacagcatctacacaatttcctaatacacctatcaattcttcatctgaagcgaaagcttattatataaatcaaaacgaaactaacgttaatgagttaactaaatattactcgcaaaaatatttaaccttctctaacagtacgttatggcaaaaagataacggtacgattcatgcaacgttgttacagttttcttggtatagtcatattcaagtttatggacctgaaagttggggcaatatcaaccaattaagaaataaaagcgttgatatttttggcataaaagaccaagaaaccattgattcttttgcattatctcaagaaacgtttactggtggtgttactcctgcagcaacatctaacgataaacactataaactgaatgtaacatataaagataaagcagaaacgtttactggcggatttccagtttatgaaggcaataagcctgttttaactttaaaagaattagattttcgtattcgtcaaacattaattaaaagtaaaaaattatataataattcttataataaaggacaaattaaaataacaggtgcagacaataactacacaatagatttaagtaaaaggttgccatcaactgatgcaaatagatatgttaaaaaacctcaaaatgcaaaaattgaagttatcctcgaaaaatcaaac

SEQ ID NO: 1086 - protein, 241 aa, Staphylococcus aureus
  MISC_FEATURE (1)..(241): hypothetical protein
MNNNITKKIILSTTLLLLGTASTQFPNTPINSSSEAKAYYINQNETNVNELTKYYSQKYLTFSNSTLWQKDNGTIHATLLQFSWYSHIQVYGPESWGNINQLRNKSVDIFGIKDQETIDSFALSQETFTGGVTPAATSNDKHYKLNVTYKDKAETFTGGFPVYEGNKPVLTLKELDFRIRQTLIKSKKLYNNSYNKGQIKITGADNNYTIDLSKRLPSTDANRYVKKPQNAKIEVILEKSN

SEQ ID NO: 1087 - DNA, 813 bp, Staphylococcus aureus
atggagttaataaaaataatcgcaaatactatattgacttcgctcacatttaaatttcttattcctcgtatcatgattcctctgaaaggagatgttctaatgagtaagaacatcacgaaaaatataattttaacgacaacattattactattaggtactgtattacctcaaaatcaaaaaccagtatttagtttttactctgaagctaaagcttatagcattggtcaagatgaaactaacatcaatgaattaattaaatattacacacagcctcatttttcattttcaaataaatggctatatcaatatgataatggaaacatttatgttgaacttaagagatattcatggtcagcacatatatctttatggggcgctgaaagttggggaaatattaatcagttaaaagatcgttacgtagatgtgtttggactaaaagacaaagatactgatcagttatggtggtcttatagagagacatttacaggtggcgttacaccagccgcaaaaccttctgataaaacttataatctttttgtgcaatacaaagataaactacaaacgattattggtgcgcataaaatataccaaggcaataaaccagtattaacattgaaagaaatcgatttccgtgcacgagaagcgttaataaaaaataaaatattatataacgaaaatcgtaataaaggtaagcttaagatcaccggtggcggtaataactacactattgatttaagcaaaagattacattcagatctagcaaatgtttatgttaaaaatcctaataaaataactgttgacgtcctctttgat

SEQ ID NO: 1088 - protein, 271 aa, Staphylococcus aureus
  MISC_FEATURE (1)..(271): hypothetical protein
MELIKIIANTILTSLTFKFLIPRIMIPLKGDVLMSKNITKNIILTTTLLLLGTVLPQNQKPVFSFYSEAKAYSIGQDETNINELIKYYTQPHFSFSNKWLYQYDNGNIYVELKRYSWSAHISLWGAESWGNINQLKDRYVDVFGLKDKDTDQLWWSYRETFTGGVTPAAKPSDKTYNLFVQYKDKLQTIIGAHKIYQGNKPVLTLKEIDFRAREALIKNKILYNENRNKGKLKITGGGNNYTIDLSKRLHSDLANVYVKNPNKITVDVLFD

SEQ ID NO: 1089 - DNA, 195 bp, Staphylococcus aureus
atgacagagttgaataatattataaactctcttcaatctttgtttgagtctgaatcaggctataaaatttcgaaaaattcaggagttccatatcaaacagtacaagatttaagaaatgggaaaaccaaactagaagatgctagatttagaacgattattaaactttatagttactatgtctcattaaaagaacac

SEQ ID NO: 1090 - protein, 65 aa, Staphylococcus aureus
  MISC_FEATURE (1)..(65): hypothetical protein
MTELNNIINSLQSLFESESGYKISKNSGVPYQTVQDLRNGKTKLEDARFRTIIKLYSYYVSLKEH

SEQ ID NO: 1091 - DNA, 144 bp, Staphylococcus aureus
atgaaactattttatatcgtatttcttattattatatggctgaatatatttttaggaaatgaaatcatccatacactgactgttttaataacaacattgtatattgttaattcaagaaaggggattaaaaatgacagagttgaa

SEQ ID NO: 1092 - protein, 48 aa, Staphylococcus aureus
MKLFYIVFLIIIWLNIFLGNEIIHTLTVLITTLYIVNSRKGIKNDRVE

SEQ ID NO: 1093 - DNA, 1986 bp, Staphylococcus aureus
atgtttaatgaaaaagatcaattagctgttgatacgctacgtgcactaagtatcgacacaatcgaaaaagcgaattctggtcatccaggattacctatgggagctgccccaatggcttacactttgtggacacgtcatctgaattttaatccacaatctaaagattacttcaatagagaccgtttcgtattatctgcagggcatggttcagcattattgtatagcttgttacatgtttctggtagtttagaattagaagaattaaagcaatttagacaatggggttctaaaacaccaggtcatcctgaatacagacatacagatggtgtagaagttactaccggaccacttggacaaggttttgctatgtcagtaggattagctttagcagaagatcacctagcagggaaatttaataaagaaggatataatgttgtagatcattacacatatgtattagcttctgacggtgatttaatggaaggtatatcgcatgaagcagcttcatttgctggacataataaattaagtaaattagttgttttatacgattcaaatgatatttcattagatggcgaattaaacaaagctttttctgaaaacacaaaagctcgttttgaagcatatggttggaattacttactagttaaagatggtaatgatttagaagaaattgataaagcgattactacagctaaatctcaagaaggaccaacgattattgaagttaaaacaacaatcggatttggttcaccgaataaagcaggaactaatggtgttcatggggcacctttaggtgaagttgaaagaaaattaacattcgaaaattacggtttagatcctgaaaaacgttttaatgtttcagaagaggtatacgaaattttccaaaatactatgttaaaacgtgctaatgaagatgaatctcaatggaattcattattagaaaaatatgcagaaacatatcctgaattagcagaagaatttaaattagcgattagtggtaaattgcctaaaaattataaggatgaattaccacgttttgaactgggtcataatggtgcatctcgtgctgattctggtactgttattcaagcaatcagtaaaactgtcccttcattctttggtggatcagcagaccttgctggttcaaacaaatccaatgtaaatgatgcaactgattatagttctgaaacacctgaaggtaaaaatgtgtggtttggtgtacgtgaatttgctatgggtgctgctgtaaatggtatggctgcacatggaggtttacatccatatggtgcaacattcttcgtatttagtgattatttaaaaccagcgttacgtttatcatcaattatgggattaaatgcaacgttcatcttcacacatgattcaattgcagtaggtgaagatggtcctactcatgaaccaattgagcaattagctggattaagagccattccaaatatgaatgttatccgtcctgctgatggtaatgaaacaagagtagcatgggaagttgccttagaatctgaatctacacctacttcattagtattgacacgtcaaaacttaccggtattagatgtaccagaagatgtagttgaagaaggcgttcgaaaaggtgcctatacagtttatggctctgaagagacaccagaattcctattattagcttcaggttcagaagttagtcttgcagttgaagctgctaaagatcttgaaaaacaaggtaaatcagtacgtgttgtttcaatgcctaactggaatgcatttgaacaacaatctgaagaatataaagaatcagttattccatcaagcgtaacaaaacgtgttgcgattgaaatggcttcaccgcttggatggcataaatatgtaggtactgcaggtaaagttattgctattgacggctttggcgcaagtgcacctggcgatttagtagttgaaaaatatggatttacaaaagaaaatatcttaaaccaagttatgagctta

SEQ ID NO: 1094 - protein, 662 aa, Staphylococcus aureus
  MISC_FEATURE (1)..(662): transketolase
MFNEKDQLAVDTLRALSIDTIEKANSGHPGLPMGAAPMAYTLWTRHLNFNPQSKDYFNRDRFVLSAGHGSALLYSLLHVSGSLELEELKQFRQWGSKTPGHPEYRHTDGVEVTTGPLGQGFAMSVGLALAEDHLAGKFNKEGYNVVDHYTYVLASDGDLMEGISHEAASFAGHNKLSKLVVLYDSNDISLDGELNKAFSENTKARFEAYGWNYLLVKDGNDLEEIDKAITTAKSQEGPTIIEVKTTIGFGSPNKAGTNGVHGAPLGEVERKLTFENYGLDPEKRFNVSEEVYEIFQNTMLKRANEDESQWNSLLEKYAETYPELAEEFKLAISGKLPKNYKDELPRFELGHNGASRADSGTVIQAISKTVPSFFGGSADLAGSNKSNVNDATDYSSETPEGKNVWFGVREFAMGAAVNGMAAHGGLHPYGATFFVFSDYLKPALRLSSIMGLNATFIFTHDSIAVGEDGPTHEPIEQLAGLRAIPNMNVIRPADGNETRVAWEVALESESTPTSLVLTRQNLPVLDVPEDVVEEGVRKGAYTVYGSEETPEFLLLASGSEVSLAVEAAKDLEKQGKSVRVVSMPNWNAFEQQSEEYKESVIPSSVTKRVAIEMASPLGWHKYVGTAGKVIAIDGFGASAPGDLVVEKYGFTKENILNQVMSL

SEQ ID NO: 1095 - DNA, 999 bp, Staphylococcus aureus
ttgtttcctcaaatcgttttaaaaaatagaaggatgatgaaaatgaaaacacgtatagtcagctcagtaacaacaacactattgctaggttccatattaatgaatcctgtcgctaatgccgcagattctgatattaatattaaaaccggtactacagatattggaagcaatactacagtaaaaacaggtgatttagtcacttatgataaagaaaatggcatgcacaaaaaagtattttatagttttatcgatgataaaaatcataataaaaaactgctagttattagaacgaaaggtaccattgctggtcaatatagagtttatagcgaagaaggtgctaacaaaagtggtttagcctggccttcagcctttaaggtacagttgcaactacctgataatgaagtagctcaaatatctgattactatccaagaaattcgattgatacaaaagagtatatgagtactttaacttatggattcaacggtaatgttactggtgatgatacaggaaaaattggcggccttattggtgcaaatgtttcgattggtcatacactgaaatatgttcaacctgatttcaaaacaattttagagagcccaactgataaaaaagtaggctggaaagtgatatttaacaatatggtgaatcaaaattggggaccatatgatagagattcttggaacccggtatatggcaatcaacttttcatgaaaactagaaatggctctatgaaagcagcagataacttccttgatcctaacaaagcaagttctctattatcttcagggttttcaccagacttcgctacagttattactatggatagaaaagcatccaaacaacaaacaaatatagatgtaatatacgaacgagttcgtgatgactaccaattgcactggacttcaacaaattggaaaggtaccaatactaaagataaatggatagatcgttcttcagaaagatataaaatcgattgggaaaaagaagaaatgacaaat

SEQ ID NO: 1096 - protein, 333 aa, Staphylococcus aureus
  MISC_FEATURE (1)..(333): alpha-hemolysin precursor
LFPQIVLKNRRMMKMKTRIVSSVTTTLLLGSILMNPVANAADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 1097 - DNA, 231 bp, Staphylococcus aureus
atggtttttaatgattgggaaattaacgttgtatactcaggagagcatgaggttgtaacaaacgaaaagagtttatttgtcattgacgaattttacgatgttgcaatcgcaatctattatttagatggaaaattaaaagtagctcatgtcaactatggttctgattttacaattgacgtagctaataaagtttttgaattgaatattcaaaatccaaatgttgatgagcat

SEQ ID NO: 1098 - protein, 77 aa, Staphylococcus aureus
  MISC_FEATURE (1)..(77): hypothetical protein
MVFNDWEINVVYSGEHEVVTNEKSLFVIDEFYDVAIAIYYLDGKLKVAHVNYGSDFTIDVANKVFELNIQNPNVDEH

SEQ ID NO: 1099 - DNA, 183 bp, Staphylococcus aureus
atgaataaacatataaataaaaaagccgcaaaactacttgaagattataaaaaggttcaacaaagaaaatcgaaagaaactgatagaggttgtttgaaaagtgtcatcatgcttatcgtcttatttttcttaattatttttggtattgtggcatgttctacaaacgtaaactttttcttccag

SEQ ID NO: 1100 - protein, 61 aa, Staphylococcus aureus
  MISC_FEATURE (1)..(61): hypothetical protein
MNKHINKKAAKLLEDYKKVQQRKSKETDRGCLKSVIMLIVLFFLIIFGIVACSTNVNFFFQ

SEQ ID NO: 1101 - DNA, 348 bp, Staphylococcus aureus
atgaaatttaaaaaatatatattaacaggaacattagcattacttttatcatcaactgggatagcaactatagaagggaataaagcagatgcaagtagtctggacaaatatttaactgaaagtcagtttcatgataaacgcatagcagaagaattaagaactttacttaacaaatcgaatgtatatgcattagctgcaggaagcttaaatccatattataaacgtacgattatgatgaatgaatatagagctaaagcggcacttaagaaaaatgatttcgtatcaatggctgatgctaaagttgcattagaaaaaatatacaaagaaattgatgaaattataaataga

SEQ ID NO: 1102 - protein, 116 aa, Staphylococcus aureus
  MISC_FEATURE (1)..(116): hypothetical protein
MKFKKYILTGTLALLLSSTGIATIEGNKADASSLDKYLTESQFHDKRIAEELRTLLNKSNVYALAAGSLNPYYKRTIMMNEYRAKAALKKNDFVSMADAKVALEKIYKEIDEIINR

SEQ ID NO: 1103 - DNA, 495 bp, Staphylococcus aureus
atgaaaaataaattgatagcaaaatctttattaacattagcggcaataggtattactacaactacaattgcgtcaacagcagatgcgagcgaaggatacggtccaagagaaaagaaaccagtgagtattaatcacaatatcgtagagtacaatgatggtacttttaaatatcaatctagaccaaaatttaactcaacacctaaatatattaaattcaaacatgactataatattttagaatttaacgatggtacattcgaatatggtgcacgtccacaatttaataaaccagcagcgaaaactgatgcaactattaaaaaagaacaaaaattgattcaagctcaaaatcttgtgagagaatttgaaaaaacacatactgtcagtgcacacagaaaagcacaaaaggcagtcaacttagtttcgtttgaatacaaagtgaagaaaatggtcttacaagagcgaattgataatgtattaaaacaaggattagttaaa

SEQ ID NO: 1104 - protein, 165 aa, Staphylococcus aureus
  MISC_FEATURE (1)..(165): hypothetical protein
MKNKLIAKSLLTLAAIGITTTTIASTADASEGYGPREKKPVSINHNIVEYNDGTFKYQSRPKFNSTPKYIKFKHDYNILEFNDGTFEYGARPQFNKPAAKTDATIKKEQKLIQAQNLVREFEKTHTVSAHRKAQKAVNLVSFEYKVKKMVLQERIDNVLKQGLVK

SEQ ID NO: 1105 - DNA, 504 bp, Staphylococcus aureus
atgataattaaaattttaacaattctattactactttgtatattgagctatttggttacaaatagaaagaagccttttctgttcttaaagacactctttatgggtgtggtatttatctttataggatatatttcactggcaatatctgccgtaattatttatggtattattcaatttatcacaattgattttggtagttttttcttaatgggtattatattgatcttgatttcaagtatattccaattatttatagttagattactttttagaaaaaagaatgtcgatttgacagaggttgtcgttttagagcatttaattcaatggttcttagtttactttgcgatctatcaagcagtaaatgaaaaaatggacattaatgatattaatatcgacaatttccaatctgtcttttttgacgtgtctaatttgaatttagtaattctaccaacgttaatcattagctgggtcacaatatttaactatagaatgagaagttacaaa

SEQ ID NO: 1106 - protein, 168 aa, Staphylococcus aureus
  MISC_FEATURE (1)..(168): hypothetical protein
MIIKILTILLLLCILSYLVTNRKKPFLFLKTLFMGVVFIFIGYISLAISAVIIYGIIQFITIDFGSFFLMGIILILISSIFQLFIVRLLFRKKNVDLTEVVVLEHLIQWFLVYFAIYQAVNEKMDINDINIDNFQSVFFDVSNLNLVILPTLIISWVTIFNYRMRSYK

SEQ ID NO: 1107 - DNA, 399 bp, Staphylococcus aureus
atgaaaaaaaatatcacaaaaactattatcgcatctacagtaatcgctgcaggtcttttaactcaaactaatgatgctaaagctttctttagttatgaatggaaaggtttagaaatcgcaaaaaatttagcagatcaagctaaaaaggacgatgaacgtattgataagttaatgaaagagtctgataaaaatctaactccttacaaagctgaaactgttaatgatctgtaccttattgttaaaaaattaagccaaggtgatgtgaagaaagcagttgtcagaattaaagatggtggtcctagagattactatacttttgacttaactcgtcctttagaagagaacagaaaaaatattaaagttgttaaaaacggtgaaatcgactcgattacttggtat

SEQ ID NO: 1108 - protein, 133 aa, Staphylococcus aureus
  MISC_FEATURE (1)..(133): hypothetical protein
MKKNITKTIIASTVIAAGLLTQTNDAKAFFSYEWKGLEIAKNLADQAKKDDERIDKLMKESDKNLTPYKAETVNDLYLIVKKLSQGDVKKAVVRIKDGGPRDYYTFDLTRPLEENRKNIKVVKNGEIDSITWY

SEQ ID NO: 1109 - DNA, 114 bp, Staphylococcus aureus
gtggctattgtgaaaaggaaatcgaatgtattaacaatcataaaaattgtaacggatatagtggcaaccgtgttaatcatacgtgctttattaaacagtcgtaaagatgctaaa

SEQ ID NO: 1110 - protein, 38 aa, Staphylococcus aureus
VAIVKRKSNVLTIIKIVTDIVATVLIIRALLNSRKDAK

SEQ ID NO: 1111 - DNA, 339 bp, Staphylococcus aureus
gtgttattaattatgaaaaagaattttattgggaaatcaattttaagcatagctgctattagtttaacggtatcaacgtttgccggtgaatctcatgcacaaactaaaaacgttgaagctgctaaaaaatatgatcagtatcaaacaaactttaaaaaacaagtaaataaaaaagttgtggatgcacaaaaagctgtaaactttttcaaacgtacaagaactgttgcaacacaccgtaaagcacaaagagctgttaatttaattcatttccaacacagttatgaaaagaaaaaattacaaagacaaatcgatctagttttaaaatataatactttaaaa

SEQ ID NO: 1112 - protein, 113 aa, Staphylococcus aureus
  MISC_FEATURE (1)..(113): hypothetical protein
VLLIMKKNFIGKSILSIAAISLTVSTFAGESHAQTKNVEAAKKYDQYQTNFKKQVNKKVVDAQKAVNFFKRTRTVATHRKAQRAVNLIHFQHSYEKKKLQRQIDLVLKYNTLK

SEQ ID NO: 1113 - DNA, 165 bp, Staphylococcus aureus
atgaaaagaattgtaattttggagaatgtgattgttgataaccctatatggttgaatcatgttgattatttggttaaaagtgtattattaaaaagtataaaattaagattccaagaagtcaggaaatttgaaattttagttaaaatcatgaatcgtatacatatt

SEQ ID NO: 1114 - protein, 55 aa, Staphylococcus aureus
  MISC_FEATURE (1)..(55): hypothetical protein
MKRIVILENVIVDNPIWLNHVDYLVKSVLLKSIKLRFQEVRKFEILVKIMNRIHI

SEQ ID NO: 1115 - DNA, 237 bp, Staphylococcus aureus
ttgagtaattctgatttgaatatcgaaagaattaacgagttagctaaaaagaaaaaagaagtaggattaactcaagaagaagcaaaggagcaaacagccttaagaaaagcttatcttgagagttttagaaaagggtttaaacaacaaattgaaaatactaaagtaattgatccagaaggtaatgatgtaacacctgaaaaaattaaagagatacaacaaaaaagagataataaaaat

SEQ ID NO: 1116 - protein, 79 aa, Staphylococcus aureus
  MISC_FEATURE (1)..(79): conserved hypothetical
LSNSDLNIERINELAKKKKEVGLTQEEAKEQTALRKAYLESFRKGFKQQIENTKVIDPEGNDVTPEKIKEIQQKRDNKN

SEQ ID NO: 1117 - DNA, 543 bp, Staphylococcus aureus
atgcgattaatttacttcaagcttttcttgaaggtgataaaaatgtctaaatggattattgtgagtgataaccatactgaatcaggcgttttatatcaaatttatgaaatgcacccagatgcagatgtatatttacatttaggagattcagaattcgcgtatgatgatacggaacttagcttatttaatagagtaaaaggcaattgtgatttttacccagaatttgaaaatgaagcggtcgcaaaatataatgacgtgaaagcattttatactcatggacatttatatcaagtcaatcgaacaagagatttattagctgaaaaaggacttgaattaggttgtttgtttgcattttatggacatacacatgtggcaaaatatgagtatattaatggtgttcatgttattaatcctggaagtatatctcaatctagaagttcaatggaagaaacatatgctgaagttattattgatgatcaaactttacatggcaccatcaatttcaaaaatcgacatcacgaaacaatcagtcatactactttt

SEQ ID NO: 1118 - protein, 181 aa, Staphylococcus aureus
  MISC_FEATURE (1)..(181): conserved hypothetical
MRLIYFKLFLKVIKMSKWIIVSDNHTESGVLYQIYEMHPDADVYLHLGDSEFAYDDTELSLFNRVKGNCDFYPEFENEAVAKYNDVKAFYTHGHLYQVNRTRDLLAEKGLELGCLFAFYGHTHVAKYEYINGVHVINPGSISQSRSSMEETYAEVIIDDQTLHGTINFKNRHHETISHTTF

SEQ ID NO: 1119 - DNA, 585 bp, Staphylococcus aureus
atgaaagagattgttattgcatcgaataatcaagggaaaataaatgactttaaagtaatatttccagattaccacgtaataggtatttcagaactaataccagattttgatgtggaagaaacaggatcaacatttgaagaaaatgctatattaaaatcagaagctgctgcaaaagcattgaataaaacggtcatagctgatgacagtggactagaagtttttgcattaaatggtgagccaggtatatactctgcacgttatgctggtgaaaataaaagcgatgaagcaaatattgaaaaattattaaataagcttggtaatacaactgatcgtcgtgcgcaatttgtttgtgtcataagtatgagtggccctgatatggaaacaaaagtatttaaaggtactgtttcaggtgaaattgcagatggaaaatatggcgaaaatggtttcggatatgatccgatattttatgtaccgaaattagataaaaccatggctcaactttcaaaagaacaaaaagggcaaattagtcatagacgaaatgcgattaatttacttcaagcttttcttgaaggtgataaaaatgtc

SEQ ID NO: 1120 - protein, 195 aa, Staphylococcus aureus
  MISC_FEATURE (1)..(195): conserved hypothetical
MKEIVIASNNQGKINDFKVIFPDYHVIGISELIPDFDVEETGSTFEENAILKSEAAAKALNKTVIADDSGLEVFALNGEPGIYSARYAGENKSDEANIEKLLNKLGNTTDRRAQFVCVISMSGPDMETKVFKGTVSGEIADGKYGENGFGYDPIFYVPKLDKTMAQLSKEQKGQISHRRNAINLLQAFLEGDKNV

SEQ ID NO: 1121 - DNA, 798 bp, Staphylococcus aureus
atgaataaaccaataggtgtaatagactctggtgtcggaggtttgacagtagctaaagaaattatgcgtcagttgccaaatgagacgatttattacttaggtgatattggacgatgtccatatgggccaagaccaggagaacaagtaaaacaatatacagttgaaatcgctcgtaaattaatggaatttgatataaaaatgctcgtgattgcttgtaatacagcaactgctgtagctttagaatatttacaaaagaccttatcaatcccagtgattggcgtaattgaaccaggtgctagaacagcaataatgactactagaaatcaaaatgtattagtactaggaacggaaggcacaattaaatctgaagcatatcgtacgcatattaaacgtatcaatccacatgtagaggtacatggcgttgcctgtccaggttttgtgccacttgtagaacaaatgagatatagtgatccaacaattacaagcattgtcattcatcaaacactgaaacgttggcgtaatagtgagtctgatactgtcattttaggatgtacccactatccattgctctataaacctatctatgattattttggtggtaaaaagacagtgatttcgtctggattagaaacggctcgtgaagttagtgcattgctaacatttagtaatgaacatgcaagttatactgaacatccagatcatcgattttttgcaacaggtgatcctactcacattactaacattatcaaagagtggttaaatttatctgtcaatgtggaacgtatatcagtgaatgac

SEQ ID NO: 1122 - protein, 266 aa, Staphylococcus aureus
  MISC_FEATURE (1)..(266): glutamate racemase
MNKPIGVIDSGVGGLTVAKEIMRQLPNETIYYLGDIGRCPYGPRPGEQVKQYTVEIARKLMEFDIKMLVIACNTATAVALEYLQKTLSIPVIGVIEPGARTAIMTTRNQNVLVLGTEGTIKSEAYRTHIKRINPHVEVHGVACPGFVPLVEQMRYSDPTITSIVIHQTLKRWRNSESDTVILGCTHYPLLYKPIYDYFGGKKTVISSGLETAREVSALLTFSNEHASYTEHPDHRFFATGDPTHITNIIKEWLNLSVNVERISVND

SEQ ID NO: 1123 - DNA, 813 bp, Staphylococcus aureus
atgactgaacaatcagtgaaaaacactccacaacatgaaacacaatctaaaccgaaacaaaaaacagtaaaattaattattaaacgacaagatacaagtgattctaagccttatgaagaaacatttgaaattccatatcgtgaaaatttaaacgtcattgcttgtttaatggaaattagacgtaacccagttaatattaaaggtgaaaaaacaacacctgttgtctgggatatgaactgcttagaagaagtatgtggagcatgttctatggttatcaatggtcgtgcaagacaatcttgttctgcgattgttgatcaattagaacaacctattcgtttagagccaatgaatactttcccagttatccgtgacttacaagttgatcgttctagaatgttcgataacttaaaacgtatgaaagcatggatcccaattgatggaacgtatgatttaggtccgggaccacgtatgccagagaaaaaacgtcaaacagcttatgaattatctaaatgtatgacatgtggtgtatgtttagaggtttgtcctaatgttactgaaaataataaattcgttggtgcacaagcaatctcgcaagttcgtttgtttaatttgcacccaacaggatctatgactaaagatgaacgtttaaatgcattaatgggtactggtggcttacagcagtgtggtaattcacaaaactgtgttaatgcttgccctaaaggtattccattaacaacatccattgcagcaatgaacagagaaacaacattccacatgtttaaatcattctttggttcagaccatgaagtagaa

SEQ ID NO: 1124 - protein, 271 aa, Staphylococcus aureus
  MISC_FEATURE (1)..(271): iron-sulphur subunit of
MTEQSVKNTPQHETQSKPKQKTVKLIIKRQDTSDSKPYEETFEIPYRENLNVIACLMEIRRNPVNIKGEKTTPVVWDMNCLEEVCGACSMVINGRARQSCSAIVDQLEQPIRLEPMNTFPVIRDLQVDRSRMFDNLKRMKAWIPIDGTYDLGPGPRMPEKKRQTAYELSKCMTCGVCLEVCPNVTENNKFVGAQAISQVRLFNLHPTGSMTKDERLNALMGTGGLQQCGNSQNCVNACPKGIPLTTSIAAMNRETTFHMFKSFFGSDHEVE

SEQ ID NO: 1125 - DNA, 1764 bp, Staphylococcus aureus
atggcagagaaacatcttattgttgtcggaggtggcctagcgggcttaatgtcaacaattaaagcggcagaaaaaggtgcacatgtagatttgttctcagttgtaccagtaaagcgttcgcactctgtttgtgcccaaggtggcattaatggtgcggtcaatactaaaggggaaggcgattctccttggattcactttgatgatacagtgtatggtggcgatttccttgcaaaccaaccacctgttaaagcgatgacagaggcagcacctaaaattattcatttattagaccgtatgggcgtaatgttcaatagaacaaatgaaggtctattagattttagacgtttcggtggtacattacatcacagaacagcatatgcaggggcaacaactggacaacaattattatatgcattggatgaacaagttcgtgcatatgaagtagatggattagttacgaagtatgaaggatgggaattccttggcatagttaaaggtgacgatgatagtgcaagaggtatcgttgcacaaaatatgacaactgctgagattgaaacatttggttcagatgcagttattatggcaacgggtggccctggtattattttcggtaaaacaacaaactcaatgattaatacaggatcagcggcttccattgtttaccaacaaggcgctatttatgctaatggtgagttcattcaaattcatcctactgcaatccctggtgatgataaactgcgactaatgagtgaatcagcacgtggtgaaggtggacgaatttggacatataaagatggtaagccttggtacttcttagaagagaaatatcctgattatggtaacttagtacctcgtgatatcgcaacgcgtgaaattttcgatgtatgtattaaccaaaaattaggtataaatggcgaaaacatggtatatcttgatttgtcacataaagatccacatgagttagatgtaaaactaggtggtatcattgagatttatgaaaaattcactggtgatgacccacgcaaagtaccaatgaagattttcccagctgttcactattcaatgggtggtctatatgtagattatgatcaaatgacaaatattaaagggttatttgcagctggagaatgtgacttctctcaacatggtggtaaccgcttaggtgccaattcattgttatcagcgatttatggtggtacagtagcaggtccaaacgcgattgattatatttcaaatattgatcgatcatatactgatatggacgaaagtatttttgaaaagcgtaaagctgaagagcaagaacgttttgataaattattagctatgcgcggtacagaaaatgcatataaattacaccgtgaacttggtgaaattatgacagcaaatgtaactgttgttcgtgaaaatgaaaaactgttagaaacagataaaaagattgttgaattgatgaaacgttatgaagatattgatatggaagatactcaaacttggagtaaccaagcggtattctttacccgtcaactatggaacatgttagtacttgcacgtgttattacgattggtgcatataaccgtaacgaatcacgcggtgcccattataaaccagaattcccagagcgtaatgatgaagagtggttaaaaacgacaatggcctcattccaaggcgcatttgaaaaaccgcagtttacttatgatgacgtcgatgtgagtttaataccacctcgtaaacgtgattacacaagtaagtctaaagggggtaaaaaa

SEQ ID NO: 1126 - protein, 588 aa, Staphylococcus aureus
  MISC_FEATURE (1)..(588): succinate dehydrogenase
MAEKHLIVVGGGLAGLMSTIKAAEKGAHVDLFSVVPVKRSHSVCAQGGINGAVNTKGEGDSPWIHFDDTVYGGDFLANQPPVKAMTEAAPKIIHLLDRMGVMFNRTNEGLLDFRRFGGTLHHRTAYAGATTGQQLLYALDEQVRAYEVDGLVTKYEGWEFLGIVKGDDDSARGIVAQNMTTAEIETFGSDAVIMATGGPGIIFGKTTNSMINTGSAASIVYQQGAIYANGEFIQIHPTAIPGDDKLRLMSESARGEGGRIWTYKDGKPWYFLEEKYPDYGNLVPRDIATREIFDVCINQKLGINGENMVYLDLSHKDPHELDVKLGGIIEIYEKFTGDDPRKVPMKIFPAVHYSMGGLYVDYDQMTNIKGLFAAGECDFSQHGGNRLGANSLLSAIYGGTVAGPNAIDYISNIDRSYTDMDESIFEKRKAEEQERFDKLLAMRGTENAYKLHRELGEIMTANVTVVRENEKLLETDKKIVELMKRYEDIDMEDTQTWSNQAVFFTRQLWNMLVLARVITIGAYNRNESRGAHYKPEFPERNDEEWLKTTMASFQGAFEKPQFTYDDVDVSLIPPRKRDYTSKSKGGKK

SEQ ID NO: 1127 - DNA, 612 bp, Staphylococcus aureus
ttggctcaatcaaaaaatgaattttatctaagacgtattcactcgttattaggtattatcccaataggtgcatttttggtcgttcatttattagtgaatcaccaagcaacacaaggtgctgaagcgtttaataaggcatctaactttatggaatcattaccatttctaattattgtagaatttttatttatatacattccgttgttatatcacggtttgtttggtatacacattgcatttacagcaaaagaaaatgttggacattactcgatttttagaaactggatgttcttcttccaaagagtgagtggtatcttaacatttatctttattggtatccatttatggcaaacacgtttacaaaaagcattttacggcaaagaagtgaattacgatttaatgcacgaaacattgcaacatcctggatgggcaatattttatattatttgtattattgctgttgtgttccactttgcaaatggcttatggtcattcttagttacttggggtggacttcaatctccaaaatcacaacgagtatttacatgggtttcattaatcgtatttttagttatttcgtatattggtgttactgcaattattgcctttatg

SEQ ID NO: 1128 - protein, 204 aa, Staphylococcus aureus
  MISC_FEATURE (1)..(204): succinate dehydrogenase
LAQSKNEFYLRRIHSLLGIIPIGAFLVVHLLVNHQATQGAEAFNKASNFMESLPFLIIVEFLFIYIPLLYHGLFGIHIAFTAKENVGHYSIFRNWMFFFQRVSGILTFIFIGIHLWQTRLQKAFYGKEVNYDLMHETLQHPGWAIFYIICIIAVVFHFANGLWSFLVTWGGLQSPKSQRVFTWVSLIVFLVISYIGVTAIIAFM

SEQ ID NO: 1129 - DNA, 1779 bp, Staphylococcus aureus
ttggaagactataagcaacgaattaaaaataaattaaatgtcgtacctatggaaccaggatgctatttaatgaaagatcgtaatgatcaagtgatatatgttggcaaagctaaaaagctaagaaatcgattgcgatcatattttacgggtgctcatgatgctaaaacaacgagactggttggtgaaatacgtcgctttgagtttattgtcacgtcaagtgaaacagaatcacttttactggaattgaatctgattaaacaatatcaaccaagatataatatattattaaaggatgataaaagttatccatttattaaaattacgaaggagaaatatcctagactactagtgacgagaactgtaaaacaaggtactggcaaatatttcggaccgtatccgaatgcatattctgctcaagaaactaaaaagttattagacagaatatatccatatcgcaaatgtgataagatgccagataaattatgtctttattaccatattggacaatgtttaggaccatgtgtatatgacgttgatttgagtaaatacgcacaaatgacgaaggaaattactgattttctgaatggggaagacaaaacaattttaaaaagtttagaagagcgaatgttaactgcaagtgaatcacttgattttgaacgggctaaagaatatagagatttaattcaacatattcaaaatctgacaaacaaacaaaaaattatgtcatcagataaaacgattcgtgatgtctttggttatagtgttgataaaggatggatgtgtatccaagttttctttatacgacaaggtaatatgataaagcgagatacaacgatgattccattacagcaaacagaagaagaagaattttatacatttattggacaattttatagcttaaaccaacatattttacctaaggaagttcatgtaccacgtaatttggataaagaaatgattcaatctgttgtggacactaaaatcgttcaacccgcgcgaggtcccaaaaaagatatggttgacctagctgcacataacgctaaagtatccttaaataataaatttgaattaatatcacgtgatgagtccagaacgattaaagctattgaagaacttggaacacaaatgggaattcaaacaccaattagaattgaagcattcgataattctaatattcaaggtgtggatccagtgtcagcaatggttacatttgtcgacggtaaaccagataagaaaaattatagaaagtataaaatcaaaacggttaaaggtccagatgattacaaatcaatgagagaagtagtaagacgacgatattctcgcgttttaaacgaaggattaccattacctgatttaataatagtagatggtggtaaaggacatatgaacggggttattgatgtgctacaaaacgaattaggtcttgatatccctgttgcaggtttgcagaaaaatgataaacaccaaacatctgaattattatatggcgctagtgcagaaattgtaccactgaagaaaaatagccaggcattttatttgttgcaccgtatccaagatgaggttcacagattcgcaatcacatttcatagacaaacacgtcaaaagacaggcttgaaatcaatacttgatgatatagatggtatcggtaacaaacgtaaaacattattattgcgttcattcggttcaatcaagaaaatgaaggaagctacacttgaagattttaaaaatataggtattcctgaaaacgtcgcaaagaacctacatgaacaattgcataaa

SEQ ID NO: 1130 - protein, 593 aa, Staphylococcus aureus
  MISC_FEATURE (1)..(593): excinuclease ABC subunit C
LEDYKQRIKNKLNVVPMEPGCYLMKDRNDQVIYVGKAKKLRNRLRSYFTGAHDAKTTRLVGEIRRFEFIVTSSETESLLLELNLIKQYQPRYNILLKDDKSYPFIKITKEKYPRLLVTRTVKQGTGKYFGPYPNAYSAQETKKLLDRIYPYRKCDKMPDKLCLYYHIGQCLGPCVYDVDLSKYAQMTKEITDFLNGEDKTILKSLEERMLTASESLDFERAKEYRDLIQHIQNLTNKQKIMSSDKTIRDVFGYSVDKGWMCIQVFFIRQGNMIKRDTTMIPLQQTEEEEFYTFIGQFYSLNQHILPKEVHVPRNLDKEMIQSVVDTKIVQPARGPKKDMVDLAAHNAKVSLNNKFELISRDESRTIKAIEELGTQMGIQTPIRIEAFDNSNIQGVDPVSAMVTFVDGKPDKKNYRKYKIKTVKGPDDYKSMREVVRRRYSRVLNEGLPLPDLIIVDGGKGHMNGVIDVLQNELGLDIPVAGLQKNDKHQTSELLYGASAEIVPLKKNSQAFYLLHRIQDEVHRFAITFHRQTRQKTGLKSILDDIDGIGNKRKTLLLRSFGSIKKMKEATLEDFKNIGIPENVAKNLHEQLHK

SEQ ID NO: 1131 - DNA, 93 bp, Staphylococcus aureus
atgctagattatcatttaacgttcatagatttattaatcccaccattctcaagtcgtaaacaatatgatgacttatcattcaactttttatat

SEQ ID NO: 1132 - protein, 31 aa, Staphylococcus aureus
MLDYHLTFIDLLIPPFSSRKQYDDLSFNFLY

SEQ ID NO: 1133 - DNA, 321 bp, Staphylococcus aureus
ttggcatttatggcaatcgtaaaagtaacagatgcagattttgattcaaaagtagaatctggtgtacaactagtagatttttgggcaacatggtgtggtccatgtaaaatgatcgctccggtattagaagaattagcagctgactatgaaggtaaagctgacattttaaaattagatgttgatgaaaatccatcaactgcagctaaatatgaagtgatgagtattccaacattaatcgtctttaaagacggtcaaccagttgataaagttgttggtttccaaccaaaagaaaacttagctgaagttttagataaacattta

SEQ ID NO: 1134 - protein, 107 aa, Staphylococcus aureus
  MISC_FEATURE (1)..(107): thioredoxin [Staphylococcus
LAFMAIVKVTDADFDSKVESGVQLVDFWATWCGPCKMIAPVLEELAADYEGKADILKLDVDENPSTAAKYEVMSIPTLIVFKDGQPVDKVVGFQPKENLAEVLDKHL

SEQ ID NO: 1135 - DNA, 309 bp, Staphylococcus aureus
ttgttcgttaaaatattgacacagaacataagttctgataaattactaatacaaacaaatgttctaggagtgaaaatgatgttttacaataaatataaaaacgtatcaacatatatcatcatatttttagtttcaagtgcagcctttgcaatattcttgttaagtgcgaacattagtgctcactcggaacaagtgtacgaaatgactgaccatcaaattaagaacaatacgataaataaagcatacgaacataaagaccctacaaacaatagcgaacaaagagatgggaaagtgttcgctttaataaat

SEQ ID NO: 1136 - protein, 103 aa, Staphylococcus aureus
  MISC_FEATURE (1)..(103): hypothetical protein
LFVKILTQNISSDKLLIQTNVLGVKMMFYNKYKNVSTYIIIFLVSSAAFAIFLLSANISAHSEQVYEMTDHQIKNNTINKAYEHKDPTNNSEQRDGKVFALIN

SEQ ID NO: 1137 - DNA, 621 bp, Staphylococcus aureus
atgagagaattaacaaaacgacaaagcgaaatatataactatattaaacaagttgttcaaacgaaaggttatccgcctagtgttcgcgaaattggtgaagcagttggcttagcatccagttcaactgttcatggtcacctttcacgtcttgaagaaaaaggctatataagaagagatccaacgaaaccacgtgctatagaaattgtaagtgatcaaacaaatgataatattaatatggaagaaacgattcatgtgccagttattggtaaagtcacagcaggtgttcctattaccgcagtagaaaatattgaagaatattttccattacctgaacacttaacatcgacacacaatagcgacatattcatattaaacgtcgtaggcgacagtatgattgaggctggtatattagacggagacaaagtaattgttcgcagtcaaaccatagcagaaaatggagacattattgttgctatgactgaggaagatgaagcaactgtcaaacgcttctataaagaaaaaaatcgttatcgattacaacctgaaaatagtacaatggagccaatttacctagacaatgttgctgtaattgggaaagtaattggtttgtaccgcgaaatg

SEQ ID NO: 1138 - protein, 207 aa, Staphylococcus aureus
  MISC_FEATURE (1)..(207): SOS regulatory LexA protein
MRELTKRQSEIYNYIKQVVQTKGYPPSVREIGEAVGLASSSTVHGHLSRLEEKGYIRRDPTKPRAIEIVSDQTNDNINMEETIHVPVIGKVTAGVPITAVENIEEYFPLPEHLTSTHNSDIFILNVVGDSMIEAGILDGDKVIVRSQTIAENGDIIVAMTEEDEATVKRFYKEKNRYRLQPENSTMEPIYLDNVAVIGKVIGLYREM

SEQ ID NO: 1139 - DNA, 2346 bp, Staphylococcus aureus
atgagacaaaaaacattagacgtcttagaatttgaaaaaataaaatcactcgttgccaatgaaactattagtgacttaggcttggaaaaggtcaatcaaatgatgccagctactaattttgaaacggttgtttttcaaatggaagaaacggatgagattgctcaaatctataataagcatcgtttaccaagcttgagtggcttatctaaagtatcagcattcattcatcgcgctgatattggcggcgttttaaatgtatcagagcttaacttgataaaaagattaattcaagtacaaaatcaattcaagacattttataatcaattggttgaagaagatgaaggtgttaaatacccaatattagatgacaagatgaatcaattacctgtgttaactgatctttttcaacaaataaatgaaacatgcgatacgtatgatttatatgataatgcgagttatgaattgcaagggattagaagtaaaatttctagcacgaatcaacgtattagacaaaatttggaccgtattgttaaaagccaagcaaatcagaaaaaattatcagatgctattgtaacagttaggaatgaaagaaacgttatacctgtcaaagctgaatatcgacaagattttaatgggattgtacatgatcaatctgcttcaggacaaacattgtatattgagccatcatcagttgttgaaatgaataatcaaattagtcgattacgtcatgacgaagcaattgaaaaagaacgcattttaacgcaactaactggttatgtggctgcggacaaagatgcactacttgtggcagaacaagtcatgggtcagttagattttttaatcgcaaaagcgagatatagtagaagtattaaaggaacaaagccgatatttaaagaggaccgtactgtatatttacctaaagcataccatccattattaaatcgtgagactgttgtagctaataccatcgaatttatggaagatattgaaacggtaattattacaggaccgaatacaggtggtaaaactgtaacattaaaaacattaggtttaattattgttatggctcaatcaggattgttgattcccacacttgatggtagtcagttaagtgtatttaaaaatgtatattgcgatatcggagatgaacaatcaatagaacaatcattatcaactttttcatctcatatgacgaatatagttgaaattttaaagcatgcagacaaacatagtttagttttatttgatgaattaggtgcaggtacagatccgagtgaaggtgctgcattagcaatgagcattttagatcatgttagaaaaattggttctctagtaatggcaacgacgcactatcctgaacttaaagcatatagttataatcgagaaggcgttatgaatgcgagtgtagaatttgatgtagatactttgagtccaacgtataagttattaatgggtgtgccgggtcgttcaaatgcttttgacatttctaaaaagttaggtcttagtttgaatattattaataaggctaagacgatgattggtactgatgaaaaagaaataaatgaaatgattgaatcattagagcgtaattacaaacgtgtagagacacagaggttagaactggaccgtcttgtaaaagaagcggagcaagtgcatgatgatttatctaagcagtatcaacaattccaaaattatgaaaagtctctaatagaggaagcgaaagaaaaagcaaatcagaagattaaggctgcaacaaaagaagctgacgatattattaaagacttaagacaattgcgtgaacaaaaaggtgcagatgttaaagaacatgaattgattgataagaagaaacgattagatgatcattatgaagcgaaatctataaagcaaaatgtacaaaagcaaaaatacgataaaattgttgctggtgatgaagtaaaagtattatcttacggtcaaaagggtgaagttttagaaattgtcaatgatgaagaagcaattgttcaaatgggaattattaaaatgaagttacctattgaagatttagagaaaaaacaaaaagaaaaagttaagccaacgaaaatggttacacgtcaaaatcgtcaaacaattaaaactgaacttgacttacgaggctatcgttatgaggatgctttaattgaactagatcaatatttagatcaagccgttttaagtaattacgaacaagtttatatcattcatggtaaaggtacaggtgcacttcaaaaaggtgtacaacaacatttgaaaaagcataaaagtgttagtgactttagaggtggtatgccaagcgaaggtggatttggcgttaccgttgcaacactaaaa

SEQ ID NO: 1140 - protein, 782 aa, Staphylococcus aureus
  MISC_FEATURE (1)..(782): MutS-like protein
MRQKTLDVLEFEKIKSLVANETISDLGLEKVNQMMPATNFETVVFQMEETDEIAQIYNKHRLPSLSGLSKVSAFIHRADIGGVLNVSELNLIKRLIQVQNQFKTFYNQLVEEDEGVKYPILDDKMNQLPVLTDLFQQINETCDTYDLYDNASYELQGIRSKISSTNQRIRQNLDRIVKSQANQKKLSDAIVTVRNERNVIPVKAEYRQDFNGIVHDQSASGQTLYIEPSSVVEMNNQISRLRHDEAIEKERILTQLTGYVAADKDALLVAEQVMGQLDFLIAKARYSRSIKGTKPIFKEDRTVYLPKAYHPLLNRETVVANTIEFMEDIETVIITGPNTGGKTVTLKTLGLIIVMAQSGLLIPTLDGSQLSVFKNVYCDIGDEQSIEQSLSTFSSHMTNIVEILKHADKHSLVLFDELGAGTDPSEGAALAMSILDHVRKIGSLVMATTHYPELKAYSYNREGVMNASVEFDVDTLSPTYKLLMGVPGRSNAFDISKKLGLSLNIINKAKTMIGTDEKEINEMIESLERNYKRVETQRLELDRLVKEAEQVHDDLSKQYQQFQNYEKSLIEEAKEKANQKIKAATKEADDIIKDLRQLREQKGADVKEHELIDKKKRLDDHYEAKSIKQNVQKQKYDKIVAGDEVKVLSYGQKGEVLEIVNDEEAIVQMGIIKMKLPIEDLEKKQKEKVKPTKMVTRQNRQTIKTELDLRGYRYEDALIELDQYLDQAVLSNYEQVYIIHGKGTGALQKGVQQHLKKHKSVSDFRGGMPSEGGFGVTVATLK

SEQ ID NO: 1141 - DNA, 1710 bp, Staphylococcus aureus
atgacaaaaaaagatgttatcaaactattagaacaaattgctacttatatggaattaaaaggggaaaatacttttaaaatatcagcgtatcgaaaagcagctcaaagtcttgaattagatgaacgaccattagatgaaatatctgatgtaacggagttaaaaggcattggtaaaggtgttgcagaagtaatcaatgattaccgtgagaccggtgaatctcagtatttacagcaattacaggaagaagttccggaaggtcttattccacttttgaaaattcaaggacttggaagcaagaaaattgctaagctatataaagagttgaatattgttgataaagcgtcacttcaagttgcttgtgaaaatggaaaagttagtgaattaagcggatttgctaagaaaacggaacaaaacatattagaagctgtgaaacaacttggtgctaagaaagatagatatccaattgatcaaatgagaagacttaatcaagaaatcattgattatatagatacattaaattatatcgatcaatattcatctgcaggaagcttccgtcgttttaaagaaatgagcaaagatttagatttcataataagtaccgataacccaaaagcagtgcagcagcaattattaaatattcccaataaagtaaaagaagttgcagtggggaacacaaaagtttcattagaattagcgtatgatgatgaaacgattggtgtcgattttcgattaattgaaccaagtgctttttatcatacattgcagcattttactgggtcaaaagaacataatataagaattcgacaacttgctaaagcacgtgatgaaaaagtaagtgaatatggaattgaacaagctgatggtacattaattcaatatgatagtgaagccaagatatatgaacattttaatgtgaattttataccacctgctatgcgagaagatggtagcgaatttgataaagatctaagtaatatcattacaatagatgatattaatggtgatattcatatgcatacaacgtatagtgatggtgcgttttctattcgagacatggtagaagcaaatatcgcaaaaggttataaattcatggtaattactgatcattcacaaagtttacgtgttgctaatggcttacaagtagaaagacttttaagacaaaacgaagaaattaaggctttagataaagaatatagtgaaattgatatttattcaggtacagaaatggatatattacctgatggctcgctggattatgatgatgaaattttagcacaacttgattatgtaattggagctattcatcaaagctttaaccaatcagaagaacaaattatggaacgattagctaatgcatgtcgcaatccatacgtgcgacatatagcgcatccaacagggcgtattataggtagaagagatggttataaaccgaatattgaacaattaatggcattagctgaagaaacgaatacagtattagaaattaatgccaatccacatcgactggatctgagcgctgatatcgttcgtaaatatccaaatgtgaaattaactattaacactgatgcgcatcatacaaatcatttagattttatgaattatggcgtagcaactgcgcaaaaaggatttgtaacaaaagatagagtgattaacgcattatcgcgtgaagcttttaaagactttattgaaaataatacaaaacttaagaaa

SEQ ID NO: 1142 - protein, 570 aa, Staphylococcus aureus
  MISC_FEATURE (1)..(570): DNA-dependent DNA
MTKKDVIKLLEQIATYMELKGENTFKISAYRKAAQSLELDERPLDEISDVTELKGIGKGVAEVINDYRETGESQYLQQLQEEVPEGLIPLLKIQGLGSKKIAKLYKELNIVDKASLQVACENGKVSELSGFAKKTEQNILEAVKQLGAKKDRYPIDQMRRLNQEIIDYIDTLNYIDQYSSAGSFRRFKEMSKDLDFIISTDNPKAVQQQLLNIPNKVKEVAVGNTKVSLELAYDDETIGVDFRLIEPSAFYHTLQHFTGSKEHNIRIRQLAKARDEKVSEYGIEQADGTLIQYDSEAKIYEHFNVNFIPPAMREDGSEFDKDLSNIITIDDINGDIHMHTTYSDGAFSIRDMVEANIAKGYKFMVITDHSQSLRVANGLQVERLLRQNEEIKALDKEYSEIDIYSGTEMDILPDGSLDYDDEILAQLDYVIGAIHQSFNQSEEQIMERLANACRNPYVRHIAHPTGRIIGRRDGYKPNIEQLMALAEETNTVLEINANPHRLDLSADIVRKYPNVKLTINTDAHHTNHLDFMNYGVATAQKGFVTKDRVINALSREAFKDFIENNTKLKK

SEQ ID NO: 1143 - DNA, 519 bp, Staphylococcus aureus
atggtcattgattttatcataatcattttctttgtgtattttgtcatcgttggattcagacgaggtttttggttatctatgatacatttgagtgcaacgattgtatcattgtggattgccagtcaattttacaaatctattgtagaaagattaattgtatttattccatatcctaaaacaacagcatttaatacaacttttgcgtttcattttaatcatctacaaaatcgatttgaagcgattgtagcttttttaatgattacattgttttgtaagttcattttatatctaattatcgtaacttttgataaaataatagcgtatcaaaacattcatattttcagtcgtgcaatgggaatgatagttggtgtgtttatgacgataattgtcttacactttacgttatatctattggcattatatcctaacgaagcattacaacatcagcttaaaatatctattgtgagtcattcattgatttttcacatcccatatttatcggctttcaccattaattta

SEQ ID NO: 1144 - protein, 173 aa, Staphylococcus aureus
  MISC_FEATURE (1)..(173): conserved hypothetical
MVIDFIIIIFFVYFVIVGFRRGFWLSMIHLSATIVSLWIASQFYKSIVERLIVFIPYPKTTAFNTTFAFHFNHLQNRFEAIVAFLMITLFCKFILYLIIVTFDKIIAYQNIHIFSRAMGMIVGVFMTIIVLHFTLYLLALYPNEALQHQLKISIVSHSLIFHIPYLSAFTINL

SEQ ID NO: 1145 - DNA, 258 bp, Staphylococcus aureus
atgacacagtttaaaaacaaggtaaatgtatcaattaatgatcagctttttacaattgttggggaagataacccagagcacatacgatatgtagcacatttagttgatgataaaataaaagaattagggtataaagcagcaggtttagatacttcaagaaaagcaatactaactgctgtgaatattatgcatgaaaaagtactactagaagaaaaaaaatcgacgtttgaaacaacaaattcacaaattgcagcagcg

SEQ ID NO: 1146 - protein, 86 aa, Staphylococcus aureus
  MISC_FEATURE (1)..(86): conserved hypothetical
MTQFKNKVNVSINDQLFTIVGEDNPEHIRYVAHLVDDKIKELGYKAAGLDTSRKAILTAVNIMHEKVLLEEKKSTFETTNSQIAAA

SEQ ID NO: 1147 - DNA, 954 bp, Staphylococcus aureus
atgaaaggatttacacaaatggcgaatatcgtttttaaattgtcggataaagacataacgacattaatgtcacgcatttcttttgatactgagaatttacctcaaggtatgaaagcacgtgcaaagtatcaaaatacaactgtaaatatttaccaatcaggtaaagtcatgtttcaaggtaatcatgcagaagctgtgtctgaagaacttctaccgcagcattctcaattgaatactaataaaactaaaaagaaaaatatggctaattcttttcttgaacaaactttaatgtatgatcaatttaactgtattggtagtgatgaggctggaagtggcgattactttggtccgttgactgtgtgtgctgctttcgttaccaaagagcatgtccctattttaaaaactttgggtgtagatgattcaaaaaaattaaccgataccaaaattgtagaacttgctgagcaattggttactttcataccacattcattattaacactacacaatgaaaaatataatattcagcaagcaaaaggctggactcaagtaaaaatgaaagctgcccttcataatgaagccatcaaaaatgtacttgaaaaaattgattcgtctcaattagactatatcgtcattgatcagttcgcaaaacgcgaagtgtatagccattacgcattatcagatataccacttccaaagaaaacaaaatttgaaacaaaaggagaatcgaagtcattagccattgcagtggcaagcataatttctcgatacgcatttgttacatatatggatcaaatatcaaaaaatattaatatgacgattcctaaaggtgccggtgctaaagtcgatgtaatcgccgccaaaattataaaaaaatacggtctttcacgtttagataccatttcaaaaaagcattttaaaaatcgtgaaaaagcccaaaaaattttaaagcctctt

SEQ ID NO: 1148 - protein, 318 aa, Staphylococcus aureus
  MISC_FEATURE (1)..(318): hypothetical protein
MKGFTQMANIVFKLSDKDITTLMSRISFDTENLPQGMKARAKYQNTTVNIYQSGKVMFQGNHAEAVSEELLPQHSQLNTNKTKKKNMANSFLEQTLMYDQFNCIGSDEAGSGDYFGPLTVCAAFVTKEHVPILKTLGVDDSKKLTDTKIVELAEQLVTFIPHSLLTLHNEKYNIQQAKGWTQVKMKAALHNEAIKNVLEKIDSSQLDYIVIDQFAKREVYSHYALSDIPLPKKTKFETKGESKSLAIAVASIISRYAFVTYMDQISKNINMTIPKGAGAKVDVIAAKIIKKYGLSRLDTISKKHFKNREKAQKILKPL

SEQ ID NO: 1149 - DNA, 2400 bp, Staphylococcus aureus
atgttgatatcaaatgaatggttgaaagaatatgtaacaatcgatgattctgtaagtaatttggcagaacgtattacgcgcacaggtattgaagtggatgatttaattgactacacaaaagatatcaaaaatttagttgtcggcttcgttaagtcaaaagagaaacatcctgatgctgataaattaaatgtttgccaagttgatatcggagaagacgaacctgtacaaatcgtttgtggtgcaccgaacgttgatgcaggacaatatgtcattgttgctaaagtaggtggcagattgcctggtggtattaaaattaagcgtgccaaattacgcggtgaacgttcagaaggtatgatttgttcgttacaagaaattggtatttcaagtaactatataccgaaaagttttgaatcaggcatttatgtatttagtgaagcccaagttccaggaacagatgccttacaagctttatatttagatgatcaagtaatggaatttgatttaacgccgaatcgtgcagatgctttaagtatgataggtactgcttatgaagttgcagcattatataatacaaaaatgactaagccagagacaacatcaaatgagcttgatttatctgcaaatgatgaactgactgtgacaattgaaaatgaagataaagtaccatattatagtgcacgtgttgttcacgacgtgacaattgaaccctcgccaatttggatgcaagcacgcttaataaaagcgggtatacgtcctattaataatgttgttgacatttcaaattatgtgttattagaatacggtcaaccattgcacatgtttgatcaagatgcgattggttcacaacaaattgttgttcgtcaagctaatgaaggcgaaaaaatgacaacattagatgatacagaacgtgaattattaacgagcgatattgtcattactaatggacaaactccaattgcattagctggtgttatgggtggcgatttttcagaagttaaagaacaaacatcaaatatagtgattgaaggtgctatttttgatccagtttcaattcgtcatacatcaagacgtttaaatttacgcagtgaatcatctagtcgttttgaaaaaggaatagctactgaatttgtagatgaagcagtcgaccgtgcatgttatttattacaaacttatgcaaacggaaaagtgctaaaagatagagtgtcttcaggagaacttggtgcatttattacaccaatcgacatcactgctgataaaattaatcgcactattggatttgatttgtcacaaaatgatattgttactatttttaatcaactagggtttgatacagaaataaatgatgatgttattacagtgctagtaccatcacgtcgtaaagatattacaattaaagaagatttaattgaagaagttgcacgtatatatggatacgacgatattccatcaacgttacctgtcttcgataaagttactagtggtcagctaactgatcgccaatataaaactagaatggttaaagaagtgttagaaggtgctggattagaccaagctattacgtattcgttagtttctaaagaagatgctactgcattttcgatgcaacagcgtcaaacaattgatttattgatgccaatgagtgaagcgcatgcgtcattacgtcaaagtttattaccacatttaatcgaagcggcatcatataatgtggcacgcaaaaataaagatgtaaaattatttgaaatcggcaatgtcttctttgctaatggagaaggtgaactaccagatcaagttgaatatttaagtggtattttaactggagattatgtagtcaatcaatggcaaggtaagaaagaaacggttgatttctatttagcaaaaggtgtcgtggatcgagtatctgaaaagttaaatcttgaatttagttatcgccgtgctgatattgatggattacatccaggtcgtactgctgaaatcttattagagaataaagttgttggttttattggtgaattacatccaatattagcagctgataatgatttaaaacgtacgtatgtttttgagttgaattttgatgcattaatggctgtgtcggtaggttacattaattaccagccaattccgagattcccaggcatgtctcgtgacattgcattagaagtagatcaaaatattccagcagctgatttattatcaacgattcatgcacatggtggcaatatattaaaagatacacttgtctttgatgtatatcagggcgaacatttagaaaaaggtaaaaaatcaattgcaatacgtttaaattatttagacacagaagaaacattgacagatgagcgcgtttcaaaagtacaagcggaaattgaagcagcattaattgaacaaggtgctgttattaga

SEQ ID NO: 1150 - protein, 800 aa, Staphylococcus aureus
  MISC_FEATURE (1)..(800): Phe-tRNA synthetase beta
MLISNEWLKEYVTIDDSVSNLAERITRTGIEVDDLIDYTKDIKNLVVGFVKSKEKHPDADKLNVCQVDIGEDEPVQIVCGAPNVDAGQYVIVAKVGGRLPGGIKIKRAKLRGERSEGMICSLQEIGISSNYIPKSFESGIYVFSEAQVPGTDALQALYLDDQVMEFDLTPNRADALSMIGTAYEVAALYNTKMTKPETTSNELDLSANDELTVTIENEDKVPYYSARVVHDVTIEPSPIWMQARLIKAGIRPINNVVDISNYVLLEYGQPLHMFDQDAIGSQQIVVRQANEGEKMTTLDDTERELLTSDIVITNGQTPIALAGVMGGDFSEVKEQTSNIVIEGAIFDPVSIRHTSRRLNLRSESSSRFEKGIATEFVDEAVDRACYLLQTYANGKVLKDRVSSGELGAFITPIDITADKINRTIGFDLSQNDIVTIFNQLGFDTEINDDVITVLVPSRRKDITIKEDLIEEVARIYGYDDIPSTLPVFDKVTSGQLTDRQYKTRMVKEVLEGAGLDQAITYSLVSKEDATAFSMQQRQTIDLLMPMSEAHASLRQSLLPHLIEAASYNVARKNKDVKLFEIGNVFFANGEGELPDQVEYLSGILTGDYVVNQWQGKKETVDFYLAKGVVDRVSEKLNLEFSYRRADIDGLHPGRTAEILLENKVVGFIGELHPILAADNDLKRTYVFELNFDALMAVSVGYINYQPIPRFPGMSRDIALEVDQNIPAADLLSTIHAHGGNILKDTLVFDVYQGEHLEKGKKSIAIRLNYLDTEETLTDERVSKVQAEIEAALIEQGAVIR

SEQ ID NO: 1151 - DNA, 1056 bp, Staphylococcus aureus
atgtctgaacaacaaacaatgtcagagttaaaacaacaagcgcttgtagatattaatgaagcaaatgatgaacgtgcactgcaagaagttaaagtgaaatacttaggtaaaaaagggtcagttagcggactaatgaaattgatgaaggatttgccgaatgaagataaacctgcgtttggtcaaaaagtgaatgaattgcgtcaaacaattcaaaatgaattagatgaaagacaacagatgttagttaaagaaaaattaaataagcaattggctgaagaaacaattgatgtatcattaccaggtcgtcatattgaaatcggttcaaagcatccattaacacgtacaatagaagaaattgaagacttattcttaggtttaggttatgaaattgtgaatggatatgaagttgaacaagatcattataacttcgaaatgctgaatttacctaaatcacaccctgcacgtgatatgcaagatagtttctatattacggatgaaattttattacgtacgcatacatcaccagtgcaggcacgtacgatggaatcacgtcatggtcaaggtccagttaaaattatttgccctggtaaagtgtatcgtcgtgactctgatgatgcgacacatagtcatcaatttacacaaatcgaaggattagttgttgataaaaacgttaaaatgagtgatttgaaaggtactttagaattgttagctaagaaattatttggtgctgatcgtgaaattcgtttacgtccaagttacttcccattcactgaaccttctgtagaagttgatgtgtcatgttttaaatgtaaaggaaaaggttgtaatgtgtgtaaacacacaggatggattgaaattttaggtgctggaatggtacatcctaatgtattagaaatggctggttttgattcttcagagtactctggatttgcatttggtatgggaccagaccgtattgcaatgttgaaatatggtatagaagatattcgtcatttctatactaatgatgtgagatttttagatcaatttaaagcggtagaagatagaggtgacatg

SEQ ID NO: 1152 - protein, 352 aa, Staphylococcus aureus
  MISC_FEATURE (1)..(352): Phe-tRNA synthetase alpha
MSEQQTMSELKQQALVDINEANDERALQEVKVKYLGKKGSVSGLMKLMKDLPNEDKPAFGQKVNELRQTIQNELDERQQMLVKEKLNKQLAEETIDVSLPGRHIEIGSKHPLTRTIEEIEDLFLGLGYEIVNGYEVEQDHYNFEMLNLPKSHPARDMQDSFYITDEILLRTHTSPVQARTMESRHGQGPVKIICPGKVYRRDSDDATHSHQFTQIEGLVVDKNVKMSDLKGTLELLAKKLFGADREIRLRPSYFPFTEPSVEVDVSCFKCKGKGCNVCKHTGWIEILGAGMVHPNVLEMAGFDSSEYSGFAFGMGPDRIAMLKYGIEDIRHFYTNDVRFLDQFKAVEDRGDM

SEQ ID NO: 1153 - DNA, 738 bp, Staphylococcus aureus
atggaacaaattacttctgcacaaaataatagaattaaacaagcgaacaagctaaaaaagaaacgtgagagggataaaactggattagctttaattgaaggtgtgcatttaattgaagaagcttatcaaagtggaattgtaattacacaattatttgcaattgaaccggcaagattagatcagcaaattatcgcatacgcgcaagaagtttttgaaataaacatgaaagttgctgaatctttatcaggtacagtgacaccacaagggtttttcgcaatcattgagaagccgcattatgatatttctaaagcacaacaagtattgctcatcgatcgtgttcaagatcctggaaatttaggcacattaattagaactgcggatgctgctggaatggatgctgtaataatggagaagggtacgacagatccttatcaagataaagtgttgcgagcgagtcaaggtagtgttttccatttgccagttatgacacaagatctcgatacgtttattactcaatttaatggtcctgtttatggtacagcacttgaaaacgcagtggcatacaaagaagttacttcaagtgattcttttgcattactattaggtaatgagggagaaggtgttaatcctgaattattagcacatactacacaaaatttaatcatacctatttatggtaaagctgaaagtttaaatgtagcgattgcaggtagtattttactttatcatttgaaaggt

SEQ ID NO: 1154 - protein, 246 aa, Staphylococcus aureus
  MISC_FEATURE (1)..(246): hypothetical protein
MEQITSAQNNRIKQANKLKKKRERDKTGLALIEGVHLIEEAYQSGIVITQLFAIEPARLDQQIIAYAQEVFEINMKVAESLSGTVTPQGFFAIIEKPHYDISKAQQVLLIDRVQDPGNLGTLIRTADAAGMDAVIMEKGTTDPYQDKVLRASQGSVFHLPVMTQDLDTFITQFNGPVYGTALENAVAYKEVTSSDSFALLLGNEGEGVNPELLAHTTQNLIIPIYGKAESLNVAIAGSILLYHLKG

SEQ ID NO: 1155 - DNA, 321 bp, Staphylococcus aureus
atgaaatttatggcagaaaataggctgacgttaacaaaaggaacagcaaaagatattatagaacgattttacacgagacatgggattgaaacattagaaggctttgatggcatgtttgttacacaaactttagaacaagaagattttgatgaagtgaaaattttaacagtttggaaatcaaagcaagcttttacggattggttaaaatctgatgtctttaaagcagcgcataaacatgttagaagtaaaaatgaagatgaaagtagcccgattataaataacaaagtaattacatatgatataggctatagttacatgaaa

SEQ ID NO: 1156 - protein, 107 aa, Staphylococcus aureus
  MISC_FEATURE (1)..(107): conserved hypothetical
MKFMAENRLTLTKGTAKDIIERFYTRHGIETLEGFDGMFVTQTLEQEDFDEVKILTVWKSKQAFTDWLKSDVFKAAHKHVRSKNEDESSPIINNKVITYDIGYSYMK

SEQ ID NO: 1157 - DNA, 732 bp, Staphylococcus aureus
atgagaatgaagcgatttttaactattgtacaaattttattggttgtaattattatcatttttggttacaaaattgttcaaacatatattgaagacaagcaagaacgcgcaaattatgagaaattacaacaaaaatttcaaatgctgatgagcaaacatcaagaacatgtgagaccacaatttgaatcacttgaaaaaataaataaagacattgttggatggataaaattatcaggaacatcattaaattatccagtactacaaggtaagacaaatcacgattatttaaatttagattttgagcgagaacatcgacgtaaaggtagtatttttatggattttagaaatgaattgaagaatttaaatcataatactattttatacgggcaccatgtcggtgataatacgatgtttgatgtgttagaagattatttaaagcaatcgttttatgaaaaacacaagataattgaatttgacaataaatatggtaaatatcaattgcaagtatttagtgcatataaaactactactaaagataattacatacgtacagattttgaaaatgatcaagattatcaacaatttttagatgagacaaaacgtaaatctgtaattaattcagatgttaatgtaacggtaaaagatagaataatgactttatcaacgtgcgaagatgcatatagtgaaacgacgaaaagaattgttgttgtcgcaaaaataattaaggtaagt

SEQ ID NO: 1158 - protein, 244 aa, Staphylococcus aureus
  MISC_FEATURE (1)..(244): conserved hypothetical
MRMKRFLTIVQILLVVIIIIFGYKIVQTYIEDKQERANYEKLQQKFQMLMSKHQEHVRPQFESLEKINKDIVGWIKLSGTSLNYPVLQGKTNHDYLNLDFEREHRRKGSIFMDFRNELKNLNHNTILYGHHVGDNTMFDVLEDYLKQSFYEKHKIIEFDNKYGKYQLQVFSAYKTTTKDNYIRTDFENDQDYQQFLDETKRKSVINSDVNVTVKDRIMTLSTCEDAYSETTKRIVVVAKIIKVS

SEQ ID NO: 1159 - DNA, 777 bp, Staphylococcus aureus
atgatgataaaaaataaaaagaaactactatttttatgtttgttagtcattttaatcgcaactgcttatatttcgtttgtaaccggtacaattaaattgtcatttaatgacctatttacaaaatttacaactggtagcaatgaagcagtggattcaatcattgatttgcgattgccacgtatattaattgcattgatggttggcgcaatgttagcagtttctggagcattattacaagcagcactacaaaatcctttggcagaggcgaatatcattggcgtttcctcaggtgcacttataatgagagcactttgtatgttgtttattccacaattgtacttttacttaccattattaagttttattggaggtttaataccatttttaataattatattgttgcattctaaatttagattcaatgctgtaagtatgatattagtaggtgttgcgttattcgtattattaaatggtgttttagaaattttaactcaaaaccctttaatgaaaattcctcaaggcttaacaatgaaaatatggagcgacgtatacatattagcagtatcagcattattgggattaatattaacattactattgtcccctaaattgaatttactaaatttagacgacatacaagcgcgaagtatcggttttaatattgatcgttacagatggttaacaggtttattagcagtatttttagcaagtgcaactgttgcgattgttggacaactagcctttttaggtattattgtgcacatgtggttagaaagc

SEQ ID NO: 1160 - protein, 259 aa, Staphylococcus aureus
  MISC_FEATURE (1)..(259): hypothetical protein
MMIKNKKKLLFLCLLVILIATAYISFVTGTIKLSFNDLFTKFTTGSNEAVDSIIDLRLPRILIALMVGAMLAVSGALLQAALQNPLAEANIIGVSSGALIMRALCMLFIPQLYFYLPLLSFIGGLIPFLIIILLHSKFRFNAVSMILVGVALFVLLNGVLEILTQNPLMKIPQGLTMKIWSDVYILAVSALLGLILTLLLSPKLNLLNLDDIQARSIGFNIDRYRWLTGLLAVFLASATVAIVGQLAFLGIIVHMWLES

SEQ ID NO: 1161 - DNA, 876 bp, Staphylococcus aureus
ttgagaatcataaagtatttaaccattttagtgataagcgtcgttatcttaaccagctgtcaatcttccagttctcaagaatcaactaaatccggcgaattcagaatcgtaccaacaactgttgcattgacaatgacattggacaaattggatttaccaattgtcggcaaacccacgtcatataagacattgcctaatcgttataaagatgtaccggaaattggtcaaccaatggagccgaatgttgaagctgttaaaaagttaaaaccaacacatgttttgagtgtgtcaacgattaaagatgaaatgcaaccattttacaaacaattaaatatgaaaggctacttttatgattttgatagtttaaaagggatgcaaaagtcgattacacaattaggtgatcaatttaatcgtaaagcacaagcaaaagaattaaatgaccatttaaattctgtaaagcaaaaaattgaaaataaagcagctaaacaaaagaaacatcccaaagtattaatattaatgggtgtaccgggtagctatttagtagcaactgataaatcatatattggtgatttagttaaaatagcaggtggagaaaatgttattaaagtgaaagatcgtcaatatatttcgtctaatactgaaaatttgttgaatatcaatccagatattattttacgattaccacacggaatgcctgaagaagttaagaaaatgtttcaaaaagaatttaaacaaaatgatatttggaaacattttaaagctgtgaaaaataatcatgtttatgacttagaggaagtgccattcggtattacagcaaatgttgatgctgataaggcaatgactcaattatatgatttattttataaggataaaaaa

SEQ ID NO: 1162 - protein, 292 aa, Staphylococcus aureus
  MISC_FEATURE (1)..(292): hypothetical protein
LRIIKYLTILVISVVILTSCQSSSSQESTKSGEFRIVPTTVALTMTLDKLDLPIVGKPTSYKTLPNRYKDVPEIGQPMEPNVEAVKKLKPTHVLSVSTIKDEMQPFYKQLNMKGYFYDFDSLKGMQKSITQLGDQFNRKAQAKELNDHLNSVKQKIENKAAKQKKHPKVLILMGVPGSYLVATDKSYIGDLVKIAGGENVIKVKDRQYISSNTENLLNINPDIILRLPHGMPEEVKKMFQKEFKQNDIWKHFKAVKNNHVYDLEEVPFGITANVDADKAMTQLYDLFYKDKK

SEQ ID NO: 1163 - DNA, 1074 bp, Staphylococcus aureus
atgagaaatgttaaacaaattgctacaaaatctattatagctattattagcttaggtatacttacatatacaacaatgattggtagcgtgttggctgatgagataaaatatccatcagccaaatttaatcaacctgaagcaaaagataaaacagaattaactacatcaatttttgatgaaaagataaaagagaataaagcgttagagttactaatttttaatcaagaaaataaaaatgtaactgaggaacaacaactagttgacgaaaaggcgcaattgatttcagatatgactggtaaaatttacttgcaagtaaagctaaaaggtcaaatagataaagaacaacttgtttttcaaaatgacaaaaatgaagaatttccttttgttataaaagatgaaaaggatgacacaatagtaagaattttaattgaacagcatatggataaaatcaatatgcatgttaaaacgttggctgaaaagaaaaatctagataacaaagaaatggtgtattctattcattttaaagagaaaaaagtacaacatgatgatgcaaaagaagtgccttcaaaacatcaaaatcaagaaaataatcaagatcagcttaaaaaagatattgatgacaaaaaagatagtcaaaaatcagatactaaggaaagacgtactagcctttttactgaaaaaggattaaatgatattcctgtacaaaaagataaagtgcaacaagacagtaataaaaagattgaaaatgagcgacctaaagcatcaggtacattaaaagttgaaaatagccctccaacaataaaaaaggttgaaaataatcacaaagagcaaccgaaacataaagatgaaaaatcaaaaaaggaaaagaaaaaagtagttgaaaaagaaaaagcgttaccagcttttaatagagatgatgatagcaagaatagtagtcaattatctagtgatattaaagaacttgatgaaccaaatcataaaaagcaatatatgttatttgcagctggcattgtgttagcaactattttacttatttcggcacatttatacagcagaaagagaggtaaccaagtt

SEQ ID NO: 1164 - protein, 358 aa, Staphylococcus aureus
  MISC_FEATURE (1)..(358): conserved hypothetical
MRNVKQIATKSIIAIISLGILTYTTMIGSVLADEIKYPSAKFNQPEAKDKTELTTSIFDEKIKENKALELLIFNQENKNVTEEQQLVDEKAQLISDMTGKIYLQVKLKGQIDKEQLVFQNDKNEEFPFVIKDEKDDTIVRILIEQHMDKINMHVKTLAEKKNLDNKEMVYSIHFKEKKVQHDDAKEVPSKHQNQENNQDQLKKDIDDKKDSQKSDTKERRTSLFTEKGLNDIPVQKDKVQQDSNKKIENERPKASGTLKVENSPPTIKKVENNHKEQPKHKDEKSKKEKKKVVEKEKALPAFNRDDDSKNSSQLSSDIKELDEPNHKKQYMLFAAGIVLATILLISAHLYSRKRGNQV

SEQ ID NO: 1165 - DNA, 681 bp, Staphylococcus aureus
ttgaaaaatattttaaaagtttttaatacaacgattttagcgttaattatcatcatcgcgacattcagtaattctgcaaatgccgcagatagcggtactttgaattatgaggtttacaaatacaataccaatgacacgtcaattgctaatgactattttaataaaccggcaaagtacattaagaaaaatggtaaattgtatgttcaaataactgtcaaccacagtcattggattactggaatgagtatcgaaggacataaagaaaatattattagtaaaaacactgccaaagatgaacgcacttctgaatttgaagtaagtaagttgaacggtaaaatagatggaaaaattgacgtttatatcgatgaaaaagtaaatggaaagccattcaaatatgaccatcattacaacattacatataaatttaatggaccaactgatgtagcaggtgctaatgcaccaggtaaagatgataaaaattctgcttcaggtagtgacaaaggatctgatggaacgactactggtcaaagtgaatctaatagttcgaataaagacaaagtagaaaatccacaaacaaatgctggtacacctgcatatatatatgcaataccagttgcatccttagcattattaatcgcaatcacattgtttgttagaaaaaaatctaaaggcaatgtggaa

SEQ ID NO: 1166 - protein, 227 aa, Staphylococcus aureus
  MISC_FEATURE (1)..(227): conserved hypothetical
LKNILKVFNTTILALIIIIATFSNSANAADSGTLNYEVYKYNTNDTSIANDYFNKPAKYIKKNGKLYVQITVNHSHWITGMSIEGHKENIISKNTAKDERTSEFEVSKLNGKIDGKIDVYIDEKVNGKPFKYDHHYNITYKFNGPTDVAGANAPGKDDKNSASGSDKGSDGTTTGQSESNSSNKDKVENPQTNAGTPAYIYAIPVASLALLIAITLFVRKKSKGNVE

SEQ ID NO: 1167 - DNA, 1050 bp, Staphylococcus aureus
atgacaaaacattatttaaacagtaagtatcaatcagaacaacgttcatcagctatgaaaaagattacaatgggtacagcatctatcattttaggttcccttgtatacataggcgcagacagccaacaagtcaatgcggcaacagaagctacgaacgcaactaataatcaaagcacacaagtttctcaagcaacatcacaaccaattaatttccaagtgcaaaaagatggctcttcagagaagtcacacatggatgactatatgcaacaccctggtaaagtaattaaacaaaataataaatattatttccaaaccgtgttaaacaatgcatcattctggaaagaatacaaattttacaatgcaaacaatcaagaattagcaacaactgttgttaacgataataaaaaagcggatactagaacaatcaatgttgcagttgaacctggatataagagcttaactactaaagtacatattgtcgtgccacaaattaattacaatcatagatatactacgcatttggaatttgaaaaagcaattcctacattagctgacgcagcaaaaccaaacaatgttaaaccggttcaaccaaaaccagctcaacctaaaacacctactgagcaaactaaaccagttcaacctaaagttgaaaaagttaaacctactgtaactacaacaagcaaagttgaagacaatcactctactaaagttgtaagtactgacacaacaaaagatcaaactaaaacacaaactgctcatacagttaaaacagcacaaactgctcaagaacaaaataaagttcaaacacctgttaaagatgttgcaacagcgaaatctgaaagcaacaatcaagctgtaagtgataataaatcacaacaaactaacaaagttacaaaacataacgaaacgcctaaacaagcatctaaagctaaagaattaccaaaaactggtttaacttcagttgataactttattagcacagttgccttcgcaacacttgcccttttaggttcattatctttattacttttcaaaagaaaagaatctaaa

SEQ ID NO: 1168 - protein, 350 aa, Staphylococcus aureus
  MISC_FEATURE (1)..(350): cell surface protein
MTKHYLNSKYQSEQRSSAMKKITMGTASIILGSLVYIGADSQQVNAATEATNATNNQSTQVSQATSQPINFQVQKDGSSEKSHMDDYMQHPGKVIKQNNKYYFQTVLNNASFWKEYKFYNANNQELATTVVNDNKKADTRTINVAVEPGYKSLTTKVHIVVPQINYNHRYTTHLEFEKAIPTLADAAKPNNVKPVQPKPAQPKTPTEQTKPVQPKVEKVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTSVDNFISTVAFATLALLGSLSLLLFKRKESK

SEQ ID NO: 1169 - DNA, 1935 bp, Staphylococcus aureus
atgaacaaacagcaaaaagaatttaaatcattttattcaattagaaagtcatcactaggcgttgcatctgtagcaattagtacacttttattattaatgtcaaatggcgaagcacaagcagcagctgaagaaacaggtggtacaaatacagaagcacaaccaaaaactgaagcagttgcaagtccaacaacaacatctgaaaaagctccagaaactaaaccagtagctaatgctgtctcagtatctaataaagaagttgaggcccctacttctgaaacaaaagaagctaaagaagttaaagaagttaaagcccctaaggaaacaaaagaagttaaaccagcagcaaaagccactaacaatacatatcctattttgaatcaggaacttagagaagcgattaaaaaccctgcaataaaagacaaagatcatagcgcaccaaactctcgtccaattgattttgaaatgaaaaagaaagatggaactcaacagttttatcattatgcaagttctgttaaacctgctagagttattttcactgattcaaaaccagaaattgaattaggattacaatcaggtcaattttggagaaaatttgaagtttatgaaggtgacaaaaagttgccaattaaattagtatcatacgatactgttaaagattatgcttacattcgcttctctgtatcaaacggaacaaaagctgttaaaattgttagttcaacacacttcaataacaaagaagaaaaatacgattacacattaatggaattcgcacaaccaatttataacagtgcagataaattcaaaactgaagaagattataaagctgaaaaattattagcgccatataaaaaagcgaaaacactagaaagacaagtttatgaattaaataaaattcaagataaacttcctgaaaaattaaaggctgagtacaagaagaaattagaggatacaaagaaagctttagatgagcaagtgaaatcagctattactgaattccaaaatgtacaaccaacaaatgaaaaaatgactgatttacaagatacaaaatatgttgtttatgaaagtgttgagaataacgaatctatgatggatacttttgttaaacaccctattaaaacaggtatgcttaacggcaaaaaatatatggtcatggaaactactaatgacgattactggaaagatttcatggttgaaggtcaacgtgttagaactataagcaaagatgctaaaaataatactagaacaattattttcccatatgttgaaggtaaaactctatatgatgctatcgttaaagttcacgtaaaaacgattgattatgatggacaataccatgtcagaatcgttgataaagaagcatttacaaaagccaataccgataaatctaacaaaaaagaacaacaagataactcagctaagaaggaagctactccagctacgcctagcaaaccaacaccatcacctgttgaaaaagaatcacaaaaacaagacagccaaaaagatgacaataaacaattaccaagtgttgaaaaagaaaatgacgcatctagtgagtcaggtaaagacaaaacgcctgctacaaaaccaactaaaggtgaagtagaatcaagtagtacaactccaactaaggtagtatctacgactcaaaatgttgcaaaaccaacaactgcttcatcaaaaacaacaaaagatgttgttcaaacttcagcaggttctagcgaagcaaaagatagtgctccattacaaaaagcaaacattaaaaacacaaatgatggacacactcaaagccaaaacaataaaaatacacaagaaaataaagcaaaatcattaccacaaactggtgaagaatcaaataaagatatgacattaccattaatggcattattagctttaagtagcatcgttgcattcgtattacctagaaaacgtaaaaac

SEQ ID NO: 1170 - protein, 645 aa, Staphylococcus aureus
  MISC_FEATURE (1)..(645): conserved hypothetical
MNKQQKEFKSFYSIRKSSLGVASVAISTLLLLMSNGEAQAAAEETGGTNTEAQPKTEAVASPTTTSEKAPETKPVANAVSVSNKEVEAPTSETKEAKEVKEVKAPKETKEVKPAAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKTEEDYKAEKLLAPYKKAKTLERQVYELNKIQDKLPEKLKAEYKKKLEDTKKALDEQVKSAITEFQNVQPTNEKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDMTLPLMALLALSSIVAFVLPRKRKN

SEQ ID NO: 1171 - DNA, 129 bp, Staphylococcus aureus
atggcagtaccaaaaagaagaacttctaaaactagaaaaaacaaacgtcgtacgcatttcaaaatttcagtaccaggtatgactgaatgcccaaactgtggtcgaatacaaattatcacaccgtgtatg

SEQ ID NO: 1172 - protein, 43 aa, Staphylococcus aureus
  MISC_FEATURE (1)..(43): ribosomal protein L32
MAVPKRRTSKTRKNKRRTHFKISVPGMTECPNCGRIQIITPCM

SEQ ID NO: 1173 - DNA, 861 bp, Staphylococcus aureus
ttggatacaccgaagaaacaacaatttgcctttaataatatacaaatgaacatgtcgaaatcagatgttgagaaaacattaaataaaccaaaaagagtgacatttaatgaatatggtacgaagtggtatacgtattatgatgacgattacaataattttataatgataagttacatgaaagataaagttaatgcgttatatacaaatcaaaatataatcacttcaaaatcaaaaattaaatacaatacacctaaatcggttgtaaggcaaagattaggcgaaccagaaacagagattgttaaaggtagagtgcgttacgaacaaaataataaagaatatgatgttttccataaaaatcacatttatacgacggtattttatgataagcatcgacgtaataatgtaacagctgttttacaagtaagtgatgctatggaaaatagattaaaagaacaatatggagcaccatcgaaatcgcttgcagatagttttgaactacaaaattttgatttagttaatgctgaaagaaaacaacatcaattatctacattgaagtattctaaacagaattctgaaactgcacgtaagcatagtaaagatatggccaacaatcattattttgatcatacaaatttaaaaggtcaatcaccatttgatcgattgaaaaaagatggtattacatttaactcagccggagagaatttagcatatggtcaagttagtagtatctatgcacatcaaggattaatgaattctattggtcacagaaaaaatattttaaatgatacgtttaaaatattaggtgttggtgttgattttaatgatgaaaaacaacctttttggacagaaaattatactggt

SEQ ID NO: 1174 - protein, 287 aa, Staphylococcus aureus
  MISC_FEATURE (1)..(287): conserved hypothetical
LDTPKKQQFAFNNIQMNMSKSDVEKTLNKPKRVTFNEYGTKWYTYYDDDYNNFIMISYMKDKVNALYTNQNIITSKSKIKYNTPKSVVRQRLGEPETEIVKGRVRYEQNNKEYDVFHKNHIYTTVFYDKHRRNNVTAVLQVSDAMENRLKEQYGAPSKSLADSFELQNFDLVNAERKQHQLSTLKYSKQNSETARKHSKDMANNHYFDHTNLKGQSPFDRLKKDGITFNSAGENLAYGQVSSIYAHQGLMNSIGHRKNILNDTFKILGVGVDFNDEKQPFWTENYTG

SEQ ID NO: 1175 - DNA, 102 bp, Staphylococcus aureus
atgaatggtttaaattctgttattggcgcaatgataataattgataaaaacgcaacaacagttactatgaattttttaatttacatcacctactataaatat

SEQ ID NO: 1176 - protein, 34 aa, Staphylococcus aureus
MNGLNSVIGAMIIIDKNATTVTMNFLIYITYYKY

SEQ ID NO: 1177 - DNA, 96 bp, Staphylococcus aureus
atgagcttgctaaacagcaagcaacaagatgattcagaatcacgacaagttgatccaaggcttcaaaaattacaacaattatatgataaagagcaa

SEQ ID NO: 1178 - protein, 32 aa, Staphylococcus aureus
MSLLNSKQQDDSESRQVDPRLQKLQQLYDKEQ

SEQ ID NO: 1179 - DNA, 102 bp, Staphylococcus aureus
ttgtacccttctaaatcaaatacttctgtagtagttacatctagtgggacttttactggtacaagagtacgtgcacaaggcattgtatacgttccagtaatg

SEQ ID NO: 1180 - protein, 34 aa, Staphylococcus aureus
LYPSKSNTSVVVTSSGTFTGTRVRAQGIVYVPVM

SEQ ID NO: 1181 - DNA, 159 bp, Staphylococcus aureus
atggttaatcttcaggatattgtcgaggatatagttattattgagaaaccaatgagagcttattcagagcaaagtgaccaaatgttgacagtaggtaatggttgggaagtaatcgatgaggatcaattagatgagcttgctaaacagcaagcaacaaga

SEQ ID NO: 1182 - protein, 53 aa, Staphylococcus aureus
  MISC_FEATURE (1)..(53): conserved hypothetical
MVNLQDIVEDIVIIEKPMRAYSEQSDQMLTVGNGWEVIDEDQLDELAKQQATR

SEQ ID NO: 1183 - DNA, 93 bp, Staphylococcus aureus
ttgttaaattcattatctgggttaattaatgaaccaaaaaagtttactgatttggattgtataagcttattagacaaaaaagaccaagttgtt

SEQ ID NO: 1184 - protein, 31 aa, Staphylococcus aureus
LLNSLSGLINEPKKFTDLDCISLLDKKDQVV

SEQ ID NO: 1185 - DNA, 144 bp, Staphylococcus aureus
ttgaatggtggtgagaattttatggcggataaaaacaaaaaacaagaagctactcgtagtaacccaataaacaaaagttttgaaaagccgggtgccagcgaaaacttaaaaagcactttatcagaaaaagctaagaaaaaagat

SEQ ID NO: 1186 - protein, 48 aa, Staphylococcus aureus; identical to SEQ ID NO: 172

SEQ ID NO: 1187 - DNA, 165 bp, Staphylococcus aureus
ttgcaaaataaaaaagaaactatagtatatgaagttttaactagtggtaatcaaccattcacttatgagttacctaaagatttatcgtcacataatgcgcgtaaatacttggaatttatttcacaaaaattagatggcgataagttaaccaaagaagattcatta

SEQ ID NO: 1188 - protein, 55 aa, Staphylococcus aureus
  MISC_FEATURE (1)..(55): hypothetical protein
LQNKKETIVYEVLTSGNQPFTYELPKDLSSHNARKYLEFISQKLDGDKLTKEDSL

SEQ ID NO: 1189 - DNA, 768 bp, Staphylococcus aureus
atgagagaaaaagtttcaaatagacttaaacacattatgaaaataagaaacttaaaacaagtagatatcattaataaatcgaaaccttatcaaaagaaactaggtatatctttaagtaaaagcactttatctcaatatattaacgacgtacaatcacccgaccaagatagaatttacctactttctaaaactctgaacgttggtgaagcgtggcttatggggtatgatgtagattcttatcgagttcctgatgaagaacgtcaagatgaaacgataatgtcaaaaatcaataacatattttctcaactcacacctccccgccaagaaaacgtacttaactatgcaaatgaacaattggaagaacagaataaagtcacttctatagatggatataaagagtctaaactagtatcgtatattgcatgtggtgcaactggtgctggcataggagaagaattatatgatgacatattgcatgaagaagtattttttaaagaagacgaaacgccatcaaatgctgatttttgtattttagttaatggtgattcaatggaacctatgttaaaacaaggaacatacgcttttattaagaaagaagattctattaaagatggtacaattgcactcgttgtattagatggagtaagtcttatcaagcgtgtagatatatgcgaagactatattaatttggtatctctaaatccgaagtatgatgatatcaaagtcgcttcgtttagtgatattaaagtaatgggcaaagttgtattg

SEQ ID NO: 1190 - protein, 256 aa, Staphylococcus aureus
  MISC_FEATURE (1)..(256): repressor homolog
MREKVSNRLKHIMKIRNLKQVDIINKSKPYQKKLGISLSKSTLSQYINDVQSPDQDRIYLLSKTLNVGEAWLMGYDVDSYRVPDEERQDETIMSKINNIFSQLTPPRQENVLNYANEQLEEQNKVTSIDGYKESKLVSYIACGATGAGIGEELYDDILHEEVFFKEDETPSNADFCILVNGDSMEPMLKQGTYAFIKKEDSIKDGTIALVVLDGVSLIKRVDICEDYINLVSLNPKYDDIKVASFSDIKVMGKVVL

SEQ ID NO: 1191 - DNA, 246 bp, Staphylococcus aureus
gtgaacttgagaggaggtgcttttatgtgttacgactactcacgtttgagcgggaaaatagtagaaaagtatggcactcagtacaattttgcaattgctatgaaattgtcagagagaagtttatccttaaaactcaacggtaaagttggttggaaagacagtgaaatatggaaagctatacaactactagatataccggtagagaaaatacacttatatttttttaaagaaaaagttcatgttata

SEQ ID NO: 1192 - protein, 82 aa, Staphylococcus aureus
VNLRGGAFMCYDYSRLSGKIVEKYGTQYNFAIAMKLSERSLSLKLNGKVGWKDSEIWKAIQLLDIPVEKIHLYFFKEKVHVI

SEQ ID NO: 1193 - DNA, 279 bp, Staphylococcus aureus
atgaacttaaggaggggcacaatggaacaaatcacgttaaccaaagaagagtgtgtcgaacaatgcatcaataaagacttaaaacttttagattatcgagttcaacaaattttagaaggtgttctatcagaaagtaccacatacggtgatgcaagaaataaattagaaacattgaaaattattgctgaatctcattttaaaaccgaacatgcttcagttatttacaaattagcattgaaaaagttagacgaaaaaatcaacgccactccaattaaagag

SEQ ID NO: 1194 - protein, 93 aa, Staphylococcus aureus
  MISC_FEATURE (1)..(93): hypothetical protein
MNLRRGTMEQITLTKEECVEQCINKDLKLLDYRVQQILEGVLSESTTYGDARNKLETLKIIAESHFKTEHASVIYKLALKKLDEKINATPIKE

SEQ ID NO: 1195 - DNA, 546 bp, Staphylococcus aureus
gtgataagtatggacataatcgcgatttgtatcgcaatttttagtttcttactgactgcacttaaatattatttagactatatgaaagattctattaacatcgatgttatacctaccagaagctttaattacttggtcgatgacaaatcaagttacaacgatataacatttattaatttcacaaagtttcccatttctgttattgacgttgaatttgatattaaaaataaagtaaatgaacaaaaaacgttcaaacctatacgatataaagataaaaactactccattccatttactttaggaccttatgaaagtgtagaatgtacttttttgctcgaagaatatccagtgatatgggaatgggatgtgactatcaaagtcactaccaacaaaggaatctatataaagcctgttatcatagaatcgcggacagaacaccgagaatcagagccacaagtgacagagttaacatcagcaaataaggtaagtgctctttccaaccccaaggatggttttttaaagaagtttttatatcatttaaaacct

SEQ ID NO: 1196 - protein, 182 aa, Staphylococcus aureus
  MISC_FEATURE (1)..(182): hypothetical protein
VISMDIIAICIAIFSFLLTALKYYLDYMKDSINIDVIPTRSFNYLVDDKSSYNDITFINFTKFPISVIDVEFDIKNKVNEQKTFKPIRYKDKNYSIPFTLGPYESVECTFLLEEYPVIWEWDVTIKVTTNKGIYIKPVIIESRTEHRESEPQVTELTSANKVSALSNPKDGFLKKFLYHLKP

SEQ ID NO: 1197 - DNA, 354 bp, Staphylococcus aureus
atgcaagcattaaaaacaaaatcgaacatcggcgaaatgttcaacatacaagaaaaagaaaatggagaaatcgcaataagtgcaagagagttatataaagctttggaagttaaaaagcgttttagcgcttgggcagaaattaacttgaagcatttcaaagaaaatagggattttacaagtgtacttacaagtacggttgttaataacggagctgtaagacaactagaagattatgctttaacacttgatgtagctaaacatgttgcgatgatgtcaggtacagaaaaaggttttgattttagagagtatttcatccaagtagagaaagcatggaacagtccagaaatgattatg

SEQ ID NO: 1198 - protein, 118 aa, Staphylococcus aureus
  MISC_FEATURE (1)..(118): hypothetical protein
MQALKTKSNIGEMFNIQEKENGEIAISARELYKALEVKKRFSAWAEINLKHFKENRDFTSVLTSTVVNNGAVRQLEDYALTLDVAKHVAMMSGTEKGFDFREYFIQVEKAWNSPEMIM

SEQ ID NO: 1199 - DNA, 171 bp, Staphylococcus aureus
gtggattataacatgcctacacagtattcaatggaacgtgagttattcgaaattaaagaaacatcaatcacacattcggacggtcatacatcaattagtaagacgccaaaagtaacaggcaaaggacaacaatactttgttaataagtttttaggagaaaaacaaacatct

SEQ ID NO: 1200 - protein, 57 aa, Staphylococcus aureus
  MISC_FEATURE (1)..(57): hypothetical protein
VDYNMPTQYSMERELFEIKETSITHSDGHTSISKTPKVTGKGQQYFVNKFLGEKQTS

SEQ ID NO: 1201 - DNA, 195 bp, Staphylococcus aureus
atgcaagctcaaaacaaaaaagtcatttattactactatgacgaagccggtaatagacgacccgttaatattcaatacaacgatggctacgacttaatgatagacccgcgttttattgaaatgacgcttgaaagacatccgcatttaaaaaataacttttatggattaatagatggaaaagaatttaagttagat

SEQ ID NO: 1202 - protein, 65 aa, Staphylococcus aureus
  MISC_FEATURE (1)..(65): hypothetical protein
MQAQNKKVIYYYYDEAGNRRPVNIQYNDGYDLMIDPRFIEMTLERHPHLKNNFYGLIDGKEFKLD

SEQ ID NO: 1203 - DNA, 138 bp, Staphylococcus aureus
atgttacaaaaatttagaatcgcgaaagaaaaaaataaattaaaactcaaattactaaagcatgctagttactgtttagaaagaagtaacaaccctgaattgttgcgagcagttgcagagttgttaaagaaggttaac

SEQ ID NO: 1204 - protein, 46 aa, Staphylococcus aureus
  MISC_FEATURE (1)..(46): hypothetical protein
MLQKFRIAKEKNKLKLKLLKHASYCLERSNNPELLRAVAELLKKVN

SEQ ID NO: 1205 - DNA, 639 bp, Staphylococcus aureus
gtgatattggtgtatattgatcctttaaaaaatgttcgtttttctattaataacgtaattagtaatgttgaaatttctaaaagtatggcaattaaacaatctttaaaacctaagtaccaattagatataattaatagaaacaacataaatttattttctgacttcaaagtagactttcatctaaacaacttaattgaaatgaattttaatttgcgtaattctttttcatctctaacatttcaaagaaatttattttctgaagaaacgataaaatcttttaaggaactctataggtttgatgatgagattgtacttcaagcacaacagaccattagagatttttatatcaatccaactgctatctctactttggctgaagccatcaattcgacctatccaataaatgagcaaagtacctacaagagacacgatgaatttgtcaaacgtatcgaaaatgattttccacatcctttcaaaaagttaataagatggtctaatggcattgcagcaggtgctgacattcaaatctttgtaacaaactatataaacgagaacgatttacatattcaaaattcattgatagttgctatagtttgtttattaagttttttatcgacctattgttcacattctaaaaag

SEQ ID NO: 1206 - protein, 213 aa, Staphylococcus aureus
  MISC_FEATURE (1)..(213): hypothetical protein
VILVYIDPLKNVRFSINNVISNVEISKSMAIKQSLKPKYQLDIINRNNINLFSDFKVDFHLNNLIEMNFNLRNSFSSLTFQRNLFSEETIKSFKELYRFDDEIVLQAQQTIRDFYINPTAISTLAEAINSTYPINEQSTYKRHDEFVKRIENDFPHPFKKLIRWSNGIAAGADIQIFVTNYINENDLHIQNSLIVAIVCLLSFLSTYCSHSKK

SEQ ID NO: 1207 - DNA, 318 bp, Staphylococcus aureus
atgccacatattttaaacgtaacagttccaatacctgaaacacatgtacttatcacaaaagatgaatatgatgagctaattggttattcattagaccctgtatggaacatgagtgacttaaagaagaaattaaaaattgcatctgatgagactatcaaggacagattactatttcatcctagatttgaaaaagaactaagagcgcaaggaattgtgcattacccagatgagaattttaatcgctggagatttaacgcaagaaagatgaataaattcgtcgatgagcatttcaatgaaatatataaggagagaataaaa

SEQ ID NO: 1208 - protein, 106 aa, Staphylococcus aureus
  MISC_FEATURE (1)..(106): hypothetical protein
MPHILNVTVPIPETHVLITKDEYDELIGYSLDPVWNMSDLKKKLKIASDETIKDRLLFHPRFEKELRAQGIVHYPDENFNRWRFNARKMNKFVDEHFNEIYKERIK

SEQ ID NO: 1209 - DNA, 267 bp, Staphylococcus aureus
gtgtcaacaatgtactacaaaattggcgatgtatgtcaaaaagtaattaatgtagacggattcgattttaaattagcagttaagaaacaagattacagcattctagtgaatgtcttagatttagaagatagatttatcgacggtataaatataacagatgagaatgatctatacacagcattagacatattaaatcaatctatttatgaatggattgaagagaacacagacgaaagagacaggctaattaacttagtcatgagatgg

SEQ ID NO: 1210 - protein, 89 aa, Staphylococcus aureus
  MISC_FEATURE (1)..(89): hypothetical protein
VSTMYYKIGDVCQKVINVDGFDFKLAVKKQDYSILVNVLDLEDRFIDGINITDENDLYTALDILNQSIYEWIEENTDERDRLINLVMRW

SEQ ID NO: 1211 - DNA, 219 bp, Staphylococcus aureus
atgaagcagactgtaacttatctaatcaagcataaagatgaaaatctatttattacaaaccgaccaactgaagtgaacgacacagtgaagtattcaactgatatgcgagacgcaagagaattcgacggactagacaaaaccgttattgatatgtctaagcacaaagctattaagaaaacagtgacagaaacaattgagtacgagaaggtagaacatgac

SEQ ID NO: 1212 - protein, 73 aa, Staphylococcus aureus
  MISC_FEATURE (1)..(73): hypothetical protein
MKQTVTYLIKHKDENLFITNRPTEVNDTVKYSTDMRDAREFDGLDKTVIDMSKHKAIKKTVTETIEYEKVEHD

SEQ ID NO: 1213 - DNA, 777 bp, Staphylococcus aureus
atgactgaaaaaactaatcaagatgtcgatatcttaacgcaactaggtgtaaaagacatcagcaaacaaaatgcaaacaagttttataaatttgcgatatacggcaagttcgggactggtaaaactacgtttttaacaaaagataacaacgccttagtactagatataaatgaggacggaacaacggtaacagaagatggggcagttgtgcagattaagaattacaagcattttagtgcagtgattaagatgttacctaaaattattgaacaactcagagaaaacggaaaacaaattgatgttgtagtgattgaaacaatccaaaagctacgtgatatcactatggacgacatcatggacggaaaattaaagaaaccaacatttaatgattggggcgagtgtgctacacgcattgtaagtatttatcgttatatttctaaattacaagaacattatcaattccatcttgctataagtggacacgagggaattaacaaagacaaagatgatgagggtagcactatcaatccaacaatcacgatagaggcacaagatcaaataaaaaaagcggtcatcagtcaatctgatgtgttagcaagaatgacaatagaagaacatgagcaagacggcgaaaaagcttatcaatatgttcttaacgctgaaccatcaaacttattcgagacaaagataagacactcaagcaacattaaaattaacaacaaacgtttcattaatccaagtattaacgacgtagtacaagcaatcagaaatggaaac

SEQ ID NO: 1214 - protein, 259 aa, Staphylococcus aureus
MTEKTNQDVDILTQLGVKDISKQNANKFYKFAIYGKFGTGKTTFLTKDNNALVLDINEDGTTVTEDGAVVQIKNYKHFSAVIKMLPKIIEQLRENGKQIDVVVIETIQKLRDITMDDIMDGKLKKPTFNDWGECATRIVSIYRYISKLQEHYQFHLAISGHEGINKDKDDEGSTINPTITIEAQDQIKKAVISQSDVLARMTIEEHEQDGEKAYQYVLNAEPSNLFETKIRHSSNIKINNKRFINPSINDVVQAIRNGN

SEQ ID NO: 1215 - DNA, 975 bp, Staphylococcus aureus
gtgaaaatatttgattacgaagatattcaattaatacctaataaatgcatagttgaaagtaggtctgaatgtgatacaactatccaatttggtccgaaaaaattcaagctacctgtagttcctgcaaatatgcaaacagttatgaatgagaaattagcgaaatggtttgctgaaaatgattacttttatatcatgcatcgttttgatgaagaagcaagaataccttttataaaacatatgcaaaattcaggcttatttgcatctatttcagttggtgtaaagaaagcggaatttgattttattgaaaagttagctcaagaaaaattaatccccgaatatattacaatagatattgcgcatggtcactcagattcagtgataaacatgattaaacatataaaaacccatatacctgatagttttgttattgctggtaatgttggtacgccagaaggtgttagagaattagaaaatgctggtgctgatgctaccaaagtcggtataggtcctggtagagtttgtattacaaagattaaaacaggttttggtactggtggttggcagttagcggcattaaacatatgtagtaaagcagctcgtaaacctttgattgccgatggtggtataagaacgcatggcgacattgctaaatcaattagatttggtgcatcaatggtcatgattggttcattatttgcggcacacgaagaatcacctggtgaaactgtagaacttgatggtaaacagtataaagaatattttggtagtgcatctgaatttcaaaaaggcgaacataaaaatgtagaaggtaaaaaaatgtttgtagaacataagggttcattaatggataccttaaaagaaatgcaacaagatttacaaagctcaatttcatatgccggtggaaaagacttgaaatcattacgtactgtagattatgttattgttagaaactctattttcaacggtgatagagat

SEQ ID NO: 1216 - protein, 325 aa, Staphylococcus aureus
  MISC_FEATURE (1)..(325): hypothetical protein
VKIFDYEDIQLIPNKCIVESRSECDTTIQFGPKKFKLPVVPANMQTVMNEKLAKWFAENDYFYIMHRFDEEARIPFIKHMQNSGLFASISVGVKKAEFDFIEKLAQEKLIPEYITIDIAHGHSDSVINMIKHIKTHIPDSFVIAGNVGTPEGVRELENAGADATKVGIGPGRVCITKIKTGFGTGGWQLAALNICSKAARKPLIADGGIRTHGDIAKSIRFGASMVMIGSLFAAHEESPGETVELDGKQYKEYFGSASEFQKGEHKNVEGKKMFVEHKGSLMDTLKEMQQDLQSSISYAGGKDLKSLRTVDYVIVRNSIFNGDRD

SEQ ID NO: 1217 - DNA, 549 bp, Staphylococcus aureus
atgaaaatcacaggacaagcgcaatttactaaagaaacaaatcaagaaaagttttataacggctcagcagggtttcaagctggagaattcacagtgaaagttaaaaatattgaattcaatgatagagaaaatagatatttcacaatcgtatttgaaaatgatgaaggcaaacaatataaacataatcaatttgtaccgccgtataaatatgatttccaagaaaaacaattgattgaattagttactcgattaggtattaagttaaatcttcctagcttagattttgataccaatgatcttattggtaagttttgtcacttggtattgaaatggaaattcaatgaagatgaaggtaagtattttacggatttttcatttattaaaccttacaaaaagggcgatgatgttgttaacaaacctattccgaagacagataagcaaaaagctgaagaaaataacggggcacaacaacaaacatcaatgtctcaacaaagcaatccatttgaaagcagtggccaatttggatatgacgaccaagatttagcgttt

SEQ ID NO: 1218 - protein, 183 aa, Staphylococcus aureus
MKITGQAQFTKETNQEKFYNGSAGFQAGEFTVKVKNIEFNDRENRYFTIVFENDEGKQYKHNQFVPPYKYDFQEKQLIELVTRLGIKLNLPSLDFDTNDLIGKFCHLVLKWKFNEDEGKYFTDFSFIKPYKKGDDVVNKPIPKTDKQKAEENNGAQQQTSMSQQSNPFESSGQFGYDDQDLAF

SEQ ID NO: 1219 - DNA, 669 bp, Staphylococcus aureus
atgcaatacattacaagataccagaaagacaatgacggcacttattccgtcgttgctactggtgttgaacttgaacaaagtcacattgacttactagaaaacggatatccactaaaagcagaagtagaggttccggataataaaaaactatctatagaacaacgcaaaaaaatattcgcaatgtgtagagatatagaacttcactggggagaaccggtggaatcaattagaaaattattacaaacagaattggaaattatgaaaggttatgaagaaatcagtctgcgcgactgttctatgaaagttgcaagggagttaatagaactgattatagcgtttatgtttcatcatcaaatacctatgagcatagaaacaagcaagttgttaagtgaagataaagcactattgtattgggctacaatcaaccgcaactgtgtaatttgtggaaagcctcacgcagacctagcgcattatgaagcagtcggcagaggaatgaacagaaacaaaatgaatcactacaacaaacatgtattagcgttatgtcgcgaacaccataaccagcaacatgcgattggcgttaagtcgtttgatgataaatatcacttgcatgactcgtggataaaagttgatgagaggctcaataaaatgctgaaaggagagaaaaaggaa

SEQ ID NO: 1220 - protein, 223 aa, Staphylococcus aureus
  MISC_FEATURE (1)..(223): hypothetical protein
MQYITRYQKDNDGTYSVVATGVELEQSHIDLLENGYPLKAEVEVPDNKKLSIEQRKKIFAMCRDIELHWGEPVESIRKLLQTELEIMKGYEEISLRDCSMKVARELIELIIAFMFHHQIPMSIETSKLLSEDKALLYWATINRNCVICGKPHADLAHYEAVGRGMNRNKMNHYNKHVLALCREHHNQQHAIGVKSFDDKYHLHDSWIKVDERLNKMLKGEKKE

SEQ ID NO: 1221 - DNA, 279 bp, Staphylococcus aureus
atggaaaaaccttatatgttaacatatgatttaaactcacccggacaaaaatatgaggaattgagaaatgttataaaaaaggaaatttctaatggtcattgcaattattggaaatcttcatttttattccgttcttctttatcaacttcagaaatgatagaaaagttgaaaccttatctcgattctggagataagctgtttgttacagaaatagtcaataacaaacaagggtggttaacaaaagaacaatgggattttatcaaccataatatttttatt

SEQ ID NO: 1222 - protein, 93 aa, Staphylococcus aureus
  MISC_FEATURE (1)..(93): hypothetical protein
MEKPYMLTYDLNSPGQKYEELRNVIKKEISNGHCNYWKSSFLFRSSLSTSEMIEKLKPYLDSGDKLFVTEIVNNKQGWLTKEQWDFINHNIFI

SEQ ID NO: 1223 - DNA, 768 bp, Staphylococcus aureus
atggcaacatttagagtttacaaagaatcaggtaactttgtcacagtacacaaagattttatacatgattctaatataagttggaaggctaaaggtattctactttatttgttaagtcgacctgataactggcaaatttacgaaacagaactagagcaacattcaactgatggacttagcggtttaaagagtggaatcaaggaactggaagaaattggatacattcaacgtagtagaaaacgtgataaaagtggtaggttaaatggttatgagtacttagtatatgagcaaccgcaccacattcgattttccaacgttggaaaaaccgttaacggtaaaaccaacaatggaaaaaccgttaatggtaaatcgcatactactaataataatagtactaataatgatttaactaataataacaatactaataatgaaggaagtatattgtcgggcaacccgacggtgtcttccattccctataaagaaattatcgaatacttaaataaaaaagcaggaaagcattttaaacataatacagctaaaacaaaagattttattaaagcaagatggaatcaagattttaggttggaggattttaaaaaggtgattgatatcaaaacagctgaatggttaaacacggatagcgataaataccttagaccagaaacactttttggcagtaaatttgaggggtacctcaatcaaaaaatacaaccaactggcacggatcaattggaacgcatgaagtacgacgaaagttattgggat

SEQ ID NO: 1224 - protein, 256 aa, Staphylococcus aureus
MATFRVYKESGNFVTVHKDFIHDSNISWKAKGILLYLLSRPDNWQIYETELEQHSTDGLSGLKSGIKELEEIGYIQRSRKRDKSGRLNGYEYLVYEQPHHIRFSNVGKTVNGKTNNGKTVNGKSHTTNNNSTNNDLTNNNNTNNEGSILSGNPTVSSIPYKEIIEYLNKKAGKHFKHNTAKTKDFIKARWNQDFRLEDFKKVIDIKTAEWLNTDSDKYLRPETLFGSKFEGYLNQKIQPTGTDQLERMKYDESYWD

SEQ ID NO: 1225 - DNA, 777 bp, Staphylococcus aureus
atgaaaccactattcagcgaaaagataaacgaaagcttgaaaaaatatcaacctactcatgtcgaaaaaggattgaaatgtgagagatgtggaagtgaatacgacttatataagtttgctcctactaaaaaacacccgaatggttacgagtataaagacggttgcaaatgtgaaatctatgaggaatataagcgaaacaagcaacggaagataaacaacatattcaatcaatcaaacgttaatccgtctttaagagatgcaacagtcaaaaactacaagccacaaaatgaaaaacaagtacacgctaaacaaacagcaatagagtacgtacaaggcttctctacaaaagaaccaaaatcattaatattgcaaggttcatacggaactggtaaaagccacctagcatacgctatcgcaaaagcagtcaaagctaaagggcatacggttgcttttatgcacataccaatgttgatggatcgtatcaaagcgacatacaacaaaaatgcagtagagactacagacgagttagtcagattgttaagcgatattgatttacttgtactagatgatatgggtgtagagaacacagaacatactttaaacaaacttttcagcattgttgataacagagtaggtaaaaacaacatctttacaactaactttagtgataaagaactaaatcaaaatatgaactggcaacgtatcaattcaagaatgaaacacaatgcaagaaaagtaagagtaatcggagacgatttcagggagcgagacgcatgg

SEQ ID NO: 1226 - protein, 259 aa, Staphylococcus aureus
  MISC_FEATURE (1)..(259): hypothetical protein
MKPLFSEKINESLKKYQPTHVEKGLKCERCGSEYDLYKFAPTKKHPNGYEYKDGCKCEIYEEYKRNKQRKINNIFNQSNVNPSLRDATVKNYKPQNEKQVHAKQTAIEYVQGFSTKEPKSLILQGSYGTGKSHLAYAIAKAVKAKGHTVAFMHIPMLMDRIKATYNKNAVETTDELVRLLSDIDLLVLDDMGVENTEHTLNKLFSIVDNRVGKNNIFTTNFSDKELNQNMNWQRINSRMKHNARKVRVIGDDFRERDAW

SEQ ID NO: 1227 - DNA, 228 bp, Staphylococcus aureus
gtgttaaaaatgccgaaagaaaaatattacttataccgagaagatggcacggaagatattaaggtcatcaagtataaagacaacgtaaatgaagtttattctctcacaggagcccatttcagcgacgaaaagaaaatcatgactgatagagacctaaaacgattcaaaggcgctcacgggcttctatatgagcaagagctaggattacaagcaacgatatttgatatt

SEQ ID NO: 1228 - protein, 76 aa, Staphylococcus aureus
  MISC_FEATURE (1)..(76): hypothetical protein
VLKMPKEKYYLYREDGTEDIKVIKYKDNVNEVYSLTGAHFSDEKKIMTDRDLKRFKGAHGLLYEQELGLQATIFDI

SEQ ID NO: 1229 - DNA, 423 bp, Staphylococcus aureus
ttgatatttagaggtggcacaatgagtaaatacaacgctaagaaagttgagtacaaaggaattgtatttgatagcaaagtagagtgcgaatattaccaatatttagaaagtaatatgaatggcactaactatgatcgtatcgaactacaacctaaattcgaactacaacctaaatttgggaagcaaagaccgattacgtatatagccgatttctctttgtggaaggaagggaaactggttgaagttatagacgttaaaggtaaggcgactgaagttgccaacatcaaagcgaagatattcagatatcagtatagagatgtgaatttaacgtggatatgtaaagcgcctaaatacacaggtcaagaatggatggtatatgaggacttagtgaaagtcagacgtaaaagaaaaagagaaatgaag

SEQ ID NO: 1230 - protein, 141 aa, Staphylococcus aureus
  MISC_FEATURE (1)..(141): hypothetical protein
LIFRGGTMSKYNAKKVEYKGIVFDSKVECEYYQYLESNMNGTNYDRIELQPKFELQPKFGKQRPITYIADFSLWKEGKLVEVIDVKGKATEVANIKAKIFRYQYRDVNLTWICKAPKYTGQEWMVYEDLVKVRRKRKREMK

SEQ ID NO: 1231 - DNA, 183 bp, Staphylococcus aureus
atgcaacaacaagcatatataaatgcaacgattgatataagaatacctacagaagttgaatatcatcatttcgatgatgtggatgatgaaaaagatatgctagcaaagcgcttagatgacaatccggatgaattactaaagtatgacaacataacaataagacatgcatatatagaggtggaa

SEQ ID NO: 1232 - protein, 61 aa, Staphylococcus aureus
MQQQAYINATIDIRIPTEVEYHHFDDVDDEKDMLAKRLDDNPDELLKYDNITIRHAYIEVE

SEQ ID NO: 1233 - DNA, 369 bp, Staphylococcus aureus
atggcgaaagcagcaagaattgtaaggatacacgataaaccttataggttcagtaaatttgaaatggaattaatagaaagtcacggtataaccgctggaatggtttctaagagagtaaaagacggttgggaactacatgaagcaatggacgcaccagaaggtacgcgtttaagcgagtacagagaaaagaaaacaatagaaagactggaacaagctagactcgaacgcaaattggaaagaaagcgaaagagagaggctgagctaagaagaaagaagccacacttgtttaatgtacctcagaaacattcacgtgatccgtactggtttgataatacttataaccaaatgttcaagaagtggcaggaagta

SEQ ID NO: 1234 - protein, 123 aa, Staphylococcus aureus
  MISC_FEATURE (1)..(123): hypothetical protein
MAKAARIVRIHDKPYRFSKFEMELIESHGITAGMVSKRVKDGWELHEAMDAPEGTRLSEYREKKTIERLEQARLERKLERKRKREAELRRKKPHLFNVPQKHSRDPYWFDNTYNQMFKKWQEV

SEQ ID NO: 1235 - DNA, 246 bp, Staphylococcus aureus
atgcctaaaaccgatagcgcatgtaaagaatacttaaaccaatttttcggctctaagagatatttgtatcaggataacgaacgagtggcacatatccatgtagtgaatggcacttattactttcacgggcatatcgtaccaggctggcaaggcgtgaaaaagacatttgatacaaccgaagagctcgaaacatatataaagcaacatggtttggaatacgaggaacagaagcaactaactttattt

SEQ ID NO: 1236 - protein, 82 aa, Staphylococcus aureus
  MISC_FEATURE (1)..(82): hypothetical protein
MPKTDSACKEYLNQFFGSKRYLYQDNERVAHIHVVNGTYYFHGHIVPGWQGVKKTFDTTEELETYIKQHGLEYEEQKQLTLF

SEQ ID NO: 1237 - DNA, 267 bp, Staphylococcus aureus
atggctaagaaatctaaaatagcaaaagagagaaaaagagaagagttagtaaataaatattacgaattacgtaaagagttaaaagcaaaaggtgattacgaagcgttaagaaaattaccaagagattcatcacctacacgtttaactagaagatgtaaagtaactggaagacctagaggtgtattacgtaaatttgaaatgtctcgtattgcgtttagagaacatgcgcacaaaggacaaattccaggtgttaaaaaatcaagttgg

SEQ ID NO: 1238 - protein, 89 aa, Staphylococcus aureus
  MISC_FEATURE (1)..(89): 30S ribosomal protein S14
MAKKSKIAKERKREELVNKYYELRKELKAKGDYEALRKLPRDSSPTRLTRRCKVTGRPRGVLRKFEMSRIAFREHAHKGQIPGVKKSSW

SEQ ID NO: 1239 - DNA, 345 bp, Staphylococcus aureus
atgatgccgaaatttagagcgtgggataaagataaaaaagttatgagttttattgacgaaatcgattttaatagtgggtacattttgatttcaacaggttataaaagtttcaatgaagtaaaactattacaatacacaggatttaaagatgtgcacggtgtggagatttatgagggggatattgttcaagattcttattccggagaagtaagttttatcgagtttaaagaaggagccttttatataacttttagcaatgtaactgaattaataagtgaaaatgacgatattattgaaattattggaaatatttttgaaaatgaggagctattggaggttatgaga

SEQ ID NO: 1240 - protein, 115 aa, Staphylococcus aureus
MMPKFRAWDKDKKVMSFIDEIDFNSGYILISTGYKSFNEVKLLQYTGFKDVHGVEIYEGDIVQDSYSGEVSFIEFKEGAFYITFSNVTELISENDDIIEIIGNIFENEELLEVMR

SEQ ID NO: 1241 - DNA, 387 bp, Staphylococcus aureus
atgacggtcaccttatcagatgaacaatataaaaacctttgtactaaattaaacaagttattaggtaaatttcacaaagcattaaaagaacgtgatgagtacaagaagcaacaagatgagcttatcgtggatataggtaagttaagagaacgtaacaaagagttggagaacatgtggcgcactcttaaaaatgaattgcttggaagatacgaacattactgttttaaatttagagaactacaccctgagagcaaagcgaacaggataggagctctctatataggaggtaaaagcactgcagatattataatgtcgcgaatggaagaactagacggaacaaatgagttctacgaatttttagggcaaatggaggaagacacaaatgaa

SEQ ID NO: 1242 - protein, 129 aa, Staphylococcus aureus
  MISC_FEATURE (1)..(129): hypothetical protein
MTVTLSDEQYKNLCTKLNKLLGKFHKALKERDEYKKQQDELIVDIGKLRERNKELENMWRTLKNELLGRYEHYCFKFRELHPESKANRIGALYIGGKSTADIIMSRMEELDGTNEFYEFLGQMEEDTNE

SEQ ID NO: 1243 - DNA, 252 bp, Staphylococcus aureus
atgaataaccgtgaacaaatagaacaatccgttataagtgctagtgcgtataacggcaatgacacagagggattactaaaagagattgaggacgtatataagaaagcgcaagcgtttgatgaaatacttgagggaatgacaaatgctattcaacattcagttaaagaaggtattgaacttgatgaagcaatagggattatggtaagtcaagttatctatgaatacaaggaggaactggagaatgaaaaaatt

SEQ ID NO: 1244 - protein, 84 aa, Staphylococcus aureus
  MISC_FEATURE (1)..(84): hypothetical protein
MNNREQIEQSVISASAYNGNDTEGLLKEIEDVYKKAQAFDEILEGMTNAIQHSVKEGIELDEAIGIMVSQVIYEYKEELENEKI

SEQ ID NO: 1245 - DNA, 168 bp, Staphylococcus aureus
atgaaaaaatttaatgttcaaatcacatatacaggcatgattgaagaggctatcgaggctgaaagtttagaagaagcagaatttgaggctcatgatattgcgagaatggaagtgccatttgattgtgatgaatttgaaattaatgtagaggtggaacaggaaaatgaa

SEQ ID NO: 1246 - protein, 56 aa, Staphylococcus aureus
MKKFNVQITYTGMIEEAIEAESLEEAEFEAHDIARMEVPFDCDEFEINVEVEQENE

SEQ ID NO: 1247 - DNA, 534 bp, Staphylococcus aureus
atgaataacacattaacaattgatcaattacaagagttattacaaatacaaaaagagttcgacgatagaataccgacgctgaacttacgagatagcaagattgcatatgtagttgaattctttgaatggtttaatacattggaaacgtttaagaactggaagaagaaaccaggtaagccgttagacgtacaacttgatgaattagctgacatgttggcgtttgggttgagtattgcgaatcaagtaggagtgtcatcagaagagataaaagaagcgattgaatcaagttttaaaaatacagaatttcacaaaatgtttaattttaaagataaagaatttgctcaagacgcagttgttagtacaccacagataatattcaaagaattttatcccgaccaattggcaattgtaatagtgatagacatagcttacaacttatattctatcgaccaactcattgacgcatacaaaaagaaaatgaaaaggaaccacgaaagacaagatggaacagcagacgcaggaaaaggatacgtg

SEQ ID NO: 1248 - protein, 178 aa, Staphylococcus aureus
  MISC_FEATURE (1)..(178): hypothetical protein
MNNTLTIDQLQELLQIQKEFDDRIPTLNLRDSKIAYVVEFFEWFNTLETFKNWKKKPGKPLDVQLDELADMLAFGLSIANQVGVSSEEIKEAIESSFKNTEFHKMFNFKDKEFAQDAVVSTPQIIFKEFYPDQLAIVIVIDIAYNLYSIDQLIDAYKKKMKRNHERQDGTADAGKGYV

SEQ ID NO: 1249 - DNA, 171 bp, Staphylococcus aureus
gtgagagaacgcactaaaattatatatcgtggttggaacaaggagatatttattttacagggtaaaaatatgaatgttattggtttgcgccaaatatttgatgaactcaaaagattgtacgaaggttataaaatcgttgttattccaatagaagttgattttgaaatcaaa

SEQ ID NO: 1250 - protein, 57 aa, Staphylococcus aureus
  MISC_FEATURE (1)..(57): hypothetical protein
VRERTKIIYRGWNKEIFILQGKNMNVIGLRQIFDELKRLYEGYKIVVIPIEVDFEIK

SEQ ID NO: 1251 - DNA, 204 bp, Staphylococcus aureus
gtgacacaatacttagtcacaacattcaaagattcatcaggactaccacatgaacattttactgctgctagagataatcagacgtttacagttgttgaggcggagagtaaagaagaagcgaaagagaagtacgaggcacaagttaaaagggatgcagttattaaattaggtcagttgtttgaaaatataagggagtgtgggaaa

SEQ ID NO: 1252 - protein, 68 aa, Staphylococcus aureus
  MISC_FEATURE (1)..(68): hypothetical protein
VTQYLVTTFKDSSGLPHEHFTAARDNQTFTVVEAESKEEAKEKYEAQVKRDAVIKLGQLFENIRECGK

SEQ ID NO: 1253 - DNA, 156 bp, Staphylococcus aureus
gtgtgggaaatgattaagcaaatattaagattattattcttactagcgatgtatgagctaggtaagtatgtaactgagcaagtatatattatgatgacagctaatgatgatgtagaggcgccgagtgattacgtctttcgagcggaggtaagtgag

SEQ ID NO: 1254 - protein, 52 aa, Staphylococcus aureus
  MISC_FEATURE (1)..(52): int gene activator RinB
VWEMIKQILRLLFLLAMYELGKYVTEQVYIMMTANDDVEAPSDYVFRAEVSE

SEQ ID NO: 1255 - DNA, 201 bp, Staphylococcus aureus
gtgatgtggattactatgactattgtatttgctatattgctattagtttgtatcagtattaatagtgatcgtgcaagagagatacaagcactcagatatatgaatgattatctacttgatgaagtagttaaaactaaaggatacaacgggttagaagaatacaggattgaattgaagcgaataaataacgatattaaaaag

SEQ ID NO: 1256 - protein, 67 aa, Staphylococcus aureus
  MISC_FEATURE (1)..(67): hypothetical protein
VMWITMTIVFAILLLVCISINSDRAREIQALRYMNDYLLDEVVKTKGYNGLEEYRIELKRINNDIKK

SEQ ID NO: 1257 - DNA, 468 bp, Staphylococcus aureus
atgtataacaggaaagaaatacgtgaaatgatagataactacaagtggatgaagaacataatagacagtaaagtctacgataacgaaagtacatcaattgcacaatatggttatcaatctgcgatgccaaaagctaaaggcacgactagcaataaagtgttagtgaaagttataaacaaaaacaaagcgcttagaaagtacgattacttgattaagaagatagcgttcattgatgaatatgaagaatacatcacgaatgaaaaagattatcatattttacaaatgttaaaacaacgagaaagccataataggatcatgagcattcttgatataggcagagacaatttttattctagagtaaaagatatagtaaatatactttataacttgcaacaagaaaccgacagttcggacacatcgtacagttcggacacatcgtacagttcggacacatcgtacagttcggac

SEQ ID NO: 1258 - protein, 156 aa, Staphylococcus aureus
MYNRKEIREMIDNYKWMKNIIDSKVYDNESTSIAQYGYQSAMPKAKGTTSNKVLVKVINKNKALRKYDYLIKKIAFIDEYEEYITNEKDYHILQMLKQRESHNRIMSILDIGRDNFYSRVKDIVNILYNLQQETDSSDTSYSSDTSYSSDTSYSSD

SEQ ID NO: 1259 - DNA, 156 bp, Staphylococcus aureus
gtgtttaacgtgcgcgtaaacgtaacattagcatgcacagaatgtggcgatcgtaactatatcactactaaaaataaacgtaataattctgagcgtattgaaatgaaaaaatattgcccaagattaaacaaatatacgttacatcgtgaaactaag

SEQ ID NO: 1260 - protein, 52 aa, Staphylococcus aureus
  MISC_FEATURE (1)..(52): 50S ribosomal protein L33
VFNVRVNVTLACTECGDRNYITTKNKRNNSERIEMKKYCPRLNKYTLHRETK

SEQ ID NO: 1261 - DNA, 1962 bp, Staphylococcus aureus
atgaaatggttcaaattaatacttgatgttacaatcttcattctgattgctatattgttatttgtttatacatataaagaaaacgaagaaatattgcctgatactaaataccctatagcggtaactgactggaataaaaaatatagtaaaaatgagatttataaacgtatagatcaattcgctaaaaatgagaacgtagcaatctataaatcaacttcaaattatacaaacaaaaacgtagataaagatatatatgtatttaataaatcaaaagcagcaactatcactccttttaatgctaaatataacattcattatttaagtgacgacgaagtattaaaaaaagatatcaaagggagttattttgtaaaagacaaaaattttgacgtgtctaaattcataaattttttaaaagaatatggtgttactgctgaatcatacaaaatagatcatatgatgattgccgttggtgtcattaaacaaatgaatatagtagttccattatcctcacttttaatcgtttattttatttattatattttcgaaaagaacattaatttcaaagcgtatgcgattaagtatttaaatggttttacattaagaaaaataattttcgaaaatttttcaaagaaatgcacgtattgggtaacgttaatcataactcaaattcttttaactacaagtgtactttggatattaaattacacgggtaatttagatttattcatattaagaatagttctgctttcatgtcttttcattttaacgattagtgttattaatttatggactttcttaatgttactaaatttaaatattgcaaatatgattaaaggtaagcagcactttaaaacaattcgttttattaatacagtttgtaaaagtattctcttagtactaatagctaatgtaatgatagaaaatactagtgttattaaagatttgaataaaataaaagaaactgagaaatattggaatgtattagatgattattacacgattgaatttgcaccttatcacgaaacaaaacaaagtttgattgataatatggtgcgatcagaacaattagtaaaggctagtgaagcagaaaataatgcgattttattcaaaccaaagggtgactccgttgacaatgacaacttttcgcctgatgaggggaatgtaatattagtaaataatcagttctggtcgatttattacaagcagtttcaacctgatattccgataaaaaatcaaaaaaataatgtcgaagtaattattccacaaaagtttcatgcaatgcgtaatgaaatcaatcaagcatatcattcatggtttgaatttgtacaaaataaaaataataaagagaataagttatctatacagtttatcaacaaaaatgattgtcgaattttttcatttgatgcacgagatagtcgccatttgtcatttatagaggcgccaatcattgtgaatgttcaggcatcagatttatcgaatgatttttattatgccatgatcagtcaaggcgggtatttattcaaaaattatgacgcgctagtaaaaaatattgaaaagtatcatcttgatggggaaatcagtggaataaccaattataaagatagcgtgatggaaatgtatcatgaaaacaatttgaaattaacagtactcaacttttcacaaatcattatcgcaatcattttaataattattattttatttgatgtgaaatattattttgaacagcatcgaaaattactcgtaatcaaaaagctatatggttattcaacattaagagccaattaccaatacttattaataaataatatagttgttatttttattggaatattgacgaatgtaattttacattctcactatataatgatgttatttgcaacgattcttgtcgttcaaatattattgcagatttgcagcctatactatcatggccgacgttttaatgaagttatcaaggagttt

SEQ ID NO: 1262 - protein, 654 aa, Staphylococcus aureus
  MISC_FEATURE (1)..(654): hypothetical protein
MKWFKLILDVTIFILIAILLFVYTYKENEEILPDTKYPIAVTDWNKKYSKNEIYKRIDQFAKNENVAIYKSTSNYTNKNVDKDIYVFNKSKAATITPFNAKYNIHYLSDDEVLKKDIKGSYFVKDKNFDVSKFINFLKEYGVTAESYKIDHMMIAVGVIKQMNIVVPLSSLLIVYFIYYIFEKNINFKAYAIKYLNGFTLRKIIFENFSKKCTYWVTLIITQILLTTSVLWILNYTGNLDLFILRIVLLSCLFILTISVINLWTFLMLLNLNIANMIKGKQHFKTIRFINTVCKSILLVLIANVMIENTSVIKDLNKIKETEKYWNVLDDYYTIEFAPYHETKQSLIDNMVRSEQLVKASEAENNAILFKPKGDSVDNDNFSPDEGNVILVNNQFWSIYYKQFQPDIPIKNQKNNVEVIIPQKFHAMRNEINQAYHSWFEFVQNKNNKENKLSIQFINKNDCRIFSFDARDSRHLSFIEAPIIVNVQASDLSNDFYYAMISQGGYLFKNYDALVKNIEKYHLDGEISGITNYKDSVMEMYHENNLKLTVLNFSQIIIAIILIIIILFDVKYYFEQHRKLLVIKKLYGYSTLRANYQYLLINNIVVIFIGILTNVILHSHYIMMLFATILVVQILLQICSLYYHGRRFNEVIKEF

SEQ ID NO: 1263 - DNA, 93 bp, Staphylococcus aureus
ttgccaggcagttttttaatcaaattttggttaaaaaataaaatggacaagataaaaaaagttattgacttaaatgttaataaaatgtataat

SEQ ID NO: 1264 - protein, 31 aa, Staphylococcus aureus
LPGSFLIKFWLKNKMDKIKKVIDLNVNKMYN

SEQ ID NO: 1265 - DNA, 486 bp, Staphylococcus aureus
gtgagggtttttatttttataaacaagaggtggagaatggagatatcaaagtaccaagagatagctacacgtacacacaatgatgaattgaatttaaatgaatatattacttgttacggcttaggtttaactcaatctacaggcaatgttacagatctaattaaacagcatatgttttgtaatgtaccgatagataaaggaattatgataaatgaacttagcgaagcattgtggaatatagctaatcttactaacgtgttaggtattaacttggatgagatagctggtcatagtgttaacactatcttgatgaataaacctaatcagactatcaatttagacaatggtataaaacgaggagacaaagtattgtttcaaggtagtaagtatcttgttgatggatcgataggaaacttattgttaattagcaatgataaagatgatagacaagtaactgtgcaagatgttaagaaagtcgacaaggag

SEQ ID NO: 1266 - protein, 162 aa, Staphylococcus aureus
VRVFIFINKRWRMEISKYQEIATRTHNDELNLNEYITCYGLGLTQSTGNVTDLIKQHMFCNVPIDKGIMINELSEALWNIANLTNVLGINLDEIAGHSVNTILMNKPNQTINLDNGIKRGDKVLFQGSKYLVDGSIGNLLLISNDKDDRQVTVQDVKKVDKE

SEQ ID NO: 1267 - DNA, 351 bp, Staphylococcus aureus
ttgtctattatgaagcgatgtggtcatccaacatgtaatgtattgattaatcataatgaaagttattgtgataaacacaagcaatatgcaaatgaaaattacaatgatttgagacgtcgaaacgatccagagtatttaagattttataaatcgaaaacgtggcaaaacatgcgtcgaattgtattgttagaacatgattttatttgtgtttcttgtggcaatcaagcgactatggttgaccatattgtaccaacaaaaattgattgggcaagaagattagacaaaagtaatttacagcctttgtgtgatgcttgccataaccaaaagacaaaagaagatttgaagaaatat

SEQ ID NO: 1268 - protein, 117 aa, Staphylococcus aureus
LSIMKRCGHPTCNVLINHNESYCDKHKQYANENYNDLRRRNDPEYLRFYKSKTWQNMRRIVLLEHDFICVSCGNQATMVDHIVPTKIDWARRLDKSNLQPLCDACHNQKTKEDLKKY

SEQ ID NO: 1269 - DNA, 465 bp, Staphylococcus aureus
atggcgggtagacctaagaagcttttgtcaaattcgaacaagaattatacaaaagaagaaattattgaaaaagagcgtcaagaagctcaattaaataaattttctaaaatcgatactgaaccaccgcactttttagatgaaatagcgaaacaagaatacttaagaatattaccgcacatgcaagaattgccaatttccaacttagataaagcacaattagcacaatattgtagtttttatagtgactttgttaaagcaagtttgattttagagcgcgaagacttgattttagaagacgacaaaggaaatcaaaaggttaatccggcgttcaacataaaggaaaaagcgggtattcgattgcaacaaacagctaatactttaggattaactattgatagccgattgcgtattatggttcctgatgaaaaagaagatgatgatccatatatggaatttgtgagtgat

SEQ ID NO: 1270 - protein, 155 aa, Staphylococcus aureus
MAGRPKKLLSNSNKNYTKEEIIEKERQEAQLNKFSKIDTEPPHFLDEIAKQEYLRILPHMQELPISNLDKAQLAQYCSFYSDFVKASLILEREDLILEDDKGNQKVNPAFNIKEKAGIRLQQTANTLGLTIDSRLRIMVPDEKEDDDPYMEFVSD

SEQ ID NO: 1271 - DNA, 1692 bp, Staphylococcus aureus
atgactgattatgttactaaatacgcaaaaaaggtagtttcaggagaaattttggcaagtttgaagaatattcaagtatgtaaacgtcacctatcttttatggagaacccgccgaatggttgccattgggataatcatttgtctaacaaagcaattaaatttgtggaaatgcttccagaccctaaaacaaaccagcccatgcctcttatggagtttcagaaattcattgttgggagcttatacggctggcgtagaggtcaatacagaatgtttactaaagcttatataagtatggctagaaaacaaggtaagtctctaatcgtatcgggaatgtccgttaacgaactgttgtttggacaataccctaaatttaatagacaaatttatgtagcttcatctacttataagcaagcgcaaacaatattcaagatggcaagccaacaagtaaacctaatgcgaagtaaaagcaagtttatccgtgaaaaaacagacgtaagaaagacagacattgaagatgtattaagtagttcagtgtttgcacctctttccaataacccagatgcggttgatggtaaagatcctacagttgctattttggacgaattggcaagtatgcctgatgatgagatgtactcaaggtttaaaacaggtatgacattacaaaaaaatcctttaaccctacttgtttcaacggccggagacaatttaaatagtcaaatgtaccaagagtataagtatattaaacgtattttaaatgaagaagtaagagctgataattactttgtatattgtgctgaaatggattcacaagaagaagttcaagatgaaacaaagtggattaaagcaatgccgcttttagaatcaaaagaacatagaaaaactatacttcaaaatgtaaaagctgatatacaagacgaattagaaaaagggacatcatatcataagattttgattaaaaacttcaatttatggcaagcgcaaagagaagatagcttgctagatatttcagattgggaacaagtaataacgcctatgcctaatatcaatggtaaagatgtgtatataggtgtcgacttatcgagattggatgacttaacatctgtagggtttattttccctaacgacgataaaaaagtgtttttacatagtcattctttcattggattaagaacaaacttagaacaaaaatctaagagagacaaaataaattatgaattagcgattgaacgtggcgaagctgagactacacaatcagatagcggcatgattgattataaacaagttatcgattttatagtgaaatttataacgacgcatgacctgaatgtacaggctgtttgctatgacccttggaatgcgcaaagttttataacaacaatcgaatcaatggctttagattggccactcattgaagtgggacaaagttttaaggcgttatcacaatctattaaagaatttagaatgtgggttgcagatgaaagaatacagcataacgataatatgttacttacaacatcagttaataatgccgttttgattcgtgacggagaagacaatgtgaaaataaataaaaaaatgaatcgtcaaaaaatagatccgattatttcgattatcacagctttcactgaagctagaatgcacgaattccaagaaaattggacggagaaatatgaaagcgaagaattcggattt

SEQ ID NO: 1272 - protein, 564 aa, Staphylococcus aureus
  MISC_FEATURE (1)..(564): hypothetical protein
MTDYVTKYAKKVVSGEILASLKNIQVCKRHLSFMENPPNGCHWDNHLSNKAIKFVEMLPDPKTNQPMPLMEFQKFIVGSLYGWRRGQYRMFTKAYISMARKQGKSLIVSGMSVNELLFGQYPKFNRQIYVASSTYKQAQTIFKMASQQVNLMRSKSKFIREKTDVRKTDIEDVLSSSVFAPLSNNPDAVDGKDPTVAILDELASMPDDEMYSRFKTGMTLQKNPLTLLVSTAGDNLNSQMYQEYKYIKRILNEEVRADNYFVYCAEMDSQEEVQDETKWIKAMPLLESKEHRKTILQNVKADIQDELEKGTSYHKILIKNFNLWQAQREDSLLDISDWEQVITPMPNINGKDVYIGVDLSRLDDLTSVGFIFPNDDKKVFLHSHSFIGLRTNLEQKSKRDKINYELAIERGEAETTQSDSGMIDYKQVIDFIVKFITTHDLNVQAVCYDPWNAQSFITTIESMALDWPLIEVGQSFKALSQSIKEFRMWVADERIQHNDNMLLTTSVNNAVLIRDGEDNVKINKKMNRQKIDPIISIITAFTEARMHEFQENWTEKYESEEFGF

SEQ ID NO: 1273 - DNA, 237 bp, Staphylococcus aureus
atgaaagcgaagaattcggattttaaaggtggtgacaaaatggacttgaataaaataaatgtcttttttaatttcttggttgctaatttggttagcatcctttttttattaggtttgtttgtggttaatgtttctgtgtataaagcattcggtcaaaatataggacttttatgcattggtataacactgattgttatttcgttgattttaaatcacgaaagcaatcaagaaaggagt

SEQ ID NO: 1274 - protein, 79 aa, Staphylococcus aureus
MKAKNSDFKGGDKMDLNKINVFFNFLVANLVSILFLLGLFVVNVSVYKAFGQNIGLLCIGITLIVISLILNHESNQERS

SEQ ID NO: 1275 - DNA, 1248 bp, Staphylococcus aureus
gtggggattttttataaaaatgaaaaacgagacttgcaatacaacgaagatgatttgcaaatgatggttcaaactttgccaggttttcaaggaacaaaattacgacaatataaagatatagaagcaattaggcatagcgacatctttacggcagttatgatgattgcttctgatttggcgcgcatgccaattagggtgacagtgaacggccaaattaattatagtgacaggattgttaatttgttaaatacacgtcctaacccaatgtataacggctatatattcaaattagtagtgtttgttagtgccttactaacatcgcacggctatattgaaattacacgtgataaaacaggagaacctatgaatttaacgttcagaaagacatccgaaatagaattgaaatcagacgcaagaggtcgactgtattattttcatcaaaggatagacagtaacggaaataatatagaacgtaatgttaagtttgaggatatgctagacatcaaattttattcgttggatggtataaatggtttgtcactgttagacacattaagtcgcacgatagaatcagataacaatggaaaagatttccttaataatttcttgcgaaatggcacacatgctggtggtattttgaaaatgaaaggtgtattagataataaaaaagcaagagaccgtgccagagaagaatttcacaaaagttttagtggaactaaacaagctgggaaagttgtcgtactcgatgaatcaatgacgtttgatcaattagaagttgatacagaagttttaaagcttatcagagaaaacaaatcatcaacaagagaaatagcaggtgtatttggtattccattgcataagttcggcatagaaacagcgaacatgagtatcacggatgctaatttagattacttatcaactttaaaaccttatattacatgcgtttgtgcagaattgaattttaagtttaatgatgaatatgtgaatcgtgaatttaaatttgataccactgaaatacgagttgttgatgaaaaaacacaagctgaaattgacaaaattaacattgattctggaaagatgaatatcgatgaaattagacaacgtgatggattagcgccaataccaggcggtaatggtagcattcacagagtcgatttaaaccatgtaaatattgaacttgtagatgagtatcagatgaataaatcgagagctactgataaaaaattgaaaggtggtgaggaaaatgag

SEQ ID NO: 1276 - protein, 416 aa, Staphylococcus aureus
VGIFYKNEKRDLQYNEDDLQMMVQTLPGFQGTKLRQYKDIEAIRHSDIFTAVMMIASDLARMPIRVTVNGQINYSDRIVNLLNTRPNPMYNGYIFKLVVFVSALLTSHGYIEITRDKTGEPMNLTFRKTSEIELKSDARGRLYYFHQRIDSNGNNIERNVKFEDMLDIKFYSLDGINGLSLLDTLSRTIESDNNGKDFLNNFLRNGTHAGGILKMKGVLDNKKARDRAREEFHKSFSGTKQAGKVVVLDESMTFDQLEVDTEVLKLIRENKSSTREIAGVFGIPLHKFGIETANMSITDANLDYLSTLKPYITCVCAELNFKFNDEYVNREFKFDTTEIRVVDEKTQAEIDKINIDSGKMNIDEIRQRDGLAPIPGGNGSIHRVDLNHVNIELVDEYQMNKSRATDKKLKGGEENE

SEQ ID NO: 1277 - DNA, 594 bp, Staphylococcus aureus
gtggtgaggaaaatgagtaaggaaacgagagttggcaacattattgaggtacgctcaaatgataacaacgaaatggtcatagaggggtatgcgttaaagtttgacacttggtctgaaaatcttggtggattcaaagaaacgatttcacgtcgcgctttagaaaacactgatttatctgatgtgcgttgtttagtagatcatatcccatcgcaaataattggtaggacaaaatcgggtactttggagctcgaaactgatgatgttggacttaaatatcgttgtaagttaccaaacacaacatttgcacgtgatttatatgagaacatgcgtgtaggcaacatcaatcaatgttcgtttggttttatgcttgacgataaaggcgatgaagtgcgttttgatgaacaagaaaacatttacaaacgtactttaacagcaattcgtgaacttacagatgtttctgtagtgacttatccggcttacaaagacactgatgttaaaccagcattacgtagtattgaaaccgttaaaaaagaacaacgtaaaaaagaattagaaataagactaaagaaacactctatattaaataatatttgg

SEQ ID NO: 1278 - protein, 198 aa, Staphylococcus aureus
VVRKMSKETRVGNIIEVRSNDNNEMVIEGYALKFDTWSENLGGFKETISRRALENTDLSDVRCLVDHIPSQIIGRTKSGTLELETDDVGLKYRCKLPNTTFARDLYENMRVGNINQCSFGFMLDDKGDEVRFDEQENIYKRTLTAIRELTDVSVVTYPAYKDTDVKPALRSIETVKKEQRKKELEIRLKKHSILNNIW

SEQ ID NO: 1279 - DNA, 1245 bp, Staphylococcus aureus
atgaaaacaaaagaagagttacaatctgagatttcagacattaaaagacaaattgatttaaaggtgaagtatgcaacgagagcacttaataacgatgagttagaaaaagcagaaaaattagaacaagaaattactgatttacgttctcaaatccaagaaaaacaagaagaattagataagctaaaagaaaaagatggaacttcagaaaacaatcaacaatcagtggaagtaaacgaagcaagtacttatcgaaatcaagcaaacattaatgatttaggtatttcgattcaaaacacaaaggtaacatcacaagaagttagagattttactgaatatcttgaaacacgcaatgatattcaaggtggttcgttaaaaacagactcaggatttgtagttattccagaggaaattgttacagatattttaaaattaaaagaggttgagtttaatcttgataagtatgtgacggtcaaacgtgttacaaatggttctggtaaatatccggtagtacgacaatcagaagttgcagcccttgaaaaagttgaagaattagaagaaaaccctgaattagcagttaaaccattcttccaattagcatatgacattaatacacaccgtggttacttccgaatttcacgtgaagcaatcgaagatgcaaaagtgaatgttttgcaagaattgaaactatggatggcgcgaactattgcagcaacacgaaacaaagcaattattgatgttatcactaaaggatcaacgggttctacaagttcaggttttgaaaaagaaggcaagaaattagaagttaaaaaagcaaaatctttagatgatattaaagatgctattaacctgaatgttaagccaaattacgaacataatgttgcgattgtttcgcaaactatgtttgcaaaattagacaaaatgaaagataagctaggaaactatttaatccagccagatgttaaagaaaaaacgcaacagcgtttattaggagctaaaatcgaaattttacctgatgaagtactagggcaaaaaggtaataacactttgattatcggtaacttaaaagatgcgattgttttatttgaccgctctcaataccaagcatcatggactgactacatgcatttcggagaatgtttaatgattgctgtacgtcaagactgtagaattctagattataaatcagcaattgtgattgaatatgatgatagtgaacgcggtgaaggcgatcttggcttagaagca

SEQ ID NO: 1280 - protein, 415 aa, Staphylococcus aureus
MKTKEELQSEISDIKRQIDLKVKYATRALNNDELEKAEKLEQEITDLRSQIQEKQEELDKLKEKDGTSENNQQSVEVNEASTYRNQANINDLGISIQNTKVTSQEVRDFTEYLETRNDIQGGSLKTDSGFVVIPEEIVTDILKLKEVEFNLDKYVTVKRVTNGSGKYPVVRQSEVAALEKVEELEENPELAVKPFFQLAYDINTHRGYFRISREAIEDAKVNVLQELKLWMARTIAATRNKAIIDVITKGSTGSTSSGFEKEGKKLEVKKAKSLDDIKDAINLNVKPNYEHNVAIVSQTMFAKLDKMKDKLGNYLIQPDVKEKTQQRLLGAKIEILPDEVLGQKGNNTLIIGNLKDAIVLFDRSQYQASWTDYMHFGECLMIAVRQDCRILDYKSAIVIEYDDSERGEGDLGLEA

SEQ ID NO: 1281 - DNA, 156 bp, Staphylococcus aureus
atggcaatgtatgaagtgaagaaatcttatactgacttggaaaaaggccagtatttaaagtcaggtaaacgtgttgaaatgacagtaaaacgtgctgaatatgttaacaaaaagctgaaagagcatggagtaatacttgaaagagtaaaagaagaa

SEQ ID NO: 1282 - protein, 52 aa, Staphylococcus aureus
MAMYEVKKSYTDLEKGQYLKSGKRVEMTVKRAEYVNKKLKEHGVILERVKEE

SEQ ID NO: 1283 - DNA, 330 bp, Staphylococcus aureus
atgcaattaacagctgaggaacttaagttattaaaaaagcattgcaaaatagatcacaattcagaggacgacttattagaaatatattactcttgggcattccgtgaaatagctagcgctgttacggataaaccaagtaaatatattgattggtttaaaagtcatcctctatttgctcgtgctatataccctttagcaagttactattttgaaaaccgtattgcttatttggatagggatttatcgcttgcgccacatatggttttaagtacggtgcataaattgagaggttcatttgagcaatttttggagagtgaaaatgatgaaatt

SEQ ID NO: 1284 - protein, 110 aa, Staphylococcus aureus
MQLTAEELKLLKKHCKIDHNSEDDLLEIYYSWAFREIASAVTDKPSKYIDWFKSHPLFARAIYPLASYYFENRIAYLDRDLSLAPHMVLSTVHKLRGSFEQFLESENDEI

SEQ ID NO: 1285 - DNA, 960 bp, Staphylococcus aureus
ttgcctaaagatttacgtcatatgcatgggttcggttctcacacatactctatgtataatgattctggtgaacgtgtttgggttaaattccattttagaacgcaacaaggtattgaaaacttaactgatgaagaagctgctgaaattatagctacagatcgtgattcatctcaacgcgatttattcgaagccattgaaaaaggtgattatccaaaatggacaatgtatattcaagtaatgactgaggaacaagctaaaaaccataaagataatccatttgatttaacaaaagtatggtatcacgatgagtatcctctaattgaagttggagagtttgaattaaatagaaatccagataattactttatggatgttgaacaagctgcgtttgcaccaactaatattattccaggattagatttttctccagacaaaatgctgcaagggcgtttattctcatatggcgatgcgcaaagatatcgattaggagttaatcattggcagattcctgtaaaccaacctaaaggtgttggtattgaaaatatttgtccttttagtagagatggtcaaatgcgcgtagttgacaataaccaaggtggaggaacacattattatccaaataaccatggtaaatttgattctcaacctgaatataaaaagccaccattcccaactgatggatacggctatgaatataatcaacgtcaagatgatgataattattttgaacaaccaggtaaattgtttagattacaatcagaggacgctaaagaaagaatttttacaaatacagcaaatgcaatggaaggcgtaacggatgatgttaaacgacgtcatattcgtcattgttacaaagctgacccagaatatggtaaaggtgttgcaaaagcattaggtattgatataaattctattgatcttgaaactgaaaatgatgaaacatacgaaaactttgaaaaa

SEQ ID NO: 1286 - protein, 320 aa, Staphylococcus aureus
  MISC_FEATURE (1)..(320): catalase [Staphylococcus
LPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFMDVEQAAFAPTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 1287 - DNA, 339 bp, Staphylococcus aureus
gtgaaaatgatgaaatttaattccaataaattaaatgaacgtatagatttttgtgaagatgtaagcgagagagtgaacggaaatccgatgaaaccgaagacgaaaatattatactcttgtttcgcttgcattcaagaatctaaagaatccgacactcaaacgaatctcaatacaggtagcaaattcattaaaactattattatcagagatacacgaggtgattataaaccaacaaataagcattacgtcttgcatgaagggcaaagatttaacatcaaatatgtaaagccagattatcaagataaatcttatttgcgtatctatggcgaggtggtcatt

SEQ ID NO: 1288 - protein, 113 aa, Staphylococcus aureus
VKMMKFNSNKLNERIDFCEDVSERVNGNPMKPKTKILYSCFACIQESKESDTQTNLNTGSKFIKTIIIRDTRGDYKPTNKHYVLHEGQRFNIKYVKPDYQDKSYLRIYGEVVI

SEQ ID NO: 1289 - DNA, 315 bp, Staphylococcus aureus
atgaatttaaatagtaatgtaattgtcaaagctggggctatgtcattagtcccgcttttaaaaagtaatacaccttttgcgaatactaaaaagcatgctcgcgatcacatagctgtttctaatgtgaaaacagacagacacacaagtgagaaaattgttacaattggttacgctaaaggcgtctcacatcgtattcatgcaacagaatttggaacaatgtaccaaaaaccacaattgtttataacaaaaacagaaaagcaagggaaaaacaaagttttaaaaacaatgcttgatactgctaagaggttgcaaaaa

SEQ ID NO: 1290 - protein, 105 aa, Staphylococcus aureus
MNLNSNVIVKAGAMSLVPLLKSNTPFANTKKHARDHIAVSNVKTDRHTSEKIVTIGYAKGVSHRIHATEFGTMYQKPQLFITKTEKQGKNKVLKTMLDTAKRLQK

SEQ ID NO: 1291 - DNA, 378 bp, Staphylococcus aureus
atgattaatgttaccaaattaattagaaacgctattattgcaaataacattacagatgaagtgaatgtgtttaactacactatagatgaccattttcacgaaaaaactgacaagcctattattcgtatatatcccttaccgttcaatcctgacacatacgctgatgataacgagatttcaagagaataccattaccaaattgatgtttggtggtctcaagatgaaccgaacgagcaagcagaaaaaattgttgagttactcaaagtgataaattttcaatgttattacagagaaccgttatacgagagtgacgtcatgtcattcagacatattataagagcaaaaggctcgattttatcaatgaaattggaggaaaat

SEQ ID NO: 1292 - protein, 126 aa, Staphylococcus aureus
MINVTKLIRNAIIANNITDEVNVFNYTIDDHFHEKTDKPIIRIYPLPFNPDTYADDNEISREYHYQIDVWWSQDEPNEQAEKIVELLKVINFQCYYREPLYESDVMSFRHIIRAKGSILSMKLEEN

SEQ ID NO: 1293 - DNA, 951 bp, Staphylococcus aureus
atgattgaaaaattgaaacaagcaccaagatttttaaaattaaacttacaacattttgcagatacaggagtttcgggtatcgcaattggggtatcaaacttttattatgcacctattttaaaagatacagaaaatgaatgggaaactggagctggcacacgtattcgtttcttaaaagaaattgaagtagaccgtccacaagataccgaggaagattatggggatgatatggtcgcagcaactgctgtatctaatggcaaactaagtgttaagacaacatttgttactgttcctgctgacgataaggcgttcttgaatggcgctaaaaaaggtgtaggtggttataaatatggagctaaggatatcccgccagatgtagcgattgtatttgaaagacgtaatcatgatgagtcttcagaatgggttggcttgttcaaaggtaaattcactcgttcaagcatcaaagggcaaacaaaacaagataaagttgaattccagaatgacgacgtagaaggcaattttattgatcgtttgtttgatgagagctcgcatgttactggctatgataaaaaaggaagcactacagggcgcgattatgtattcatggaaacatttggtaaaacttatgatgaattcatgtctagtcgaggagaacaaaatatggaacctgtagaaaaagaaatgaaaaaaacagaaaaagttgaagtcacttctgtaaacgtcactgatgaacaagttacagttaaagttgatgctactaaacaactatcagccacaaccgaaccatctggacagaaagtaacttatgcagtgactgaggggcaaacgtatgctagcgtaacatcaactggcctcgttaaaggtttggcggaaggtaatgcgaccgttacagcgactgcaggaaagcaaactgatactgtgcaaattacagtacaatctaatttagaaatg

SEQ ID NO: 1294 - protein, 317 aa, Staphylococcus aureus
MIEKLKQAPRFLKLNLQHFADTGVSGIAIGVSNFYYAPILKDTENEWETGAGTRIRFLKEIEVDRPQDTEEDYGDDMVAATAVSNGKLSVKTTFVTVPADDKAFLNGAKKGVGGYKYGAKDIPPDVAIVFERRNHDESSEWVGLFKGKFTRSSIKGQTKQDKVEFQNDDVEGNFIDRLFDESSHVTGYDKKGSTTGRDYVFMETFGKTYDEFMSSRGEQNMEPVEKEMKKTEKVEVTSVNVTDEQVTVKVDATKQLSATTEPSGQKVTYAVTEGQTYASVTSTGLVKGLAEGNATVTATAGKQTDTVQITVQSNLEM

SEQ ID NO: 1295 - DNA, 444 bp, Staphylococcus aureus
atggaacgtacatcaattgaattaattacaggatttacaaaaacaggaaagccgcaatatcaaaagtatttagcgaagccgattattactttgtttgaaacaattcaaggttcaaaattaggtttgaaacttaacaaagcctttaagggggctgattttaaagatctaacagaagaagaatttaataacttaagtgtgacagaacaggaagaatacaaaaacaagcaagaagaatacgaaaacaacatggctgtacaaatggaagtattagaagaagttttggatttcatcgttgaagcttttgataatcaatttaccagtatagaacttcaaaaaggattaccaaatggtcaagaaggtattgaaaagattggacagttaattggacgaattacaggtggggaacctagcgatacaaaaaagttcgtgacagagaatcagaaa

SEQ ID NO: 1296 - protein, 148 aa, Staphylococcus aureus
MERTSIELITGFTKTGKPQYQKYLAKPIITLFETIQGSKLGLKLNKAFKGADFKDLTEEEFNNLSVTEQEEYKNKQEEYENNMAVQMEVLEEVLDFIVEAFDNQFTSIELQKGLPNGQEGIEKIGQLIGRITGGEPSDTKKFVTENQK

SEQ ID NO: 1297 - DNA, 120 bp, Staphylococcus aureus
ttgatagaaaaaggcatggatgcagaaaaagtggctaacatgccgatacacttctttttagacattgtcgaatcgaagattgaaacaaagcgaactgcgaaaagttttaaagatattttt

SEQ ID NO: 1298 - protein, 40 aa, Staphylococcus aureus
LIEKGMDAEKVANMPIHFFLDIVESKIETKRTAKSFKDIF

SEQ ID NO: 1299 - DNA, 4650 bp, Staphylococcus aureus
atgcctaatcctataggtaatatggtcataaaggttgatttagatggttctggattcaatagaggtgtgacaggtttaaataggcaaatgaaaatggtttcgcgtgagctttcggctaatttatcacaattttctagatatgataattcattagaaaagtcgaagataaaagtcgaaggtttgagtaaaaaacaaaaagttcaagcccagattactaaagagctgaaagatagttatgacaaacttagtaaagaaactggtgaaaacagtgcaaagacacaagctgcggctgctaaatacaatgaagcttacgctaaattaaaccaatatgagcgagagttaaatcaagccacacaagaattaaaagacatgcaaagagagcagaaagcattaaatactgcaatgggaaaacttggtaccaactttaataattttggtcctaaacttcaagaaattggtaacagtatgaaaaatgtaggccgtaacatgactatgtatgtaactgcgccggtggttgctgggtttgctgtagcagctaaaaaaggtattgaattcgatgacagtatgagaaaagttaaagcaacttcaggtgctactggggaagagtttgaagctttgaagaaaaaggctcgcgaaatgggtgcaacaacaaaatttagtgcatcagattcggctgaagcattaaattacatggcacttgctggttgggattctaagcaaatgatggaaggtttaagcggagttatggatttagcggcagcatctggcgaagaactggaagcagtaagtgacattgttacagatggactaacggcattcggtttaaaagcaaaggatagtggtcattttgcggacattttagcacaaactagctcgaaggcaaatacggatgttagagggctcggagaagcttttaaatatgtcgctcctgtagcaggtgcgttaggttacacgattgaagatacatctattgcgataggtttaatgagtaatgctggtatcaaaggtgaaaaagcaggtacagcgttacgaacaatgttcaccaatctttcaagtccaactagagctatggggaatgaaatggaacgcttaggaatatctattacagatagtaatgggaaaatgattcctatgcgaaagcttttagaccaactgagggaaaaatttaaacatctttcaaaagaccaacaagctagttctgcagctacaatatttggtaaagaagcgatgtcaggagcattagcgattataaatgcttctgatgaagactatcaaaagttaaccaaatctatagattcatctaccggcgcatctaaaagaatggccgatacaatggaatctggtttaggtgggaaattaagaactttaaggtcgcaattagaagaactagccttaacgatttatgacagaatagaaccagcactaaagattatagtaagtgcttttagcaaagtagtgacatgggttactaaattaccaacgtcaattcaattagcggttgttgggtttggattatttgcagcagttttaggtcctttagtttttatgttcggtttatttatcagcgtgatggggaatgcaatgacagttttaggacccttgttaataaacgttaataaagctggtggtttattcgcgtttttaagaactaaaatcgcatcacttgttaaactatttccgattttaggtgtgtcgatatcaagtttaacgttacctataacattaattgtaggtgcattagttggtattggcatagctttctatcaagcttataaacgttcagaaacttttagaaatattgtaaatcaggcaatctctggtgtagcaaacgcatttaaagcagctaaactagcgttacaaggtttctttgatttattcaaaggtgatagtaaaggcgcggttaccctagagaagatatttccacccgaaactgtagcaggaatacaaaatgtagttaatacgattagaacaactttctttaaagtagttgatgcaatcgttggtttcgccaaagagataggcgctcaattagcctctttctggaaagagaacggctcagaaataacacaagctttgcaaaatatagctggtttcattaaagcaacctttgaatttatttttaactttattattaaaccaatcatgtttgcgatttggcaagtgatgcaatttatttggccggcggttaaagctttgattgtcagcacttgggaaaatatcaaaggtgtaatacaaggggctattaatattattttgggtattatcaaagtgttctctagtcttttcacaggaaactggcgaggcgtttgggacggcattgtaatgatactgaaaggtactgtgcagttaatttggaatttaatacaactgtggtttgtaggtaagattctaggtgttgttagatactttggtggattgcttaaaggtttaatatccggtatctggggtgttatcaaaggtattttcacaaaatcattatctgcaatttggaatgcaacgaaaagtatttttggtttcttatacaatagtgttaaatctattttcactaatatgaaaaactggttatctagtacgtggaataatatcaaaagcaataccgtcggcaaggctcattcgttatttacgggtgtaaggtctaaattcacaagtttatggaatgcgacgaaagatatatttactaaattaagaaattggatgtcaaacatctggaactctattaaagataacacggtaggtatagctggtcgtttgtgggataaagtacgtaatatcttcggaaacatgcgtgacggtttaaaatctatcattggtaaaattaaagatcatatcggcggtatggtagatgctattaaaaaaggacttaataaattaattgaaggcttaaactgggtcggtggtaagttaggtatggatgaaatacctaggttacacactggtacagagcacacacatactactacaagattagttaagaacggtaagattgcacgtgatacattcgctacagttggggataaaggacgtggaaatggtccaaatggttttagaaatgaaatgattgaattccctaatggtaaacgtgtaatcacacctagtacagacactactgcttatttacctaaaggctcaaaagtatacaacggtgcacaaacttattcaatgttaaacggaacgcttccgagatttcatttcggtactactatgtggaaagatattaaatctagtgcatcatcggcatttaactggacaaaagatcaaataggtaaaggcacaaagtggcttggcgataaagttggtgatgtcatggactttatcgataatccaggcaaacttttaaattatgtacttcaagcgtttggagttgatttcagttctctaactaaaggtatgggtattgctggcgatataacaaaagctgcatggtctaagattaagaaaagtgcaatcaagtggcttgaggatgctttcgcagagtcgggtgatggcggtgtattagatatgagtaaattacgttacttatacggtcacactgctgcttatacacgagaaaccggacgcccattccatgaaggtctggattttgattacatttacgaacctgttccatcaaccattaatggtagagcacaagttatgcctgttcataatggtggttatggaaaatgggtgaaaattgtaaagggcgccttagaagttatttatgcacatttatctaaatataaagttaaaactggtcaacaagttagggtcggacagactgttggtatatcggggaatacggggtttagtacaggacctcacttacattatgagatgcgttggaatggaagacatagagacccgttaccgtggttaagaaagaataatgggggcggcaaaagtacacccggtggtaatggtgcagctaatgctagacgagctattaaggctgctcaaaatattttaggaggaaggtataaggcgagttggattactaacgagatgatgcgtgttgcgagtcgtgaatccaattatacagctaatgcagtcaataattgggatagcaacgcaagagctggtataccttcaagaggtatgttccaaatgatagatccttcatttagagcgtacgcaaagtcgggttacaataatcctctcaacccaactcatcaagctatatcggctatgagatatattgtgggtaaatgggtaccaagaacaggctcatggagagctgcgttcaaacgcgctggtgattacgcatatgctactggtggcaaagtctataacggattgtatcacttaggggaagaaggatatccagagtggataatacctactgatccaagtagagcgaacgaagcacacaaattattagctttagctgctaacgatattgataaccgctctaaaaataagcgaccaaacaacttaccaaatccaagtataagtaatagtgatacaaactatattcatacattggagaataaactggatgcggttattaattgtttggttagtttggttgagtctaatcaagttattgcagataaggattacgaaccagttattaataagtatgtgtttgaagatgaggtaaataattctatcgataaacgagagcgtcacgaatctacaagagttagatttagaagaggaggcacgataatc

SEQ ID NO: 1300 - protein, 1550 aa, Staphylococcus aureus
  MISC_FEATURE (1)..(1550): phi PVL ORF 15 and 16
MPNPIGNMVIKVDLDGSGFNRGVTGLNRQMKMVSRELSANLSQFSRYDNSLEKSKIKVEGLSKKQKVQAQITKELKDSYDKLSKETGENSAKTQAAAAKYNEAYAKLNQYERELNQATQELKDMQREQKALNTAMGKLGTNFNNFGPKLQEIGNSMKNVGRNMTMYVTAPVVAGFAVAAKKGIEFDDSMRKVKATSGATGEEFEALKKKAREMGATTKFSASDSAEALNYMALAGWDSKQMMEGLSGVMDLAAASGEELEAVSDIVTDGLTAFGLKAKDSGHFADILAQTSSKANTDVRGLGEAFKYVAPVAGALGYTIEDTSIAIGLMSNAGIKGEKAGTALRTMFTNLSSPTRAMGNEMERLGISITDSNGKMIPMRKLLDQLREKFKHLSKDQQASSAATIFGKEAMSGALAIINASDEDYQKLTKSIDSSTGASKRMADTMESGLGGKLRTLRSQLEELALTIYDRIEPALKIIVSAFSKVVTWVTKLPTSIQLAVVGFGLFAAVLGPLVFMFGLFISVMGNAMTVLGPLLINVNKAGGLFAFLRTKIASLVKLFPILGVSISSLTLPITLIVGALVGIGIAFYQAYKRSETFRNIVNQAISGVANAFKAAKLALQGFFDLFKGDSKGAVTLEKIFPPETVAGIQNVVNTIRTTFFKVVDAIVGFAKEIGAQLASFWKENGSEITQALQNIAGFIKATFEFIFNFIIKPIMFAIWQVMQFIWPAVKALIVSTWENIKGVIQGAINIILGIIKVFSSLFTGNWRGVWDGIVMILKGTVQLIWNLIQLWFVGKILGVVRYFGGLLKGLISGIWGVIKGIFTKSLSAIWNATKSIFGFLYNSVKSIFTNMKNWLSSTWNNIKSNTVGKAHSLFTGVRSKFTSLWNATKDIFTKLRNWMSNIWNSIKDNTVGIAGRLWDKVRNIFGNMRDGLKSIIGKIKDHIGGMVDAIKKGLNKLIEGLNWVGGKLGMDEIPRLHTGTEHTHTTTRLVKNGKIARDTFATVGDKGRGNGPNGFRNEMIEFPNGKRVITPSTDTTAYLPKGSKVYNGAQTYSMLNGTLPRFHFGTTMWKDIKSSASSAFNWTKDQIGKGTKWLGDKVGDVMDFIDNPGKLLNYVLQAFGVDFSSLTKGMGIAGDITKAAWSKIKKSAIKWLEDAFAESGDGGVLDMSKLRYLYGHTAAYTRETGRPFHEGLDFDYIYEPVPSTINGRAQVMPVHNGGYGKWVKIVKGALEVIYAHLSKYKVKTGQQVRVGQTVGISGNTGFSTGPHLHYEMRWNGRHRDPLPWLRKNNGGGKSTPGGNGAANARRAIKAAQNILGGRYKASWITNEMMRVASRESNYTANAVNNWDSNARAGIPSRGMFQMIDPSFRAYAKSGYNNPLNPTHQAISAMRYIVGKWVPRTGSWRAAFKRAGDYAYATGGKVYNGLYHLGEEGYPEWIIPTDPSRANEAHKLLALAANDIDNRSKNKRPNNLPNPSISNSDTNYIHTLENKLDAVINCLVSLVESNQVIADKDYEPVINKYVFEDEVNNSIDKRERHESTRVRFRRGGTII

SEQ ID NO: 1301 - DNA, 1488 bp, Staphylococcus aureus
atgcaagatacaattcaaatagacaataaaacaattggatggctggttgtgcaaagagggttcgagataccctcttttaattttgttactgaaaaagaaaacgtaaaaggtagagcgggatctattgttaagaatcgttatttaaatgatatcgaatttgatttaccattaattattcgaaacgaaaaattgtcaccaggtggagaaaaaacacacgatgatatattagaagcattggtcaagttcttcaatattaaagatttaacacctaaaaaacttaaattcaaatctcaaaactggtattggtttgcatattttgatggtccattaaaattaccgaaaaacccaagaggttcagtgaagttcactataaaagtagtgttaacagatccttataaatactcggtaactggaaacaaaaacaccgcgatttcagaccaagtttcagttgtaaatagtgggactgctgacactcctttaattgttgaagcccgagcaattaaaccatctagttactttatgatcactaaaaatgatgaagattattttatggttggtgatgatgaggtaaccaaagaagttaaggattacatgcctcctgtttatcatagtgagtttcgtgatttcaaaggttggactaagatgattactgaagatattccaagtaatgatttaggtggtaaggtcggcggtgactttgtgatatccaatcttggcgaaggatataaagcaactaattttcctgatgcaaaaggttgggttggtgctggcacgaaacgagggctccctaaagcgatgacagattttcaaattacctataaatgtattgttgaacaaaaaggtaaaggtgccggaagaacagcacaacatatttatgatagtgatggtaagttacttgcttctattggttatgaaaataaatatcatgatagaaaaataggacatattgttgttacgttgtataaccaaaaaggagaccccaaaaagatatacgactatcagaataaaccgataatgtataacttggacagaatcgttgtttatatgcggctcagaagagtaggtaataaattttctattaaaacttggaaatttgatcacattaaagacccagatagacgtaaacctattgatatggatgagaaagagtggatagatggcggtaagttttatcagcgtccagcttctatcatagctatctatagtgcgaagtataacggttataagtggatggagatgaatggattaggttcattcaatacggagattctaccgaaaccgaaaggcgcaagggatgtcattatacaaaaaggtgatttagtgaaaatagatatgcaagcaaaaagtgttgtcatcaatgaggaaccaatgttgagcgagaaatcgtttggaagtaattatttcaatgttgattctgggtacagtgaattaatcatacaacctgaaaacgtctttgatacgacggttaaatggcaagatagatattta

SEQ ID NO: 1302 - protein, 496 aa, Staphylococcus aureus
  MISC_FEATURE (1)..(496): hypothetical protein
MQDTIQIDNKTIGWLVVQRGFEIPSFNFVTEKENVKGRAGSIVKNRYLNDIEFDLPLIIRNEKLSPGGEKTHDDILEALVKFFNIKDLTPKKLKFKSQNWYWFAYFDGPLKLPKNPRGSVKFTIKVVLTDPYKYSVTGNKNTAISDQVSVVNSGTADTPLIVEARAIKPSSYFMITKNDEDYFMVGDDEVTKEVKDYMPPVYHSEFRDFKGWTKMITEDIPSNDLGGKVGGDFVISNLGEGYKATNFPDAKGWVGAGTKRGLPKAMTDFQITYKCIVEQKGKGAGRTAQHIYDSDGKLLASIGYENKYHDRKIGHIVVTLYNQKGDPKKIYDYQNKPIMYNLDRIVVYMRLRRVGNKFSIKTWKFDHIKDPDRRKPIDMDEKEWIDGGKFYQRPASIIAIYSAKYNGYKWMEMNGLGSFNTEILPKPKGARDVIIQKGDLVKIDMQAKSVVINEEPMLSEKSFGSNYFNVDSGYSELIIQPENVFDTTVKWQDRYL

SEQ ID NO: 1303 - DNA, 3783 bp, Staphylococcus aureus
gtgatacatgttttagattttaacgacaagattatagatttcctttctactgatgacccttccttagttagagcgattcataaacgtaatgttaatgacaattcagaaatgcttgaactgctcatatcatcagaaagagctgaaaagttccgtgaacgacatcgtgttattataagggattcaaacaaacaatggcgtgaatttattattaactgggttcaagatacgatggacggctacacagagatagaatgtatagcgtcttatcttgctgatataacaacagctaaaccgtatgcaccaggcaaatttgagaaaaagacaacttcagaagcattgaaagatgtgttgagcgatacaggttgggaagtttctgaacaaaccgaatacgatggcttacgtactacgtcatggacttcttatcaaactagatatgaagttttaaagcaattatgtacaacctataaaatggcattggatttttatatagagcttagttctaataccgtcaaaggtagatatgtggtactcaaaaagaaaaacagcttattcaaaggtaaagaaattgagtatggtaaagatttggttgggttaactaggaagattgatatgtcagaaatcaaaacagcattaattgctgtgggacccgaaaatgacaaaggaaagcgtttagagttagttgtgactgatgacgaagcacaaagtcaattcaacttacctacccgttatatttggggaatatacgaacctcaatcagatgatcaaaatatgaatgaaacacggttgcgttctttagccaaaacagagttaaataaacgtaagtcggcagttatgtcatatgagattacttctactgatttggaagttacgtatccgcacgagattatatcaattggtgatacagtcagagtaaaacatagagattttaacccgccattgtatgtagaggcagaagttattgccgaagaatataacataatttcagaaaatagcacatatacattcggtcaacctaaagagttcaaagaatcagaattacgagaagagtttaacaaacgattgaacataatacatcaaaagttaaacgataatattagcaatatcaacactatagttaaagatgttgtagatggtgaattagaatactttgaacgcaaaatacacaaaaatgatacaccgccagaaaatccagtcaatgatatgctttggtatgatacaagtaaccctgatgttgctgtcttgcgtagatattggaatggtcgatggattgaagcaacaccaaatgatgttgaaaaattaggtggtataacaagagagaaagcgctattcagtgaattaaacaatatttttattaatttatctatacaacacgctagtcttttgtcagaagctacagaattactgaatagcgagtacttagtagataatgatttgaaagcggacttacaagcaagtttagacgctgtgattgatgtttataatcaaattaaaaataatttagaatctatgacacccgaaactgcaacgattggtcggttggtagatacacaagctttatttcttgaatatagaaagaaattacaagatgtctatacagatgtagaagatgtcaaaatcgctatttcagatagatttaaattattacagtcacaatacactgatgaaaaatataaagaagcgttggaaataatagcaacaaaatttggtttaacggtgaatgaagatttgcagttagtcggagaacctaatgttgttaaatcagctattgaagcagctagagaatccacaaaagaacaattacgtgactatgtaaaaacatcggactataaaacagacaaagacggtattgttgaacgtttagatactgctgaagctgagagaacgactttaaaaggtgaaatcaaagataaagttacgttaaacgaatatcgaaacggattggaagaacaaaaacaatatactgatgaccagttaagtgatttgtccaataatcctgagattaaagcaagtattgaacaagcaaatcaagaagcgcaagaagctttaaaatcatacattgatgctcaagataatcttaaagagaaggaatcgcaagcgtatgctgatggtaaaatttcggaagaagagcaacgcgctatacaagatgctcaagctaaacttgaagaggcaaaacaaaacgcagaactaaaggctagaaacgctgaaaagaaagctaatgcttatacagacaacaaggtcaaagaaagcacagatgcacagaggagaacactgactcgctatggttctcaaattatacaaaatggtaaggaaatcaaattaagaactactaaagaagagtttaatgcaaccaatcgtacactttcaaatatattaaacgagattgtccaaaacgttacagatggaacaacaatcagatatgatgataacggagtggctcaagctttaaatgtggggccacgtggtattagattaaatgctgataaaattgatattaacggtaatagagaaataaaccttcttatccaaaatatgcgagataaagtagataaaaccgatattgtcaacagccttaatttatcaagagagggtcttgatatcaatgttaatagaattggaattaaaggcggtaacaataacagatatgttcaaatacagaatgattctattgaactaggtggtattgtgcaacgaacttggaaaggcaaacgatcaaccgatgatatattcacacgtcttaaagatggacatctaaggtttagaaataataccgcaggcggttcactttatatgtcacattttggtatttcaacatatattgatggagaaggcgaagacggaggttcatccggtactattcaatggtgggataaaacttacagtgatagcggtatgaatggcataacaatcaattcctatggtggtgtcgttgcactaacgtcagataataatcgggttgttctggagtcttacgcttcatcgaatatcaaaagcaaacaggcaccggtgtatttatatccaaacacagacaaagtgcctggattaaaccgatttgcattcacgctgtctaatgcagataacgcttattcgagtgatggttatattatgtttggttctgatgagaactatgattacggtgcgggtatcaggttttctaaagaaagaaataaaggtcttgttcaaattgttaatggacgatatgcaacaggtggagatacaacaatcgaagcagggtatggcaaatttaatatgctgaaacgacgtgatggtaataggtatattcatatacagagtacagacctactgtctgtaggttcagatgatgcaggagataggatagcttctaactcaatttatagacgtacttattcggccgcagctaatttgcatattacttctgctggcacaattgggcgttcgacatcagcgcgtaaatacaagttatctatcgaaaatcaatataacgatagagatgaacaactggaacattcaaaagctattcttaacttacctattagaacgtggtttgataaagctgagtctgaaattttagctagagagctgagagaagatagaaaattatcggaagacacctataaacttgatagatacgtaggtttgattgctgaagaggtggagaatttaggattaaaagagtttgtcacgtatgatgacaaaggagaaattgaaggtatagcgtatgatcgtctatggattcatcttatccctgttatcaaagaacaacaactaagaatcaagaaattggaggagtcaaagaatgcagga

SEQ ID NO: 1304 - protein, 1261 aa, Staphylococcus aureus
  MISC_FEATURE (1)..(1261): phi PVL ORF 20 and 21
VIHVLDFNDKIIDFLSTDDPSLVRAIHKRNVNDNSEMLELLISSERAEKFRERHRVIIRDSNKQWREFIINWVQDTMDGYTEIECIASYLADITTAKPYAPGKFEKKTTSEALKDVLSDTGWEVSEQTEYDGLRTTSWTSYQTRYEVLKQLCTTYKMALDFYIELSSNTVKGRYVVLKKKNSLFKGKEIEYGKDLVGLTRKIDMSEIKTALIAVGPENDKGKRLELVVTDDEAQSQFNLPTRYIWGIYEPQSDDQNMNETRLRSLAKTELNKRKSAVMSYEITSTDLEVTYPHEIISIGDTVRVKHRDFNPPLYVEAEVIAEEYNIISENSTYTFGQPKEFKESELREEFNKRLNIIHQKLNDNISNINTIVKDVVDGELEYFERKIHKNDTPPENPVNDMLWYDTSNPDVAVLRRYWNGRWIEATPNDVEKLGGITREKALFSELNNIFINLSIQHASLLSEATELLNSEYLVDNDLKADLQASLDAVIDVYNQIKNNLESMTPETATIGRLVDTQALFLEYRKKLQDVYTDVEDVKIAISDRFKLLQSQYTDEKYKEALEIIATKFGLTVNEDLQLVGEPNVVKSAIEAARESTKEQLRDYVKTSDYKTDKDGIVERLDTAEAERTTLKGEIKDKVTLNEYRNGLEEQKQYTDDQLSDLSNNPEIKASIEQANQEAQEALKSYIDAQDNLKEKESQAYADGKISEEEQRAIQDAQAKLEEAKQNAELKARNAEKKANAYTDNKVKESTDAQRRTLTRYGSQIIQNGKEIKLRTTKEEFNATNRTLSNILNEIVQNVTDGTTIRYDDNGVAQALNVGPRGIRLNADKIDINGNREINLLIQNMRDKVDKTDIVNSLNLSREGLDINVNRIGIKGGNNNRYVQIQNDSIELGGIVQRTWKGKRSTDDIFTRLKDGHLRFRNNTAGGSLYMSHFGISTYIDGEGEDGGSSGTIQWWDKTYSDSGMNGITINSYGGVVALTSDNNRVVLESYASSNIKSKQAPVYLYPNTDKVPGLNRFAFTLSNADNAYSSDGYIMFGSDENYDYGAGIRFSKERNKGLVQIVNGRYATGGDTTIEAGYGKFNMLKRRDGNRYIHIQSTDLLSVGSDDAGDRIASNSIYRRTYSAAANLHITSAGTIGRSTSARKYKLSIENQYNDRDEQLEHSKAILNLPIRTWFDKAESEILARELREDRKLSEDTYKLDRYVGLIAEEVENLGLKEFVTYDDKGEIEGIAYDRLWIHLIPVIKEQQLRIKKLEESKNAG

SEQ ID NO: 1305 - DNA, 150 bp, Staphylococcus aureus
atgcaggataacaaacaaggattacaagctaatcctgaatatacaattcattatttatcacaggaaattatgaggttaacacaagaaaacgcgatgttaaaagcgtatatacaagaaaataaagaaaatcaacaatgtgctgaggaagag

SEQ ID NO: 1306 - protein, 50 aa, Staphylococcus aureus
  MISC_FEATURE (1)..(50): hypothetical protein
MQDNKQGLQANPEYTIHYLSQEIMRLTQENAMLKAYIQENKENQQCAEEE

SEQ ID NO: 1307 - DNA, 567 bp, Staphylococcus aureus
  MISC_FEATURE (1)..(567): n = g, a, t, or c
atgactatgtcacaacaagacaaaaagttaactggtgtttttgggcatccagtatcagaccgagaaaatagtatgacagcagggcctaggggacctcttttaatgcaagatatttactttttagagcaaatgtctcaatttgatagagaagtaataccagaacgtcgaatgcatgccaaaggttctggtgcatttgggacatttactgtaactaaagatataacaaaatatacgaatgctaaaatattctctgaaataggtaagcaaaccgaaatgtttgcccgtttctctactgtagcaggagaacgtggtgctgctgatgcggagcgtgacattcgaggatttgcgttaaagttctacactgaagaagggaactgggatttagtagggaataacacaccagtattcttctttagagatccaaagttatttgttagtttaaatcgtgcggtgaaacgagatcctagaacaaatatgagagatnnncaaataactgggatttctgggcgggtcttccagaagcattgcggccaagtaacgatcttaatgtcagatagagggattgcc

SEQ ID NO: 1308 - protein, 189 aa, Staphylococcus aureus
  MISC_FEATURE (1)..(189): Xaa = any amino acid
  MISC_FEATURE (1)..(189): catalase Staphylococcus
MTMSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDXQITGISGRVFQKHCGQVTILMSDRGIA

SEQ ID NO: 1309 - DNA, 1419 bp, Staphylococcus aureus
atggaagataataaaatgaaccgtagtcttaactcaagacacatttccatgattgctataggtggtgcaattgggactggtctatttgtagctactggtaatatcatttctcaagctggtcctggaggcgctatactcgcttatcttgttattggtgtcatgctatatttcttaatgtcatcaattggagagttggcaacattttatccagtatcaggttcattcagctcttattcaacacgctttattgactcatctcttggctttaccatgggatggttgtattgggcattgtggtcattagttacaagtgttgatgtcatagtagcgtcaaatgtgctttatttctgggacacatttaaatttttccaccccattacttggagcttaatctttattacaattttactattattaaacattttttctgtaaaatcatttggagaaactgagttttggttatcattgattaaagtgttaacaattatcgtattcgttatttttggctttttaatgattttcggtatcttaggtggtcatacatatggatttgaaaactatacaaaaggccaagcaccgtttgttggtggtatctctggtttcttaggcgtattattagtcgccggattttcggttggtggtacagaagtagtagcagtaactgctggtgaatcagatgaccctaaaaagtctatgcctaaggcaattaaacaagtattttggcgtattcttttattctatgtcttatcaattgcagtaattggtgcaattattccgtacacagatccatcattattaagagcaagtagttcaataagtcaaagcccatttacaattgtattcgatagagtaggcatagcctttgcagcatcagtaatcaacgcggttattttaacttcattattatccgctgcaaattcaggtgtttatacaacaggcagaatgttgtattccttaagttcagacaaaaaagcaccccaatttttaagtaaattaaacaagacaactaagttacctttaagagcattattaactacttatgcagtcgttgttattgttattatttatgcaaactttaattcaaatgccgtttttaatttacttgaaattattggttcaatgattatagttgtttggggatcaagcatttggtcacaaatacgattgcgacaagctattaaaaaacaaggtcaagaccctaataaggtcctaccatataaagcacctttttatccattaggaccaatcattgtcatcactacactattattcttgctatttggtggctcagttgaatatattttaaaagatcaatggttaaatgcttttaaaaactttttacctttaatcattctagcgttgatttactttattcataaaatcattcacaaaacaaaatttgtaaagctagaaaacaat

SEQ ID NO: 1310 - protein, 473 aa, Staphylococcus aureus
  MISC_FEATURE (1)..(473): gamma-aminobutyrate
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLENN

SEQ ID NO: 1311 - DNA, 285 bp, Staphylococcus aureus
atggcaaaagaaattatcaacaatacagaaaggtttattttagtacaaatcgacaaagaaggtacagaacgtgtagtatatcaagatttcacaggaagttttacaacttctgaaatggttaaccatgctcaagattttaaatctgaagaaaacgctaagaaaattgcggagacgttaaatttgttatatcaattaactaacaaaaaacaacgtgtgaaagtagttaaagaagtagttgaaagatcagatttatctccagaggtaacagttaacactgaaacagta

SEQ ID NO: 1312 - protein, 95 aa, Staphylococcus aureus
  MISC_FEATURE (1)..(95): hypothetical protein
MAKEIINNTERFILVQIDKEGTERVVYQDFTGSFTTSEMVNHAQDFKSEENAKKIAETLNLLYQLTNKKQRVKVVKEVVERSDLSPEVTVNTETV

SEQ ID NO: 1313 - DNA, 294 bp, Staphylococcus aureus
ttggggtggttcaaaaaacacgaacatgaatggcgcatcagaaggttagaagagaatgataaaacaatgctcagcacactcaacgaaattaaattaggtcaaaaaacccaagagcaagttaacattaaattagataaaaccttagatgctattcaaaaagaaagagaaatagatgaaaagaataagaaagaaaatgataagaacatacgtgatatgaaaatgtgggtgcttggtttagttgggacaatatttgggtcgctaattatagcattattgcgtatgcttatgggcata

SEQ ID NO: 1314 - protein, 98 aa, Staphylococcus aureus
  MISC_FEATURE (1)..(98): hypothetical protein
LGWFKKHEHEWRIRRLEENDKTMLSTLNEIKLGQKTQEQVNIKLDKTLDAIQKEREIDEKNKKENDKNIRDMKMWVLGLVGTIFGSLIIALLRMLMGI

SEQ ID NO: 1315 - DNA, 105 bp, Staphylococcus aureus
ttgatatttatattatggtgtgttaatttatatatagaaaaagggcaacatgcgcaaacatgttaccctaatgagcccgttaaaaagacggtggctattttagat

SEQ ID NO: 1316 - protein, 35 aa, Staphylococcus aureus
LIFILWCVNLYIEKGQHAQTCYPNEPVKKTVAILD

SEQ ID NO: 1317 - DNA, 252 bp, Staphylococcus aureus
atgattaattggaaaattagaatgaaacaaaaatcattttgggtagcgatattgtcagctatctttttatttgctcaaaacatcgcaaaagctattgggtatgatatccaagtttatacagagcaattaacagacggtttaaacgctatattaggatttttagtattaactggtgtgattcaagacccgactactaaaggtataggtgatagccaccaagctttagaatatgaagaaccaagaagaaaatac

SEQ ID NO: 1318 - protein, 84 aa, Staphylococcus aureus
  MISC_FEATURE (1)..(84): holin homolog
MINWKIRMKQKSFWVAILSAIFLFAQNIAKAIGYDIQVYTEQLTDGLNAILGFLVLTGVIQDPTTKGIGDSHQALEYEEPRRKY

SEQ ID NO: 1319 - DNA, 753 bp, Staphylococcus aureus
atgaaaacatacagtgaagcaagagcaaggttacgttggtatcaaggtagatatattgattttgacggttggtatggttaccaatgtgcagatttagcagttgattacatttattggttgttagaaattagaatgtggggaaatgcaaaagatgcaatcaataacgattttaaaaacatggcaacagtatatgaaaacacaccatcgtttgttccacaaataggtgatgtggctgtatttaccaaaggaatatataaacaatacggtcatattggtttagtgtttaatggtggtaatacaaaccaatttttaattttggaacagaactatgacggtaacgcaaatacgcctgcaaagttacgttgggataattattacggctgtactcactttattagacctaagtataaaagtgagggcttaatgaataagatcacaaataaagttaaaccacctgctcaaaaagcagtcggtaaatctgcaagtaaaataacagttggaagtaaagcgccttataaccttaaatggtcaaaaggtgcttattttaatgcgaaaatcgacggcttaggtgctacttcagccactagatacggtgataatcgtactaactatagattcgatgttggacaggctgtatacgcgcctggaacattaatatatgtgtttgaaattatagatggttggtgtcgcatttattggaacaatcataatgagtggatatggcatgagagattgattgtgaaagaagtgttt

SEQ ID NO: 1320 - protein, 251 aa, Staphylococcus aureus
  MISC_FEATURE (1)..(251): lytic enzyme
MKTYSEARARLRWYQGRYIDFDGWYGYQCADLAVDYIYWLLEIRMWGNAKDAINNDFKNMATVYENTPSFVPQIGDVAVFTKGIYKQYGHIGLVFNGGNTNQFLILEQNYDGNANTPAKLRWDNYYGCTHFIRPKYKSEGLMNKITNKVKPPAQKAVGKSASKITVGSKAPYNLKWSKGAYFNAKIDGLGATSATRYGDNRTNYRFDVGQAVYAPGTLIYVFEIIDGWCRIYWNNHNEWIWHERLIVKEVF

SEQ ID NO: 1321 - DNA, 489 bp, Staphylococcus aureus
atgctcaaaagaagtttattatttttaactgttttattgttattattctcattttcttcaattactaatgaggtaagtgcatcaagttcattcgacaaaggaaaatataaaaaaggcgatgacgcgagttattttgaaccaacaggcccgtatttgatggtaaatgtgactggagttgatggtaaaggaaatgaattgctatcccctcattatgtcgagtttcctattaaacctgggactacacttacaaaagaaaaaattgaatactatgtcgaatgggcattagatgcgacagcatataaagagtttagagtagttgaattagatccaagcgcaaagatcgaagtcacttattatgataagaataagaaaaaagaagaaacgaagtctttccctataacagaaaaaggttttgttgtcccagatttatcagagcatattaaaaaccctggattcaacttaattacaaaggttattatagaaaagaaa

SEQ ID NO: 1322 - protein, 163 aa, Staphylococcus aureus
  MISC_FEATURE (1)..(163): staphylokinase precursor
MLKRSLLFLTVLLLLFSFSSITNEVSASSSFDKGKYKKGDDASYFEPTGPYLMVNVTGVDGKGNELLSPHYVEFPIKPGTTLTKEKIEYYVEWALDATAYKEFRVVELDPSAKIEVTYYDKNKKKEETKSFPITEKGFVVPDLSEHIKNPGFNLITKVIIEKK

SEQ ID NO: 1323 - DNA, 294 bp, Staphylococcus aureus
gtgccagcaggttatacactcgataaaaacaatgtaccgtataaaaaagagactggttattacacagttgccaatgttaaaggtaataacgtgagggatggctattcaactaattcaagaattacaggtgtattacccaataacgcaactatcaaatatgacggcgcatattgcattaatggctatagatggattacttatattgctaatagtggacaacgtcgttatatagcgacaggagaggtagacaaggcaggtaatagaataagcagttttggtaagtttagtgcagtt

SEQ ID NO: 1324 - protein, 98 aa, Staphylococcus aureus
  MISC_FEATURE (1)..(98): truncated amidase
VPAGYTLDKNNVPYKKETGYYTVANVKGNNVRDGYSTNSRITGVLPNNATIKYDGAYCINGYRWITYIANSGQRRYIATGEVDKAGNRISSFGKFSAV

SEQ ID NO: 1325 - DNA, 447 bp, Staphylococcus aureus
atgaaaaagaaattagcaacaacagttttagcattaagttttttaacggcaggaatcagtacacaccatcattcagcgaaagcttttacttttgaaccgtttcctacaaatgaagaaatagaatcaaataagaaattgttagagaaagaaaaagcttataaagaatcatttaaaaatagtggtcttcctacaacactaggaaaattagatgaacgtttgagaaattatttaaagaaaggcacaaaaaattctgctcaatttgaaaaaatggttattttaactgaaaataaaggttactatacagtatatctgaatacaccacttgctgaagatagaaaaaatgttgagttactaggtaaaatgtataaaacatacttctttaaaaaaggagagtctaaatcatcttatgtaattaatggtcctggaaaaactaatgaatatgcatac

SEQ ID NO: 1326 - protein, 149 aa, Staphylococcus aureus
MKKKLATTVLALSFLTAGISTHHHSAKAFTFEPFPTNEEIESNKKLLEKEKAYKESFKNSGLPTTLGKLDERLRNYLKKGTKNSAQFEKMVILTENKGYYTVYLNTPLAEDRKNVELLGKMYKTYFFKKGESKSSYVINGPGKTNEYAY

SEQ ID NO: 1327 - DNA, 348 bp, Staphylococcus aureus
atgaaaattagaaaatctatacttgcgggaactttagcaatcgttttagcatcaccactagtaactaatctagataaaaatgaggcacaagctagcacaagcttgccaacatcgaatgaatatcaaaacgaaaagttagctaatgaattaaaatcgttattagatgaactaaatgttaatgaattagctactggaagtttaaacacttattataagcgaactataaaaatttcaggtctaaaagcaatgtatgctcttaagtcaaaagactttaagaaaatgtcagaagcaaaatatcaacttcaaaagatttataacgaaattgacgaagcactaaaaagtaaatat

SEQ ID NO: 1328 - protein, 116 aa, Staphylococcus aureus
  MISC_FEATURE (1)..(116): hypothetical protein
MKIRKSILAGTLAIVLASPLVTNLDKNEAQASTSLPTSNEYQNEKLANELKSLLDELNVNELATGSLNTYYKRTIKISGLKAMYALKSKDFKKMSEAKYQLQKIYNEIDEALKSKY

SEQ ID NO: 1329 - DNA, 102 bp, Staphylococcus aureus
atgttaccattctttattttagatattttgcatatcgtgtataatatagataacaataacttttcaggggtgaaattcaatgattggacaaacaaatttatt

SEQ ID NO: 1330 - protein, 34 aa, Staphylococcus aureus
MLPFFILDILHIVYNIDNNNFSGVKFNDWTNKFI

SEQ ID NO: 1331 - DNA, 177 bp, Staphylococcus aureus
gtgaaatttaaaacaactaaagaatgtaaaagtaataatatctttaaaagaagtcaagaaattaataatagagaaagtgaaaagggttgtttatggggcattagcatgttgattctacttttcttattgattctgtttggaataactgcttgttcatcaagcattcactttattaat

SEQ ID NO: 1332 - protein, 59 aa, Staphylococcus aureus
  MISC_FEATURE (1)..(59): hypothetical protein
VKFKTTKECKSNNIFKRSQEINNRESEKGCLWGISMLILLFLLILFGITACSSSIHFIN

SEQ ID NO: 1333 - DNA, 204 bp, Staphylococcus aureus
gtgataatgatggtgaaaaaaacaaaatccaattcactaaaaaaagttgcaacacttgcattagcaaatttattattagttggtgcacttactgacaatagtgccaaagccgaatctaagaaagatgatactgatttgaagttagttagtcataacgtttatatgttatcgaccgttttgtatccaaactggagacttttaaca

SEQ ID NO: 1334 - protein, 68 aa, Staphylococcus aureus
  MISC_FEATURE (1)..(68): truncated 6449-6450
VIMMVKKTKSNSLKKVATLALANLLLVGALTDNSAKAESKKDDTDLKLVSHNVYMLSTVLYPNWRLLT

SEQ ID NO: 1335 - DNA, 1752 bp, Staphylococcus aureus
atgaaatttaagtcattgattacaacaactttagcattaggtgttttagcatcaacaggtgcaaactttaataataatgaagcgtctgccgcagctaagccattagataaatcatcaagttcgttacaccatggatattctaaagtccatgttccatatgcaatcactgtgaacggtacaagccaaaatattttatcaagcttaacatttaataagaatcaaaatattagttataaagatttagaggatagagttaaatcagttttaaaatcagacagaggtattagtgatatagatttaagactatcgaagcaagcgaaatatactgtttactttaaaaatggaacaaagaaagttatcgatttgaaagcaggtatttacacagctgatttaattaatacaagtgaaattaaagctattaatattaacgtagatactaaaaagcaagttgaagataaaaagaaagataaagcaaattaccaagttccatacacaatcactgtgaacggtacaagccaaaatattttatcaaacttaacatttaataagaatcaaaatattagttacaaagatttagaggataaagttaaatcagttttagaatcaaatagaggtattaccgatgttgatttaagattatcgaagcaagcgaaatatacagttaattttaaaaatggaacgaagaaagttatcgatttgaaatcaggtatttacacagcgaatttaataaattcaagtgatattaaaagtatcaatattaacgtagatacaaaaaaacatatcgaaaataaagctaaaagaaactatcaagttccatattcaattaatttaaatggtacatctacaaacattttatcgaatctttcattttcaaataaaccttggacaaattacaaaaatttaactagtcaaataaaatcagtactgaagcatgatagaggtattagtgaacaagatttaaaatatgctaagaaagcttattatactgtttattttaaaaatggtggtaaaagaatcttacagttgaattcaaaaaattacacagcaaacttagttcatgcgaaagatgttaagagaattgaaattactgttaaaacaggaactaaagcgaaagcagacagatatgtaccatacacaattgcagtaaatggcacatcaacaccaattttatcagatttaaaatttacaggtgacccacgtgtaggctacaaagatatctctaaaaaagttaaatcagtattgaagcatgatagaggtatcggggaacgtgaattaaaatatgcaaaaaaagcaacttacacagtacattttaaaaatggaacgaaaaaagtgattaacataaattcaaatattagccaactgaatctgctttatgttcaagatattaaaaagatagatattgatgttaaaacaggaactaaagcgaaagcggatagctatgtaccatatacaattgcagtaaatggcacatcaacaccaattttatcaaaacttaaaatttcgaataaacaattaattagttacaaatatttaaatgacaaagtgaaatctgtattaaaaagtgaaagaggcatcagtgatcttgacttaaaatttgcgaaacaagcaaaatatacagtatatttcaaaaatggaaagaaacaagtagtgaatttaaaatcagacatctttacacctaatttatttagtgccaaagatattaaaaagattgatattgatgtaaaacaatacactaaatcaaaaaaaaataaa

SEQ ID NO: 1336 - protein, 584 aa, Staphylococcus aureus
  MISC_FEATURE (1)..(584): truncated map-w protein
MKFKSLITTTLALGVLASTGANFNNNEASAAAKPLDKSSSSLHHGYSKVHVPYAITVNGTSQNILSSLTFNKNQNISYKDLEDRVKSVLKSDRGISDIDLRLSKQAKYTVYFKNGTKKVIDLKAGIYTADLINTSEIKAININVDTKKQVEDKKKDKANYQVPYTITVNGTSQNILSNLTFNKNQNISYKDLEDKVKSVLESNRGITDVDLRLSKQAKYTVNFKNGTKKVIDLKSGIYTANLINSSDIKSININVDTKKHIENKAKRNYQVPYSINLNGTSTNILSNLSFSNKPWTNYKNLTSQIKSVLKHDRGISEQDLKYAKKAYYTVYFKNGGKRILQLNSKNYTANLVHAKDVKRIEITVKTGTKAKADRYVPYTIAVNGTSTPILSDLKFTGDPRVGYKDISKKVKSVLKHDRGIGERELKYAKKATYTVHFKNGTKKVININSNISQLNLLYVQDIKKIDIDVKTGTKAKADSYVPYTIAVNGTSTPILSKLKISNKQLISYKYLNDKVKSVLKSERGISDLDLKFAKQAKYTVYFKNGKKQVVNLKSDIFTPNLFSAKDIKKIDIDVKQYTKSKKNK

SEQ ID NO: 1337 - DNA, 288 bp, Staphylococcus aureus
gtgaaattcccagtaacaataaataaatttgaaaacatagtttcaaatgaatttgtgttctataatgcaagcaaaattacaattaatgatttaagtataaaacttaaatcagcaatggcaaatgatcaagggataactaaacatgacataggacttgctgaacgcgcagtgtataaagtgtattttaaaaatggttcgtcaaaatatgtagacttaaaaactgagtataaagatgaaagagtatttaaagcaactgacattaaaaaggtagatattgaacttaaattc

SEQ ID NO: 1338 - protein, 96 aa, Staphylococcus aureus
  MISC_FEATURE (1)..(96): truncated map-w protein
VKFPVTINKFENIVSNEFVFYNASKITINDLSIKLKSAMANDQGITKHDIGLAERAVYKVYFKNGSSKYVDLKTEYKDERVFKATDIKKVDIELKF

SEQ ID NO: 1339 - DNA, 1284 bp, Staphylococcus aureus
atgaatcctttagcccaaagcttaaatgaacaacttcaacagtcaaatgcaactgcctttacaatgttatctgacttaggtcaaaatatgttttatccaaaaggcattttatctcaatctgctgaagcaaagagtacaacatataatgcaactataggtatggcgacaaacaaagacggaaaaatgtttgcatcatctttagatgcaatgtttaatgatttaactccagatgaaatattcccttatgcgccaccacaaggcatcgaagaattacgtgatttatggcaacaaaaaatgttgcgtgacaatccagagctatcaatcgacaacatgtcactaccaattgttacgaatgcattaacacatggtttatctttagttggcgatttatttgtaaatcaaggtgacactatcttgttaccagagcataattggggtaattacaaacttgttttcaatacgagaaatggtgcaaaccttcaaacatatcctatctttgataaagacgggcattatactactgattcacttgtagaagctttacaatcatacaataaagataaagtcattatgattttaaattatcctaataatccgacaggttacacacctacgcataaagaagtgactaccatcgtcgatgcaattaaagcattagctgataaaggtacaaaagttatagctgttgtggatgacgcatactatggtttattctatgaagatgtgtatactcaatcattatttactgcattatctaatttaaattcaaatgcaatattacctgttcgtttagatggtgcaacaaaagaatttttcgcatggggattccgtgttgggtttatgacatttggaacgtctgatcaaacaactaaagaagtattagaagccaaagtaaaaggtcttatacgaagtaacatttctagtggacctcttccaacacaaagcgctgttaagcatgtattaaaaaataataaacaattcgataaagaaatcgaacaaaatattcaaacattaaaagaacgctatgaagtcactaaggaagttgtctatgctgatcaatatcattcacattggcaagcctatgactttaactctggatactttatggcaataaaagttcatgatgttgaccctgaagaacttcgtaaacatttaattgaaaaatattcaattggtgttattgcacttaatgcaacagatattcgtattgcgtttagctgtgtagaaaaagaagatatcccacatgtatttgattcaattgctaaagcgattgatgacttaaga

SEQ ID NO: 1340 - protein, 428 aa, Staphylococcus aureus
  MISC_FEATURE (1)..(428): hypothetical protein
MNPLAQSLNEQLQQSNATAFTMLSDLGQNMFYPKGILSQSAEAKSTTYNATIGMATNKDGKMFASSLDAMFNDLTPDEIFPYAPPQGIEELRDLWQQKMLRDNPELSIDNMSLPIVTNALTHGLSLVGDLFVNQGDTILLPEHNWGNYKLVFNTRNGANLQTYPIFDKDGHYTTDSLVEALQSYNKDKVIMILNYPNNPTGYTPTHKEVTTIVDAIKALADKGTKVIAVVDDAYYGLFYEDVYTQSLFTALSNLNSNAILPVRLDGATKEFFAWGFRVGFMTFGTSDQTTKEVLEAKVKGLIRSNISSGPLPTQSAVKHVLKNNKQFDKEIEQNIQTLKERYEVTKEVVYADQYHSHWQAYDFNSGYFMAIKVHDVDPEELRKHLIEKYSIGVIALNATDIRIAFSCVEKEDIPHVFDSIAKAIDDLR

SEQ ID NO: 1341 - DNA, 96 bp, Staphylococcus aureus
atgatgtggtggcaagaagggatgatgacacttattacaggtggcttactaattatttttcgactttggttagaactgaaatggaaaaataaaaaa

SEQ ID NO: 1342 - protein, 32 aa, Staphylococcus aureus
MMWWQEGMMTLITGGLLIIFRLWLELKWKNKK

SEQ ID NO: 1343 - DNA, 174 bp, Staphylococcus aureus
ttgaaacatctaacaaaaatatttgtagtacttgcaattattttatttattattggttattatttacaagcaactaatcatgaaagccaaggtataaaattattattagcagcgattatgtttatgatttgtgcttttataagtagaagtaatgatcgacgtaaaaatagtaaa

SEQ ID NO: 1344 - protein, 58 aa, Staphylococcus aureus
  MISC_FEATURE (1)..(58): hypothetical protein
LKHLTKIFVVLAIILFIIGYYLQATNHESQGIKLLLAAIMFMICAFISRSNDRRKNSK

SEQ ID NO: 1345 - DNA, 459 bp, Staphylococcus aureus
ttgataatgagacatgcatatttacaaaactgtgtatattgtgtatattgtatatatacagaagttgatagggggacgttgatgaaaataattttaaaaaacaatagtgattttccgatttatgaacagattaagcaacaagtaaaacaaaatattttaaagggacatgttgctcctggagagcatttgccgtcaatgagagaacttgccaaagatcttcaagtaagtttgattactaccaaacgtgcttatgaagatttagagaaagacggttttgttacaacaattagaggaaaagggacctttgttaaggagcaagatagttctattttaaaagagaaacaattttttaccattgaaaatttggttaaagaattggttaatgaagcgcaagccatcgaaatgtcacttgaggaactgcaggatattttaacgttcatttatgaggaggaatcatca

SEQ ID NO: 1346 - protein, 153 aa, Staphylococcus aureus
  MISC_FEATURE (1)..(153): hypothetical protein
LIMRHAYLQNCVYCVYCIYTEVDRGTLMKIILKNNSDFPIYEQIKQQVKQNILKGHVAPGEHLPSMRELAKDLQVSLITTKRAYEDLEKDGFVTTIRGKGTFVKEQDSSILKEKQFFTIENLVKELVNEAQAIEMSLEELQDILTFIYEEESS

SEQ ID NO: 1347 - DNA, 312 bp, Staphylococcus aureus
atgattggacaaacaaatttatttgatgatgtactaaagcaagatgaaagatttgttattgtagttcaagcattagaagaaaagaacggacaattattaaagagaactttaagggaatatcccggtttaaaccataaacaaatgaatgatttatttatgcacttaaaggaattattttccgaagaatcatttgctgaaaaccaatcagcgttcagtattacagtttatacaaatttagattatactgctgaccaaatatatgctcatgtaaaacgtttcagaggtaagcatgactggacacaaacagctaaa

SEQ ID NO: 1348 - protein, 104 aa, Staphylococcus aureus
  MISC_FEATURE (1)..(104): hypothetical protein
MIGQTNLFDDVLKQDERFVIVVQALEEKNGQLLKRTLREYPGLNHKQMNDLFMHLKELFSEESFAENQSAFSITVYTNLDYTADQIYAHVKRFRGKHDWTQTAK

SEQ ID NO: 1349 - DNA, 894 bp, Staphylococcus aureus
atgaatgccatagaattaagtaatgttaattattcaagtgatcagtttaatttaaagaatatctctttcaaagttcctcaaggattcgtcactggttttattggtagaaatggcgctggtaaaaccacaataataaggttaattatggatttgtatcaaccacaaactggtgttattagagtattagaagaggatatggctctcaatccgatagagttaaagaatagaattgggtttgtttactctgaaaattattttaatgagagatggactacgaagcaacttgaaaaaatgattgcccctttttatcgtaaatgggaccatcaagtatttgaattttatcttgaaaagttcgatttaccaatcaataaatcaataaaaacattttcgactgggatgaaaatgaaattatcactagcagttgcattttcacatcatgctgaattgtatatttttgatgagcctacttcaggtctcgatcccttagctagaaatgagctattggagataattcagcaagaattaattgatgaaaataaaacaatattcatgtcgacacacattatctcagatttagaaaaaatagctgattatatcattcacttaagtgacggtgaagttatcttaaatggttcaaaagaacaactgttacaaagatatcaagttgtgagtggtgctattgaggaccttgatgatgaattagcatctctacttatttatgaagaacataagcgtacgggatttataggattaacagaacatgcgcaagtatttaaagaaattttaggtcataaagtgaatatcactacaccttctattgagaacttaatggtttatcttgaaaagagaaaacctaaatatcatgaaaacatcaaattgatggaagaaggtttt

SEQ ID NO: 1350 - protein, 298 aa, Staphylococcus aureus
  MISC_FEATURE (1)..(298): hypothetical protein
MNAIELSNVNYSSDQFNLKNISFKVPQGFVTGFIGRNGAGKTTIIRLIMDLYQPQTGVIRVLEEDMALNPIELKNRIGFVYSENYFNERWTTKQLEKMIAPFYRKWDHQVFEFYLEKFDLPINKSIKTFSTGMKMKLSLAVAFSHHAELYIFDEPTSGLDPLARNELLEIIQQELIDENKTIFMSTHIISDLEKIADYIIHLSDGEVILNGSKEQLLQRYQVVSGAIEDLDDELASLLIYEEHKRTGFIGLTEHAQVFKEILGHKVNITTPSIENLMVYLEKRKPKYHENIKLMEEGF

SEQ ID NO: 1351 - DNA, 678 bp, Staphylococcus aureus
atgaaggcattgttaattaggaattttaaattacgacgatatacacttatcatctatgttctattattaaccttatatcctttttatataatgcttgactcaacaaagttcttttacttattgcaatcttttataagtccaacaatattgattatttggattttagatgctggtcacttatttagactcaatcgtagattaggtggtaatgattcatattatttttatatgagtttaccagtgtcaaaaaaacaattgcttaatgccaactatattacatgcattgttttaacattaattggaacgcttgttattagtttatatgcttatgaagcagatgtgattgaaccaaattcaatctatttttcaactgcatatgcatttgtcatatctaacttcttgtctataccaattgcatttagtcaatttacagaattgcgtagagtcaaagtgccatatggtatatacgtgtttactattatcattttagttccatttttattttcaattgcaatagtattggtgaattattttgttctaagtcaatcatcattcccagatttatattcatatattttaaatattggttttctaattataagcattgttatacttattgttaattattttaaacagctcaataaaataaatactagaaaatttaaaggaggcagtcga

SEQ ID NO: 1352 - protein, 226 aa, Staphylococcus aureus
  MISC_FEATURE (1)..(226): hypothetical protein
MKALLIRNFKLRRYTLIIYVLLLTLYPFYIMLDSTKFFYLLQSFISPTILIIWILDAGHLFRLNRRLGGNDSYYFYMSLPVSKKQLLNANYITCIVLTLIGTLVISLYAYEADVIEPNSIYFSTAYAFVISNFLSIPIAFSQFTELRRVKVPYGIYVFTIIILVPFLFSIAIVLVNYFVLSQSSFPDLYSYILNIGFLIISIVILIVNYFKQLNKINTRKFKGGSR

SEQ ID NO: 1353 - DNA, 870 bp, Staphylococcus aureus
atgaaattagaacatattacaaaaaaatacggctcaaatgtcgttttaaatgatattgattttgactttggcgatagtagaattgtcggattaataggaaaaaacggtgttggtaaaacaaccgttatgaaagtaatgaatggtaatattattaaatttgatggaaaagtagatattgataatgcagataatatcggttttttaattgagcatcctaaattatatgataataaatcaggattgtataacttgaaattatttgcacaagtattaggtaagggttttgataaagcatacacagacaaaattatagatgcatttggtatgagaccttatattaaaaagaaagttaagaaatattcaatggggatgaagcaaaagttagcaattgcagtatctttaatgaataaacctaaatttttaatcttggatgagcctacaaatggtatggatccagatggctcaattgatgtgctgactacaattaagtctttagtaaatgaacttgatatgagaattctaatatcaagtcataagttagaagatattgaattaatttgtgatagagctgtatttttaagagacggacattttgttcaagatgtaaacatggaggaaggtgttgcatctgacacaacgatagttactgttgatcataaagactttgatagaactgaaaaatatcttgcagagcatttccaattacaaaatgtcgacaaagcagacggacatttaatgatcaatgcacaaaaaaattatcaagttatactaaaagcattatctgaattagatatttatccgaaatatattgaaacacgtaaaagttcattgcgtgatacgtacttcaatataaatcaaagaggtgataaa

SEQ ID NO: 1354 - protein, 290 aa, Staphylococcus aureus
  MISC_FEATURE (1)..(290): hypothetical protein
MKLEHITKKYGSNVVLNDIDFDFGDSRIVGLIGKNGVGKTTVMKVMNGNIIKFDGKVDIDNADNIGFLIEHPKLYDNKSGLYNLKLFAQVLGKGFDKAYTDKIIDAFGMRPYIKKKVKKYSMGMKQKLAIAVSLMNKPKFLILDEPTNGMDPDGSIDVLTTIKSLVNELDMRILISSHKLEDIELICDRAVFLRDGHFVQDVNMEEGVASDTTIVTVDHKDFDRTEKYLAEHFQLQNVDKADGHLMINAQKNYQVILKALSELDIYPKYIETRKSSLRDTYFNINQRGDK

SEQ ID NO: 1355 - DNA, 738 bp, Staphylococcus aureus
atgagaattttaaatttagttaagtatgatttttatagtatatttaaaagtcctttaacatatttagcgatactagtcgtatctagtttgattgcaactcaaagtatacttatggcaaattcgatggataacccgaaacatattattgtctatggatctgtatttgctgcagcaaaatggttattgttaataattggattaatgtttgttgttaagacaattacgcgtgatttttcacaaggtacaattcaactatatatgagtaaagttaaaacacgcgttggatacattatttcgaaaacaatttcaattattttaatttcaatattatttgcattaattcattatgtgattttgattgttgtgcaggcatctagtaatggaaaaaatttggcgttttctaaatatgtagataatttatggttcttcctaatctttttactattctttggcttgtttttattcttaatcacacttgcatcacaaaaaacagcaatgatattttcattaggtgtatttttagtactcattgtaccgtttattaaaccttttattacatttatcccaagatacggtgaaaaagttttagatgcttttgattatatcccttttgcttacttaactgataaaatgattagctctaactttgattttagcaattggcaatgggtaatttcattaggttctatagtgatattcttcattttgaatatcttatatgtcgctaaaaaagacatt

SEQ ID NO: 1356 - protein, 246 aa, Staphylococcus aureus
  MISC_FEATURE (1)..(246): conserved hypothetical
MRILNLVKYDFYSIFKSPLTYLAILVVSSLIATQSILMANSMDNPKHIIVYGSVFAAAKWLLLIIGLMFVVKTITRDFSQGTIQLYMSKVKTRVGYIISKTISIILISILFALIHYVILIVVQASSNGKNLAFSKYVDNLWFFLIFLLFFGLFLFLITLASQKTAMIFSLGVFLVLIVPFIKPFITFIPRYGEKVLDAFDYIPFAYLTDKMISSNFDFSNWQWVISLGSIVIFFILNILYVAKKDI

SEQ ID NO: 1357 - DNA, 582 bp, Staphylococcus aureus
atgctaaaggaggtttttacaatgacaaatttagaaacttatttcaaaaatagccaacccttaaatgaatacattgatggaatgaagacaaatcaagataccgttctcagtatctatcaatcatttgagttaccagaagatgattcacgcatcaaaaaaataaaagagatgaattattctaaagtattagtaattactgaagactggtgtggagatgcaatgatgaatctcccaattctaaaacacatcagtgaagcattaaatttagaagtacgcgtgttccatagagatgatgatacaaaactgatcgatcaatatttaacaaatggtaaatcacgtgcaattcctatcttcgtattcttgaatgatcaattcgaacaagaaacagtttggggaccaagagcaaatgaagtccaaaaatttgtaactgatgttcgtgctgataaattaccgagcaaagatcatccagactatgcagatttagaaaaagaaacacacttagttatatcaaaccgctataaaactgacgcttcattttggaaagcagtttataattccatcctaaataaattagaaaataaa

SEQ ID NO: 1358 - protein, 194 aa, Staphylococcus aureus
  MISC_FEATURE (1)..(194): hypothetical protein
MLKEVFTMTNLETYFKNSQPLNEYIDGMKTNQDTVLSIYQSFELPEDDSRIKKIKEMNYSKVLVITEDWCGDAMMNLPILKHISEALNLEVRVFHRDDDTKLIDQYLTNGKSRAIPIFVFLNDQFEQETVWGPRANEVQKFVTDVRADKLPSKDHPDYADLEKETHLVISNRYKTDASFWKAVYNSILNKLENK

SEQ ID NO: 1359 - DNA, 522 bp, Staphylococcus aureus
atgctatatttaaataagtacaaagaaagggtgacatcagtgcgtattcaaaatcgctgggttgtgtttatattatttttaatctgttcttttggtgtattaattggtttatatcaatatcgtcatacgaaaactgtggatttgtctaatcttgaaataaacgatattaaattaaatgagaagtttgataaaaaaggctatgaagtaaataaaaaaattaagtttgatcgttttaaattttataacagtaaagctcaccctgatcttaccgttaaagtgagagaaaaggataacatcgttaaggggataatattagtaagagatgaaaagatacatactaattttgatgggggaattggttcgccgataaataacgcgattgaaaatcttggattcggatataaaagaacaaaagttggcaatgatttctcatcggtaaagtatattgatagagataaccatttaaaattaaacttactttatcaagatttagaaattaaacgtattgaattttttagtaaa

SEQ ID NO: 1360 - protein, 174 aa, Staphylococcus aureus
  MISC_FEATURE (1)..(174): hypothetical protein
MLYLNKYKERVTSVRIQNRWVVFILFLICSFGVLIGLYQYRHTKTVDLSNLEINDIKLNEKFDKKGYEVNKKIKFDRFKFYNSKAHPDLTVKVREKDNIVKGIILVRDEKIHTNFDGGIGSPINNAIENLGFGYKRTKVGNDFSSVKYIDRDNHLKLNLLYQDLEIKRIEFFSK

SEQ ID NO: 1361 - DNA, 564 bp, Staphylococcus aureus
gtgacctatatgaacaagattacttatttaaatgaattagaaacagcacttgatgcgctacctaggcatttaagagatcaaaaaatgtatgaatatgaacgttatttttatgagcaagaacttaatggcgttgatgaaggggaaattttaaagaagttaaaagacccacaagatgttgcagctgaaacaaaagctagaagtgttattgattatgctgaatctaaaccaacatttgaaaatatttcaagagctgttgctgcttcattaagtttaggcattctatctatttttgtcatccttataccagtatctatagttggattatttgtattagcattatttttaatatcacttttgctgctgttttgtccaattattttattagcatcagcaatatccagaggaattgtggactcaattagtaatgtattttttgccatatcatattcaggattaggattagtatttatcattgtcatatttaagattttagaatacatttatcgtttaatcttaaaatatttactttggtatattaaaactgtcaaaggaagcgttagaaaa

SEQ ID NO: 1362 - protein, 188 aa, Staphylococcus aureus
  MISC_FEATURE (1)..(188): conserved hypothetical
VTYMNKITYLNELETALDALPRHLRDQKMYEYERYFYEQELNGVDEGEILKKLKDPQDVAAETKARSVIDYAESKPTFENISRAVAASLSLGILSIFVILIPVSIVGLFVLALFLISLLLLFCPIILLASAISRGIVDSISNVFFAISYSGLGLVFIIVIFKILEYIYRLILKYLLWYIKTVKGSVRK

SEQ ID NO: 1363 - DNA, 840 bp, Staphylococcus aureus
atgaagaaattcttttttattgggcttttagtgtttgttgtcttttttacagcagcaaccattatttggttcagctatgataaaaacaaatatggtactaaacaatatgataaaacattcaaagacgatgcttttgacaatgtatctataaatttggatagtacagaacttcgtataaaacgggggaatcaatttagagttaaatatgatggtgacaatgatatattaattaatatagtagataagacgttgaagattagtgataaaaggtctaagacaagaggatatgcaattgatatgaatccttttcatgagaataagaaaacgttaacgattgaaatgcctgataaaatgattaaacgtttaaatctatcatctggagcaggaagtgttagaatcagtgatgttgatttagagaacacaagtattcaaagcattaacggtgaagtagttattaaaaactcaaatcttgacgcactagattcaaagacaaataatagttctacttatattagtaaaagtaacattaaaaatagcaatattaaagttgttattggtacgctacaaatcgacaagagtcaaattaaacaatccatatttttaaacgatcatggtgacattgaatttaaaaacatgccatcaaaagtagatgcaaaagcttctactaaacaaggagatattcgttttaagtatgatagtaaacctgaagacactatactaaagctaaatccgggaacgggtgatagcgtagttaaaaataaaacatttactaatggtaaagttgggaaaagcgacaatgttttagaattttatacgattgatggtaatatcaaagttgaa

SEQ ID NO: 1364 - protein, 280 aa, Staphylococcus aureus
  MISC_FEATURE (1)..(280): hypothetical protein
MKKFFFIGLLVFVVFFTAATIIWFSYDKNKYGTKQYDKTFKDDAFDNVSINLDSTELRIKRGNQFRVKYDGDNDILINIVDKTLKISDKRSKTRGYAIDMNPFHENKKTLTIEMPDKMIKRLNLSSGAGSVRISDVDLENTSIQSINGEVVIKNSNLDALDSKTNNSSTYISKSNIKNSNIKVVIGTLQIDKSQIKQSIFLNDHGDIEFKNMPSKVDAKASTKQGDIRFKYDSKPEDTILKLNPGTGDSVVKNKTFTNGKVGKSDNVLEFYTIDGNIKVE

SEQ ID NO: 1365 - DNA, 1110 bp, Staphylococcus aureus
atgacattcaatatacatacgattactatttatttacaatatattacaactaaaaagaaaggggccgatgatatgcaacaagtgacatcagatatcatgacttttagaggttcacatttcgagttaggtgttaaaactggtaaatggcttcaacaaacacctcttctaaaaaatcgagaaaaagaatggaaaaaacgtgtcccacgtttcgatatagatgtaaatgaaacttatcaaatattccaaacatacgcacctcaaatatgggaagaattaatgggactacaaagtatactcaaaatgccaacacgccaaattattttaaactttggacattatcgttttaccgatttaaaagaaagtggttgcacggtctttcaaggcaaagacttcatggttagaaattatgattaccaccctgcaacttatgatggtcgctacttactttatcaacctacagatagcggtttagctcaaattggtcctgtatcaagggtaactggaagaatggatggtatgaatgagtcaggattaactatgggctataactttatgcaccggaagaaaccagcaaatggttttgtatgttatatgattggtcgtctaattcttgaaaattgccgaaatgtaacagaagcaatccaattattgaaagaaataccacacagaagctcatttagctacatactgatggacaaatcattgaaccatgcaattgttgaagtgacaccgagatcaatagatgttcgttatgataatatatgtacaaatcattttgaaatattaacacatgaaaatcgtaattatacaaaagaatctaaagaaagactggcgcgtaccatttcacaaactaatgataatttagatatgactacagcatttaagttattcaataatcctcagtatgaaatttacagtaaactattcaaaagctggtctggcaccatccatacatcaatgtatcaacctgaaacattaactgcatattttacattgggagaaaatgcgccaccagaaataatagatttcaaatcatggttagatggtcaagaccttaatatcactcactttactggcaatatagataccgacttaacttttgccaacaaa

SEQ ID NO: 1366 - protein, 370 aa, Staphylococcus aureus
  MISC_FEATURE (1)..(370): hypothetical protein
MTFNIHTITIYLQYITTKKKGADDMQQVTSDIMTFRGSHFELGVKTGKWLQQTPLLKNREKEWKKRVPRFDIDVNETYQIFQTYAPQIWEELMGLQSILKMPTRQIILNFGHYRFTDLKESGCTVFQGKDFMVRNYDYHPATYDGRYLLYQPTDSGLAQIGPVSRVTGRMDGMNESGLTMGYNFMHRKKPANGFVCYMIGRLILENCRNVTEAIQLLKEIPHRSSFSYILMDKSLNHAIVEVTPRSIDVRYDNICTNHFEILTHENRNYTKESKERLARTISQTNDNLDMTTAFKLFNNPQYEIYSKLFKSWSGTIHTSMYQPETLTAYFTLGENAPPEIIDFKSWLDGQDLNITHFTGNIDTDLTFANK

SEQ ID NO: 1367 - DNA, 171 bp, Staphylococcus aureus
atgtggaattttattaaatgtgtgtttaaattcgtatttagcttagttgctattacaacattagttgctggtgttggtgtagtagcatttgcttatatctttaaaaaagattttgaagatattgaaagaaaaactaaagaaattatttctgatattgaaagtaaaaataac

SEQ ID NO: 1368 - protein, 57 aa, Staphylococcus aureus
  MISC_FEATURE (1)..(57): hypothetical protein
MWNFIKCVFKFVFSLVAITTLVAGVGVVAFAYIFKKDFEDIERKTKEIISDIESKNN

SEQ ID NO: 1369 - DNA, 399 bp, Staphylococcus aureus
atgacaagttatgaagaagaaactgattatcgtaacgttccaagagaattactagataacaatatacctatgggaagaggcatgattaaatgggctccttttgcaacattacccgaacaattcgaaacgattcaacaatacattatcgaccaaaacaaaattacacgtcctgtattatcagatgatcaattggctgagctaaacattcggctacacgaggcgctacaatatgcccaacctgtagaagttaaattttataataatggctttgtagattcagtacgcttaaccatttatcgtattgatgctattaattatgaaattgatggttatgtttacaatcagcaacaacgtcaaaaaatttctatctttgatatcttagatattgtcttgttacct

SEQ ID NO: 1370 - protein, 133 aa, Staphylococcus aureus
  MISC_FEATURE (1)..(133): hypothetical protein
MTSYEEETDYRNVPRELLDNNIPMGRGMIKWAPFATLPEQFETIQQYIIDQNKITRPVLSDDQLAELNIRLHEALQYAQPVEVKFYNNGFVDSVRLTIYRIDAINYEIDGYVYNQQQRQKISIFDILDIVLLP

SEQ ID NO: 1371 - DNA, 1026 bp, Staphylococcus aureus
atgacaaatggatatattggttcttacactaaaaagaatggtaaagggatttatcgttttgaattaaacgaaaatcagtcacgtattgatttattagaaacaggatttgaattagaagcgtctacatatttggtgcgtaataatgaagttttatatggaatcaacaaagaaggagaacaatgcggtgttgcaagtttgaaaattgatgacaatggtgaattgcatttattaaataaatgtttgtcttcaaaagctggtacaggttgttatgtatcgatttcagaagataaacgatatttatttgaagcggtatatggtgctggcatcatacgtatgtatgaattaaatacgcacacaggtgaaattatacgtctaattcaagaacttgcacatgattttccaacaggtacacatgaaagacaagatcatccacacgcacattatattaatcaaactccagatggtaagtacgttgcagtaacagatttaggtgctgatcgtatcgttacttataaatttgatgacaacgggtttgaattttataaagaatctttatttaaagatagtgatgggacaagacatattgaatttcatgataatggaaaatttgcttatgtcgtacacgaattatcaaatactgtgagtgttgcagaatataatgacggtaaatttgaagagctcgagcgtcatttaacaattcctgaaaactttgatggagatactaaacttgcagcagtgcgtttatctcatgatcaacaattcttatatgtatctaatagagggcatgatagcattgcaatttttaaagttcttgataatggtcaacacttagaactagtaacaattactgaaagtggtggtcaattcccaagagattttaatattgcctcatcagatgaccttttagtttgtgctcatgagcaaggagattcagttgtaactgttttcgaaagaaataaagaaacaggtaaaattacgctatgtgataacactcgtgtagcatctgaaggtgtatgtgtcatattt

SEQ ID NO: 1372 - protein, 342 aa, Staphylococcus aureus
  MISC_FEATURE (1)..(342): conserved hypothetical
MTNGYIGSYTKKNGKGIYRFELNENQSRIDLLETGFELEASTYLVRNNEVLYGINKEGEQCGVASLKIDDNGELHLLNKCLSSKAGTGCYVSISEDKRYLFEAVYGAGIIRMYELNTHTGEIIRLIQELAHDFPTGTHERQDHPHAHYINQTPDGKYVAVTDLGADRIVTYKFDDNGFEFYKESLFKDSDGTRHIEFHDNGKFAYVVHELSNTVSVAEYNDGKFEELERHLTIPENFDGDTKLAAVRLSHDQQFLYVSNRGHDSIAIFKVLDNGQHLELVTITESGGQFPRDFNIASSDDLLVCAHEQGDSVVTVFERNKETGKITLCDNTRVASEGVCVIF

SEQ ID NO: 1373 - DNA, 1377 bp, Staphylococcus aureus
atgaatatcattgagcaaaaattttatgacagtaaagcttttttcaatacacaacaaactaaagatattagttttagaaaagagcaattaaagaagttaagcaaagctattaaatcatacgagagcgatattttagaagcactatatacagatttaggaaaaaataaagtcgaagcttatgctactgaaattggcataactttgaaaagtatcaaaattgcccgtaaggaacttaaaaactggactaaaacaaaaaatgtagacacacctttatatttatttccaacaaaaagctatatcaaaaaagaaccttatggaacagttttgatcattgcaccatttaactatccttttcaactagtgttcgaacctttaatcggtgctattgcagcaggtaatacggcaattattaaaccatctgagttgacgcctaatgttgcacgagtgattaaacggttaatcaatgaaacatttgatgcaaattacattgaagttattgagggaggaattgaagaaacgcaaacgttaattcacttaccttttgactatgtcttctttacaggaagtgaaaatgtaggcaaaatcgtttatcaagctgccagcgaaaatttagttcctgtgacattagaaatgggcggtaaatctccagtcatcgttgatgaaacagcgaatattaaagttgctagtgagcgcatttgttttgggaaattcactaatgccggccaaacatgtgttgcaccagattacattttagtacacgaatctgtaaaagatgatttaatcacagccctatcaaaaacgttgcgtgaattttatggtcaaaatatacaacaaagtccagattatggccgcattgtaaaccttaaacattatcatcgtctgacttcattacttaacagtgcacaaatgaatattgtatttggtggtcatagtgatgaggatgaacgttatatagaaccaacattgttagatcacgttacaagtgattcagcaattatgcaagaagaaatttttggtcctatcttaccgattttaacgtatcagtcattggatgaagcaatagcctttattcaccaaagaccaaaacctttgagtttatatttatttagcgaagatgaaaatgctacacaacgtgtaataaacgagctatcatttggcggcggcgctattaatgatacattgatgcacctagcgaatcctaaattaccatttggtggtgttggtgcctcaggtatgggacgctatcatggtaaatattcattcgacacttttacacatgaaaaaagctacattttcaaatctacacgattagaatcaggtgtccatttaccaccatataaaggtaaatttaaatacatcaaagctttctttaaaaat

SEQ ID NO: 1374 - protein, 459 aa, Staphylococcus aureus
  MISC_FEATURE (1)..(459): aldehyde dehydrogenase
MNIIEQKFYDSKAFFNTQQTKDISFRKEQLKKLSKAIKSYESDILEALYTDLGKNKVEAYATEIGITLKSIKIARKELKNWTKTKNVDTPLYLFPTKSYIKKEPYGTVLIIAPFNYPFQLVFEPLIGAIAAGNTAIIKPSELTPNVARVIKRLINETFDANYIEVIEGGIEETQTLIHLPFDYVFFTGSENVGKIVYQAASENLVPVTLEMGGKSPVIVDETANIKVASERICFGKFTNAGQTCVAPDYILVHESVKDDLITALSKTLREFYGQNIQQSPDYGRIVNLKHYHRLTSLLNSAQMNIVFGGHSDEDERYIEPTLLDHVTSDSAIMQEEIFGPILPILTYQSLDEAIAFIHQRPKPLSLYLFSEDENATQRVINELSFGGGAINDTLMHLANPKLPFGGVGASGMGRYHGKYSFDTFTHEKSYIFKSTRLESGVHLPPYKGKFKYIKAFFKN

SEQ ID NO: 1375 - DNA, 171 bp, Staphylococcus aureus
ttgaatgttgtggccgttaattttaaatggtctttcgaattatatatgttgaaagttgaaaatagagcgatgaatcgtgtacataataatatttataactttaatcataacgaaaaaggtaggaagaaaacaaaaatttatactcaacatcgcaaatattttaagaaaatg

SEQ ID NO: 1376 - protein, 57 aa, Staphylococcus aureus
LNVVAVNFKWSFELYMLKVENRAMNRVHNNIYNFNHNEKGRKKTKIYTQHRKYFKKM

SEQ ID NO: 1377 - DNA, 933 bp, Staphylococcus aureus
ttgacaatggctaaaacatatattttcggacataagaatccagacactgatgcaatttcatctgcgattattatggcagaatttgaacaacttcgaggtaattcaggagccaaagcataccgtttaggtgatgtgagtgcagaaactcaattcgcgttagatacatttaatgtacctgctccggaattattaacagatgatttagatggtcaagatgttatcttagttgatcataacgaattccaacaaagttctgatacgattgcctctgctacaattaagcatgtaattgatcatcacagaattgcaaatttcgaaactgctggtcctttatgttatcgtgctgaaccagttggttgtacagctacaattttatacaaaatgtttagagaacgtggctttgaaattaaacctgaaattgccggtttaatgttatcagcaattatctcagatagcttacttttcaaatcaccaacatgtacacaacaagatgttaaagcagctgaagaattaaaagatattgctaaagttgatattcaaaagtacggcttagatatgttaaaagcaggtgcttcaacaactgataaatcagttgaattcttattaaacatggatgctaaatcatttactatgggtgactatgtgactcgtattgcacaagttaatgctgttgaccttgacgaagtgttaaatcgtaaagaagatttagaaaaagaaatgttagctgtaagtgcacaagaaaaatatgacttatttgtacttgttgttactgacatcattaatagtgattctaaaattttagttgtaggtgctgaaaaagataaagttggcgaagcattcaatgttcaattagaagatgacatggccttcttatctggtgtcgtttctcgaaaaaaacaaatcgtacctcaaatcactgaagcattaacaaaa

SEQ ID NO: 1378 - protein, 311 aa, Staphylococcus aureus
  MISC_FEATURE (1)..(311): manganese-dependent
LTMAKTYIFGHKNPDTDAISSAIIMAEFEQLRGNSGAKAYRLGDVSAETQFALDTFNVPAPELLTDDLDGQDVILVDHNEFQQSSDTIASATIKHVIDHHRIANFETAGPLCYRAEPVGCTATILYKMFRERGFEIKPEIAGLMLSAIISDSLLFKSPTCTQQDVKAAEELKDIAKVDIQKYGLDMLKAGASTTDKSVEFLLNMDAKSFTMGDYVTRIAQVNAVDLDEVLNRKEDLEKEMLAVSAQEKYDLFVLVVTDIINSDSKILVVGAEKDKVGEAFNVQLEDDMAFLSGVVSRKKQIVPQITEALTK

SEQ ID NO: 1379 - DNA, 558 bp, Staphylococcus aureus
atgacacatcgcgcactattagttgttgactattcatatgactttatcgcagacgacggcttactaacatgcggtaaacctggacaaaatattgaagattttattgtttctcgtatcaatgactttaattattatcaagaccatatattctttttaatggatttacattatttacatgacattcatcatcctgaaagtaaattattcccaccacacaatatcgtagatacaagtggtagagaattatacggtaaagtaggtaaattatacgaaacaattaaagcgcaacctaatgtacatttcattgataaaacgcgctatgattcgttctttggtaccccgcttgatagtttattgagagaaagaagtattaatcaagtcgaaatcgttggtgtatgtaccgatatttgcgtgttacatacagcaatttctgcatacaacttaggttataaaatttcagtacctgctgagggagtggcttcatttaatcaaaaagggcatgaatgggcacttgcacatttcaaaaactcattaggtgcagaggtagaacaacacgtt

SEQ ID NO: 1380 - protein, 186 aa, Staphylococcus aureus
MTHRALLVVDYSYDFIADDGLLTCGKPGQNIEDFIVSRINDFNYYQDHIFFLMDLHYLHDIHHPESKLFPPHNIVDTSGRELYGKVGKLYETIKAQPNVHFIDKTRYDSFFGTPLDSLLRERSINQVEIVGVCTDICVLHTAISAYNLGYKISVPAEGVASFNQKGHEWALAHFKNSLGAEVEQHV

SEQ ID NO: 1381 - DNA, 1095 bp, Staphylococcus aureus
atgtatatcaatatgaaagattatgggttaacaggcataatcaaaactaaagatactcgagcaatacaacgtgcgttaaatcgtggaagatgtaaaccaacgacagtttatataccgaaagggacgtatgatatttgcaaaccattaacgatatatggcaatacaacacttttgttagataatgaaactattttacgccgatgtcattctggtcctttattaaaaaatggtcgtcgctttggtttttatcgtggttataatggacacagtcatattcatattaaaggcggcaagtttgatatgaatggtgtatcgtatccttataacaatacagctatgtgcattgggcatgctgaagatattcaattaataggtgtgaccattaagaatgtagtgagtggtcatgcaattgatgcttgtgggattaacggactctatattaaaagctgttcatttgaaggattcatagactatagtggcgaacgcttttattctgaagcaatacaattagacattcaagtacctggtgcttttccaaaattcggaacgacagatggtacgataacgaaaaatgtcattatcgaagattgttattttggaccttcagaattgcccgaaatgggaagttggaatcgtgctattggctcacatgcaagtagacataatcgatactatgagaatattcatattagaaataatatatttgaagatatacaaggttatgcattaactcccttgaagtataaagatgctttcattattaataataagtttattaactgtgagggtggcattagatatttaggagttagagatggtaaaaatgcagcagatgtgatgacaggaaaagacttaggttcccaagcaggcataaatatgaatataattggaaatgaatttaaaggatcaatgtctaaagatgcgatacatgtacgtaattataataatgttaaacataaagatgtattaatcgttgggaatacattcaataattcgactcaatcaattcatttagaagatattgatacagtgtttttaagtcctgttgaagcgggtattcaagttactacaatcaatgtagatgaaataaaaaag

SEQ ID NO: 1382 - protein, 365 aa, Staphylococcus aureus
  MISC_FEATURE (1)..(365): conserved hypothetical
MYINMKDYGLTGIIKTKDTRAIQRALNRGRCKPTTVYIPKGTYDICKPLTIYGNTTLLLDNETILRRCHSGPLLKNGRRFGFYRGYNGHSHIHIKGGKFDMNGVSYPYNNTAMCIGHAEDIQLIGVTIKNVVSGHAIDACGINGLYIKSCSFEGFIDYSGERFYSEAIQLDIQVPGAFPKFGTTDGTITKNVIIEDCYFGPSELPEMGSWNRAIGSHASRHNRYYENIHIRNNIFEDIQGYALTPLKYKDAFIINNKFINCEGGIRYLGVRDGKNAADVMTGKDLGSQAGINMNIIGNEFKGSMSKDAIHVRNYNNVKHKDVLIVGNTFNNSTQSIHLEDIDTVFLSPVEAGIQVTTINVDEIKK

SEQ ID NO: 1383 - DNA, 1296 bp, Staphylococcus aureus
gtgttattaccattaggtcatatacttacaccagaacaagtatcatccgaatatggcaatgatattatctttttgtttttaggtggatttattttggcaattgcaatggaaagatggaatttacatacgagagtagcgttgacaattattaatttgattggtgcaagcacttcaaaaatattacttggattcatggtggcaacaggattcttatctatgtttgtatcgaacactgcagctgtaatgattatgattccgattggtttagcaattattaaggaagcacatgatttacaagaagccaatacgaatcaaacaagtattcaaaagtttgaaaaatctctagttttagcaattggctatgcaggtacgattggtggcttgggtacattaatcggaaccccgccattaattattttaaaaggacaatacatgcaacattttggacatgaaattagttttgctaaatggatgattgtagggattccaacggtcattgttttgttaggtattacttggctctatttaagatatgttgcgtttagacatgatttgaaatatttacctggtggtcagacgttaattaaacaaaagttagacgagcttggcaaaatgaagtatgaagaaaaggtagtacaaactatctttgtacttgctagcttattatggattacaagagagtttcttctgaaaaaatgggaagttacgtcatctgttgcagatggtacgattgctatttttatatcaatattattatttattattccagctaaaaatactgaaaaacatcgccgtatcattgactgggaagttgcaaaagagctcccttggggtgtattaattttatttggtggcggtttagcattagcgaaaggtatttctgaaagtggtttagcaaaatggttaggcgaacagttgaaatcattaaatggtgttagtccgattcttattgtaattgtcataacaatctttgtcttatttttaactgaagtgacatctaatactgcaactgcaacgatgattttaccgattttagcaacgttgtctgttgctgttggagtgcatccattactacttatggcacctgcagctatggcggctaactgtgcatacatgttaccagtagggacaccaccgaatgcaattatctttggttctggtaaaatatctatcaaacaaatggcatcagtaggattctgggtaaacttaatcagtgcaataattattattttagtcgtgtattatgtaatgcctatagttttaggtattgatataaatcaaccactgccattgaaa

SEQ ID NO: 1384 - protein, 432 aa, Staphylococcus aureus
  MISC_FEATURE (1)..(432): hypothetical protein
VLLPLGHILTPEQVSSEYGNDIIFLFLGGFILAIAMERWNLHTRVALTIINLIGASTSKILLGFMVATGFLSMFVSNTAAVMIMIPIGLAIIKEAHDLQEANTNQTSIQKFEKSLVLAIGYAGTIGGLGTLIGTPPLIILKGQYMQHFGHEISFAKWMIVGIPTVIVLLGITWLYLRYVAFRHDLKYLPGGQTLIKQKLDELGKMKYEEKVVQTIFVLASLLWITREFLLKKWEVTSSVADGTIAIFISILLFIIPAKNTEKHRRIIDWEVAKELPWGVLILFGGGLALAKGISESGLAKWLGEQLKSLNGVSPILIVIVITIFVLFLTEVTSNTATATMILPILATLSVAVGVHPLLLMAPAAMAANCAYMLPVGTPPNAIIFGSGKISIKQMASVGFWVNLISAIIIILVVYYVMPIVLGIDINQPLPLK

SEQ ID NO: 1385 - DNA, 792 bp, Staphylococcus aureus
atgcaattatattatttaggccctaaaggtacattttcatatttggcttgtcgtcagtatttttctgaaaatgaagcaacttttcaaccaaagtcaaatttatttgaagtcatcaaggcagttgcagatgatgacacatcgattggtgttgtccctattgaaaattctatagaaggaacaatcaacattgtggcagatgcacttgcacagcaagatgtctttgcacacggtgaaatacgtttagatattaactttgcattatatggtaatggaacagattccatttctgatattaaaaaagtgtattctattgcaccagcaatcagtcaaacaacaaattacatacatcaacatcaatttgactatgattatgtcgacagtacaattcaaagtttgactaaaattgaaaatggcgttgcagcaattgcacctttaggtagtggcgaagcttatggttttacacctattgatacacatattgaagactatccacataacgtgacacgttttttagttataaaaaatcagcagcaatttgatcaaaatgcgacatcattgatgtttttaattacaccaatgcatgataaacctgggttgttagcaagtgtgcttaatacatttgctttgtttaatattaatttatcctggattgagtctcgtcctttaaaaacacaattaggtatgtatcgatttttcgttcaggctgattctgcaattacaaccgatataaagaaagtcattgctattttagaaaccttagatttcaaagtagaaatgattggtgcttttaat

SEQ ID NO: 1386 - protein, 264 aa, Staphylococcus aureus
  MISC_FEATURE (1)..(264): hypothetical protein
MQLYYLGPKGTFSYLACRQYFSENEATFQPKSNLFEVIKAVADDDTSIGVVPIENSIEGTINIVADALAQQDVFAHGEIRLDINFALYGNGTDSISDIKKVYSIAPAISQTTNYIHQHQFDYDYVDSTIQSLTKIENGVAAIAPLGSGEAYGFTPIDTHIEDYPHNVTRFLVIKNQQQFDQNATSLMFLITPMHDKPGLLASVLNTFALFNINLSWIESRPLKTQLGMYRFFVQADSAITTDIKKVIAILETLDFKVEMIGAFN

SEQ ID NO: 1387 - DNA, 1083 bp, Staphylococcus aureus
gtgttgttaatgttatttaaagaggctcaagctttcatagaaaacatgtataaagagtgtcattatgaaacgcaaattatcaataaacgtttacatgacattgaactagaaataaaagaaactgggacatatacacatacagaagaagaacttatttatggtgctaaaatggcttggcgtaattcaaatcgttgcattggtcgtttattttgggattcgttaaatgtcattgatgcaagagatgttactgacgaagcatcgttcttatcatcaattacttatcatattacacaggctacaaatgaaggtaaattaaagccgtatattactatatatgctccaaaggatggacctaaaattttcaacaatcaattaattcgctatgctggctatgacaattgtggtgatcctgctgaaaaagaagttacacgcttagcaaatcacttaggttggaaaggaaaaggtactaattttgacgtgttaccactgatttaccaattacctaatgagtcagttaaattttacgaatatcctacttcattaattaaagaagtacctattgaacataatcattatccaaaattaagaaaattgaacttaaaatggtatgcagtccctatcatttccaatatggacttaaaaatcggtggcattgtatatccaactgcaccctttaacggttggtatatggtaactgaaattggcgtacgtaactttattgatgattaccgttacaatttactagaaaaagttgcagatgcgtttgaatttgatacacttaaaaataattcatttaataaagatcgagcacttgttgaattgaactatgctgtgtatcattcctttaaaaaagaaggcgtatcaattgtcgatcatttgaccgctgcaaagcaattcgaactattcgaacgtaacgaagcacaacaaggtcgtcaagttaccggaaaatggtcttggctagcaccgccattatctccaacattgacgtcaaattatcatcacggatatgacaatacagtaaaagatccaaactttttctataaaaagaaagaatcaaatgctaaccagtgccctttccatcat

SEQ ID NO: 1388 - protein, 361 aa, Staphylococcus aureus
  MISC_FEATURE (1)..(361): nitric-oxide synthase
VLLMLFKEAQAFIENMYKECHYETQIINKRLHDIELEIKETGTYTHTEEELIYGAKMAWRNSNRCIGRLFWDSLNVIDARDVTDEASFLSSITYHITQATNEGKLKPYITIYAPKDGPKIFNNQLIRYAGYDNCGDPAEKEVTRLANHLGWKGKGTNFDVLPLIYQLPNESVKFYEYPTSLIKEVPIEHNHYPKLRKLNLKWYAVPIISNMDLKIGGIVYPTAPFNGWYMVTEIGVRNFIDDYRYNLLEKVADAFEFDTLKNNSFNKDRALVELNYAVYHSFKKEGVSIVDHLTAAKQFELFERNEAQQGRQVTGKWSWLAPPLSPTLTSNYHHGYDNTVKDPNFFYKKKESNANQCPFHH

SEQ ID NO: 1389 - DNA, 801 bp, Staphylococcus aureus
atgacaaattataaagttgtcgttttagatatggatgacacattgctaaattcagataatgtgatatcagaagaaactgcaaattatttaacagcaattcaagatgaaggttattatgttgttctagcatctggtagacctactgaaggtatgattccaactgctagagatttaaaattacctgaacatcatagctatattattagttataacggtagtaaaacgattaacatgactaatgaagaagtagaagtaagtaaatcgattggtaagcaagatttcgatgaaattgtagattattgtcgagatagaggctttttcgttcttacatatcatgatggtcaaattatttacgacagcgaacatgagtatatgaatattgaagcagaattaacaggtttaccgatgaaacgtgttgatgatatcaaagcgtatattcaaggcgatgtacccaaggtcatgggtgtagattatgtagcgaatattacagaagctagaattgatttgaatggtgtgttcaatgataatgtagatgctacgacaagtaagccattcttcttagaatttatggccaaagacgtttcaaaaggtaatgcaattaaagcgttatgtcacaaattgggatattcggtggatcaagtcattgcttttggtgatagtatgaatgataaatcaatgtttgaagtcgcaggtctagctattgctatggggaatgcatcagatgaacttaagcaatatgcaaatgaagttacgttggatcataatgaaaatggtattccacatgcgctcaaaaaattgtta

SEQ ID NO: 1390 - protein, 267 aa, Staphylococcus aureus
  MISC_FEATURE (1)..(267): conserved hypothetical
MTNYKVVVLDMDDTLLNSDNVISEETANYLTAIQDEGYYVVLASGRPTEGMIPTARDLKLPEHHSYIISYNGSKTINMTNEEVEVSKSIGKQDFDEIVDYCRDRGFFVLTYHDGQIIYDSEHEYMNIEAELTGLPMKRVDDIKAYIQGDVPKVMGVDYVANITEARIDLNGVFNDNVDATTSKPFFLEFMAKDVSKGNAIKALCHKLGYSVDQVIAFGDSMNDKSMFEVAGLAIAMGNASDELKQYANEVTLDHNENGIPHALKKLL

SEQ ID NO: 1391 - DNA, 1512 bp, Staphylococcus aureus
atgataaaatgtaagaaaatatttaggtcgattggagagatacaagtgtaccaattagaagacgacagtttaatgttacataatgacttatatcaaataaatatggctgaaagttattggaatgataatattcatgaaaaaatggctgtatttgatttgtattttagaaaaatgccatttaatagtggctatgctgtttttaatggtttaaaacgcgtcattgattttatagaacattttggattttcagaatctgatttggaatatttaaagtctattggctacaaggatgatttcttatcatatttaaaagatttaaaattcacaggcagcatccgttcgatgcaagaaggcgaattatgctttggtaacgaaccattgttacgcgtagaagcaccattgattcaagcgcaattaatagaaacaattttattaaacattgtaaatttccatacattaattacaacaaaggctagcagaattcgtcaaattgcatcaaatgataaattaatggagtttggtacacgtcgtgcgcaagaaattgatgcagcattgtggggcgctagagctgcttacatcgggggctttgattctacaagtaatgttagggcggggaaattatttggtatacctgtgtctggtacacatgcacatgcatttgtccaaacttatggagacgaatatgttgccttcaaaaaatatgctgaaagacataaaaattgtgtgttcctagtagatacattccatactttaaaatctggcgtgccaaatgcaataaaagttgcaaaagaattaggtgacaaaattaactttgtaggtattcgattagattctggagatatcgcttatttatctaaagaggcaagacgtatgcttgatgaagcaggatttactgaaactaaaattatcgcgtctaatgatttggatgaagaaacgattacgagtttgaaagcacaaggtgcaaaagtagattcttggggcgttggtacaaagctgattacaggatacgatcaaccagcattaggtgcagtatataaacttgtagctattgaaaatgaagatggttcatatagtgatcgtattaaattatcaaataacgctgaaaaggttacgacgccaggtaagaaaaatgtatatcgcattataaacaagaaaacaggtaaggcagaaggcgattatattactttggaaaatgaaaatccatacgatgaacaacctttaaaattattccatccagtgcatacttataaaatgaaatttataaaatctttcgaagccattgatttgcatcataatatttatgaaaatggtaaattagtatatcaaatgccaacagaagatgaatcacgtgaatatttagcactaggattacaatctatttgggatgaaaataagcgtttcctgaatccacaagaatatccagtcgatttaagcaaggcatgttgggataataaacataaacgtatttttgaagttgcggaacacgttaaggagatggaagaagataatgag

SEQ ID NO: 1392 - protein, 504 aa, Staphylococcus aureus
  MISC_FEATURE (1)..(504): nicotinate
MIKCKKIFRSIGEIQVYQLEDDSLMLHNDLYQINMAESYWNDNIHEKMAVFDLYFRKMPFNSGYAVFNGLKRVIDFIEHFGFSESDLEYLKSIGYKDDFLSYLKDLKFTGSIRSMQEGELCFGNEPLLRVEAPLIQAQLIETILLNIVNFHTLITTKASRIRQIASNDKLMEFGTRRAQEIDAALWGARAAYIGGFDSTSNVRAGKLFGIPVSGTHAHAFVQTYGDEYVAFKKYAERHKNCVFLVDTFHTLKSGVPNAIKVAKELGDKINFVGIRLDSGDIAYLSKEARRMLDEAGFTETKIIASNDLDEETITSLKAQGAKVDSWGVGTKLITGYDQPALGAVYKLVAIENEDGSYSDRIKLSNNAEKVTTPGKKNVYRIINKKTGKAEGDYITLENENPYDEQPLKLFHPVHTYKMKFIKSFEAIDLHHNIYENGKLVYQMPTEDESREYLALGLQSIWDENKRFLNPQEYPVDLSKACWDNKHKRIFEVAEHVKEMEEDNE

SEQ ID NO: 1393 - DNA, 858 bp, Staphylococcus aureus
ttgaagttgcggaacacgttaaggagatggaagaagataatgagtaaattacaagacgttattgtacaagaaatgaaagtgaaaaagcgtatcgatagtgctgaagaaattatggaattaaagcaatttataaaaaattatgtacaatcacattcatttataaaatctttagtgttaggtatttcaggaggacaggattctacattagttggaaaactagtacaaatgtctgttaacgaattacgtgaagaaggcattgattgtacgtttattgcagttaaattaccttatggagttcaaaaagatgctgatgaagttgagcaagctttgcgattcattgaaccagatgaaatagtaacagtcaatattaagcctgcagttgatcaaagtgtgcaatcattaaaagaagccggtattgttcttacagatttccaaaaaggaaatgaaaaagcgcgtgaacgtatgaaagtacaattttcaattgcttcaaaccgacaaggtattgtagtaggaacagatcattcagctgaaaatataactgggttttatacgaagtacggtgatggtgctgcagatatcgcacctatatttggtttgaataaacgacaaggtcgtcaattattagcgtatcttggtgcgccaaaggaattatatgaaaaaacgccaactgctgatttagaagatgataaaccacagcttccagatgaagatgcattaggtgtaacttatgaggcgattgataattatttagaaggtaagccagttacgccagaagaacaaaaagtaattgaaaatcattatatacgaaatgcacacaaacgtgaacttgcatatacaagatacacgtggccaaaatcc

SEQ ID NO: 1394 - protein, 286 aa, Staphylococcus aureus
  MISC_FEATURE (1)..(286): NAD synthetase
LKLRNTLRRWKKIMSKLQDVIVQEMKVKKRIDSAEEIMELKQFIKNYVQSHSFIKSLVLGISGGQDSTLVGKLVQMSVNELREEGIDCTFIAVKLPYGVQKDADEVEQALRFIEPDEIVTVNIKPAVDQSVQSLKEAGIVLTDFQKGNEKARERMKVQFSIASNRQGIVVGTDHSAENITGFYTKYGDGAADIAPIFGLNKRQGRQLLAYLGAPKELYEKTPTADLEDDKPQLPDEDALGVTYEAIDNYLEGKPVTPEEQKVIENHYIRNAHKRELAYTRYTWPKS

SEQ ID NO: 1395 - DNA, 612 bp, Staphylococcus aureus
gtggggcgccttatgtcattcgtaacagaaaatccatggttaatggtactaactatatttatcattaacgtttgttatgtaacgtttttaacgatgcgaacaattttaacgttgaaaggttatcgttatattgctgcatcagttagttttttagaagtattagtttatatcgttggtttaggtttggttatgtctaatttagaccatattcaaaatattattgcctacgcatttggtttttcaataggtatcattgttggtatgaaaatagaagaaaaactggcattaggttatacagttgtaaatgtaacttcagcagaatatgagttagatttaccgaatgaacttcgaaatttaggatatggcgttacgcactatgctgcgtttggtagagatggtagtcgtatggtgatgcaaattttaacaccaagaaaatatgaacgtaaattgatggatacgataaaaaatttagatccgaaagcatttatcattgcgtatgaacctcgaaacatacatggtggattctggactaaaggcattcgtcgtagaaagcttaaagattatgaaccagaagaactggaaagtgtagtagaacatgaaattcaaagtaaa

SEQ ID NO: 1396 - protein, 204 aa, Staphylococcus aureus
  MISC_FEATURE (1)..(204): conserved hypothetical
VGRLMSFVTENPWLMVLTIFIINVCYVTFLTMRTILTLKGYRYIAASVSFLEVLVYIVGLGLVMSNLDHIQNIIAYAFGFSIGIIVGMKIEEKLALGYTVVNVTSAEYELDLPNELRNLGYGVTHYAAFGRDGSRMVMQILTPRKYERKLMDTIKNLDPKAFIIAYEPRNIHGGFWTKGIRRRKLKDYEPEELESVVEHEIQSK

SEQ ID NO: 1397 - DNA, 171 bp, Staphylococcus aureus
atgaaattcaaagtaaatgagaatgaaacaattgctgattgtttgtcacgaatgaaaatgcaagggtatatgccggtaaaacgtattgaaaaacccgtgtttcaagagcaaaaagatggcacggttgaagtatcacatcaagaaatcgtttttgtaggtaagaaaatccaa

SEQ ID NO: 1398 - protein, 57 aa, Staphylococcus aureus
MKFKVNENETIADCLSRMKMQGYMPVKRIEKPVFQEQKDGTVEVSHQEIVFVGKKIQ

SEQ ID NO: 1399 - DNA, 351 bp, Staphylococcus aureus
ttgtattttagaaaggtaaataatattatggaacaaattgaattatttagtattgataaattcaaatgtaattcagaggctaagtattatcttaatattattgagggagaatggcatcctcaagatttaaatgatagtcctttaaaatttattctcagtacctcagacgattctgattacatttgcaaatatataaatacagaacacaaacaactcacattatataataaaaataatagctcaattgttattgaaatatttataccaaatgataataaaatactactaacaattatgaacacagaagctttgggaacttctcctagaatgactttcattaagcataagtca

SEQ ID NO: 1400 - protein, 117 aa, Staphylococcus aureus
  MISC_FEATURE (1)..(117): hypothetical protein
LYFRKVNNIMEQIELFSIDKFKCNSEAKYYLNIIEGEWHPQDLNDSPLKFILSTSDDSDYICKYINTEHKQLTLYNKNNSSIVIEIFIPNDNKILLTIMNTEALGTSPRMTFIKHKS

SEQ ID NO: 1401 - DNA, 1164 bp, Staphylococcus aureus
atgaaaagaaactttccaaaattaatagctttaagtttaatattttctttaagtgttacccctattgcaaacgctgagagcaattcaaatatcaaagcaaaagataagaagcatgtgcaagttaatgtcgaggacaagagtgttcctactgacgtacgtaatttagcgcaaaaagactatctttcttatgttacttcacttgataaaatctataataaagagaaagcctcgtatacacttggtgaaccttttaaaatttataaattcaacaaaaagagtgatggtaattattattttccagttttgaacactgaaggtaatatcgattatatagttacaatttcaccaaaaatcactaagtattctagttcatcttctaaatacacaatcaatgtttctccatttttatctaaagtcttaaatcaatataaagatcaacaaattactattttgacaaactcaaaaggttactatgtggttactcaaaatcataaagctaaactagtactaaaaacaccacgtctagaagataaaaagttaaaaaagactgagagtatacctactggcaataatgtaacgcaactaaagcaaaaagcttctgtcactatgccaactagtcaatttaaaagtaataattatacttacaacgagcaatatataaataaacttgagaatttcaagataagagaaactcaaggtaacaatggttggtgtgcaggctatacgatgtctgaattactaaatgcgacttataatactaacaaatatcatgcagaagctgtgatgagatttttacacccaaacttacaaggacaacgattccaatttactggtttaacgccaagagagatgatttattttggacaaactcagggaagaagtccacaacttcttaatagaatgactacatataatgaagttgacaatcttactaaaaataataaaggaattgctgttttaggtagtagagtagaatcaagaaatggtatgcacgcagggcatgccatggcagttgttgggaacgctaaattagataatggacaagaggttataattatatggaatccatgggataatggttttatgactcaagatgctaaaaacaatgttattccagtatccaatggcgaccattatcgatggtattcatctatttatggttat

SEQ ID NO: 1402 - protein, 388 aa, Staphylococcus aureus
  MISC_FEATURE (1)..(388): staphopain [Staphylococcus
MKRNFPKLIALSLIFSLSVTPIANAESNSNIKAKDKKHVQVNVEDKSVPTDVRNLAQKDYLSYVTSLDKIYNKEKASYTLGEPFKIYKFNKKSDGNYYFPVLNTEGNIDYIVTISPKITKYSSSSSKYTINVSPFLSKVLNQYKDQQITILTNSKGYYVVTQNHKAKLVLKTPRLEDKKLKKTESIPTGNNVTQLKQKASVTMPTSQFKSNNYTYNEQYINKLENFKIRETQGNNGWCAGYTMSELLNATYNTNKYHAEAVMRFLHPNLQGQRFQFTGLTPREMIYFGQTQGRSPQLLNRMTTYNEVDNLTKNNKGIAVLGSRVESRNGMHAGHAMAVVGNAKLDNGQEVIIIWNPWDNGFMTQDAKNNVIPVSNGDHYRWYSSIYGY

SEQ ID NO: 1403 - DNA, 1362 bp, Staphylococcus aureus
ttgtttatttttattaaaaaatgttctgtttttgaaaattcgagtatacatacgataggagttaaaaaaatgattgaacgctattctagagaagaaatgtctaatatttggactgatcaaaatcgctatgaagcatggttagaagtggaaattttagcatgtgaagcatggagtgaattaggacatataccgaaagctgacgtacaaaaaattcgtcaaaacgcaaaggtaaatgtcgaacgtgcacaagaaattgaacaagaaacgcgccatgatgttgtagcctttactagacaagtttctgaaacgctaggtgaagaacgtaagtgggtacattatggtttaacttctactgatgttgtagatacagctttaagtttcgttattaaacaagcaaatgacattattgaaaaagatttagaaagatttatcgacgttttagctgaaaaagcaaaaaattataaatatacattgatgatgggacgtacacatggagtgcatgcagaaccaactacatttggtgtcaaaatggcattgtggtacacggaaatgcaacgtaacttacaacgtttcaaacaagtaagagaagaaattgaagtagggaaaatgagtggtgcagtaggtacttttgctaacattcctcctgaaatagaaagttatgtgtgtaaacatttaggtattggcacagcgcctgtatcaacgcaaacattgcaacgcgatcgacatgcatactatattgcgacattagcattaatcgcgacatcactagaaaaatttgccgttgaaatacgtaaccttcaaaaaaccgaaacgagagaagttgaagaagcatttgcaaaaggccaaaaaggttcatctgcaatgcctcataaacgaaatccaattggttctgaaaatatcacaggtatttcaagagtcattcgtggttatattactacagcttatgagaatgtgccattatggcatgaaagagatatttctcattcttctgctgagcgtattatgttaccagatgttacaatagcactagattatgcattgaatcgtttcacaaatattgtggaccgtttaactgtatttgaagataatatgcgtaataacatagataaaacatttggtctgattttctcacaacgtgtcttattagcattaattaataaaggtatggttcgtgaagaagcatacgacaaagtacaaccaaaagcgatgatatcttgggaaacgaaaacaccgttccgtgaattaatcgaacaagatgagtctattacaagtgttttaacaaaagaagaattggatgaatgtttcgatcctaaacatcatttgaatcaagttgacactattttcgaacgcgctggattagca

SEQ ID NO: 1404 - protein, 454 aa, Staphylococcus aureus
  MISC_FEATURE (1)..(454): adenylosuccinate lyase
LFIFIKKCSVFENSSIHTIGVKKMIERYSREEMSNIWTDQNRYEAWLEVEILACEAWSELGHIPKADVQKIRQNAKVNVERAQEIEQETRHDVVAFTRQVSETLGEERKWVHYGLTSTDVVDTALSFVIKQANDIIEKDLERFIDVLAEKAKNYKYTLMMGRTHGVHAEPTTFGVKMALWYTEMQRNLQRFKQVREEIEVGKMSGAVGTFANIPPEIESYVCKHLGIGTAPVSTQTLQRDRHAYYIATLALIATSLEKFAVEIRNLQKTETREVEEAFAKGQKGSSAMPHKRNPIGSENITGISRVIRGYITTAYENVPLWHERDISHSSAERIMLPDVTIALDYALNRFTNIVDRLTVFEDNMRNNIDKTFGLIFSQRVLLALINKGMVREEAYDKVQPKAMISWETKTPFRELIEQDESITSVLTKEELDECFDPKHHLNQVDTIFERAGLA

SEQ ID NO: 1405 - DNA, 300 bp, Staphylococcus aureus
atgcaaattgaaaaattacgaggtgcagcgttagatgaattgtttgatgcaatactaacgttagaaaatagagaagaatgttaccaatttttcgatgatttgtgtactgtaaatgaaattcaatcactgtctcaaagattacaagttgctaaaatgattaagcaaggttatacctatgcaacgattgaacaagaatctggagcatcgactgcaacgatttctagagtgaagcgttcattacaatggggtaatgatgcttatacaatgattttagatcgtatgaatattgaaacaaatgaa

SEQ ID NO: 1406 - protein, 100 aa, Staphylococcus aureus
  MISC_FEATURE (1)..(100): conserved hypothetical
MQIEKLRGAALDELFDAILTLENREECYQFFDDLCTVNEIQSLSQRLQVAKMIKQGYTYATIEQESGASTATISRVKRSLQWGNDAYTMILDRMNIETNE

SEQ ID NO: 1407 - DNA, 714 bp, Staphylococcus aureus
atgttaaaaaaggagtttcggaaaatgtatgacattaaaaaatggcgccatatttttaaattagacccagctaaacatatttcagatgatgatttagatgcgatttgtatgtctcaaacagatgcaattatgattggtggaactgatgacgttactgaagataatgtcattcatttaatgagcagagtaagaagatacccattgcctttagtacttgaaatatcaaacatcgaaagtgtaatgcctggttttgatttttattttgtacctacagtactgaacagtacagatgttgtatttcacaatggtacattattagaagcgcttaaaacatatggacatagtatagattttgaggaagtaatatttgaagggtatgtcgtgtgcaatgctgatagcaaagtggcaaaacataccaaagcaaatacagatttaacaacagaagatttagaagcatatgcccaaatggtcaatcatatgtatcgattaccggttatgtatatagagtatagtggcatttatggcgacgtatcaaaggttcaagctgtctcagaacatctaacagaaacgcaacttttttatggtggcggtatttcctcagaacaacaagcgacagagatggcagctattgcagatacaattatcgtcggtgatattatttataaagatattaaaaaagctttaaaaacagtaaaaataaaggagtctagtaaa

SEQ ID NO: 1408 - protein, 238 aa, Staphylococcus aureus
  MISC_FEATURE (1)..(238): conserved hypothetical
MLKKEFRKMYDIKKWRHIFKLDPAKHISDDDLDAICMSQTDAIMIGGTDDVTEDNVIHLMSRVRRYPLPLVLEISNIESVMPGFDFYFVPTVLNSTDVVFHNGTLLEALKTYGHSIDFEEVIFEGYVVCNADSKVAKHTKANTDLTTEDLEAYAQMVNHMYRLPVMYIEYSGIYGDVSKVQAVSEHLTETQLFYGGGISSEQQATEMAAIADTIIVGDIIYKDIKKALKTVKIKESSK

SEQ ID NO: 1409 - DNA, 2190 bp, Staphylococcus aureus
atgaatgcgttattaaatcatatgaatacagagcaaagtgaagctgtaaagacaacagaaggaccattgttaattatggcaggtgctggttcagggaagacacgtgttttaacacatagaattgcttatttattagacgaaaaagatgtctcaccatacaatgttttggctattacttttacaaataaagctgcaagagaaatgaaagaacgtgttcaaaaattagtaggtgatcaagcagaagttatttggatgtcaacattccactcaatgtgtgttcgtattttacgtcgtgatgcagatcgaattggtatagaacgcaattttacgataattgatcctacagaccaaaaatctgttattaaagacgtcttaaaaaatgaaaatattgatagtaaaaagtttgaacctcgtatgtttatcggtgcgatcagtaatttgaaaaatgaacttaaaacacctgcagatgctcaaaaagaagccacagattatcactcgcaaatggtagcaacggtttatagtggatatcaacgccaattgtcacgtaatgaagcgttagattttgatgaccttattatgacaacgattaacttatttgagcgtgtaccagaagttctagaatattatcagaacaaattccaatatattcatgtagatgagtatcaagatactaataaagcacaatacacattagttaaattattagcaagtaagtttaaaaacttatgtgttgtaggtgactcagatcagtcaatttatggttggcgtggtgctgatattcaaaatatcttatcatttgaaaaagactatccagaagcgaatacaatctttttagagcaaaattatcgttcgacgaaaacgattttaaatgcggctaacgaagtgattaaaaataattctgaacgtaagccaaaaggactgtggactgcaaatacgaatggtgagaaaattcattactatgaagcaatgacggaacgtgatgaagcggaatttgtaatacgagaaattatgaagcatcaacgtaatggtaagaaatatcaagatatggcaattttatatagaacgaatgcacaatcacgtgtacttgaggaaacattcatgaaatctaatatgccatacacaatggttggtggccaaaagttctatgaccgtaaagaaatcaaagatttattaagttatttgcgtataattgccaatagtaatgatgacattagtttgcaacgtattattaatgttccaaaaagaggtgtaggtccttcatctgttgaaaaagttcaaaactatgcacttcaaaacaatatcagtatgtttgatgcacttggagaagctgattttatcggattgtcaaaaaaggtgacacaagagtgtcttaatttttacgagttaatccaaagcttgataaaagaacaagaatttttagaaattcatgaaatagttgatgaagtattacaaaagtctggctatcgagaaatgcttgaacgtgaaaatacattagaatctcgaagtagattagaaaacatcgatgaatttatgtcagtaccaaaagactatgaggaaaataccccattagaagaacagtcattaattaactttttaacggatttatcgttagtagctgatattgatgaggcagatactgaaaatggcgtaacactaatgacgatgcactcggctaagggccttgaatttccaattgtctttataatggggatggaagaatctttattcccacatattagagcgattaagagtgaagatgatcatgaaatgcaagaagaacgtcgtatttgttatgtagcaattacaagggctgaagaggtgttatatatcactcatgcgacatcaagaatgttatttggtcgccctcagtcaaatatgccatccagatttttaaaggaaattccagaatcactattagaaaatcattcaagtggcaaacgacaaacgatacaacctaaggcaaaaccttttgctaaacgcggatttagtcaacgaacaacgtcaacgaaaaaacaagtattgtcatctgattggaatgtaggtgacaaagtgatgcataaagcctggggagaaggcatggtgagtaatgtaaacgagaaaaatggctcaatcgaactagatattatctttaaatcacaagggccaaaacgtttgttagcgcaatttgcaccaattgaaaaaaaggaggat

SEQ ID NO: 1410 - protein, 730 aa, Staphylococcus aureus
  MISC_FEATURE (1)..(730): ATP-depentend DNA helicase
MNALLNHMNTEQSEAVKTTEGPLLIMAGAGSGKTRVLTHRIAYLLDEKDVSPYNVLAITFTNKAAREMKERVQKLVGDQAEVIWMSTFHSMCVRILRRDADRIGIERNFTIIDPTDQKSVIKDVLKNENIDSKKFEPRMFIGAISNLKNELKTPADAQKEATDYHSQMVATVYSGYQRQLSRNEALDFDDLIMTTINLFERVPEVLEYYQNKFQYIHVDEYQDTNKAQYTLVKLLASKFKNLCVVGDSDQSIYGWRGADIQNILSFEKDYPEANTIFLEQNYRSTKTILNAANEVIKNNSERKPKGLWTANTNGEKIHYYEAMTERDEAEFVIREIMKHQRNGKKYQDMAILYRTNAQSRVLEETFMKSNMPYTMVGGQKFYDRKEIKDLLSYLRIIANSNDDISLQRIINVPKRGVGPSSVEKVQNYALQNNISMFDALGEADFIGLSKKVTQECLNFYELIQSLIKEQEFLEIHEIVDEVLQKSGYREMLERENTLESRSRLENIDEFMSVPKDYEENTPLEEQSLINFLTDLSLVADIDEADTENGVTLMTMHSAKGLEFPIVFIMGMEESLFPHIRAIKSEDDHEMQEERRICYVAITRAEEVLYITHATSRMLFGRPQSNMPSRFLKEIPESLLENHSSGKRQTIQPKAKPFAKRGFSQRTTSTKKQVLSSDWNVGDKVMHKAWGEGMVSNVNEKNGSIELDIIFKSQGPKRLLAQFAPIEKKED

SEQ ID NO: 1411 - DNA, 912 bp, Staphylococcus aureus
atgtcgaatgttttggagttaacaattcctgcatcaacagccaaccttggagttggctttgattctataggtatggctttagataaatttttgcatctgtctgtaaaggaaacatcagggacaaaatgggaatatattttccatgatgatgcatctaagcaattgcctactgacgaaacaaactttatttatcatgtagcacaacaagttgcttctaaatatagtgttgacttgcctaatttatgtatcgaaatgagaagtgatattccattggcaagagggttaggttcgtcagcttctgctttagtaggagctatatatatcgcaaattattttggtgatatccaactgtctaaacatgaggtattacaattagcgactgaaatcgaaggacatcctgataatgttgcgccgaccatttatggtggtttaatcgctggatattataatgatgtctcgaaagaaacgtcagttgcacatatcgacataccagacgtggatgtgattgtaacgataccaacttatgaactaaaaacagaagcatcaagacgtgctttaccacaaaaattaacacatagtgaagcggttaaaagtagtgcaattagtaatacaatgatttgtgcattagcacagcacaattatgaattagcaggtaaactcatgcaacaagatggctttcatgaaccgtatcgtcagcatttaattgctgaatttgatgaagtgaaaacaattgctagtcaacataatgcctatgcaactgtaattagtggtgctggaccaactattttaatatttagtcgtaaagaaaatagtggggaattggttcgctctttaaatagtcaggtagtatcatgccattctgaattggtcgatattaatatcagtggtgttaaagaacgaattgtataccaa

SEQ ID NO: 1412 - protein, 304 aa, Staphylococcus aureus
  MISC_FEATURE (1)..(304): homoserine kinase homolog
MSNVLELTIPASTANLGVGFDSIGMALDKFLHLSVKETSGTKWEYIFHDDASKQLPTDETNFIYHVAQQVASKYSVDLPNLCIEMRSDIPLARGLGSSASALVGAIYIANYFGDIQLSKHEVLQLATEIEGHPDNVAPTIYGGLIAGYYNDVSKETSVAHIDIPDVDVIVTIPTYELKTEASRRALPQKLTHSEAVKSSAISNTMICALAQHNYELAGKLMQQDGFHEPYRQHLIAEFDEVKTIASQHNAYATVISGAGPTILIFSRKENSGELVRSLNSQVVSCHSELVDINISGVKERIVYQ

SEQ ID NO: 1413 - DNA, 2001 bp, Staphylococcus aureus
atggctgatttatcgtctcgtgtgaacgagttacatgatttattaaatcaatacagttatgaatactatgtagaggataatccatctgtaccagatagtgaatatgacaaattacttcatgaactgattaaaatagaagaggagcatcctgagtataagactgtagattctccaacagttagagttggcggtgaagcccaagcctctttcaataaagtcaaccatgacacgccaatgttaagtttagggaatgcatttaatgaggatgatttgagaaaattcgaccaacgcatacgtgaacaaattggcaacgttgaatatatgtgcgaattaaaaattgatggcttagcagtatcattgaaatatgttgatggatacttcgttcaaggtttaacacgtggtgatggaacaacaggtgaagatattaccgaaaatttaaaaacaattcatgcgatacctttgaaaatgaaagaaccattaaatgtagaagttcgtggtgaagcatatatgccgagacgttcattttttcgattaaatgaagaaaaagaaaaaaatgatgagcagttatttgcaaatccaagaaacgctgctgcgggatcattaagacagttagattctaaattaacggcaaaacgaaagctaagcgtatttatatatagtgtcaatgatttcactgatttcaatgcgcgttcgcaaagtgaagcattagatgagttagataaattaggttttacaacgaataaaaatagagcgcgtgtaaataatatcgatggtgttttagagtatattgaaaaatggacaagccaaagagagtcattaccttatgatattgatgggattgttattaaggttaatgatttagatcaacaggatgagatgggattcacacaaaaatctcctagatgggccattgcttataaatttccagctgaggaagtagtaactaaattattagatattgaattaagtattggacgaacaggtgtagtcacacctactgctattttagaaccagtaaaagtagctggtacaactgtatcaagagcatctttgcacaatgaggatttaattcatgacagagatattcgaattggtgatagtgttgtagtgaaaaaagcaggtgacatcatacctgaagttgtacgtagtattccagaacgtagacctgaggatgctgtcacatatcatatgccaacccattgtccaagttgtggacatgaattagtacgtattgaaggcgaagtagcacttcgttgcattaatccaaaatgccaagcacaacttgttgaaggattgattcactttgtatcaagacaagccatgaatattgatggtttaggcactaaaattattcaacagctttatcaaagcgaattaattaaagatgttgctgatattttctatttaacagaagaagatttattacctttagacagaatggggcagaaaaaagttgataatttattagctgccattcaacaagctaaggacaactctttagaaaatttattatttggtctaggtattaggcatttaggtgttaaagcgagccaagtgttagcagaaaaatatgaaacgatagatcgattactaacggtaactgaagcggaattagtagaaattcatgatataggtgataaagtagcacaatctgtagttacttatttagaaaatgaagatattcgtgctttaattcaaaaattaaaagataaacatgttaatatgatttataaaggtatcaaaacatcagatattgaaggacatcctgaatttagtggtaaaacgatagtactgactggtaagctacatcaaatgacacgcaatgaagcatctaaatggcttgcatcacaaggtgctaaagttacaagtagcgttactaaaaatacagatgtcgttattgctggtgaagatgcaggttcaaaattaacaaaagcacaaagtttaggtattgaaatttggacagagcaacaatttgtagataagcaaaatgaattaaatagt

SEQ ID NO: 1414 - protein, 667 aa, Staphylococcus aureus
  MISC_FEATURE (1)..(667): DNA ligase [Staphylococcus
MADLSSRVNELHDLLNQYSYEYYVEDNPSVPDSEYDKLLHELIKIEEEHPEYKTVDSPTVRVGGEAQASFNKVNHDTPMLSLGNAFNEDDLRKFDQRIREQIGNVEYMCELKIDGLAVSLKYVDGYFVQGLTRGDGTTGEDITENLKTIHAIPLKMKEPLNVEVRGEAYMPRRSFFRLNEEKEKNDEQLFANPRNAAAGSLRQLDSKLTAKRKLSVFIYSVNDFTDFNARSQSEALDELDKLGFTTNKNRARVNNIDGVLEYIEKWTSQRESLPYDIDGIVIKVNDLDQQDEMGFTQKSPRWAIAYKFPAEEVVTKLLDIELSIGRTGVVTPTAILEPVKVAGTTVSRASLHNEDLIHDRDIRIGDSVVVKKAGDIIPEVVRSIPERRPEDAVTYHMPTHCPSCGHELVRIEGEVALRCINPKCQAQLVEGLIHFVSRQAMNIDGLGTKIIQQLYQSELIKDVADIFYLTEEDLLPLDRMGQKKVDNLLAAIQQAKDNSLENLLFGLGIRHLGVKASQVLAEKYETIDRLLTVTEAELVEIHDIGDKVAQSVVTYLENEDIRALIQKLKDKHVNMIYKGIKTSDIEGHPEFSGKTIVLTGKLHQMTRNEASKWLASQGAKVTSSVTKNTDVVIAGEDAGSKLTKAQSLGIEIWTEQQFVDKQNELNS

SEQ ID NO: 1415 - DNA, 1203 bp, Staphylococcus aureus
atgtcgatgaagcgtacattagtattattgattacagctatctttatactcgctgcttgtggtaaccataaggatgaccaggctggaaaagataatcaaaaacataacaatagttcaaatcaagtaaaagaaattgcaacggataaaaatgtacaaggtgataactatcgtacattgttaccatttaaagaaagccaggcaagaggacttttacaagataacatggcaaatagttataatggcggcgactttgaagatggtttattgaacttaagtaaagaagtatttccaacagataaatatttgtatcaagatggtcaatttttggacaagaaaacaattaatgcctatttaaatcctaagtatacaaaacgtgaaatcgataaaatgtctgaaaaagataaaaaagacaagaaagcgaatgaaaatttaggacttaatccatcacacgaaggtgaaacagatcctgaaaagattgcagaaaaatcaccagcctatttatctaacattttagagcaagatttttatggtggtggagatacaaaaggtaagaatattaaaggtatgacgattggtttagctatgaatagtgtttattactataaaaaagaaaaagatggatcgacttttagtaaaaaactagatgatagcgaagttaaaaagcaaggtaaacaaatggctagtgagatattatcaaggttacgtgaaaatgatgatttaaaagatataccaattcattttgcaatttataagcaatcaagtgaagattcaatcacaccaggtgaatttatcactcaagcgactgcagaaaagagtcaaacaaagcttaatgaatggcataatatcaatgaaaaatcagctttattaccttcttcaacagcagcagattatgatgaaaatttaaataataatttcaagcaatttaatgataatttgcaatcatatttttctaatttcacacaagcagtagggaaagttaaatttgttgataaaaagccacaacgattagtagtagatttaccaatcgattactatggacaagctgaaacaattggtattacacagtacgttactgaacaagcgaataaatatttcgataaaatcgataactatgaaattcgtattaaagatggtaaccaaccacgtgctttaattagtaagacaaaagatgacaaagaaccgcaagttcatatttacagtaat

SEQ ID NO: 1416 - protein, 401 aa, Staphylococcus aureus
  MISC_FEATURE (1)..(401): conserved hypothetical
MSMKRTLVLLITAIFILAACGNHKDDQAGKDNQKHNNSSNQVKEIATDKNVQGDNYRTLLPFKESQARGLLQDNMANSYNGGDFEDGLLNLSKEVFPTDKYLYQDGQFLDKKTINAYLNPKYTKREIDKMSEKDKKDKKANENLGLNPSHEGETDPEKIAEKSPAYLSNILEQDFYGGGDTKGKNIKGMTIGLAMNSVYYYKKEKDGSTFSKKLDDSEVKKQGKQMASEILSRLRENDDLKDIPIHFAIYKQSSEDSITPGEFITQATAEKSQTKLNEWHNINEKSALLPSSTAADYDENLNNNFKQFNDNLQSYFSNFTQAVGKVKFVDKKPQRLVVDLPIDYYGQAETIGITQYVTEQANKYFDKIDNYEIRIKDGNQPRALISKTKDDKEPQVHIYSN

SEQ ID NO: 1417 - DNA, 1545 bp, Staphylococcus aureus
gtgtttatcatgcttacaatggggacagcattaagtcaacaagtagatgccaattggcaaacttatattatgattgccgtctacttcttgatactaatcgttattggcttttacggttacaagcaagcaactggtaacctaagcgagtacatgttaggtggacgtagtattggaccgtatattactgcattatcagctggagcttcagatatgagtggatggatgattatggggctacctggttctgtctatagcactggtctatcagctatgtggattacaatcggtttaacattaggtgcttatataaattactttgttgttgctcctagacttcgtgtttataccgaattagctggagatgcaattacattaccagatttctttaaaaatcgtttaaacgataaaaataatgtgttaaagattatttctggattgattatcgtagtattctttacattatatacacattctggtttcgtatctggtggtaaactatttgaaagtgcttttggattagattatcatttcggtttaatattagttgctttcattgtcattttctatactttctttggtggatatttagctgtatcaattacagatttcttccaaggtgtcattatgttaattgcgatggttatggtccctattgttgctatgatgaatttaaacggctggggaacgtttcatgatgtagcagctatgaaacctacaaatttaaatttatttaaagggttatcatttataggaattatctctctattttcatggggattaggttatttcggtcaacctcatatcattgtaaggtttatgtctattaaatcacacaagatgctacctaaagctagacgtttaggtattagctggatggctgttggtttattaggcgctgtggctgttggtttaacaggtattgcattcgtacctgcttatcatattaaactagaagatcctgagacattattcatcgtgatgagtcaagtactcttccatcctcttgtaggtggtttcttacttgctgcgattctagctgcaattatgagcacgatttcttcacaattacttgtaacatctagttcactaacggaagacttttataaattaattcgtggtgaagaaaaagctaaaacgcaccaaaaagaatttgttatgattggaagattatctgtattagttgtagcaattgttgccatcgcgattgcatggaatccaaacgacacaattctaaacttagtaggtaacgcttgggccggatttggtgcatcgttcagtccacttgtgctatttgcactttactggaaaggtttgacacgtgccggtgctgtaagtggaatggtttcaggtgccttagtcgttatcgtttggattgcatggattaaaccattggcacatatcaacgaaatattcggcttatatgaaattattcctggatttattgtaagtgtaatcgttacatatgttgtaagtaaacttactaaaaaacctggtgcatttgttgaaactgacttaaacaaagttcgtgacatcgttagagaaaaa

SEQ ID NO: 1418 - protein, 515 aa, Staphylococcus aureus
  MISC_FEATURE (1)..(515): high affinity proline
VFIMLTMGTALSQQVDANWQTYIMIAVYFLILIVIGFYGYKQATGNLSEYMLGGRSIGPYITALSAGASDMSGWMIMGLPGSVYSTGLSAMWITIGLTLGAYINYFVVAPRLRVYTELAGDAITLPDFFKNRLNDKNNVLKIISGLIIVVFFTLYTHSGFVSGGKLFESAFGLDYHFGLILVAFIVIFYTFFGGYLAVSITDFFQGVIMLIAMVMVPIVAMMNLNGWGTFHDVAAMKPTNLNLFKGLSFIGIISLFSWGLGYFGQPHIIVRFMSIKSHKMLPKARRLGISWMAVGLLGAVAVGLTGIAFVPAYHIKLEDPETLFIVMSQVLFHPLVGGFLLAAILAAIMSTISSQLLVTSSSLTEDFYKLIRGEEKAKTHQKEFVMIGRLSVLVVAIVAIAIAWNPNDTILNLVGNAWAGFGASFSPLVLFALYWKGLTRAGAVSGMVSGALVVIVWIAWIKPLAHINEIFGLYEIIPGFIVSVIVTYVVSKLTKKPGAFVETDLNKVRDIVREK

SEQ ID NO: 1419 - DNA, 300 bp, Staphylococcus aureus
atgacaaaagtaacacgtgaagaagttgagcatatcgcgaatcttgcaagacttcaaatttctcctgaagaaacggaagaaatggccaacacattagaaagcattttagattttgcaaaacaaaatgatagcgctgatacagaaggcgttgaacctacatatcacgttttagatttacaaaacgttttacgtgaagataaagcaattaaaggtattccacaagaattagctttgaaaaatgccaaagaaacagaagatggacaatttaaagtgcctacaatcatgaatgaggaggacgcg

SEQ ID NO: 1420 - protein, 100 aa, Staphylococcus aureus
  MISC_FEATURE (1)..(100): glutamyl-tRNAGln
MTKVTREEVEHIANLARLQISPEETEEMANTLESILDFAKQNDSADTEGVEPTYHVLDLQNVLREDKAIKGIPQELALKNAKETEDGQFKVPTIMNEEDA

SEQ ID NO: 1421 - DNA, 1473 bp, Staphylococcus aureus
atgaggaggacgcgtaagatgagcattcgctacgaatcggttgagaatttattaactttaataaaagacaaaaaaatcaaaccatctgatgttgttaaagatatatatgatgcaattgaagagactgatccaacaattaagtcttttctagcgctggataaagaaaatgcaatcaaaaaagcgcaagaattggatgaattacaagcaaaagatcaaatggatggcaaattatttggtattccaatgggtataaaagataacattattacaaacggattagaaacaacatgtgcaagtaaaatgttagaaggttttgtgccaatttacgaatctactgtaatggaaaaactacataatgaaaatgccgttttaatcggtaaattaaatatggatgagtttgcaatgggtggttcaacagaaacatcttatttcaaaaaaacagttaacccatttgaccataaagcagtgccaggtggttcatcaggtggatctgcagcagcagttgcagctggcttagtaccatttagcttaggttcagacacaggtggttcaattagacaaccggctgcatattgtggcgttgtcggtatgaaaccaacatacggtcgtgtatctcgatttggattagttgcttttgcatcttcattagaccaaattggtccattgactcgaaatgtaaaagataatgcaatcgtattagaagctatttctggtgcagatgttaatgactctacaagtgcaccagttgatgatgtagactttacatctgaaattggtaaagatattaaaggattaaaagttgcattacctaaagaatacttaggtgaaggtgtagctgatgacgtaaaagaagcagttcaaaacgctgtagaaactttaaaatctttaggtgctgtcgttgaggaagtatcattgccaaatactaaatttggtattccatcatattacgtgattgcatcatcagaagcttcgtcaaacctttctcgttttgacggaattcgttatggttatcattctaaagaagctcattcattagaagaattatataaaatgtcaagatctgaaggtttcggtaaagaagtaaaacgtcgtattttcttaggtacatttgcattaagttcaggttactatgatgcttactataaaaaatctcaaaaagttagaacattgattaaaaatgactttgataaagtattcgaaaattatgatgtagtagttggtccaacagcgcctacaactgcgtttaatttaggtgaagaaattgatgatccattaacaatgtatgccaatgatttattaacaacaccagtaaacttagctggattacctggtatttctgttccttgtggacaatcaaatggccgaccaatcggtttacagttcattggtaaaccattcgatgaaaaaacgttatatcgtgtcgcttatcaatatgaaacacaatacaatttacatgacgtttatgaaaaatta

SEQ ID NO: 1422 - protein, 491 aa, Staphylococcus aureus
  MISC_FEATURE (1)..(491): glutamyl-tRNAGln
MRRTRKMSIRYESVENLLTLIKDKKIKPSDVVKDIYDAIEETDPTIKSFLALDKENAIKKAQELDELQAKDQMDGKLFGIPMGIKDNIITNGLETTCASKMLEGFVPIYESTVMEKLHNENAVLIGKLNMDEFAMGGSTETSYFKKTVNPFDHKAVPGGSSGGSAAAVAAGLVPFSLGSDTGGSIRQPAAYCGVVGMKPTYGRVSRFGLVAFASSLDQIGPLTRNVKDNAIVLEAISGADVNDSTSAPVDDVDFTSEIGKDIKGLKVALPKEYLGEGVADDVKEAVQNAVETLKSLGAVVEEVSLPNTKFGIPSYYVIASSEASSNLSRFDGIRYGYHSKEAHSLEELYKMSRSEGFGKEVKRRIFLGTFALSSGYYDAYYKKSQKVRTLIKNDFDKVFENYDVVVGPTAPTTAFNLGEEIDDPLTMYANDLLTTPVNLAGLPGISVPCGQSNGRPIGLQFIGKPFDEKTLYRVAYQYETQYNLHDVYEKL

SEQ ID NO: 1423 - DNA, 1434 bp, Staphylococcus aureus
gtggaaatcatgcattttgaaacagttataggacttgaagttcacgtagagttaaaaacggactcaaaaatgttttctccatcaccagcgcattttggagcagaacctaactcaaatacaaatgttatcgacttagcatatccaggtgtcttaccagttgttaataagcgtgcagtagactgggcaatgcgtgctgcaatggcactaaatatggaaatcgcaacagaatctaagtttgaccgtaagaactatttctatccagataatccaaaagcatatcaaatttctcaatttgatcaaccaattggtgaaaatggatatatcgatatcgaagtcgacggtgaaacaaaacgaatcggtattactcgtcttcacatggaagaagatgctggtaagtcaacacataaaggtgagtattcattagttgacttgaaccgtcaaggtacaccgctaattgaaatcgtatctgaaccagatattcgttcacctaaagaagcatatgcatatttagaaaaattgcgttcaattattcaatacactggtgtatcagacgttaagatggaagagggatctttacgttgtgatgctaacatctctttacgtccatatggtcaagaaaaatttggtactaaagccgaattgaaaaacttaaactcatttaactatgtacgtaaaggtttagaatatgaagaaaaacgccaagaagaagaattgttaaatggtggagaaatcggacaagaaacacgtcgatttgatgaatctacaggtaaaacaattttaatgcgtgttaaagaaggttctgatgattaccgttacttcccagagcctgacattgtacctttatatattgatgatgcttggaaagagcgtgttcgtcagacaattcctgaattaccagatgaacgtaaagctaagtatgtaaatgaattaggtttacctgcatacgatgcacacgtattaacattgactaaagaaatgtcagatttctttgaatcaacaattgaacacggtgcagatgttaaattaacatctaactggttaatgggtggcgtaaacgaatatttaaataaaaatcaagtagaattattagatactaaattaacaccagaaaatttagcaggtatgattaaacttatcgaagacggaacaatgagcagtaaaattgcgaagaaagtcttcccagagttagcagctaaaggtggtaatgctaaacagattatggaagataatggcttagttcaaatttctgatgaagcaacacttctaaaatttgtaaatgaagcattagacaataacgaacaatcagttgaagattacaaaaatggtaaaggcaaagctatgggcttcttagttggtcaaattatgaaagcgtctaaaggtcaagctaatccacaattagtaaatcaactattaaaacaagaattagataaaaga

SEQ ID NO: 1424 - protein, 478 aa, Staphylococcus aureus
  MISC_FEATURE (1)..(478): glutamyl-tRNAGln
VEIMHFETVIGLEVHVELKTDSKMFSPSPAHFGAEPNSNTNVIDLAYPGVLPVVNKRAVDWAMRAAMALNMEIATESKFDRKNYFYPDNPKAYQISQFDQPIGENGYIDIEVDGETKRIGITRLHMEEDAGKSTHKGEYSLVDLNRQGTPLIEIVSEPDIRSPKEAYAYLEKLRSIIQYTGVSDVKMEEGSLRCDANISLRPYGQEKFGTKAELKNLNSFNYVRKGLEYEEKRQEEELLNGGEIGQETRRFDESTGKTILMRVKEGSDDYRYFPEPDIVPLYIDDAWKERVRQTIPELPDERKAKYVNELGLPAYDAHVLTLTKEMSDFFESTIEHGADVKLTSNWLMGGVNEYLNKNQVELLDTKLTPENLAGMIKLIEDGTMSSKIAKKVFPELAAKGGNAKQIMEDNGLVQISDEATLLKFVNEALDNNEQSVEDYKNGKGKAMGFLVGQIMKASKGQANPQLVNQLLKQELDKR

SEQ ID NO: 1425 - DNA, 144 bp, Staphylococcus aureus
ttgattgctgacttagatgcaatcgagggtttatttatatctatagaagtcaaattacttttaactttattcattgtacatgttaatggtaaaaatattaattttattaatgcgttagctttaattatattaaggcaaactgta

SEQ ID NO: 1426 - protein, 48 aa, Staphylococcus aureus
LIADLDAIEGLFISIEVKLLLTLFIVHVNGKNINFINALALIILRQTV

SEQ ID NO: 1427 - DNA, 945 bp, Staphylococcus aureus
atgaggaaacgtgctagaatcatttataacccgacatcaggtaaagagctatttaaaagagaattacctgatgccttaataaaattagaaaaagcgggatatgaaacgagtgcatatgcaaccgagaaaataggtgatgccacacttgaagcagaaagagctatgcatgaaaattatgatgtattaatcgctgcaggtggtgatggaacattaaatgaagtagttaatggtatcgcagaaaagcctaatcgtcctaagctaggtgtcattcctatgggtactgttaatgactttggacgtgcattgcatatacctaatgacatcatgggggcacttgatgtcatcattgaaggtcattctactaaagtagatattggtaaaatgaataatcgatactttattaatttagctgcaggcggacaattgacgcaagtctcttatgaaacaccgagtaaattgaaatctattgttggtccatttgcttattacatcaaaggtttcgaaatgttacctcaaatgaaagctgtagatttaagaattgaatatgatggtaatgttttccaaggagaagcattattattctttttaggtttaacaaattcaatggcaggatttgaaaaattagtgccggacgctaagttagatgacggctattttacgttaattatagttgaaaaatcaaaccttgcagaacttggtcatattatgactttagcttcaagaggagaacatactaagcatcctaaagttatttatgaaaaagcaaaggcaattaatatttcatcattcacagacttacaactaaatgtagatggagaatatggtggtaaattaccagcgaatttcttaaatctagaacgtcatatagatgtctttgcacctaatgatattgtaaatgaagagttaataaataatgatcatgttgatgacaatttaatcgaagaa

SEQ ID NO: 1428 - protein, 315 aa, Staphylococcus aureus
  MISC_FEATURE (1)..(315): conserved hypothetical
MRKRARIIYNPTSGKELFKRELPDALIKLEKAGYETSAYATEKIGDATLEAERAMHENYDVLIAAGGDGTLNEVVNGIAEKPNRPKLGVIPMGTVNDFGRALHIPNDIMGALDVIIEGHSTKVDIGKMNNRYFINLAAGGQLTQVSYETPSKLKSIVGPFAYYIKGFEMLPQMKAVDLRIEYDGNVFQGEALLFFLGLTNSMAGFEKLVPDAKLDDGYFTLIIVEKSNLAELGHIMTLASRGEHTKHPKVIYEKAKAINISSFTDLQLNVDGEYGGKLPANFLNLERHIDVFAPNDIVNEELINNDHVDDNLIEE

SEQ ID NO: 1429 - DNA, 1359 bp, Staphylococcus aureus
ttgcaagcaatagctaaaaatgacataaaaacgggaacagttgttgatttaacgcatgaaggccatggtgtcgtaaaaatagatcgctttcctattttcataccacaagctttaattaatgaacaaattgaatataaaattatcaaagtaaaaaagaactttgcgataggtaagttgcttaatataaatacgagaagtgagaatcgtgttgcaccgccatgtatatattatgaacgttgtggtgggtgccaacttcaacacttatcatacgaagcacaacttgaaatgaaaaaggaacaagtgattaatttgtttcagcgaaaagcgcattttgataattctaagattaacgatacagttggcatgacagatccttggagatatcgaaacaagtcccagattccagttggtaagaatgaacagaatgaagttattatgggcttttatcgtcaaagaagccatgacattattgacatggaaagttgtttaatacaagattcacaacatcaagaagtgatgaatgaagttaaatctattttaaaagatttaaatgtaagtatttatcaagaacaattgaaaaaaggtttaatgagacatttggttgtaagaacaggatatcatacagacgaaatgatgattatttttgtaactaatggtaaaaagtggccacaaaaaaatgctgttgttgagaagatattagatgcatttcctaatgtgacaagcattaaacaaaacattaatgatagccactctaatgttattatgggacgtcaatctataacgctatatggtaaagatacaattattgatcaattaacagatagtacatttaaaataagtgatcagtcattctaccaaattaattctgaacaaacagagaaattatataataaagcaattgagtatgcgcaattgacaggtaatgaagttgtattagatacctattgtggtattggaacaatagggctatatatggcaccacttgcaaaacatgtatacggtgttgaagtagtaccttctgcaattgaagacgcacaacaaaatgcgactataaaccaatgcaataatacaacttttgtctgtgggaaagctgaagaagttattttacaatggaaagcacaagggattaaaccagatgttgtaatggttgatccgccaagaaagggctgtgacgaaacgtttattcagactttgcttacattagaacctaagcgtattgtctatatttcatgtaatcccgcaacacagcaacgtgatgcattattattagctgaaaaatatcaacttgaagaggtaacaccggtagatatgtttccacaaacaacacatgttgagacagtggcattattcaatttgaaa

SEQ ID NO: 1430 - protein, 453 aa, Staphylococcus aureus
  MISC_FEATURE (1)..(453): RNA methyltransferase
LQAIAKNDIKTGTVVDLTHEGHGVVKIDRFPIFIPQALINEQIEYKIIKVKKNFAIGKLLNINTRSENRVAPPCIYYERCGGCQLQHLSYEAQLEMKKEQVINLFQRKAHFDNSKINDTVGMTDPWRYRNKSQIPVGKNEQNEVIMGFYRQRSHDIIDMESCLIQDSQHQEVMNEVKSILKDLNVSIYQEQLKKGLMRHLVVRTGYHTDEMMIIFVTNGKKWPQKNAVVEKILDAFPNVTSIKQNINDSHSNVIMGRQSITLYGKDTIIDQLTDSTFKISDQSFYQINSEQTEKLYNKAIEYAQLTGNEVVLDTYCGIGTIGLYMAPLAKHVYGVEVVPSAIEDAQQNATINQCNNTTFVCGKAEEVILQWKAQGIKPDVVMVDPPRKGCDETFIQTLLTLEPKRIVYISCNPATQQRDALLLAEKYQLEEVTPVDMFPQTTHVETVALFNLK

SEQ ID NO: 1431 - DNA, 1059 bp, Staphylococcus aureus
atgagaagatggcaaggattagtagaagagtttaaagcacatttaccagtaaatgaaaatacaccaaaattaacattgaacgagggaaatacaccactcattcattgtgaaaatatgtctaaaatactaggcatagatttatatgtgaagtatgaaggtgccaatccgacaggttcatttaaagatcgcggtatggtaatggctgtgacaaaagcaaaagagcaaggtaagaaaattgtaatatgcgcttcgactggaaatacatcagcgtctgcagcagcatatgcagcgagagcaggtttaaaagctatcgtcgtaataccagaaggtaaaattgcattaggtaaattgtcgcaagcagtaatgtatggtgcagaaatcgtttctattgaaggaaactttgatgaagctttagaaattgtaaaagaaattgcaaaaagtggcgaaatcgagcttgtaaactctgtcaatccatttagaatcgaaggacaaaagacaggctcatttgaaattgtacaacaattagacggtgaagcacctgatattttagcgattcctgtaggtaatgcaggtaatattactgcatattggaaaggctttaaagaatatcatgaagctaaaggatcacaattgccgaaaatgtttggcttccaagctgaaggcgcatcaccaattgttcaaaataaagtcattaaaaatcctgaaacgattgcaactgctattcgaattggtaatcctgctagttgggataaggcgactaatgctcttaaagaatcaaatggattaatagatagtgttactgatgatgaaattctagaagcatatcagttaatgacaactaaagaaggtgtctttagtgaaccagcgagtaatgcttctattgcaggtttaattaaattgcatagacaaggtaaattacctcaaggtaaaaaagtagttgctattttaactggtaatggattaaaagatcctgatactgctatttcactactagataatccgataaagccattgccaaatgataaagatagcattatcgattatattaaaggagcttta

SEQ ID NO: 1432 - protein, 353 aa, Staphylococcus aureus
  MISC_FEATURE (1)..(353): threonine synthase
MRRWQGLVEEFKAHLPVNENTPKLTLNEGNTPLIHCENMSKILGIDLYVKYEGANPTGSFKDRGMVMAVTKAKEQGKKIVICASTGNTSASAAAYAARAGLKAIVVIPEGKIALGKLSQAVMYGAEIVSIEGNFDEALEIVKEIAKSGEIELVNSVNPFRIEGQKTGSFEIVQQLDGEAPDILAIPVGNAGNITAYWKGFKEYHEAKGSQLPKMFGFQAEGASPIVQNKVIKNPETIATAIRIGNPASWDKATNALKESNGLIDSVTDDEILEAYQLMTTKEGVFSEPASNASIAGLIKLHRQGKLPQGKKVVAILTGNGLKDPDTAISLLDNPIKPLPNDKDSIIDYIKGAL

SEQ ID NO: 1433 - DNA, 534 bp, Staphylococcus aureus
ttggtaatgcataaaattgatttaacgacaaataattttcaaatgcgaaggtttattatcttgcaacttgttattgcgttattcgtgattttatttacgtataagtgggcgttaggtgtcacagcggttgtcgatcaaaatatcatcatcaatcttgtatatgggtttgctggattcattattttattgattttacatgaacttatccatagagcattatttcttttatttaaaaaagatagcaaacctatgtttaatataaaaaaagacagaatcttattccaaacagcagatgcttgcttcaacaaatggcaattctcaattattatgctgtcaccactaatcctattaagtactggcttgcttattttaattaaggtatttggttattcatcacttatttttatgtttagtatgcataccgcttattgctttatagatattctgcttgttgcattaacaatatctagtagttttaaatatgttcaacaagatgaagatagtatttatttgtatcatcaaaagccgactcaa

SEQ ID NO: 1434 - protein, 178 aa, Staphylococcus aureus
  MISC_FEATURE (1)..(178): conserved hypothetical
LVMHKIDLTTNNFQMRRFIILQLVIALFVILFTYKWALGVTAVVDQNIIINLVYGFAGFIILLILHELIHRALFLLFKKDSKPMFNIKKDRILFQTADACFNKWQFSIIMLSPLILLSTGLLILIKVFGYSSLIFMFSMHTAYCFIDILLVALTISSSFKYVQQDEDSIYLYHQKPTQ

SEQ ID NO: 1435 - DNA, 1068 bp, Staphylococcus aureus
ttgactgagagacgaattattcatatagatatggactatttttttgcacaagtcgaaatgagagataaccccaaattgaaagggaaaccagtcattgttggtggtaaagcaagcagtaggggtgttgtctctacggcatcctatgaagcacgaaaatacggcgtccattcagcaatgcctatgtcacaagcgcataaattatgtccaaatggatactttgtcacaagtaattttggtgcttaccgagaaacatctgcgcagattatgtctattttccgaagttatacagataaggtagaaccgatgtcattggatgaagcgtatttagatattacagaattagtgagaccagaccttcctgcttcgaaaattgctcagtatattagaaaagatattctagagcagacacatttaacagcatctgcaggtgtttcttataacaaatttttagctaaattagcgagtggtatgaataaacctgatggtatgactgtgattgattatcaaaatgtccatgatattttgatgacattggatattggagattttccaggcgtaggtaaagcttccaaaaaagtaatgcatgataatggtatttttaacggtagagatttatatgagaaaacggaatttgaattaatacgtttgtttggaaaaagaggtcggggtttatataacaaggcacgcggtattgaccatagtgaagtgaaatcatcaagagtaagaaaatcagtagggactgaacgcacatttgcaacagacgtgaatgatgatgaagagattttaagaaaagtatgggaattgtcaggtaaaacagctgaacgtctaaataaattacagaagtcagctaaaactgtaacggttaaaattaaaacttatcaatttgaaacgctatctaaacagatgagtttaagagattcggttagttctgaagaagatatttataatattgcatatttactttataacgatttaaaagaccctgatgtaccaattcgacttattggtgtcactgtaggtaatttagaacaatcaacttataaaaatatgacgatatatgactttata

SEQ ID NO: 1436 - protein, 356 aa, Staphylococcus aureus
  MISC_FEATURE (1)..(356): hypothetical protein
LTERRIIHIDMDYFFAQVEMRDNPKLKGKPVIVGGKASSRGVVSTASYEARKYGVHSAMPMSQAHKLCPNGYFVTSNFGAYRETSAQIMSIFRSYTDKVEPMSLDEAYLDITELVRPDLPASKIAQYIRKDILEQTHLTASAGVSYNKFLAKLASGMNKPDGMTVIDYQNVHDILMTLDIGDFPGVGKASKKVMHDNGIFNGRDLYEKTEFELIRLFGKRGRGLYNKARGIDHSEVKSSRVRKSVGTERTFATDVNDDEEILRKVWELSGKTAERLNKLQKSAKTVTVKIKTYQFETLSKQMSLRDSVSSEEDIYNIAYLLYNDLKDPDVPIRLIGVTVGNLEQSTYKNMTIYDFI

SEQ ID NO: 1437 - DNA, 552 bp, Staphylococcus aureus
atgatacaagatgcgtttgttgcacttgattttgaaacagcaaatggtaaacgtacaagtatttgttctgtcggaatggttaaagtcattgatagtcaaataacagaaacatttcatactcttgtgaatccgcaagactatttttcacaacaaaatattaaaattcatggcatacaaccagaagatgttgaaaatgcacctacgtttgactacgtatttccatatatgatgcaatttattgcagatttacctgttgtcgcacataacgcggcatttgatatgaacgtcttacatcaaagcattcaaaatattggtttaccaactccaaatttaacttacttttgtagttatcaacttgctaaaagaaccgttgattcgtatcgatacggtttaaaacatatgatggagttttatcaattagattttcatggtcatcatgatgcattgaatgatgccaaagcatgcgcaatgattacttttaggctactgaaaaattatgaaaatttaacatatgtaactaatatttatggtaaaaatctaaaagataaaggc

SEQ ID NO: 1438 - protein, 184 aa, Staphylococcus aureus
  MISC_FEATURE (1)..(184): hypothetical protein
MIQDAFVALDFETANGKRTSICSVGMVKVIDSQITETFHTLVNPQDYFSQQNIKIHGIQPEDVENAPTFDYVFPYMMQFIADLPVVAHNAAFDMNVLHQSIQNIGLPTPNLTYFCSYQLAKRTVDSYRYGLKHMMEFYQLDFHGHHDALNDAKACAMITFRLLKNYENLTYVTNIYGKNLKDKG

SEQ ID NO: 1439 - DNA, 90 bp, Staphylococcus aureus
atgactaaaaatacaataattagccttgaaaatgaaaaaacgcagatcaatgattcagaaaatgaatctagtgatctccgtaaagcaaaa

SEQ ID NO: 1440 - protein, 30 aa, Staphylococcus aureus
MTKNTIISLENEKTQINDSENESSDLRKAK

SEQ ID NO: 1441 - DNA, 498 bp, Staphylococcus aureus
atgttaagtaaaaatttattagaagcattaaatgatcaaatgaaccatgagtactttgcagcacacgcatatatggcaatggcagcatactgtgataaagaatcgtacgaaggatttgcaaacttcttcattcaacaagctaaagaagaacgtttccatggacaaaagatttataactatattaacgacagaggtgcacatgcagaattcagagcagtttcagcaccaaaaattgacttttcaagcatactagaaactttcaaagacagcttatctcaagaacaagaagtaacaagacgtttctataacttatctgaaatcgctcgtcaagataaagattatgcaactatctcattcttaaactggttcttagatgaacaagtcgaagaagaatcaatgtttgaaactcacatcaattatttaactcgtatcggcgatgacagcaatgcattatatctttacgaaaaagaacttggcgctcgtacattcgacgaagaa

SEQ ID NO: 1442 - protein, 166 aa, Staphylococcus aureus
  MISC_FEATURE (1)..(166): hypothetical protein
MLSKNLLEALNDQMNHEYFAAHAYMAMAAYCDKESYEGFANFFIQQAKEERFHGQKIYNYINDRGAHAEFRAVSAPKIDFSSILETFKDSLSQEQEVTRRFYNLSEIARQDKDYATISFLNWFLDEQVEEESMFETHINYLTRIGDDSNALYLYEKELGARTFDEE

SEQ ID NO: 1443 - DNA, 1380 bp, Staphylococcus aureus
ttgagaaacttttttgaagttgccttgtcatgttataatgatgcgagtggaaatttgaggaggaaacacatgagacagtggacggcaatccatctagcgaaattggcgcgtaaagcaagtagagcagtaggtaaaagaggaacagatttacctggacaaatcgctagaaaagtggatacagatatattaagaaaattagcagagcaagttgatgatattgtatttatcagtggaacaaatggtaaaacaacgacttcaaacttaattggacatactttaaaagcaaataatattcaaattatacacaataatgaaggtgctaatatggctgcaggtataacttttgcattcatcatgcaatcaacacctaagactaaaattgcggtaatcgaaattgatgaaggttcgattccacgtgtgttaaaagaagttacaccttcaatgatggtatttactaatttctttagagatcaaatggatcgcttcggtgaaattgatattatggttaataacattgcagagacaattagtaataaaggcatcaaattattgctaaatgctgatgatccatttgtgagtcgtttgaaaatcgcaagtgatacgattgtgtactatggtatgaaagcacatgcccatgaatttgaacaaagtacgatgaatgaaagtagatattgtccaaactgtggtcgcttattgcaatacgattatattcattataatcaaattggtcattatcactgtcagtgtggtttcaaacgagagcaagcaaaatatgaaatatcaagttttgatgtggcaccgtttttatatttaaatatcaatgatgaaaaatatgatatgaaaattgcaggtgactttaacgcttataacgcgttagcagcatatactgttttaagagagctagggttaaatgaacaaacaattaaaaatggctttgaaacgtatacatcagacaatggtcgtatgcagtactttaaaaaagaacgaaaagaagcgatgatcaatttagctaaaaatcctgcaggaatgaatgcaagtttatcagttggtgaacaattagaaggcgaaaaagtgtatgttatttcgctaaatgataacgctgcagatggtcgagatacttcatggatttatgatgcagattttgaaaaattatctaagcaacaaattgaagctatcatcgtgacaggtacacgagcagaagaacttcaattgcgattgaagttagcagaggttgaagtaccaattatagttgagcgtgatatttataaagcaacggcaaagactatggattataaaggtttcacagttgcaataccaaactatacatcattagcgcctatgcttgaacaattaaaccgttcgtttgaaggaggtcaatca

SEQ ID NO: 1444 - protein, 460 aa, Staphylococcus aureus
  MISC_FEATURE (1)..(460): hypothetical protein
LRNFFEVALSCYNDASGNLRRKHMRQWTAIHLAKLARKASRAVGKRGTDLPGQIARKVDTDILRKLAEQVDDIVFISGTNGKTTTSNLIGHTLKANNIQIIHNNEGANMAAGITFAFIMQSTPKTKIAVIEIDEGSIPRVLKEVTPSMMVFTNFFRDQMDRFGEIDIMVNNIAETISNKGIKLLLNADDPFVSRLKIASDTIVYYGMKAHAHEFEQSTMNESRYCPNCGRLLQYDYIHYNQIGHYHCQCGFKREQAKYEISSFDVAPFLYLNINDEKYDMKIAGDFNAYNALAAYTVLRELGLNEQTIKNGFETYTSDNGRMQYFKKERKEAMINLAKNPAGMNASLSVGEQLEGEKVYVISLNDNAADGRDTSWIYDADFEKLSKQQIEAIIVTGTRAEELQLRLKLAEVEVPIIVERDIYKATAKTMDYKGFTVAIPNYTSLAPMLEQLNRSFEGGQS

SEQ ID NO: 1445 - DNA, 750 bp, Staphylococcus aureus
ttgaaggaggtcaatcataatatgcatgaattgactatttatcattttatgtcagataaattgaatttatacagtgatataggaaatattattgctttaagacaacgtgctaaaaaacgaaatattaaagttaatgtcgtagaaatcaatgaaacagaaggtattacctttgatgaatgtgatattttctttatcggtggtggaagtgatagagaacaagcattagcaacaaaagaattaagtaaaattaagacaccacttaaagaagcgattgaagatggtatgccgggattaacgatttgtggaggctatcaatttttagggaaaaaatatatcacgcctgatggtacagaattagaagggttaggtattttagatttttatactgaatcaaagacaaaccgattaacaggagatattgttatcgaaagtgatacttttggaactattgtaggttttgaaaatcacggtggtagaacatatcatgatttcggtacacttggtcatgttacttttggttatggtaataatgatgaagataaaaaagaaggcattcattataaaaatttattaggtacttatttacatggaccaattttacctaaaaattacgaaatcactgattatctgttagaaaaagcttgtgaacgtaagggtattccgtttgagcctaaagaaatagataatgaagcggaaatacaagcgaaacaagtattaatagacagagcaaatagacagaagaaatctcgt

SEQ ID NO: 1446 - protein, 250 aa, Staphylococcus aureus
  MISC_FEATURE (1)..(250): hypothetical protein
LKEVNHNMHELTIYHFMSDKLNLYSDIGNIIALRQRAKKRNIKVNVVEINETEGITFDECDIFFIGGGSDREQALATKELSKIKTPLKEAIEDGMPGLTICGGYQFLGKKYITPDGTELEGLGILDFYTESKTNRLTGDIVIESDTFGTIVGFENHGGRTYHDFGTLGHVTFGYGNNDEDKKEGIHYKNLLGTYLHGPILPKNYEITDYLLEKACERKGIPFEPKEIDNEAEIQAKQVLIDRANRQKKSR

SEQ ID NO: 1447 - DNA, 108 bp, Staphylococcus aureus
ttggatggaaacaaccaaattgatgtgtgtttttttgttctagtgaataattattatacaatgagtatctatcctagaattatcaatagtaatggtgattatgcaaca

SEQ ID NO: 1448 - protein, 36 aa, Staphylococcus aureus
LDGNNQIDVCFFVLVNNYYTMSIYPRIINSNGDYAT

SEQ ID NO: 1449 - DNA, 459 bp, Staphylococcus aureus
atggtgattatgcaacatgaaaaaatgaatgatgaaaggaatttgacgatgaagcctactaaagtgatattaaaagatgcatcttatttacatagcaaaacatcgataacatttattttaaaagatgtagttatcgaagaagataataaaatttattatttcgacactagtgcaactttcgaagatcaagaagttaaatttgaatttgcactctttgatagtgacatggacaatttgaaacatatggattgcgacaatcctgttactgaaatatattttatagaacctgatttacattttacaattattgattttaatcaagaactgctttgtatttatattgattttgattctggtttaaggcattcaaacatggcaacagaatctggtatttcattaaggataaatgttgctaaatcagattttactaaatttattaatgaattagcctctttacat

SEQ ID NO: 1450 - protein, 153 aa, Staphylococcus aureus
  MISC_FEATURE (1)..(153): hypothetical protein
MVIMQHEKMNDERNLTMKPTKVILKDASYLHSKTSITFILKDVVIEEDNKIYYFDTSATFEDQEVKFEFALFDSDMDNLKHMDCDNPVTEIYFIEPDLHFTIIDFNQELLCIYIDFDSGLRHSNMATESGISLRINVAKSDFTKFINELASLH

SEQ ID NO: 1451 - DNA, 984 bp, Staphylococcus aureus
atgaacgatcaatggtataaacatttaattggtgccagaacaattaaaactggtattgccatttttttaacagctgtcttttgtatggcactagatttaacacccatctatgccattttaacagctgtagtcacaattgaaccaactgccaaggcatcacttattaaaggttatcgtagattacctgctacggtaattggtgcaggctttgcagtattatttacatatttattcggcgatcaatcaccttttacatatgcattgagtgcaacgttcacgattttattctgtacaaaactcaaattgcaagttggtacgaatgtcgctgtactaacatcattagctatgattccaggtattcatgatgcctacatattcaactttttgtctcgaacattgacagcaattattggactcgtgacatcaggtttaattaacttcatggtgtttccacctaagtattatggtcaggtcgaagaaaaattaagtaagacagatgccttgatgtataaattattttacaatcgctgccaagaacttatcttatcaagactgcaatctgataaaagcgaaaaagcatataaaaatattttcaatttaaataatcaagttgaaacgttaataagttatcaacgtgatgaattaagctatcataagaaaaaagaatgtgattggaaattactcaatcaattaactaaacgtgcatatacgaatcgtttgtttatcactcatttatcaaatatcatttacttgcctaaaaatactcgtgttaacttttcaggtgacgaaaaaatggcattgctaaaaattagtagtagcatcaaagatatattttatgatggttcttttaagagagaagatgattctgtagaaactttacgttcgactataaaagcacttgaaattagtggtgaaaatcaaattaaaagtcatatactatacgaagttctaatgatttatcgactgctagacagcagatatgct

SEQ ID NO: 1452 - protein, 328 aa, Staphylococcus aureus
  MISC_FEATURE (1)..(328): conserved hypothetical
MNDQWYKHLIGARTIKTGIAIFLTAVFCMALDLTPIYAILTAVVTIEPTAKASLIKGYRRLPATVIGAGFAVLFTYLFGDQSPFTYALSATFTILFCTKLKLQVGTNVAVLTSLAMIPGIHDAYIFNFLSRTLTAIIGLVTSGLINFMVFPPKYYGQVEEKLSKTDALMYKLFYNRCQELILSRLQSDKSEKAYKNIFNLNNQVETLISYQRDELSYHKKKECDWKLLNQLTKRAYTNRLFITHLSNIIYLPKNTRVNFSGDEKMALLKISSSIKDIFYDGSFKREDDSVETLRSTIKALEISGENQIKSHILYEVLMIYRLLDSRYA

SEQ ID NO: 1453 - DNA, 1314 bp, Staphylococcus aureus
ttgtttttctcaaaagcacaaacggaggtacataaaatgaaaaaattaaatatagcattattaggattaggtactgtcggatctggtgttgttaaaatcatcgaagagaaccgacagcaaattcaagatacattaaataaagatattgtcataaagcatattcttgttcgagataaatctaaaaagagaccgctaaatattagccaatatcatttaactgaagatgttaatgaaattttaaatgatgattcattagatattatcgttgaagtcatgggaggaattgaaccaactgtagattggttaagaacagcacttaaaaataaaaaacatgttattaccgcaaataaagatttattagcagtacatcttaaacttttagaagatttagcagaagaaaatggtgtagctttaaagtttgaagcgagtgtagcaggtggtattccgatcgtaaatgccataaataatggtttgaatgcgaataatatttcaaaatttatgggaattttaaatggtacctctaattttattttatctaaaatgactaaagagcaaacgacatttgaggaagcacttgatgaagcgaaaagacttggttttgctgaagcggatccaactgatgatgtagaaggggtagatgcagcgcgtaaagttgtcattacatcatatttatcatttaaccaagtcattaaattaaacgacgttaaacgaagaggaattagtggcgtaactttaactgatattaatgtagccgatcaactggggtataaaattaaattgattggtaagggaatatatgaaaatggcaaagttaatgcatcggtagaaccaacgttaattgataaaaagcatcaattagcagctgtagaggatgaatataacgcgatttatgttattggtgatgccgttggtgacacgatgttttatggaaaaggagcaggcagtttagcaacaggtagtgccgttgtcagtgatttattgaatgtagcattattctttgaatcagatttacacacattgccaccacattttgaattaaagacagataaaacacgggaaatgatggattcagatgcagaaattaatattaaagaaaaatccaatttctttgtagtagtgaatcatgtcaaaggttcaattgaaaattttgaaaatgagttaaaggcaatattaccatttcaccgatcattaagagttgcaaattacgataatcaatcatatgccgctgttatagttggattggaatcatcaccggaagaattaatcactaagcatggatacgaagttgacaaagtatacccagtagaaggagtt

SEQ ID NO: 1454 - protein, 438 aa, Staphylococcus aureus
  MISC_FEATURE (1)..(438): homoserine dehydrogenase
LFFSKAQTEVHKMKKLNIALLGLGTVGSGVVKIIEENRQQIQDTLNKDIVIKHILVRDKSKKRPLNISQYHLTEDVNEILNDDSLDIIVEVMGGIEPTVDWLRTALKNKKHVITANKDLLAVHLKLLEDLAEENGVALKFEASVAGGIPIVNAINNGLNANNISKFMGILNGTSNFILSKMTKEQTTFEEALDEAKRLGFAEADPTDDVEGVDAARKVVITSYLSFNQVIKLNDVKRRGISGVTLTDINVADQLGYKIKLIGKGIYENGKVNASVEPTLIDKKHQLAAVEDEYNAIYVIGDAVGDTMFYGKGAGSLATGSAVVSDLLNVALFFESDLHTLPPHFELKTDKTREMMDSDAEINIKEKSNFFVVVNHVKGSIENFENELKAILPFHRSLRVANYDNQSYAAVIVGLESSPEELITKHGYEVDKVYPVEGV

SEQ ID NO: 1455 - DNA, 1392 bp, Staphylococcus aureus
ttggcatgcactatgaaagtttccaaattcggtggtagctccgtctccaatgctactcaaattaaaaaggttttaaatattgttaattctgatccagagcgaaagattgttatcgtttctgctccaggtaaaagacatgataatgatattaaaacaactgatttgttaatcagattatatgaaaaggtcattaatcatcttgattatcatgataaaaaaagagaaattattcagcgttatgatgatattgtaaaagaattgcaaatggatgaaagtattttacggacgatagatgtgactttggaacattatataaatcaattaaaaaatgaaccaaagagactattagatgcattactttcttgtggtgaagattttaatgcgcaattgatagctttatataataatagtcaaggtataccaacaaaatatatatcaccgaaggaagcgggtatttttgttactgacgtcccacaagaagcacaaatattagatagtgcttactctgaaattaaaaaattaagagattatgatgaaaaactaattatcccaggattttttggcgtatctcatgaaggatatatagttacatttccacgtggcggatcagatataactggcgccatcatatcaagtggtgttagagccacaatttatgaaaatttcaccgatgtgtctggtatttataaagctaatccaaatatcatcaaagatcctgaattaatcgaagaaatcacttatcgagaaatgcgtgaattatcttatgctggttttagtgttttccatgatgaagccttacaaccactttataaagatcgcatccctgtggtgattaaaaatacgaaccgccctcaagataagggtacatttatagtgcatgatagagaaataaatgcgaaaaatgtgattagcggtataagttgtgataaagattttaccgttattaatatcaaaaagtatttaatgaatagacaagtcggctttactagaaagatattaggtgtcttagaggataataatatttcatttgatcatatgccttcaggtattgatactatcagtatcgttatgcgttcaaaacaaattcaaaataaagaaacaaaagtattaaatgaaattcgtcaaaaatgtgatgttgatgagctaagtattgagcatgatttagcaatattaatgattgtcggcgaaggtatgaataaagtcatcggtactgcaaataaaattacacatgccttagctgaatcaaaaattaacttaaaaatgattaaccaaggtgcttcggaaatctcgatgatgtttggaattcatgtagatgatgctgaaaaagctgtattatctacatatgagttttgctatcacggggttgcattaaaaaacttgtgtgataaaaac

SEQ ID NO: 1456 - protein, 464 aa, Staphylococcus aureus
  MISC_FEATURE (1)..(464): aspartate kinase homolog
LACTMKVSKFGGSSVSNATQIKKVLNIVNSDPERKIVIVSAPGKRHDNDIKTTDLLIRLYEKVINHLDYHDKKREIIQRYDDIVKELQMDESILRTIDVTLEHYINQLKNEPKRLLDALLSCGEDFNAQLIALYNNSQGIPTKYISPKEAGIFVTDVPQEAQILDSAYSEIKKLRDYDEKLIIPGFFGVSHEGYIVTFPRGGSDITGAIISSGVRATIYENFTDVSGIYKANPNIIKDPELIEEITYREMRELSYAGFSVFHDEALQPLYKDRIPVVIKNTNRPQDKGTFIVHDREINAKNVISGISCDKDFTVINIKKYLMNRQVGFTRKILGVLEDNNISFDHMPSGIDTISIVMRSKQIQNKETKVLNEIRQKCDVDELSIEHDLAILMIVGEGMNKVIGTANKITHALAESKINLKMINQGASEISMMFGIHVDDAEKAVLSTYEFCYHGVALKNLCDKN

SEQ ID NO: 1457 - DNA, 756 bp, Staphylococcus aureus
atgattgtaaaaacagaagaagaattacaagcgttaaaagaaattggatacatatgcgctaaagtgcgcaatacaatgcaagctgcaaccaaaccaggtatcactacgaaagagcttgataatattgcgaaagagttatttgaagaatacggtgctatttctgcgccaattcatgatgaaaattttcctggtcaaacgtgtattagtgtcaatgaagaggtggcacatgggattccaagtaagcgtgtcattcgtgaaggagatttagtaaatattgatgtatcggctttgaagaatggctattatgcagatacaggcatttcatttgtcgttggagaatcagatgatccaatgaaacaaaaagtatgtgacgtagcaacgatggcatttgagaatgcaattgcaaaagtaaaaccgggtactaagttaagtaacattggtaaagcggtgcataatacagctagacaaaatgatttgaaagtcattaaaaacttaacaggtcatggtgttggtttatcattacatgaagcaccagcacatgtacttaattactttgatccaaaagacaaaacattattaactgaaggtatggtattagctattgaaccgtttatctcatcaaatgcatcatttgttacagaaggtaaaaatgaatgggcttttgaaacgagcgataaaagttttgttgctcaaattgagcatacggttatcgtgactaaggatggtccgattttaacgacaaagattgaagaagaa

SEQ ID NO: 1458 - protein, 252 aa, Staphylococcus aureus
  MISC_FEATURE (1)..(252): methionyl aminopeptidase
MIVKTEEELQALKEIGYICAKVRNTMQAATKPGITTKELDNIAKELFEEYGAISAPIHDENFPGQTCISVNEEVAHGIPSKRVIREGDLVNIDVSALKNGYYADTGISFVVGESDDPMKQKVCDVATMAFENAIAKVKPGTKLSNIGKAVHNTARQNDLKVIKNLTGHGVGLSLHEAPAHVLNYFDPKDKTLLTEGMVLAIEPFISSNASFVTEGKNEWAFETSDKSFVAQIEHTVIVTKDGPILTTKIEEE

SEQ ID NO: 1459 - DNA, 393 bp, Staphylococcus aureus
gtgatagttatgaactatgttgaacgttatattgaacagtttttgagagcaacagtaagaaataatatcaagcactaccttttaatgctagatgaaaaaatgaaaaatttagatgattatatgcgttatttaattactaaaaaagaacaacttagcaagttaattgacagtctaatgctaacattagaaaataaatatattgatattgctgaagcatttcaaattcaatgtgcaagagaaatcaataatcaagaaattgaaaatattaaatcagagttgaataaagttgaagcatattatgcacaaattgaaactcaaattcaacaaacttcaactgaaaaaatagcaacagaaaaaacatcgtatctaataaattatatgaacgctgtggca

SEQ ID NO: 1460 - protein, 131 aa, Staphylococcus aureus
  MISC_FEATURE (1)..(131): hypothetical protein
VIVMNYVERYIEQFLRATVRNNIKHYLLMLDEKMKNLDDYMRYLITKKEQLSKLIDSLMLTLENKYIDIAEAFQIQCAREINNQEIENIKSELNKVEAYYAQIETQIQQTSTEKIATEKTSYLINYMNAVA

SEQ ID NO: 1461 - DNA, 699 bp, Staphylococcus aureus
atgacacacaaatatatatcaacgcaaatgttgatcatttttactgcattaatgattattgccaatttttactacatattttttgaaaaaattggctttttactcgttctattattgggatgtgtattagtttatgtaggatatctttattttcataaaatacgtggccttttggcgttttggataggcgcgctattaattgcattcacattattgtctaataagtatacaatcatcatcttgttcgtctttttattattacttattgtgcgttatttaatacacaagtttaaaccaaaaaaagtagttgcgacggatgaggttatgacttcaccatcttttattaaacaaaagtggtttggtgagcaacgtacaccagtttatgtatataagtgggaagatgtacaaattcaacatggaattggcgacctacatattgacttaacaaaagctgcaaatattaaggaaaataataccattgttgttagacacattttaggtaaagtgcaggttatattgccggttaattacaatattaatttacatgtagctgctttttatggaagtacttacgtgaatgaaaaatcatataaagttgaaaataacaatattcatattgaagaaatgatgaaaccggataactatacagttaatatctacgtatcaacgtttatcggagacgtagaggtgatttatcga

SEQ ID NO: 1462 - protein, 233 aa, Staphylococcus aureus
  MISC_FEATURE (1)..(233): conserved hypothetical
MTHKYISTQMLIIFTALMIIANFYYIFFEKIGFLLVLLLGCVLVYVGYLYFHKIRGLLAFWIGALLIAFTLLSNKYTIIILFVFLLLLIVRYLIHKFKPKKVVATDEVMTSPSFIKQKWFGEQRTPVYVYKWEDVQIQHGIGDLHIDLTKAANIKENNTIVVRHILGKVQVILPVNYNINLHVAAFYGSTYVNEKSYKVENNNIHIEEMMKPDNYTVNIYVSTFIGDVEVIYR

SEQ ID NO: 1463 - DNA, 1041 bp, Staphylococcus aureus
atgaaccactacattagaacaattggttcaatgctcatcttagtatatagcatgctagctgcatttctgttcatcgataaagtttttgtaaatatcatctattttcaaggtatgttttatacacaaatattcggaataccagtttttttatttttaaatctcatcatcatattattgtgtattattgttggttcggtactcgcttacaaaatcaatcagcaaaatgattggattaagacgcaaattgagcgttcaatggaaggcgaaacagttggcattaatgatcaaaatatagaaatatatagtgaaacgttagatttataccatacactcgtacctttaaatcaagaattgcataagttgcgacttaaaactcaaaacttaaccaatgaaaattataatattaatgatgtgaaagttaaaaagattattgaagatgaacgtcaaagactagcacgagaacttcacgattctgttagtcagcaactttttgcggcaagtatgatgctatctgctatcaaagaaacgaagttagaaccaccattagaccaacaaattcctattttagagaaaatggttcaagattcgcagttagaaatgcgtgctttgctgttacatttaagaccgcttggtttaaaagacaaatctttaggtgagggtattaaagatttagttattgatttacaaaaaaaagtgccaatgaaagttgtgcatgaaatacaagattttaaagtgcctaaaggtattgaagatcatttgttcagaattacacaggaagcaatttcgaatacattgcgtcattcaaacggtacaaaagtgacagtagaattgtttaataaagacgattatttattgttgagaattcaagataatggtaaaggttttaatgttgatgaaaaattagaacaaagttatggacttaaaaatatgcgtgaaagagctttggaaattggtgcaacgttccatattgtatcattgccagattcaggtacacgtatcgaggtgaaagcacctttaaataaggaggattcgtatgacgat

SEQ ID NO: 1464 - protein, 347 aa, Staphylococcus aureus
  MISC_FEATURE (1)..(347): two-component sensor
MNHYIRTIGSMLILVYSMLAAFLFIDKVFVNIIYFQGMFYTQIFGIPVFLFLNLIIILLCIIVGSVLAYKINQQNDWIKTQIERSMEGETVGINDQNIEIYSETLDLYHTLVPLNQELHKLRLKTQNLTNENYNINDVKVKKIIEDERQRLARELHDSVSQQLFAASMMLSAIKETKLEPPLDQQIPILEKMVQDSQLEMRALLLHLRPLGLKDKSLGEGIKDLVIDLQKKVPMKVVHEIQDFKVPKGIEDHLFRITQEAISNTLRHSNGTKVTVELFNKDDYLLLRIQDNGKGFNVDEKLEQSYGLKNMRERALEIGATFHIVSLPDSGTRIEVKAPLNKEDSYDD

SEQ ID NO: 1465 - DNA, 627 bp, Staphylococcus aureus
atgacgattaaagtattgtttgtggatgatcatgaaatggtacgtataggaatttcaagttatctatcaacgcaaagtgatattgaagtagttggtgaaggcgcttctggtaaagaagcaattgccaaagcccatgagttgaagccagatttaattttaatggatttacttatggatgacatggatggtgtagaagcgacgactcagattaaaaaagatttaccgcaaattaaagtattaatgttaactagttttattgaagataaagaggtatatcgtgcattagatgcaggtgtcgatagttacattttaaaaacaacaagtgcaaaagatatcgccgatgcagttcgtaaaacttctagaggagaatctgtttttgaaccggaagttttagtgaaaatgcgtaaccgtatgaaaaagcgcgcagagttatatgaaatgcttacagaacgagaaatggaaatattattattgattgcgaaaggttactcaaatcaagaaattgctagtgcatcgcatattactattaaaacggttaagacacatgtgagtaacattttaagtaagttagaagtgcaagatagaacacaagctgttatctatgcattccaacataatttaattcaa

SEQ ID NO: 1466 - protein, 209 aa, Staphylococcus aureus
  MISC_FEATURE (1)..(209): two-component response
MTIKVLFVDDHEMVRIGISSYLSTQSDIEVVGEGASGKEAIAKAHELKPDLILMDLLMDDMDGVEATTQIKKDLPQIKVLMLTSFIEDKEVYRALDAGVDSYILKTTSAKDIADAVRKTSRGESVFEPEVLVKMRNRMKKRAELYEMLTEREMEILLLIAKGYSNQEIASASHITIKTVKTHVSNILSKLEVQDRTQAVIYAFQHNLIQ

SEQ ID NO: 1467 - DNA, 1221 bp, Staphylococcus aureus
gtgcacatgtcgaaaaaggatcactcttcttcaaaataccttaattctgttaaggaagcgcaagaggagtcaaaaaagaaaaataaaagtaatcccaaaattgatgttgatcgtacatatattgaacctcaacaattccaatctaagaaacctaaaaaagatgatcaggttttcttcttatcaagattaaataaacctgcaaaatataagaaagactctaatttcttatcatatctcatctatcgcataggaaaagatgatgcctcaggactagcagcacaaatgacttaccatttcgtacttgctatgttccctatgttgcttttcctattaacattattaccatttttcaatattaagcagagtcaaattactaatatgttaagcaatgcacccgctgaaacatctactctaattaagagtgtaattggtgatataactcaaaactccagtggtggcttattatctatcggtttgattttagcaatttggtcagcttcaaatggaatgactgcaattatgaattctttcaatgttgcttacgatgtagaagatagccgtaatggaatcgtattaaaactactaagtgttgtcttcactgtagttatgggcgttgtgtttgtagttgctctagcattaccaacgcttggttctgtaattagtcatttcctattcggtccacttggatttgacgaacaagtgaaatggatttttaaccttattagaattgtgttaccaatcattattatatttatcatatttatcgtgttatattcggttgcacctaacgttaaaacgaagcttaagtcagtattaccaggtgcagtatttacttcaattatttggttagctggttcatttggttttggttggtatatttcaaattttggtaactattctaaaacatatggcagtatcgcgggtatcatcattttgttactatggttatatatcacaagttttattataattgtcggtgctgaaatcaatgcaatcattcatcagcgtagtgtaattaaaggtaaaacacctgaagaagcagcattagaacatgatgacaataataaaaatcattataatgagaacactagatacgaatatgatgaagatagtaatgcaacacatcaacgtacgtatcatgttgatgaacatcctagtgatacctatccagaagatgataaaaatataaaagacaaaatcgttgataagcttaaaaaagac

SEQ ID NO: 1468 - protein, 407 aa, Staphylococcus aureus
  MISC_FEATURE (1)..(407): hypothetical protein
VHMSKKDHSSSKYLNSVKEAQEESKKKNKSNPKIDVDRTYIEPQQFQSKKPKKDDQVFFLSRLNKPAKYKKDSNFLSYLIYRIGKDDASGLAAQMTYHFVLAMFPMLLFLLTLLPFFNIKQSQITNMLSNAPAETSTLIKSVIGDITQNSSGGLLSIGLILAIWSASNGMTAIMNSFNVAYDVEDSRNGIVLKLLSVVFTVVMGVVFVVALALPTLGSVISHFLFGPLGFDEQVKWIFNLIRIVLPIIIIFIIFIVLYSVAPNVKTKLKSVLPGAVFTSIIWLAGSFGFGWYISNFGNYSKTYGSIAGIIILLLWLYITSFIIIVGAEINAIIHQRSVIKGKTPEEAALEHDDNNKNHYNENTRYEYDEDSNATHQRTYHVDEHPSDTYPEDDKNIKDKIVDKLKKD

SEQ ID NO: 1469 - DNA, 273 bp, Staphylococcus aureus
atggaaaataaatttgttcctggtattttaattggtgccgtaattggtggtgcaattagtttagctgataaatctacacgtcaagctttagttcaatcagttaaagatgcaaaaaatggtaaccgcactcgtaagccttctaaagtcagcaagattaaagacgaagttttatactggaaagatgttgttgaagaaattcgtcgtaataatcctgaattagaacgttcattaaaggatgcgaaagaaacatttgttaatagaaaaaatcaacgc

SEQ ID NO: 1470 - protein, 91 aa, Staphylococcus aureus
  MISC_FEATURE (1)..(91): hypothetical protein
MENKFVPGILIGAVIGGAISLADKSTRQALVQSVKDAKNGNRTRKPSKVSKIKDEVLYWKDVVEEIRRNNPELERSLKDAKETFVNRKNQR

SEQ ID NO: 1471 - DNA, 462 bp, Staphylococcus aureus
atggtagatgtagcatttgtctgtcttggcaatatatgtcgttctccaatggcagaagcaatcatgcgacaaagacttaaagacagaaatattcatgatattaaagtacattcaagaggtactggtagctggaatttaggagagccacctcatgaaggtacacaaaaaattctcaacaaacacaatattccatttgatggcatgattagtgaattattcgaagcgacagatgattttgattacattgtggctatggatcaaagtaacgttgataatattaaatctatcaatcctaatcttaagggacaattgttcaaactgttagaatttagtaatatggaagagagtgatgtaccagatccatactacacgaataattttgaaggtgtatacgacatggtattatcatcttgtgataatttaatagactacatcgtaaaagatgcaaatttgaaagagggg

SEQ ID NO: 1472 - protein, 154 aa, Staphylococcus aureus
  MISC_FEATURE (1)..(154): hypothetical protein
MVDVAFVCLGNICRSPMAEAIMRQRLKDRNIHDIKVHSRGTGSWNLGEPPHEGTQKILNKHNIPFDGMISELFEATDDFDYIVAMDQSNVDNIKSINPNLKGQLFKLLEFSNMEESDVPDPYYTNNFEGVYDMVLSSCDNLIDYIVKDANLKEG

SEQ ID NO: 1473 - DNA, 213 bp, Staphylococcus aureus
gtgaacattgtggctatgacaaatgaagagaaagtattagctattagagagaagttaaatattgttaatcaaggattattagatcctgaaaaatataaaaatgcaaatgaagaagaattaacagatatatatgattttgttcaatcaagagaaagattgtcgccaagtgaagtgacagctattgctgacgctttaggacaattgcgacacgaa

SEQ ID NO: 1474 - protein, 71 aa, Staphylococcus aureus
  MISC_FEATURE (1)..(71): conserved hypothetical
VNIVAMTNEEKVLAIREKLNIVNQGLLDPEKYKNANEEELTDIYDFVQSRERLSPSEVTAIADALGQLRHE

SEQ ID NO: 1475 - DNA, 1254 bp, Staphylococcus aureus
gtgggaattttgactaattacaaagaaaagttacaacaatacgctgaactattagttaaggttggtatgaatgttcaaccaaaacagccagtatttattagatcatcagtagaaacattagaattaacgcatttaattgtagaagaagcatatcattgtggcgcttcagatgtacgtgttgtatatagcgatccaaccttaaaacgcttaaaatttgaaaatgaatctgtggaacattttgctaatcatgagataaaatcatatgatgttgaagcgagaatggattacgttaaacgtggcgctgctaatttagcacttattagtgaagatcctgatttaatggatggtatcgatagccaaaaattacaagcatttcaacaacaaaacgcacgcgcatttaaaggatatatggaaagtgtacaaaaaaatcaatttccatgggtcgtagctgcttttccatctaaagcttgggcgaagagagtgtatcctgaactatctgtagaagaagcatatattaagtttattgacgaggtattcgatattgtgcgaattgatggtaacgatccagttgaaaattggcgtcaacacatcgctaatttaagtgtttacgctcaaaagttacaacaaaaaaattaccatgcgttgcattatgtatctgaaggtactgatttaacagtaggtttagcgaaaaatcatatctgggaagatgctacaagttatgttaacggcaaggaacaagcttttattgctaatataccaactgaagaagtatttacagcaccagatcgaaatagagtagatggatatgttactaataaattgcctttaagttataatggcacaattatcgatcaatttaaattgatgtttaaagatggagagattattgatttttcagctggaaaaggtgaagcggtattgaaagatttaatcaatactgatgaaggttcaagaagattaggtgaagtagcattagtacctgatgattcaccgatatcaaatcgtaataccattttttacaatactttatttgatgaaaatgcagcatgtcatttagcgattggatctgcttacgcctttaatattcaaggtggaacggaaatgactgttgaggaaaagattgcaagcggattaaatgattcaaatgtacatgtcgatttcatgattggtagtagtgatttgactatttatggcatattcgaagatggttcaaaagaactagtatttgaaaatggaaattgggcatcaacattt

SEQ ID NO: 1476 - protein, 418 aa, Staphylococcus aureus
  MISC_FEATURE (1)..(418): aminopeptidase ampS
VGILTNYKEKLQQYAELLVKVGMNVQPKQPVFIRSSVETLELTHLIVEEAYHCGASDVRVVYSDPTLKRLKFENESVEHFANHEIKSYDVEARMDYVKRGAANLALISEDPDLMDGIDSQKLQAFQQQNARAFKGYMESVQKNQFPWVVAAFPSKAWAKRVYPELSVEEAYIKFIDEVFDIVRIDGNDPVENWRQHIANLSVYAQKLQQKNYHALHYVSEGTDLTVGLAKNHIWEDATSYVNGKEQAFIANIPTEEVFTAPDRNRVDGYVTNKLPLSYNGTIIDQFKLMFKDGEIIDFSAGKGEAVLKDLINTDEGSRRLGEVALVPDDSPISNRNTIFYNTLFDENAACHLAIGSAYAFNIQGGTEMTVEEKIASGLNDSNVHVDFMIGSSDLTIYGIFEDGSKELVFENGNWASTF

SEQ ID NO: 1477 - DNA, 543 bp, Staphylococcus aureus
ttgggagataaaataatgacaaatcaggacagaccaatgaaatctatgtcagaatcaaaatgttataaaaatagacaagttttccctcaagatacgaatcaccatcatacaatgtttggtggtacattgatggctaatattgatgaaattgcagcaatcacagctatgaaacatgctggtgcgcaagtagttaccgcatctacagactcagtagatttcttaaagccgattaaaacaggggacatattacaatacgtagcgatggtttcatacgctgggactagttcaatggaagtggtcgttcaaattagaattgacgatgtatttaataacaagcatgatttagctgcattaagttacttaacatttgttgcgttagatgatgaaggcaaacctaaacatgtacctggtgtatatccagaagatgatgttgaaaaatggttttatgatacagcaccacaacgtgttgaacgaagaaaagcacgtcgcattgaaagtaaacaaacaattgaatatttagctcaagtgcaacatattagagac

SEQ ID NO: 1478 - protein, 181 aa, Staphylococcus aureus
  MISC_FEATURE (1)..(181): conserved hypothetical
LGDKIMTNQDRPMKSMSESKCYKNRQVFPQDTNHHHTMFGGTLMANIDEIAAITAMKHAGAQVVTASTDSVDFLKPIKTGDILQYVAMVSYAGTSSMEVVVQIRIDDVFNNKHDLAALSYLTFVALDDEGKPKHVPGVYPEDDVEKWFYDTAPQRVERRKARRIESKQTIEYLAQVQHIRD

SEQ ID NO: 1479 - DNA, 1143 bp, Staphylococcus aureus
atgcgtaataacaagcctaaaataagtattcaaaacgacccatgggaagcatataacgatgttaaagaacatggccaattaactttaagtaacatcgaatttacaactacaaatctttgtaatatgcgttgtagccactgtgcagttggttatactttacaaactgtcgaccccgagcctttagatatggacttaatttatcgtagacttgatgaaattccaaatctgcgaacgatgtctattacaggtggcgaaccaatgttttctaaaaagtctattagaaatgttgttaaacctctattaaagtatgcacatcatcgaggtatatatacacaaatgaattcaaacctaacattgcctcaagatcgttatttagatattgctgaatatatcgatgttatgcatatctcacacaactggggaacaactgatgaattcgcaaatgttggctttggcgcaatgaagaagcaaccaccgttaaaagctaagttaaaattatatgaacaaatgatttcgaatgcacgtacattatcagaacaaggaatgtttgtatctgcggaaacaatgctcaatcaaagtacgctaccacatttacgaaaaatacatcaagaagtcgttcatgatatgaaatgtagcagacacgagattcaccctatgtatccagctgactttgcaagtcaattaaatgtgttaactctagcggaaatgaaaaagacaattcatgatatattggatttcagagatgaagatatttggatgttatttggtactttgcctgtgtttccatgcttaaaggatgatgaagatcaaaagttactatcacgtttaagaaatgctaaaaatgtaacgactagaaatgacccggatggccgtagtcgtttaaatgtcaatgtatttacaggtaatgtaatcgtaactgatttcggagatgaaacaggtacaatttcgaatatacaaaaagataaattaacagatgtatttgataaatggttatcctctgatcttgctaaatcattaaattgtcattgttccgagtttagttgtttagggccaaatgttcttgttaaaaatatgtactatccgaatatggattttaaagataatgagcgtcatatgcacaaacaaccacaaattatacaattt

SEQ ID NO: 1480 - protein, 381 aa, Staphylococcus aureus
  MISC_FEATURE (1)..(381): conserved hypothetical
MRNNKPKISIQNDPWEAYNDVKEHGQLTLSNIEFTTTNLCNMRCSHCAVGYTLQTVDPEPLDMDLIYRRLDEIPNLRTMSITGGEPMFSKKSIRNVVKPLLKYAHHRGIYTQMNSNLTLPQDRYLDIAEYIDVMHISHNWGTTDEFANVGFGAMKKQPPLKAKLKLYEQMISNARTLSEQGMFVSAETMLNQSTLPHLRKIHQEVVHDMKCSRHEIHPMYPADFASQLNVLTLAEMKKTIHDILDFRDEDIWMLFGTLPVFPCLKDDEDQKLLSRLRNAKNVTTRNDPDGRSRLNVNVFTGNVIVTDFGDETGTISNIQKDKLTDVFDKWLSSDLAKSLNCHCSEFSCLGPNVLVKNMYYPNMDFKDNERHMHKQPQIIQF

SEQ ID NO: 1481 - DNA, 1044 bp, Staphylococcus aureus
atgccagtatataaggatgataatacaggtaaatggtatttttccattagatataaagatgtatacggtaataacaaacgaaaaatgaagcgtgggtttgaacgtaagaaagatgccaaactagctgaaagcgaatttatacaaaatgttaaatatggatactcggacaatcaaccctttgaatatatattttttgatcgtttaaaaaatgaaaatctttctgcacgctcaatagaaaagcgaactacagaatataatactcacataaaagaaaggttcggaaatatccctattggcaaaatcactactacgcaatgtactgctttcaggaattatttgttaaacgatgcaggtctttctgttgactatgcacgatctgtgtgggcaggttttaaagcagttatcaattacgccaaaaagcattacaagctcttatacgaccccacattatcggtaactcctattcccagaacaaaaccacaagctaaatttatcactcgtgaagaatttgatgaaaaagtagaacaaatcacaaatgatacttctcgtcagctaactagactgttattttattctggtcttagaataggagaagctttagctttgcagtggaaagattacgataaaataaaaggcgaaattgacgtaaataagaaaatcaatttaagtaatagaaaaattgaatataatctaaaaaaagaaagctctaaagggataatacctgtaccaaatttaattagagagatgcttaaaaacatgtataatgaatcttctaaaagatataaatattttgacgaaaactattttatattcgggggtttagaacctattagatacgttacttattcgtatcattttaaatctgtattcccgaatctaaaaatacaccatttaagacactcgtacgctagctatttaattaataatggtgtagatatgtatttattaatggaattaatgaggcattctaacattacagaaacaattcaaacgtactctcatttatatactgataaaaaacatcaagctatgagcatatttgat

SEQ ID NO: 1482 - protein, 348 aa, Staphylococcus aureus
  MISC_FEATURE (1)..(348): integrase [Staphylococcus
MPVYKDDNTGKWYFSIRYKDVYGNNKRKMKRGFERKKDAKLAESEFIQNVKYGYSDNQPFEYIFFDRLKNENLSARSIEKRTTEYNTHIKERFGNIPIGKITTTQCTAFRNYLLNDAGLSVDYARSVWAGFKAVINYAKKHYKLLYDPTLSVTPIPRTKPQAKFITREEFDEKVEQITNDTSRQLTRLLFYSGLRIGEALALQWKDYDKIKGEIDVNKKINLSNRKIEYNLKKESSKGIIPVPNLIREMLKNMYNESSKRYKYFDENYFIFGGLEPIRYVTYSYHFKSVFPNLKIHHLRHSYASYLINNGVDMYLLMELMRHSNITETIQTYSHLYTDKKHQAMSIFD

SEQ ID NO: 1483 - DNA, 903 bp, Staphylococcus aureus
atggaagagaaacaatacttatggagatataacgatatagaaaaaagaatgaatgaacttcacaaaaaatataaagaattagtggatatattttttggtgatgtaatagataaaaatactggatacttccccttttattccggtataaaatatagctacgcagatttgaatatcagtttttacagaggtttaatttatattcacggtgggtcagaaggcatgcaagcgaagaaaataaatatttctgtagatgatgttttaaaaagaacagaaagatctttcgagaagttaagtgaatatataaaaagtactttcattttcgaaaaagtcatacatgattttcaaatgtttaacttgagcgatttagctagtatatacaacgacgatgcaattgcgcattattattttgaaactcattctgacttatatttatcagataaatctacaaaaatttatcgaacacctaattctttgttagaaaacgcaaatgatttaccggcttctttaagaaaatacactcaattattagaaacagttaatgacaaggattttgaaactcatatagttgaagcttatgattgctttatgtctgaaaaaaggctagctacatcactacttttaggtagagcgctagaactaatgtgtaggctgatattgaacaagtttgataaagatataattaaacaaacacctgattacaagaggaatataagaacatttttaaacgaaatggaaaacaacgatttaatagaagaacatttaaaacattcagtcaaagctgctattgaacacagaaactctattatgcatggtattaaaatcgaagagtacaattcgataattcaaacattatttgacgaaatagctaagctgtctaatgtatataagtctcttaataaacag

SEQ ID NO: 1484 - protein, 301 aa, Staphylococcus aureus
MEEKQYLWRYNDIEKRMNELHKKYKELVDIFFGDVIDKNTGYFPFYSGIKYSYADLNISFYRGLIYIHGGSEGMQAKKINISVDDVLKRTERSFEKLSEYIKSTFIFEKVIHDFQMFNLSDLASIYNDDAIAHYYFETHSDLYLSDKSTKIYRTPNSLLENANDLPASLRKYTQLLETVNDKDFETHIVEAYDCFMSEKRLATSLLLGRALELMCRLILNKFDKDIIKQTPDYKRNIRTFLNEMENNDLIEEHLKHSVKAAIEHRNSIMHGIKIEEYNSIIQTLFDEIAKLSNVYKSLNKQ

SEQ ID NO: 1485 - DNA, 183 bp, Staphylococcus aureus
atggaatcatatgaagaaattgagcatatacacattaacactggtagaaaaaaacttacacaagaacaaatagaagaagccaaagcttttatagacagtcaaggatttaaagatatgattcgagaagctaaagagtcacgtcaaagagttatggagtctaaaattaccgatagaactaaaatg

SEQ ID NO: 1486 - protein, 61 aa, Staphylococcus aureus
MESYEEIEHIHINTGRKKLTQEQIEEAKAFIDSQGFKDMIREAKESRQRVMESKITDRTKM

SEQ ID NO: 1487 - DNA, 165 bp, Staphylococcus aureus
atgaaaataactaattgcaaaataaaaaaagaaactatagtatatgaagttttaactagtggtaatcaaccattcacttatgagttacctaaagatttatcgtcacataatgcgcgtaaatacttggaatttatttcacaaaaaatagatggcgataagttaaat

SEQ ID NO: 1488 - protein, 55 aa, Staphylococcus aureus
  MISC_FEATURE (1)..(55): hypothetical protein
MKITNCKIKKETIVYEVLTSGNQPFTYELPKDLSSHNARKYLEFISQKIDGDKLN

SEQ ID NO: 1489 - DNA, 717 bp, Staphylococcus aureus
atggataaaaaagaattagcgaaatttataggcaataaaatcagatactatagaaccaaattgaacttaactcaagatcaacttggagaaaaactcaacactaaaaaagctactatttcaaattatgagacagggtacagaactcctaaacaagatgatttgtttgaaattgctcatattttaaatatcagtatcgatgatttgtttcctacaagaaataataaaaaaaacgacatcacttccatatacaacaaactcacacctccccgccaagaaaacgtacttaactacgcaaatgagcaattagatgaacagaataaagtcacttctatagatgaatataaagagtctaaactagtatcgtatattgcatgtggtgcaactggtgctggcataggagaagaattatatgatgacatattgcatgaagaagtattttttaaagaagacgaaacgccatcaaatgctgatttttgtattttagttaatggtgattcaatggaacctatgttaaaacaaggaacatacgcttttattaagaaagaagattctattaaagatggtacaattgcactcgttgtattagatggagtaagtcttatcaagcgtgtagatatatgcgaagactatattaatttggtatctctaaatccgaagtatgatgatatcaaagtcgcttcgtttagtaatattaaagtaatgggcaaagttgtattg

SEQ ID NO: 1490 - protein, 239 aa, Staphylococcus aureus
  MISC_FEATURE (1)..(239): repressor homolog
MDKKELAKFIGNKIRYYRTKLNLTQDQLGEKLNTKKATISNYETGYRTPKQDDLFEIAHILNISIDDLFPTRNNKKNDITSIYNKLTPPRQENVLNYANEQLDEQNKVTSIDEYKESKLVSYIACGATGAGIGEELYDDILHEEVFFKEDETPSNADFCILVNGDSMEPMLKQGTYAFIKKEDSIKDGTIALVVLDGVSLIKRVDICEDYINLVSLNPKYDDIKVASFSNIKVMGKVVL

SEQ ID NO: 1491 - DNA, 216 bp, Staphylococcus aureus
atgcaatggaatttaataaagttgagaaaagaaagaaagtgtactcaagaagatttagcaaacctcttgaatatatcaactgaaggttatcgtttaaaagaattaggaaagcatcaatttaagaatgatgagatgtttattatcgctgatttttttgacgaaaatattggagatatttttttacccacaaagtacacgaaacgcaaacaaacatct

SEQ ID NO: 1492 - protein, 72 aa, Staphylococcus aureus
MQWNLIKLRKERKCTQEDLANLLNISTEGYRLKELGKHQFKNDEMFIIADFFDENIGDIFLPTKYTKRKQTS

SEQ ID NO: 1493 - DNA, 594 bp, Staphylococcus aureus
gtgtatttgagagtgaatgaaatgaatgctaaagaacaattagtggacaatttaatgaaaacatcatcgcaattatttaaatttcacggtgaagttgccatgcagcttttcttaaatgatgaattaaaattaccttctattgttgaaatatgcgtggaacgtaagcgtttaagtgatattgtgaaagttattccgcaatcatatgcgttactatacatagataagcaagatcaagcaatagctaaagaagatttatcactttcaaaaattgcaaaagtttatgtgcaatatgatgatacaacaataatgagtattttcgtttatgatgtagtaaacgatgaatggatttttagattggatccgaatatacgtatacctaagagtaacatatacttccatagtttaaattgggatgtggattatattaaaccggagatcgttctaatgtatgatctaatgcaacaccatcagtatcatcattattccaattataaacgagtcatagatgcattaagctactatcaattttttattttaaaatttgtagtaggtgagcaacgtattaaggatgcaatccagagaacaataaataat

SEQ ID NO: 1494 - protein, 198 aa, Staphylococcus aureus
  MISC_FEATURE (1)..(198): hypothetical protein
VYLRVNEMNAKEQLVDNLMKTSSQLFKFHGEVAMQLFLNDELKLPSIVEICVERKRLSDIVKVIPQSYALLYIDKQDQAIAKEDLSLSKIAKVYVQYDDTTIMSIFVYDVVNDEWIFRLDPNIRIPKSNIYFHSLNWDVDYIKPEIVLMYDLMQHHQYHHYSNYKRVIDALSYYQFFILKFVVGEQRIKDAIQRTINN

SEQ ID NO: 1495 - DNA, 894 bp, Staphylococcus aureus
ttgtatacaaagttaaagaagtcaaaaaggattggtgaaaaaatgtctttttatgttgtacttatcattatcattgtagcattaattggtatattagttttaaatcaaaggtatagtaatagtaaaatagataccgaagtttatgcaagaaagcaacttattaaaaagaacaaagcattaagtgcagaaaatgctgaattaagaagtcaaatgctgagttctaataatgatgttggccaccatgcatacaaaaatgctaaaagagaattacgcaagattttagatagctatctcgaaaatggtaaattaaaatattacgatattatcgttacaagcaatttagctactaaacatccgtttttcgagtatgcacgttcatttgattttatcattgtttcagatatcggtttaataaacgttgatgtaaaaagctggggtgaaaaaacattttatcactttgatgtacctgatgagcatgatacagaaataagcaatagtaatattgaaaaagttgtcggtcattacattagccagcaatatcatgatcagtttaattcatcaagaaagtctatctatacttttacagaaacagttcaaccaaatcgtgttatttatgatttttatgattatgatccgtatcaattagcagcaaataatgcgaaagcattaaaggatcatattgaacaaaactttaactttaaagtccaaagtaccggtgttatttactttagtgatggtacagttaatatcattcaaggttctgaagaaagagataaatatgttgatacagtttcaacaaaatcttcgttacgacgtattattagcgaagccatagagctatctaaacaccctttaaataaagaacaggttgatcaaatcacagctatattcaag

SEQ ID NO: 1496 - protein, 298 aa, Staphylococcus aureus
  MISC_FEATURE (1)..(298): hypothetical protein
LYTKLKKSKRIGEKMSFYVVLIIIIVALIGILVLNQRYSNSKIDTEVYARKQLIKKNKALSAENAELRSQMLSSNNDVGHHAYKNAKRELRKILDSYLENGKLKYYDIIVTSNLATKHPFFEYARSFDFIIVSDIGLINVDVKSWGEKTFYHFDVPDEHDTEISNSNIEKVVGHYISQQYHDQFNSSRKSIYTFTETVQPNRVIYDFYDYDPYQLAANNAKALKDHIEQNFNFKVQSTGVIYFSDGTVNIIQGSEERDKYVDTVSTKSSLRRIISEAIELSKHPLNKEQVDQITAIFK

SEQ ID NO: 1497 - DNA, 306 bp, Staphylococcus aureus
atgcaagaccaatcattaaaattagtaaaactacaactaaaatatcataacctttcaggacaaattgaagcttatgataaatcacttaaagaaataagatacactcgagatcttttcaacaaacatctaagcatgaataacgaagacgcatttgctggtttggaaatggtagaagatgaaattactaaaaagctacgaagtgctatcaaagagttccaaaaagtagtgaaagcgttagacaagcttaacggtgttgaaagcgataacaaagttactgatttaacagagtggcggaaagtgaatcag

SEQ ID NO: 1498 - protein, 102 aa, Staphylococcus aureus
MQDQSLKLVKLQLKYHNLSGQIEAYDKSLKEIRYTRDLFNKHLSMNNEDAFAGLEMVEDEITKKLRSAIKEFQKVVKALDKLNGVESDNKVTDLTEWRKVNQ

SEQ ID NO: 1499 - DNA, 789 bp, Staphylococcus aureus
atgcaagcattacaaacatttaattttaaagagctaccagtaagaacagtagaaattgaaaacgaaccttattttgtaggaaaagatattgctgagattttaggatatgcaagatcagacaatgccattagaaatcatgttgatagcgaggacaaactgacgcaccaatttagtgcatcaggtcaaaacagaaatatgatcattatcaacgaatcaggattatacagtctaatcttcgatgcttctaaacaaagcaaaaacgaaaaaattagagaaaccgctagaaaattcaaacgctgggtaacatcagatgtcctaccagctattcgcaaacacggtatatacgcaacagacaatgtaattgaacaaacattaaaagatccagactacatcattacagtgttgactgagtataagaaagaaaaagagcaaaacttacttttacaacaagaaattggagagctaaaacccaaagcagattatgttgatgaaatcttaaaatcaactggcacattagccacaactcaaatcgcggcagactacggtatatcagcacaaaagttaaacaaactactacacgaagctagactacaacgaaaagtaaataaacagtgggtgctttactcagaacacatgggcaagagttacacagattcagacactataacaattgtgcgttctgatggcagagaagacacagttttacaaactagatggacacaaaaaggcagattgaaaatacatgaaatcatgactgaattcggttatgaagctaatttagggggagcg

SEQ ID NO: 1500 - protein, 263 aa, Staphylococcus aureus
  MISC_FEATURE (1)..(263): hypothetical protein
MQALQTFNFKELPVRTVEIENEPYFVGKDIAEILGYARSDNAIRNHVDSEDKLTHQFSASGQNRNMIIINESGLYSLIFDASKQSKNEKIRETARKFKRWVTSDVLPAIRKHGIYATDNVIEQTLKDPDYIITVLTEYKKEKEQNLLLQQEIGELKPKADYVDEILKSTGTLATTQIAADYGISAQKLNKLLHEARLQRKVNKQWVLYSEHMGKSYTDSDTITIVRSDGREDTVLQTRWTQKGRLKIHEIMTEFGYEANLGGA

SEQ ID NO: 1501 - DNA, 222 bp, Staphylococcus aureus
atgacaccagaacaaaaagaaaagctaaacaatatagtattaacactttatgcagttaaagaaaacaaaagtcaaacatacacacacaaagatactcttactgtgacatatgcaggcgagattgagcacacttacgaagtcgacagagagaaacaccttgaatcaatgattgagtgggcaattgaccaaatcgaacagcactttgatttagacgaagaagaa

SEQ ID NO: 1502 - protein, 74 aa, Staphylococcus aureus
  MISC_FEATURE (1)..(74): hypothetical protein
MTPEQKEKLNNIVLTLYAVKENKSQTYTHKDTLTVTYAGEIEHTYEVDREKHLESMIEWAIDQIEQHFDLDEEE

SEQ ID NO: 1503 - DNA, 447 bp, Staphylococcus aureus
atgaacgcactatacaaaacaaccctcctcaccacaatggcagttgtgacgtggaaggtttggaagattgaacgaaatacgagaaagcctgtaatcaatagaaatgattttagtaaagagtctacagcagaaacgattgagcgacacagtgatcctgattcaggaataaaactacttaaggcattttccgacttcactaaacaagctgaaaagcaaaaacctacactaggagaagtttatagacggaacaaacctgaattaccaaccgttactttagacgaaaacggactgtttataaatgattttagggtgccttatgtacttgaggaaggggttaacgtaaagaaatctatgaacaacctatataaggtcagtttggactttttcgctaaaagtattattgcagataattacgaagcagataacccagagaatcaacagttattt

SEQ ID NO: 1504 - protein, 149 aa, Staphylococcus aureus
MNALYKTTLLTTMAVVTWKVWKIERNTRKPVINRNDFSKESTAETIERHSDPDSGIKLLKAFSDFTKQAEKQKPTLGEVYRRNKPELPTVTLDENGLFINDFRVPYVLEEGVNVKKSMNNLYKVSLDFFAKSIIADNYEADNPENQQLF

SEQ ID NO: 1505 - DNA, 219 bp, Staphylococcus aureus
atgatgaaaaatagtttgcaagctaaagaacttgcggtaattttatctgtttctaaatccaaagcaggacaaataataagagaactgaataaagagcttgaagatgaaggatacattgcgatacgaggcagaataccagtccaattagctaggaaaaaattcccttatcacgacttatcagaccagagaataatggaggagttgaaaaaagaaaatgag

SEQ ID NO: 1506 - protein, 73 aa, Staphylococcus aureus
  MISC_FEATURE (1)..(73): hypothetical protein
MMKNSLQAKELAVILSVSKSKAGQIIRELNKELEDEGYIAIRGRIPVQLARKKFPYHDLSDQRIMEELKKENE

SEQ ID NO: 1507 - DNA, 159 bp, Staphylococcus aureus
atgagtaacatttataaaagctacctagtagcagtactatgcttcacagtcttagcgattgtacttatgccgtttctatacttcactacagcatggtcaattgcaggattcgcaagtatcgcaacattcatattctataaggaatacttttatgaagaa

SEQ ID NO: 1508 - protein, 53 aa, Staphylococcus aureus
  MISC_FEATURE (1)..(53): hypothetical protein
MSNIYKSYLVAVLCFTVLAIVLMPFLYFTTAWSIAGFASIATFIFYKEYFYEE

SEQ ID NO: 1509 - DNA, 327 bp, Staphylococcus aureus
atgactgaaaatattaaaactgaacaacattattacactaaagatttttcaggatacagaaatgaagaagataactttgtagcaaatcaagaattgacagtaacaatcacattgaacgagtacagaaaacttattgaaataaaggctgttaaagataaagaagaagatacttacagaggtaagtattttgcggaagaaagaaaaaacgaaaaattggaaaaagaaaatataaaactaaaaaacaaaatttatgaattacaaaacgaagaagataacgaggaggacgaagaagacaaggaggacgagaacgatgtattacaaaattgg

SEQ ID NO: 1510 - protein, 109 aa, Staphylococcus aureus
MTENIKTEQHYYTKDFSGYRNEEDNFVANQELTVTITLNEYRKLIEIKAVKDKEEDTYRGKYFAEERKNEKLEKENIKLKNKIYELQNEEDNEEDEEDKEDENDVLQNW

SEQ ID NO: 1511 - DNA, 258 bp, Staphylococcus aureus
atgtattacaaaattggtgagataaaaaacaaaattataagctttaacgggtttgaatttaaagtgtctgtgatgaagagacatgacggtatcagtatacaaatcaaggatatgaataatgttccacttaaatcgtttcatgtcatagatttaagcgaactatatattgcgacggatgcaatgcgtgacgttataaacgaatggattgaaaataacacagatgaacaggacaaactaattaacttagtcatgaaatgg

SEQ ID NO: 1512 - protein, 86 aa, Staphylococcus aureus
  MISC_FEATURE (1)..(86): hypothetical protein
MYYKIGEIKNKIISFNGFEFKVSVMKRHDGISIQIKDMNNVPLKSFHVIDLSELYIATDAMRDVINEWIENNTDEQDKLINLVMKW

SEQ ID NO: 1513 - DNA, 534 bp, Staphylococcus aureus
gtgaatgatttacaagagagagaattagaaacattcgaacaagacgaccgattcaaagtaactgatctagacagtgctaactgggtttttaagaaactggatgcaatcacaactaaagagaatgaaatcaacgatttagcaaataaagaaattgaacgcataaacgaatggaaagataaagaagtagaaaaattacagagtggcaaagaatatttacaaagccttgtaattgaatattacagaatacaaaaagaacaagatagcaaattcaagttgaatacaccttacggaaaagtgacagccagaaaaggttcaaaagtcattcaagttagcaatgagcaagaagtcattaaacaacttgagcaacgaggttttgacaactatgtaaaagtaactaaaaaacttagccaatcagacattaagaaagatttcaatgtaactgaaaacggcacattgattgacgcaaacggcgaagttttagagggtgctagcattgtggagaaaccaacgtcatacacggtaaaggtgggagaa

SEQ ID NO: 1514 - protein, 178 aa, Staphylococcus aureus
VNDLQERELETFEQDDRFKVTDLDSANWVFKKLDAITTKENEINDLANKEIERINEWKDKEVEKLQSGKEYLQSLVIEYYRIQKEQDSKFKLNTPYGKVTARKGSKVIQVSNEQEVIKQLEQRGFDNYVKVTKKLSQSDIKKDFNVTENGTLIDANGEVLEGASIVEKPTSYTVKVGE

SEQ ID NO: 1515 - DNA, 777 bp, Staphylococcus aureus
atgactgaaaaaactaatcaagatgtcgatattttaacgcaactaggtgtaaaagacatcagcaaacaaaatgcaaacaagttttataaatttgcgatatacggcaagttcggtactggtaaaactacgtttttaacaaaagataacaatgccttagtactagatataaatgaggacggaacaacggtaacagaagatggggcagttgtgcagattaagaattataagcattttagtgcagtgattaaaatgctgcctaaaattattgaacaactaagagaaaacggaaaacaaattgatgttgtagtgattgaaacaatccaaaagttacgtgatatcactatggacgacatcatggacggtaaatcaaagaaaccgacatttaatgattggggcgagtgtgctacacgcattgtaagtatttatcgttatatttctaaattacaagaacattatcaatttcatcttgctataagcggacacgagggcattaacaaagacaaagatgatgagggaagtactatcaatccaacaatcacgatagaggcacaagaccaaataaaaaaagcagtcatcagtcaatctgacgtgttagcaagaatgacaatagaagaacatgagcaagacggcgaaaaaacttatcaatatgtacttaacgctgaaccatcaaatttattcgagacaaagataagacactcaagcaacatcaaaattaacaacaaacgtttcattaatccaagtattaacgatgttgtacaagcaattagaaatggtaat

SEQ ID NO: 1516 - protein, 259 aa, Staphylococcus aureus
MTEKTNQDVDILTQLGVKDISKQNANKFYKFAIYGKFGTGKTTFLTKDNNALVLDINEDGTTVTEDGAVVQIKNYKHFSAVIKMLPKIIEQLRENGKQIDVVVIETIQKLRDITMDDIMDGKSKKPTFNDWGECATRIVSIYRYISKLQEHYQFHLAISGHEGINKDKDDEGSTINPTITIEAQDQIKKAVISQSDVLARMTIEEHEQDGEKTYQYVLNAEPSNLFETKIRHSSNIKINNKRFINPSINDVVQAIRNGN

SEQ ID NO: 1517 - DNA, 552 bp, Staphylococcus aureus
atgaaaatcactggtagaacacaatacattcaagaaactaatcaagaggcattcatgaaaggtggggactttttaggagctggagaatttacagtaaaagttgcaaatgtcgagtttaacgacagagaaaacagatacttcacgattgtttttgaaaacaacgaaggtaaacaatacaaacacaaccaattcgtcccaccattccaacaagattatcaagaaaaacaatatatcgagttacttagtagattaggaattaaattgaacttaccagatttaacttttgacacagatcaattaattaacaaaatcggaactattgtacttaaaaataaatttaacgaggaacaaggcaagtattttgtaagactctcatatgtaaaagtttggaataaagacgatgaagtagttaataaaccagaacctaaaactgatgagatgaaacaaaaagaacagcaagcaaatgggaaacagacgccaatgagtcaacaatcaaacccattcgctaatgctaatggtccaatagaaatcaatgatgatgatttaccgttc

SEQ ID NO: 1518 - protein, 184 aa, Staphylococcus aureus
MKITGRTQYIQETNQEAFMKGGDFLGAGEFTVKVANVEFNDRENRYFTIVFENNEGKQYKHNQFVPPFQQDYQEKQYIELLSRLGIKLNLPDLTFDTDQLINKIGTIVLKNKFNEEQGKYFVRLSYVKVWNKDDEVVNKPEPKTDEMKQKEQQANGKQTPMSQQSNPFANANGPIEINDDDLPF

SEQ ID NO: 1519 - DNA, 690 bp, Staphylococcus aureus
atgcaatacattacaagataccagaaagacaatgacggtacttattccgtcgttgctactggtgttgaacttgaacaaagtcacattgacttactagaaaacggatatccactaaaagcagaagtagaggttccggacaataaaaaactatctatagaacaacgcaaaaaaatattcgcaatgtgtagagatatagaacttcactggggcgaaccagtagaatcaactagaaaattattacaaacagaattggaaattatgaaaggttatgaagaaatcagtctgcgcgactgttctatgaaagttgcaagggagttaatagaactgattatagcgtttatgtttcatcatcaaatacctatgagtgtagaaacgagtaagttgttaagcgaagataaagcgttattatattgggctacaatcaaccgcaactgtgtaatatgcggaaagcctcacgcagacctggcacattatgaagcagtcggcagaggcatgaacagaaacaaaatgaatcactacgacaaacatgtgttagcactgtgtagacaacatcataatgaacagcacgcaattggcgttaagtcgtttgatgataaatatcacttgcatgactcgtggataaaagttgatgagaggctcaacaaaatgctgaaaggagaaaacaatgggagaagtatcgtggataaaact

SEQ ID NO: 1520 - protein, 230 aa, Staphylococcus aureus
  MISC_FEATURE (1)..(230): hypothetical protein
MQYITRYQKDNDGTYSVVATGVELEQSHIDLLENGYPLKAEVEVPDNKKLSIEQRKKIFAMCRDIELHWGEPVESTRKLLQTELEIMKGYEEISLRDCSMKVARELIELIIAFMFHHQIPMSVETSKLLSEDKALLYWATINRNCVICGKPHADLAHYEAVGRGMNRNKMNHYDKHVLALCRQHHNEQHAIGVKSFDDKYHLHDSWIKVDERLNKMLKGENNGRSIVDKT

SEQ ID NO: 1521 - DNA, 804 bp, Staphylococcus aureus
atgggagaagtatcgtggataaaacttaaagttggcatgtttgatgacagcaaaatcaaatatatcgaagctttacccgaaagagatacgatcataactatttgggttaagttactaactttatcaggaaagtacaatgaacaaggttatattatgctatccgaaaacttgccgtacaacgaagaaatgttagcaaatgaatttaatagacctattaactcaataaggttagcaattcaaacttttgagacattgggcatgattgaaaaagttaatggtgtcataaaagtgacaaactgggagaagcatcaaagcttagatagcaaagctaagcataaagaaaaaaataaattgcgacaacaacgctatcgtgagaaacagaaaaagttactagaagcaaaacgtaacgttaccgtaacgttacgtaacgatacagaagaagaagaagaaagagaagaagaaaaagaagaagaatataagaataaagaagaagaaagagaagccgtcttctcatcttcaataaaatatataattgcaaatttggatgataagttaacacctaatcaaatggaacaattagggtttgctattgatgatataggtacaaacgcttttgaagttgtaaaagtaggtgttgagtacactaaaagcaaaagtgcgcatggtggctatttaattaaagttttaaacaactgggctaaagagaatgtcaaaacaaaagaagatgcagaaaataaaatagcacctagaaaaaatactactgatgatgtcattgcacaaatggaaaaagaattgagtgatgac

SEQ ID NO: 1522 - protein, 268 aa, Staphylococcus aureus
MGEVSWIKLKVGMFDDSKIKYIEALPERDTIITIWVKLLTLSGKYNEQGYIMLSENLPYNEEMLANEFNRPINSIRLAIQTFETLGMIEKVNGVIKVTNWEKHQSLDSKAKHKEKNKLRQQRYREKQKKLLEAKRNVTVTLRNDTEEEEEREEEKEEEYKNKEEEREAVFSSSIKYIIANLDDKLTPNQMEQLGFAIDDIGTNAFEVVKVGVEYTKSKSAHGGYLIKVLNNWAKENVKTKEDAENKIAPRKNTTDDVIAQMEKELSDD

SEQ ID NO: 1523 - DNA, 354 bp, Staphylococcus aureus
atgccgatgagcaaaacacaagcattagaaattattaaaaaagttaggtacgtatacaacattgattttgataaaccgaagttagaaatgtggattgatgtattaagtcaaaatggagattatcaaccaactgtaaaagcggtagatgtttatatcaacagtaacaacccgtacccgcctaacttaccagcaatcatgcgtaaggaacctaaaaaagtatctatcgagccagtagataacgaaaccgctacacaccaatggaaaatgcagaatgaccccgaatatgtcagacaaagaaaaatagcgctagataagttcatgaataagttggcagaatttgggggcgaaaacgaa

SEQ ID NO: 1524 - protein, 118 aa, Staphylococcus aureus
MPMSKTQALEIIKKVRYVYNIDFDKPKLEMWIDVLSQNGDYQPTVKAVDVYINSNNPYPPNLPAIMRKEPKKVSIEPVDNETATHQWKMQNDPEYVRQRKIALDKFMNKLAEFGGENE

SEQ ID NO: 1525 - DNA, 1239 bp, Staphylococcus aureus
atgaattacggacaattcgaaattgaaagtacaataatcgctacgctacttaaacaaccggacgtattagaaaagataagagttaaagattacatgtttacgaacgaaaagtttaaaacctttttcaattatgtaatggacgtcggaaagatagatcatcaagaaatctatttaaaagcaactaaagataaagaatttttagatgcagatactataactaaactttacaactccgatttcattggatatggcttctttgaacgttatcaacaagaattattggaaagttatcagctcaacaaagctaacgaattggtaactgagttcaaacaacaacctacgaaccaaaactttaacaacttgattgatgaactcaaggatttaaaaacaattactaacaaaaaagaagatggaaccaagaagtttgttgaggagtttgtcgaagagttatacagcgatagccctaagaagcaaattaagacgggttacaagctaatggattacaaaatagggggattagaaccatcacaattaatcgtcatcgcagcgcgtccctcagtgggtaagacaggttttgcattaaacatgatgctgaacatagcacaaaatggatacaaaacatctttctttagtctcgaaacaaccggcacatcggtattgaaacgtatgttatcaacaattactggtattgagttaacaaagataaaagaaatcaggaacttaacgccggatgacttaacaaagttaacgaatgcgatggataaaatcatgaaattaggcatcgatatttctgataaaagtaatatcacaccgcaagatgtgcgagcgcaagcaatgaggcattcagacaggcaacaagttatttttatagattatcttcaactgatggatactgatgcgaaagttgatagacgtgtagcagtagaaaagatatcacgtgacttaaagataatcgctaacgagacaggcgcaatcatcgtactactttcacaactgaatcgtggtgtcgagtctagacaggataaaagaccaatgctatcggacatgaaagaatcaggcggaatagaagcagatgcgagtttagcgatgctactttaccgtgatgattattataaccgtgacgaagatgacagtatcactggcaaatctattgttgaatgtaacatagccaaaaacaaagacggcgaaaccggaataattgaatttgagtattacaagaagactcagaggtttttcaca

SEQ ID NO: 1526 - protein, 413 aa, Staphylococcus aureus
  MISC_FEATURE (1)..(413): replicative DNA helicase
MNYGQFEIESTIIATLLKQPDVLEKIRVKDYMFTNEKFKTFFNYVMDVGKIDHQEIYLKATKDKEFLDADTITKLYNSDFIGYGFFERYQQELLESYQLNKANELVTEFKQQPTNQNFNNLIDELKDLKTITNKKEDGTKKFVEEFVEELYSDSPKKQIKTGYKLMDYKIGGLEPSQLIVIAARPSVGKTGFALNMMLNIAQNGYKTSFFSLETTGTSVLKRMLSTITGIELTKIKEIRNLTPDDLTKLTNAMDKIMKLGIDISDKSNITPQDVRAQAMRHSDRQQVIFIDYLQLMDTDAKVDRRVAVEKISRDLKIIANETGAIIVLLSQLNRGVESRQDKRPMLSDMKESGGIEADASLAMLLYRDDYYNRDEDDSITGKSIVECNIAKNKDGETGIIEFEYYKKTQRFFT

SEQ ID NO: 1527 - DNA, 177 bp, Staphylococcus aureus
atgtatgaagagacaaagcaaagcgacccgattgtagcaaatgtatatatcgagactggttgggcggtcaatagattgttggacaataacgagttatcgcctttcgatgattacgacagagttgaaaagaaaatcatgaatgaaatcaactggaagaaaacacacattaaggagtgt

SEQ ID NO: 1528 - protein, 59 aa, Staphylococcus aureus
MYEETKQSDPIVANVYIETGWAVNRLLDNNELSPFDDYDRVEKKIMNEINWKKTHIKEC

SEQ ID NO: 1529 - DNA, 219 bp, Staphylococcus aureus
atgccgaaagaaaaatattacttataccgagaagatggcacggaagatattaaggtcatcaagtataaagacaacgtaaatgaagtttattcgctcacaggagcccatttcagcgacgaaaagaaaattatgactgatagtgacctaaaacgattcaaaggcgctcacgggcttctatatgagcaagagctaggattgcaagcaacgatatttgatatt

SEQ ID NO: 1530 - protein, 73 aa, Staphylococcus aureus
  MISC_FEATURE (1)..(73): hypothetical protein
MPKEKYYLYREDGTEDIKVIKYKDNVNEVYSLTGAHFSDEKKIMTDSDLKRFKGAHGLLYEQELGLQATIFDI

SEQ ID NO: 1531 - DNA, 423 bp, Staphylococcus aureus
ttgatatttagaggtggcacaatgagtaaatacaatgctaagaaagttgagtacaaaggaattgtatttgatagcaaagtagagtgcgaatattaccaatatttagaaagtaatatgaatggcactaactatgatcgtatcgaaatacaaccgaaatttgaattacaacctaaattcgggaaacaaagaccgattacgtatatagccgatttctctttgtggaaggaagggaaactggttgaagttatagacgttaaaggtaaggcgactgaagttgccaacatcaaagcgaagatattcagatatcagtatagagatgtgaatttaacgtggatatgtaaagcgcctaaatacacaggtcaagaatggatggtatatgaggacttagtgaaagtcagacgtaaaagaaaaagagaaatgaag

SEQ ID NO: 1532 - protein, 141 aa, Staphylococcus aureus
  MISC_FEATURE (1)..(141): hypothetical protein
LIFRGGTMSKYNAKKVEYKGIVFDSKVECEYYQYLESNMNGTNYDRIEIQPKFELQPKFGKQRPITYIADFSLWKEGKLVEVIDVKGKATEVANIKAKIFRYQYRDVNLTWICKAPKYTGQEWMVYEDLVKVRRKRKREMK

SEQ ID NO: 1533 - DNA, 183 bp, Staphylococcus aureus
atgcaacaacaagcatatataaacgcaacgattgatataagaatacctacagaagttgaatatcagcattacgatgatgtggataaagaaaaagatacgctggcaaagcgcttagatgacaatccggacgaattactaaagtatgacaacataacaataagacatgcatatatagaggtggaa

SEQ ID NO: 1534 - protein, 61 aa, Staphylococcus aureus
MQQQAYINATIDIRIPTEVEYQHYDDVDKEKDTLAKRLDDNPDELLKYDNITIRHAYIEVE

SEQ ID NO: 1535 - DNA, 594 bp, Staphylococcus aureus
ttgacgatatttcttaacttttatatgattaatcggaatgaaaaaagagaagtaggtggcaatatgaagtcaaataaatcgcttgctatgattgtggtagccatcattattgtaggtgtattagcatttcaatttatgaatcatacgggtcctttcaaaaaggggacgaatcatgaaactgtacaagatttaaatggtaaagataaagtacatgttcaaagagttgtggatggtgatacatttattgcaaatcaaaatggtaaagaaattaaagttaggcttataggggttgatacgccagaaacggtgaaaccgaatacgcctgtacaaccatttggcaaagaagcatcaaattatagtaagaagacattaacaaatcaagatgtttatttagaatatgataaagaaaaacaagatcgctatggtagaacattggcgtatgtatggataagtaaagatcgtatgtacaataaggaattagtggaaaagggacttgctagagagaagtatttttcaccaaatggcaaatatagaaatgtatttatagaagcacaaaataaagctaaacaacagaaattaaatatttggagtaaa

SEQ ID NO: 1536 - protein, 198 aa, Staphylococcus aureus
  MISC_FEATURE (1)..(198): thermonuclease
LTIFLNFYMINRNEKREVGGNMKSNKSLAMIVVAIIIVGVLAFQFMNHTGPFKKGTNHETVQDLNGKDKVHVQRVVDGDTFIANQNGKEIKVRLIGVDTPETVKPNTPVQPFGKEASNYSKKTLTNQDVYLEYDKEKQDRYGRTLAYVWISKDRMYNKELVEKGLAREKYFSPNGKYRNVFIEAQNKAKQQKLNIWSK

SEQ ID NO: 1537 - DNA, 186 bp, Staphylococcus aureus
atgaacatttcaaatgaaaatacagtcacattaattgcagtaattatcgcaattatcattggtattttcctacaaatatttttcaaattaccattaatagtgacggcagtactatctattttattgggtatctttgtaggctttatcgtttacttgattgtttcgttttataataagcgaaaaaat

SEQ ID NO: 1538 - protein, 62 aa, Staphylococcus aureus
  MISC_FEATURE (1)..(62): hypothetical protein
MNISNENTVTLIAVIIAIIIGIFLQIFFKLPLIVTAVLSILLGIFVGFIVYLIVSFYNKRKN

SEQ ID NO: 1539 - DNA, 267 bp, Staphylococcus aureus
atgaagttgaacgaagtattcgcaactaatttaagggtaatcatggctagagataacgtaagtgtccaagatttgcacaatgaaactggcgtatcaagatcaactattagtggatataaaaacggaaaagctgagatggttaacttaaatgtattagataaattggcagatgctctaggtgttaatgtaagtgaactatttactagaaatcacaacacgcacaaattagaggattggattaaaaaaagtaaatgtatagaggtggaa

SEQ ID NO: 1540 - protein, 89 aa, Staphylococcus aureus
MKLNEVFATNLRVIMARDNVSVQDLHNETGVSRSTISGYKNGKAEMVNLNVLDKLADALGVNVSELFTRNHNTHKLEDWIKKSKCIEVE

SEQ ID NO: 1541 - DNA, 357 bp, Staphylococcus aureus
atgagtatcgtaaagattaacggtaaaccatataaatttaccgaacatgaaaatgaattgataaaaaagaacggtttaactccaggaatggttgcaaaaagagtacgaggtggctgggcgttgttagaagccttacatgcaccttatggtatgcgcttagctgagtataaagaaattgtgttatccaaaatcatggagcgagagagcaaagagcgtgaaatggctaggcaacgacgtaaagaggctgaactacgtaagaagaagccacatttgtttaatgtgcctcaaaaacattcacgtgatccgtactggtttgatactacttataaccaaatgtttaagaaatggcaggaagca

SEQ ID NO: 1542 - protein, 119 aa, Staphylococcus aureus
  MISC_FEATURE (1)..(119): hypothetical protein
MSIVKINGKPYKFTEHENELIKKNGLTPGMVAKRVRGGWALLEALHAPYGMRLAEYKEIVLSKIMERESKEREMARQRRKEAELRKKKPHLFNVPQKHSRDPYWFDTTYNQMFKKWQEA

SEQ ID NO: 1543 - DNA, 246 bp, Staphylococcus aureus
atgcctaaaaccgatagcgcatgtaaagaatacttaaaccaatttttcggatctaagagatatctgtatcaggataacgaacgagtggcacatatccatgtagtgaacggcacttattactttcatgggcatatcgtgccaggttggcaaggcgtgaaaaagacatttgatacagcggaagagctcgaaacatatataaagcaacatggtttggaatacgaggagcagaagcaactaactttattt

SEQ ID NO: 1544 - protein, 82 aa, Staphylococcus aureus
  MISC_FEATURE (1)..(82): hypothetical protein
MPKTDSACKEYLNQFFGSKRYLYQDNERVAHIHVVNGTYYFHGHIVPGWQGVKKTFDTAEELETYIKQHGLEYEEQKQLTLF

SEQ ID NO: 1545 - DNA, 252 bp, Staphylococcus aureus
atggaaatgatgaataaccgcgaacaaattgaacaatcagtgatcagtgctagtgcgtataacggtaatgacacagagggattactaaaagagattgaggacgtgtataagagagcacaagcgtttgatgaaatacttgagggaatgacaaatgctattcaacattcagttaaagaaggtattgaacttgatgaagcagtagggattatggcaggtcaagttgtctataaatatgaggaggaacaaggaaaa

SEQ ID NO: 1546 - protein, 84 aa, Staphylococcus aureus
  MISC_FEATURE (1)..(84): hypothetical protein
MEMMNNREQIEQSVISASAYNGNDTEGLLKEIEDVYKRAQAFDEILEGMTNAIQHSVKEGIELDEAVGIMAGQVVYKYEEEQGK

SEQ ID NO: 1547 - DNA, 240 bp, Staphylococcus aureus
atgagtaataaaagtaattcagaaataatcaaaagagtattagaaacgagcaaaagcgacataaatatttgggatgtactaagcgagtttgacagtgaacaagaggaagaaatacttgattttatagatgagaacattgaagaatttgaaatattcctcaataccgcactaattcatattgttgaaagattgaaattgagaatagcgtttgctacagctagggaggagcaggaaaatgac

SEQ ID NO: 1548 - protein, 80 aa, Staphylococcus aureus
MSNKSNSEIIKRVLETSKSDINIWDVLSEFDSEQEEEILDFIDENIEEFEIFLNTALIHIVERLKLRIAFATAREEQEND

SEQ ID NO: 1549 - DNA, 507 bp, Staphylococcus aureus
atgactaacacattacaagtaaggctattatcagaaaatgctagaatgcccgaacgaaatcataagacggatgcaggttatgacatattctcagctgaaactgtcgtacttgagccacaagaaaaggcagtgattaaaacagatgtagctgtaagcataccagagggctatgtcggactattaactagccgtagtggtgtaagtagtaaaacgcatttagtgattgaaacaggcaagatagacgcgggatatcacggcaatttagggattaatatcaagaatgacgctattgcatcgaatggttatatcacaccaggtgtttttgatattaaaggagaaatcgatttgagtgacgccataagacaatacggaacttatcaaatcaacgaaggagacaaactagctcaattggttatcgtgcctatatggacacctgaactaaagcaagtggaggaattcgaaagtgtttcagaacgtggagaaaaaggcttcggaagtagcggagtg

SEQ ID NO: 1550 - protein, 169 aa, Staphylococcus aureus
  MISC_FEATURE (1)..(169): dUTP pyrophosphatase
MTNTLQVRLLSENARMPERNHKTDAGYDIFSAETVVLEPQEKAVIKTDVAVSIPEGYVGLLTSRSGVSSKTHLVIETGKIDAGYHGNLGINIKNDAIASNGYITPGVFDIKGEIDLSDAIRQYGTYQINEGDKLAQLVIVPIWTPELKQVEEFESVSERGEKGFGSSGV

SEQ ID NO: 1551 - DNA, 243 bp, Staphylococcus aureus
gtgagttacatcattacattagttccaatacttgtattcatagtaatatttaacaatttacttaacagatatatggttttgtacaaagaattagatttatttacatgcagaattggaatgttattagtcttaatcgttatagtagattttgcaaagcaaaaaaatatgttggctacattgagtgttgtactaatacttttattcgtagaaaaacttagaatcattcaaaggagtgataagaag

SEQ ID NO: 1552 - protein, 81 aa, Staphylococcus aureus
VSYIITLVPILVFIVIFNNLLNRYMVLYKELDLFTCRIGMLLVLIVIVDFAKQKNMLATLSVVLILLFVEKLRIIQRSDKK

SEQ ID NO: 1553 - DNA, 186 bp, Staphylococcus aureus
gtgacgcaatacttagtcacaacattcaaagattcaacaggacaaccacatgaacattttactactgctagagataatcagacgtttacagttgttgaggcagagagtaaagaagaagctgagcgcaaatacgaggcacaagttaagataaggagagatggagatgccaaagaaaacggtaacgat

SEQ ID NO: 1554 - protein, 62 aa, Staphylococcus aureus
  MISC_FEATURE (1)..(62): hypothetical protein
VTQYLVTTFKDSTGQPHEHFTTARDNQTFTVVEAESKEEAERKYEAQVKIRRDGDAKENGND

SEQ ID NO: 1555 - DNA, 204 bp, Staphylococcus aureus
atggagatgccaaagaaaacggtaacgattgatgtagatgaaaacttattagtagtagctagtaatgaaatatcagaactattatatgaatatgacagtgagttaatgtcagctgatgaagatggcgataatagagatatcaaagaaaaaagagacgcattaaaacaagctatacaaattatcgataaattaacatggggtgtt

SEQ ID NO: 1556 - protein, 68 aa, Staphylococcus aureus
MEMPKKTVTIDVDENLLVVASNEISELLYEYDSELMSADEDGDNRDIKEKRDALKQAIQIIDKLTWGV

SEQ ID NO: 1557 - DNA, 186 bp, Staphylococcus aureus
atggggtgtttagtggtggttaaagaaattttgagactattattcttactagcgatgtatgagttaggtaagtatgtaactgagcaagtatatattatgatgacggctaatgatgatgtagaggcgccaagtgacttcgcaaagttgagtgatcagtctgatttgatgagggcggaggtgtcggag

SEQ ID NO: 1558 - protein, 62 aa, Staphylococcus aureus
  MISC_FEATURE (1)..(62): int gene activator RinB
MGCLVVVKEILRLLFLLAMYELGKYVTEQVYIMMTANDDVEAPSDFAKLSDQSDLMRAEVSE

SEQ ID NO: 1559 - DNA, 144 bp, Staphylococcus aureus
atgatgtggttaatcatagcaattatattactagtcatcttattgtttggtgtgatgttacaagcggaacagttaaaaggtgatgtaaaagttaaagagcgagagatagagatattaagaagtagattgagacactttgaagat

SEQ ID NO: 1560 - protein, 48 aa, Staphylococcus aureus
  MISC_FEATURE (1)..(48): hypothetical protein
MMWLIIAIILLVILLFGVMLQAEQLKGDVKVKEREIEILRSRLRHFED

SEQ ID NO: 1561 - DNA, 420 bp, Staphylococcus aureus
atgactaaaaagaaatacggattaaaattatcaacagttcgaaagttagaagatgagttgtgtgattatcctaattatcataaacaacttgaagatttaagaagtgaaataatgacaccgtggattccaacagatacaaatataggcggggagtttgtaccgtctaatacatcgaaaacagaaatggcagtaactaattatctttgtagtatacgaagaggtaaaatccttgagtttaagagcgctattgaacgtataatcaacacatcaagcaggaaagaacgcgaattcattcaagagtattattttaataaaaaggaattagtgaaagtttgtgttgacatacacatttctgatagaactgctcatagaatcaaaagaaaaatcatatctagattggcggaagagttaggggaagac

SEQ ID NO: 1562 - protein, 140 aa, Staphylococcus aureus
  MISC_FEATURE (1)..(140): hypothetical protein
MTKKKYGLKLSTVRKLEDELCDYPNYHKQLEDLRSEIMTPWIPTDTNIGGEFVPSNTSKTEMAVTNYLCSIRRGKILEFKSAIERIINTSSRKEREFIQEYYFNKKELVKVCVDIHISDRTAHRIKRKIISRLAEELGED

SEQ ID NO: 1563 - DNA, 507 bp, Staphylococcus aureus
ttggctgattatagccaatccttttttaattttaaaaagcgtatagcgcgagagttggtggtaaatgaaatgaacgaaaaacaaaagagattcgcagatgaatatataatgaatggatgtaatggtaaaaaagcagcaattacagcaggttatagtaagaaaacagcagagtctttagcaagtcgattgttaagaaatgttaatgtttcggaatatattaaagaacgattagaacagatacaagaagagcgtttaatgagtattacagaagctttagcgttatctgcttctattgctagaggagaacctcaagaggcttacagtaagaaatatgaccatttaaacgatgaagtggaaaaagaggttacttacacaatcacaccaacttttgaagagcgtcagagatctattgaccacatactaaaagtacatggtgcgtatatcgataaaaaagaaattactcagaagaatattgagattaatattggtgagtacgatgacgaaagt

SEQ ID NO: 1564 - protein, 169 aa, Staphylococcus aureus
  MISC_FEATURE (1)..(169): hypothetical protein
LADYSQSFFNFKKRIARELVVNEMNEKQKRFADEYIMNGCNGKKAAITAGYSKKTAESLASRLLRNVNVSEYIKERLEQIQEERLMSITEALALSASIARGEPQEAYSKKYDHLNDEVEKEVTYTITPTFEERQRSIDHILKVHGAYIDKKEITQKNIEINIGEYDDES

SEQ ID NO: 1565 - DNA, 1299 bp, Staphylococcus aureus
ttgagattaatattggtgagtacgatgacgaaagttaaattaaactttaacaaaccgtctaatgttttcaatagaaacatattcgaaatactaaccaattacgataacttcactgaagtacattacggtggaggttcgagcggtaagtctcacggcgttatacaaaaagttgtactcaaagcattgcaagattggaaatatcctaggcgtatactgtggcttagaaaagtacaatcaacaattaaagatagtttgttcgaagatgttaaagattgtttgataaactttggtatttgggacatgtgcctttggaataagactgataacaaagttgaattgccaaacggcgcagtttttttgtttaaaggattagataacccagagaaaataaagtcgataaaaggcatatcagacatagtcatggaagaagcgtctgaattcacactaaatgattacacgcaattaacgttgcgtttgagggagcgtaaacacgtgaataagcaaatatttttgatgtttaacccagtatctaaactgaattgggtttataagtatttctttgaacatggtgaaccaatggaaaatgtcatgattagacaatctagttatcgagataataagtttcttgatgaaatgacacgacaaaacttagagttgttagcaaatcgtaatccagcatattacaaaatttatgcgttaggtgaatttgctacactagacaaattggttttccctaagtatgaaaaacgtttaataaataaagatgagttaagacatttaccttcttattttggattggactttggctacgttaatgatcctagtgcttttatacattctaaaatagatgtaaagaaaaagaagttatacatcattgaagagtatgttaaacaaggtatgctgaatgatgaaatagctaatgtcataaagcaacttggttatgctaaagaagaaattacagcagatagtgcagaacaaaaaagtatagctgaattaaggaatctagggcttaaaaggattttaccaaccaaaaaagggaagggctcggttgtacaagggttacaattcttaatgcaatttgaaatcattgttgatgaacgttgtttcaagactattgaagagtttgacaactacacatggcaaaaggacaaagatacaggtgaatataccaatgaaccagtagatacatacaatcattgtatcgattcgttgcgttattcagtggaacgattctacagaccggttagaaaacgcacaaatctcagttcgaaagttgacacaataaaatctctaggatta

SEQ ID NO: 1566 - protein, 433 aa, Staphylococcus aureus
  MISC_FEATURE (1)..(433): hypothetical protein
LRLILVSTMTKVKLNFNKPSNVFNRNIFEILTNYDNFTEVHYGGGSSGKSHGVIQKVVLKALQDWKYPRRILWLRKVQSTIKDSLFEDVKDCLINFGIWDMCLWNKTDNKVELPNGAVFLFKGLDNPEKIKSIKGISDIVMEEASEFTLNDYTQLTLRLRERKHVNKQIFLMFNPVSKLNWVYKYFFEHGEPMENVMIRQSSYRDNKFLDEMTRQNLELLANRNPAYYKIYALGEFATLDKLVFPKYEKRLINKDELRHLPSYFGLDFGYVNDPSAFIHSKIDVKKKKLYIIEEYVKQGMLNDEIANVIKQLGYAKEEITADSAEQKSIAELRNLGLKRILPTKKGKGSVVQGLQFLMQFEIIVDERCFKTIEEFDNYTWQKDKDTGEYTNEPVDTYNHCIDSLRYSVERFYRPVRKRTNLSSKVDTIKSLGL

SEQ ID NO: 1567 - DNA, 1533 bp, Staphylococcus aureus
atgttaaaagtaaacgaatttgaaacagatacagatctacggggaaacataaattacttatttaatgatgaagccaatgttgtttacacatatgacgggacggaatccgatttattacaaaacgttaatgaagtaagtaaatacattgaacatcacatggattaccaacgacctagattgaaagtgttaagtgattattacgaaggtaaaactaagaacttagttgagttaacacgacgcaaagaagagtacatggcagataaccgtgtagcgcatgattacgcatcttatattagcgattttatcaacggctatttcttgggtaatccaattcaatatcaagatgatgacaaagatgtattagaagttattgaggcgttcaatgatttaaatgatgttgagtcacacaatagatctttaggattagatttgtcaatttatggcaaagcttatgagttaatgattagaaaccaagatgatgaaacgcgtttatacaagagtgatgcaatgagtacttttgtcatatacgacaatacaattgaacgtaatagtatcgcaggcgttagatatttaagaactaaaccaatagacaagactgacgaagatgaagtgtttacagttgatttattcacttcacacggtgtttatagatatcttaccagtagaacaaatggattgaagctcacaccacgtgaaaacggttttgaatcacactctttcgaacgtatgcctattacagaatttagcaacaacgaaagaagaaaaggggattatgagaaagtaatcactttaattgatttgtatgataatgctgaatcagatactgctaactatatgagtgatttaaatgacgctatgttacttattaaaggtaatttaaatttagatcctgtagaagttagaaaacaaaaggaagctaacgtgttgtttttagaaccgactgtttatgctgatagcgaaggtagagaaacagaaggctctgttgatggtggttatatttataagcaatacgatgtacaaggtaccgaagcttataaagaccgtttaaacagtgatatacacatgtttaccaacacgcctaacatgaaagatgataactttagcggcactcaatcgggcgaggcaatgaaatacaaattatttggattggaacaacgtactaaaactaaagaaggattgtttactaaagggttaagacgtcgtgctaagttgttagagacaatacttaaaaatacatggtcgattgacgctaacaaagatttcaatactgttagatacgtatacaacagaaacttacctaaatcattgattgaagaattaaaagcttatattgattctggtgggaagattagccaaacaactttaatgtctctattctcgttcttccaagaccctgaattagaagttaagaaaatcgaagaagatgagaaagaatctattaaaaaagctcaaaaaggtatttataaagaccctagagacatcaatgatgacgaacaagatgatgatacaaaagatactgttgataaaaaggaa

SEQ ID NO: 1568 - protein, 511 aa, Staphylococcus aureus
  MISC_FEATURE (1)..(511): hypothetical protein
MLKVNEFETDTDLRGNINYLFNDEANVVYTYDGTESDLLQNVNEVSKYIEHHMDYQRPRLKVLSDYYEGKTKNLVELTRRKEEYMADNRVAHDYASYISDFINGYFLGNPIQYQDDDKDVLEVIEAFNDLNDVESHNRSLGLDLSIYGKAYELMIRNQDDETRLYKSDAMSTFVIYDNTIERNSIAGVRYLRTKPIDKTDEDEVFTVDLFTSHGVYRYLTSRTNGLKLTPRENGFESHSFERMPITEFSNNERRKGDYEKVITLIDLYDNAESDTANYMSDLNDAMLLIKGNLNLDPVEVRKQKEANVLFLEPTVYADSEGRETEGSVDGGYIYKQYDVQGTEAYKDRLNSDIHMFTNTPNMKDDNFSGTQSGEAMKYKLFGLEQRTKTKEGLFTKGLRRRAKLLETILKNTWSIDANKDFNTVRYVYNRNLPKSLIEELKAYIDSGGKISQTTLMSLFSFFQDPELEVKKIEEDEKESIKKAQKGIYKDPRDINDDEQDDDTKDTVDKKE

SEQ ID NO: 1569 - DNA, 993 bp, Staphylococcus aureus
ttgcctaacaaaaacactcaagaatattgggaagaacgcggacgcaaagcaatcgagaatgagttgaagcgtgataaaactaaagctgaagaaatagaacgtatattgaatatgatgattaagcgcattgaaaaagagatcaatgcgtttattgtcaagtacggagattttgcaggcgttacattacaagaagcacaaaagattattgatgagttcgatgtaaaagcgtttcaagaagaagcaaaaagattggtcgaaaacaaggagtttagcgatagagcaaatgaagaattaaagaagtataacacgaaaatgtatgtatctagagaacagatgttaaagattcaaatagaattcttaattgcttatgcaacagctcaaacagaattatcgatgagggaatatttcgaatcaacagcttatcgtgtgttcagtgatcaagcgggtattttaggtgaaggtgtacaagtagctaaagaagttatagatacaatcgttgatacacaatttcatggtgtcgtttggtcagagcgattatggactaataccgaagcaatgaaacaagaagtagaagaaataattgctaatgtagttattagaggtcgacatcctaatgaatatgttaaagatatgcgcaagcacttaaataaattcgaaggcacagcacgacaaaagaccgcagcaattaaatcattgctttatacggaatcggcacgtgttcacgcacaatcaagcattgacagcatgaaagaaatttcaccggaaggatattatatgtatattgcaaaaatcgataatagaacaactaaagtatgcaaagggcttaatggagaaatattcaaagttaaagacgctaaaattggtgttaatttctatcctatgcatatcaattgtcgttcagattgcgctttactacctaaatctatgtggccgaaaaaaccaagcaagaaacgaaaaacaaaatacttcggagggaaagtgaaaagcggtgat

SEQ ID NO: 1570 - protein, 331 aa, Staphylococcus aureus
  MISC_FEATURE (1)..(331): hypothetical protein
LPNKNTQEYWEERGRKAIENELKRDKTKAEEIERILNMMIKRIEKEINAFIVKYGDFAGVTLQEAQKIIDEFDVKAFQEEAKRLVENKEFSDRANEELKKYNTKMYVSREQMLKIQIEFLIAYATAQTELSMREYFESTAYRVFSDQAGILGEGVQVAKEVIDTIVDTQFHGVVWSERLWTNTEAMKQEVEEIIANVVIRGRHPNEYVKDMRKHLNKFEGTARQKTAAIKSLLYTESARVHAQSSIDSMKEISPEGYYMYIAKIDNRTTKVCKGLNGEIFKVKDAKIGVNFYPMHINCRSDCALLPKSMWPKKPSKKRKTKYFGGKVKSGD

SEQ ID NO: 1571 - DNA, 183 bp, Staphylococcus aureus
ttggaggatactaatatgagtaatactgacaaataccttagagacatagcaagagaattaaaaggtatacgtaaagagttacaaaagcgaaacgaaacagttattattgatgcaaacttagacagtttaaggtcggcagtattagccgataaagaaaaatcgaaatataatgaacctctcttt

SEQ ID NO: 1572 - protein, 61 aa, Staphylococcus aureus
  MISC_FEATURE (1)..(61): hypothetical protein
LEDTNMSNTDKYLRDIARELKGIRKELQKRNETVIIDANLDSLRSAVLADKEKSKYNEPLF

SEQ ID NO: 1573 - DNA, 618 bp, Staphylococcus aureus
atggaagaaaataaacttaagtttaatttgcaattttttgcagaccaatcagatgatccggacgaaccaggcggagatggtaaaaaaggaaatcctgataagaaagaaaatgacgaaggtactgaaataactttcacgccagagcaacaaaagaaagttgatgaaatacttgaacgtcgtgtagcccacgaaaagaaaaaagctgatgagtatgcaaaagaaaaagcagcagaagctgctaaagaagctgctaaattagcgaaaatgaacaaggatcaaaaagatgaatatgaacgcgaacaaatggaaaaagaactggaacaattacgttcagaaaaacaattaaacgaaatgcgttcagaagcacgaaaaatgttgagtgaagcggaagttgattcatcagatgaggttgtcaatttagttgtaacagatactgctgaacaaactaaattgaatgttgaagctttttctaatgcagtaaaaaaagcggttaatgaagcggttaaggttaacgctagacaatcgccattgactggtggagattcatttaatcactcgactaaaaataaaccgcaaaacttagctgaaatagctagacaaaaaagaattattaaaaat

SEQ ID NO: 1574 - protein, 206 aa, Staphylococcus aureus
  MISC_FEATURE (1)..(206): hypothetical protein
MEENKLKFNLQFFADQSDDPDEPGGDGKKGNPDKKENDEGTEITFTPEQQKKVDEILERRVAHEKKKADEYAKEKAAEAAKEAAKLAKMNKDQKDEYEREQMEKELEQLRSEKQLNEMRSEARKMLSEAEVDSSDEVVNLVVTDTAEQTKLNVEAFSNAVKKAVNEAVKVNARQSPLTGGDSFNHSTKNKPQNLAEIARQKRIIKN

SEQ ID NO: 1575 - DNA, 972 bp, Staphylococcus aureus
atggaacaaacacaaaaattaaaattaaatttgcaacattttgcaagtaacaatgttaaaccacaagtatttaaccctgacaatgtaatgatgcatgaaaagaaagatggcacgttgttaaacgactttacaacacctatcttacaagaggttatggaaaactctaaaatcatgcaattaggtaagtacgaaccaatggaaggtactgagaagaagtttactttttgggctgataaaccaggtgcttactgggtaggtgaaggtcaaaaaatcgaaacgtctaaggctacttgggttaatgctacaatgagagcgtttaaattaggggttatcttaccagtaacaaaagaattcttgaattacacttattcacaattctttgaagaaatgaaacctatgattgctgaagctttctataaaaagtttgacgaggcaggtattttgaatcaaggtaacaatccgttcggtaaatcaattgcacaatcaattgaaaaaactaataaggttattaaaggtgacttcacacaagataacattattgatttagaggcattgcttgaagatgacgaattagaagcaaatgcatttatctcaaaaacacaaaacagaagcttgttacgtaaaattgtagatcctgaaacgaaagaacgtatttatgaccgtaacagtgattcgttagacggtctacctgtggttaaccttaaatcaagcaacttaaaacgtggtgaattaatcactggtgacttcgacaaattgatttatggtatccctcaattaatcgaatacaaaatcgatgaaactgcacaattatctacagttaaaaacgaagatggcacacctgtaaacttgtttgaacaagacatggtggcattacgtgcaactatgcatgtagcattgcatattgctgatgataaagcgtttgctaagttagttcctgctgacaaaagaacagattcagttccaggagaagtt

SEQ ID NO: 1576 - protein, 324 aa, Staphylococcus aureus
  MISC_FEATURE (1)..(324): hypothetical protein
MEQTQKLKLNLQHFASNNVKPQVFNPDNVMMHEKKDGTLLNDFTTPILQEVMENSKIMQLGKYEPMEGTEKKFTFWADKPGAYWVGEGQKIETSKATWVNATMRAFKLGVILPVTKEFLNYTYSQFFEEMKPMIAEAFYKKFDEAGILNQGNNPFGKSIAQSIEKTNKVIKGDFTQDNIIDLEALLEDDELEANAFISKTQNRSLLRKIVDPETKERIYDRNSDSLDGLPVVNLKSSNLKRGELITGDFDKLIYGIPQLIEYKIDETAQLSTVKNEDGTPVNLFEQDMVALRATMHVALHIADDKAFAKLVPADKRTDSVPGEV

SEQ ID NO: 1577 - DNA, 285 bp, Staphylococcus aureus
atgcccgaaatcattggaattgttaaagtagattttacagatttagaagataacagacatgtctatatgaaagggcatgtctaccctcgtaaaggttataatcctacagatgaacgtatcaaagctttagctagtgttgaaaataaacgcaacaaacaaatgatttacattgtaaatgacaaattaaccaaaaaagaacttgtcgaaatagcaagtgttgctggcttacaagttgatgaaaaacaaacaaaagctgaaattatcaatgcttttgagtcactagag

SEQ ID NO: 1578 - protein, 95 aa, Staphylococcus aureus
  MISC_FEATURE (1)..(95): hypothetical protein
MPEIIGIVKVDFTDLEDNRHVYMKGHVYPRKGYNPTDERIKALASVENKRNKQMIYIVNDKLTKKELVEIASVAGLQVDEKQTKAEIINAFESLE

SEQ ID NO: 1579 - DNA, 600 bp, Staphylococcus aureus
atgacatctttaattattgcagaagatcaaaatatgttacgacaggcaatggttcaattaattaaactacatggtgattttgaaattttagcagatactgataatggtctcgatgcaatgaaacttattgaagaatataatcctaacgttgttattttagatatagaaatgccaggcatgactggacttgaagttttagcggaaattagaaaaaagcatttgaatattaaagtgattattgtaacaacttttaaaagaccgggatactttgaaaaagcagttgtgaatgatgtggatgcatatgttttaaaagaacgttctatagaagaattggtggaaaccattaataaagtaaataacggagagaaagaatatagcgccacattgatgacttcattttttgtagataaaaacccattaacgcccaaagaacaaattgtattaagggaaattggcaatggtttaagtagtaaagaaataagtgaaaaattatttttgacagatggaacagttagaaattatacatctgttataattgataaattatttgcagataatcgttttgatgcttggaaaaaggcaaatgaaaaaggctggatc

SEQ ID NO: 1580 - protein, 200 aa, Staphylococcus aureus
  MISC_FEATURE (1)..(200): hypothetical protein
MTSLIIAEDQNMLRQAMVQLIKLHGDFEILADTDNGLDAMKLIEEYNPNVVILDIEMPGMTGLEVLAEIRKKHLNIKVIIVTTFKRPGYFEKAVVNDVDAYVLKERSIEELVETINKVNNGEKEYSATLMTSFFVDKNPLTPKEQIVLREIGNGLSSKEISEKLFLTDGTVRNYTSVIIDKLFADNRFDAWKKANEKGWI

SEQ ID NO: 1581 - DNA, 330 bp, Staphylococcus aureus
atgactacgctagctgatgtaaaaaaacgtattggtcttaaagatgaaaagcaagatgaacaattagaagaaatcataaaaagttgtgaaagccagttgttatcaatgttacctattgaagttgaacaaataccggaaaggtttagttacatgattaaagaagttgcagttaaacgctacaacaggattggtgctgaaggtatgacatcagaagcggttgacggacgtagcaatgcgtatgaattgaacgatttcaaggagtatgaagctattattgataattactttaatgctagaacgagaactaaaaaaggaagggctgtgttcttt

SEQ ID NO: 1582 - protein, 110 aa, Staphylococcus aureus
  MISC_FEATURE (1)..(110): hypothetical protein
MTTLADVKKRIGLKDEKQDEQLEEIIKSCESQLLSMLPIEVEQIPERFSYMIKEVAVKRYNRIGAEGMTSEAVDGRSNAYELNDFKEYEAIIDNYFNARTRTKKGRAVFF

SEQ ID NO: 1583 - DNA, 114 bp, Staphylococcus aureus
ttgatacaaggatatacagacacgaaacgtcatattatatcgaagaggtcaattgatgaatatagatggattagacgcactgttaaaccaatttcacgatatgaaaaccaacat

SEQ ID NO: 1584 - protein, 38 aa, Staphylococcus aureus
LIQGYTDTKRHIISKRSIDEYRWIRRTVKPISRYENQH

SEQ ID NO: 1585 - DNA, 300 bp, Staphylococcus aureus
atgaaaaccaacattgatgatgatgtagatgatattttacaggaaaacgccaaagaatatgtagtacgagctaaattgaaagctagagaagtaatgaataagggttattggactggtaatttatcacgcaatatcagatataaaaaaactggcgatttgcaatacactatcacatcgcacgcagcttatagtggtttcttagaatttggtactcgatacatggaggctgaaccttttatgtggccggtatacgaagtgattaggaaatcaactgtagaagaattgaaagcgttgtttgaa

SEQ ID NO: 1586 - protein, 100 aa, Staphylococcus aureus
  MISC_FEATURE (1)..(100): hypothetical protein
MKTNIDDDVDDILQENAKEYVVRAKLKAREVMNKGYWTGNLSRNIRYKKTGDLQYTITSHAAYSGFLEFGTRYMEAEPFMWPVYEVIRKSTVEELKALFE

SEQ ID NO: 1587 - DNA, 381 bp, Staphylococcus aureus
atgacaccgaacttacaactttataataaagcgtatgaaacgctacaaggatatggattccctgttatttctcgtaaagagatgcaacaagagattccgtatcctttttttgtaataaaaatgccggagtcaaatagaagtaagtacacgtttgatagttattctggcgatacgaatttagttattgatatttggagtgtaagcgatgatttaggacatcatgacggacttgttaaaagatgtattgatgatttaacacctagcgttaaaacaaacgattatgactttgaagaagaagatactaacatcacacagttagttgatgatactaccaatcaagaattgctacacacatcagtaacgatatcttacaaaacattt

SEQ ID NO: 1588 - protein, 127 aa, Staphylococcus aureus
  MISC_FEATURE (1)..(127): hypothetical protein
MTPNLQLYNKAYETLQGYGFPVISRKEMQQEIPYPFFVIKMPESNRSKYTFDSYSGDTNLVIDIWSVSDDLGHHDGLVKRCIDDLTPSVKTNDYDFEEEDTNITQLVDDTTNQELLHTSVTISYKTF

SEQ ID NO: 1589 - DNA, 579 bp, Staphylococcus aureus
atggcaaatatgaaaaatagtaatgatcgtattattttatttagaaaagctggcgaaaaagtagatgctactaaaatgctttttttaactgaatacggcttatcacatgaagctgatacagatacagaggatacaatggacggttcttataacactggtggttctgttgagtcaacaatgtctggtactgctaaaatgttttatggtgacgattttgcagatgaaattgaagatgcagttgtagatcgcgtattgtatgaagcttgggaagttgaaagtagaataccaggcaaaaatggggattccgctaaatttaaagcgaaatatttccaaggtttccacaataaatttgaattaaaagcagaagctaacggtattgatgaatatgaatatgaatatggagtgaatggtcgtttccaacgtggatttgcaacactacctgaggctgtaacaaagaaacttaaggcgactggatacagattccacgacactacaaaagcagatgcattaactggcgaagatttaacagcaattccacaacctaaagtagattcaccaccggttgcaccaagagaggta

SEQ ID NO: 1590 - protein, 193 aa, Staphylococcus aureus
  MISC_FEATURE (1)..(193): hypothetical protein
MANMKNSNDRIILFRKAGEKVDATKMLFLTEYGLSHEADTDTEDTMDGSYNTGGSVESTMSGTAKMFYGDDFADEIEDAVVDRVLYEAWEVESRIPGKNGDSAKFKAKYFQGFHNKFELKAEANGIDEYEYEYGVNGRFQRGFATLPEAVTKKLKATGYRFHDTTKADALTGEDLTAIPQPKVDSPPVAPREV

SEQ ID NO: 1591 - DNA, 363 bp, Staphylococcus aureus
atgaatgtagaaattaacggaaagtcattagaattaagttttggttttaaatttttaagagaaatcgataaccgattaggtttaaaagttgaacaagcttctatcggtcaaggtgtatcaatgttgcctgtaggtttagaaagtggaaatccggttgtgattggcgaagttttaatcgcagctacatctcacttaaaaaaacaagcaattactattaataacattgatgaagcattagatgaaatcgcagaaaatatcggactagaagaattcggttcggatattttaacggagttgggaaagcgacctatgacccgaaacctagtcgaagtagtggaaacggaagaaaaaccagcggaagcc

SEQ ID NO: 1592 - protein, 121 aa, Staphylococcus aureus
  MISC_FEATURE (1)..(121): hypothetical protein
MNVEINGKSLELSFGFKFLREIDNRLGLKVEQASIGQGVSMLPVGLESGNPVVIGEVLIAATSHLKKQAITINNIDEALDEIAENIGLEEFGSDILTELGKRPMTRNLVEVVETEEKPAEA

SEQ ID NO: 1593 - DNA, 342 bp, Staphylococcus aureus
atgtcaacacttggtattacagatttgaacgttattgagcaaatgacattaacagaatataactatcgaatgtatgcgaaagagtatgaaatgctaacccaagaattcgaacgttacaaacttgcgtttgctattcgtgatgctgcagctactaaaaatgttgggacagaaaataaacctaaagaggaatatgtttttaacaatgcaaacgacgtattgccttatgaagaaaatatccaacggcttaacgaaggtaaagatataagatttagtagcgaacgtgatgaatacgaaccacaaaataatgaattctttaaagttatagcagaatttaataagcaa

SEQ ID NO: 1594 - protein, 114 aa, Staphylococcus aureus
  MISC_FEATURE (1)..(114): hypothetical protein
MSTLGITDLNVIEQMTLTEYNYRMYAKEYEMLTQEFERYKLAFAIRDAAATKNVGTENKPKEEYVFNNANDVLPYEENIQRLNEGKDIRFSSERDEYEPQNNEFFKVIAEFNKQ

SEQ ID NO: 1595 - DNA, 162 bp, Staphylococcus aureus
atgccagttgatgatccgctgaatgcattcatcaaattgttaattccaacgaaaacatttttgaaaatattaccaatgataggtaagtttgtttttgtgtattcaataaaacgagttatcgaattttctccagctgcactattagcccagttagagaaagat

SEQ ID NO: 1596 - protein, 54 aa, Staphylococcus aureus
MPVDDPLNAFIKLLIPTKTFLKILPMIGKFVFVYSIKRVIEFSPAALLAQLEKD

SEQ ID NO: 1597 - DNA, 3465 bp, Staphylococcus aureus
gtgacggaatataaaattaaagcgactattgaagctagtgtagccaaattcaaaaggcaaattgatagtgcggttaagtctgtgcaaagatttaaacgagtagcagatcaaactaaagatgttgaattaaacgctaacgataaaaatttacaaaaaactatcaaagttgctaaaaagtctttagatgcctttagtaacaaaaatgtaaaagctaaattagatgctagtatacaagatttacaacaaaaggtactagaatcgaattttgaactagacaaactaaactctaaagaagttacaccagaagttaagttgcaaaaacaaaagttgattaaagatatcgctgaaacagaagctaaattatcagaattagaaaagaaacgtgtcaatattgacgtcaatgcagataacagtaaattcaatcgagtgttaaaagtatctaaagctagtctcgaagcattaaataggtctaaagccaaagctattatagacgtggacaatggtgttgctaactctaaaatcaaacgtactaaagaagaacttaaaagtattccgaacaaaactagatctcgacttgatgtagatacagggctttctataccaactatttatgcgtttaaaaaatcattagacgcattgccgaacaaaaaaacaacaaaggtagatgtcgatactaatggtttaaagaaagcttatgcctacataataaaagcaaatgacaattttcaaagacagatggggaatttagctaatatgttccgtgtgttcggtactgtaggttctaatatggttggtggattacttacatcatcttttagtatcttaatacctgtaatagcgagcgtagtacctgtagtatttgcgctattaaacgctatcaaagtgttaactggtggtgtacttgctttaggtggtgccgtagcaatagcgggagcaggatttgtagcgtttggcgcaatggctatcagcgctataaagatgcttaatgatggcactttacaagctagctcagcaacaaacgaatacaaaaaagcgttagatggcgtaaagtcagcatggactgatattataaagcaaaatcaatccgctatcttcacaactcttgcaaatggtttaaatactgttaaaactgcaatgcagagcttacaaccgttttttagtggtatttcaagaggaatggaagaagcgtctcaaagcgtgcttaaatgggctgaaaatagcagtgtagcttcaagattctttaatatgatgaatacaacgggtgtttcggtatttaacaagctattaagtgctgcaggtggttttggtgacggattagtcaatgtattcacgcaattagcaccactgtttcaatggtcggctgattggttggatagattaggtcaatctttctctaactgggctaatagtgcagctggagaaaattcgataactcgttttattgaatacacaaaaacaaacttacctatcattggtaatattttcaaaaatgttttcgttggaattaacaatttgatgaatgcattcagcggatcatcaactggcatattccaatctcttgaacaaatgacagctaagtttagggaatggtctgaacaagtaggacaatctcaagggtttaaagactttgtcagttatatacaaacaaatggaccactaataatgcaattgattggaaacatcgcaagaggattagttgcattcgcaacagcaatggctcctatagctagtgcagtattacgcgttgcagttgcaataactggttggatagctaacttgtttgaggcgcatccagctacagcacaattagttggtgtcattataactttagttggtgcatttagatttttaataccgattattcttgctgtatctaactttatgggtggcggattaataggtagaatcattgcattagtaagtaagttcggtttattaagagcgggattaacaattttaaaaggtgcgttcatgttattaaaaggaccattaaaaattatatcagttatattccaattgttattcggtaagattggattaattagaaatgctatcacaggactagtaactgtgtttggtattttaggcggtccaataacaatagtaattggtgtaattgctgcattaatagctatattcgttttattgtggaataaaaatgaaggattcagaaactttattataaatgcttggaatgcgataaaaacgtttatggttaatgtttggaatgtattaaaagctgtagcttcggttgtatggaatgctattttaacagctatcactacagcagtatcgaatgtttacaattttataatgattgtttggaatcaaatagtcgcttatttacaagggctatggaatggaattatcgctattgcaacaacagtatggaaccttttagttacaatcattacaactgttttcacgacgataatgacaatagttatgacgatatggacagctatttggacgttcttaagtacaatctggaatacgataattacaatcgctactacgatttggaatttgttagtcactgtaataactacagtgtttaccacaattatgactatcgcaataacaatttggaacgctatttggacgttcttacaaacgttgtggaacactatagttactgtggcaactaaggtttggaacgctatcactacagctatatctactgcgttacaagcggcatggagttttatttctaatatatggaatacgatttggagtttcttatctggtatattaacgacaatttggaataaagttgtaagcatattcacacaagttgtttcaactatatcagacaaaatgtctcaagcttggaacttcattgtcactaaaggtatgcaatgggtatctactataacaagtacgctaattaactttgttaatagagttgttcaaggattcgttaatgttgtaaacaaagttagtcaaggtatgacaaatgcagtaaataaagttaaaagctttgtggatgactttgtatcagcaggtgctgatatgatccgtggtttgatgagaggtattggtaatatggctagagacttagctgaaaaagcagctagtgtagcaaaaggtgctttaaatgcagccaaaagagcgctaggtattcactcaccttcacgtgaattcatggatgttggtatgtattcaatgttaggtttcgttaaaggtatagataatcattcaagtaaagttatccgtaatgtttctaatgttgcagataaagtagttgatgcatttcaacctacattaaacgcacctgacatttctagtattacaggaaacttaagtaatttaggtggaaatataaatgcgcaagtacaacacacacattctattgaaacatcaccgaacatgaaaactgttaaagttgaattcgatgtcaataacgatgcgcttactagtattgttaacggcagaaatgctaaacgcaattctgagtattactta

SEQ ID NO: 1598 - protein, 1155 aa, Staphylococcus aureus
  MISC_FEATURE (1)..(1155): hypothetical protein
VTEYKIKATIEASVAKFKRQIDSAVKSVQRFKRVADQTKDVELNANDKNLQKTIKVAKKSLDAFSNKNVKAKLDASIQDLQQKVLESNFELDKLNSKEVTPEVKLQKQKLIKDIAETEAKLSELEKKRVNIDVNADNSKFNRVLKVSKASLEALNRSKAKAIIDVDNGVANSKIKRTKEELKSIPNKTRSRLDVDTGLSIPTIYAFKKSLDALPNKKTTKVDVDTNGLKKAYAYIIKANDNFQRQMGNLANMFRVFGTVGSNMVGGLLTSSFSILIPVIASVVPVVFALLNAIKVLTGGVLALGGAVAIAGAGFVAFGAMAISAIKMLNDGTLQASSATNEYKKALDGVKSAWTDIIKQNQSAIFTTLANGLNTVKTAMQSLQPFFSGISRGMEEASQSVLKWAENSSVASRFFNMMNTTGVSVFNKLLSAAGGFGDGLVNVFTQLAPLFQWSADWLDRLGQSFSNWANSAAGENSITRFIEYTKTNLPIIGNIFKNVFVGINNLMNAFSGSSTGIFQSLEQMTAKFREWSEQVGQSQGFKDFVSYIQTNGPLIMQLIGNIARGLVAFATAMAPIASAVLRVAVAITGWIANLFEAHPATAQLVGVIITLVGAFRFLIPIILAVSNFMGGGLIGRIIALVSKFGLLRAGLTILKGAFMLLKGPLKIISVIFQLLFGKIGLIRNAITGLVTVFGILGGPITIVIGVIAALIAIFVLLWNKNEGFRNFIINAWNAIKTFMVNVWNVLKAVASVVWNAILTAITTAVSNVYNFIMIVWNQIVAYLQGLWNGIIAIATTVWNLLVTIITTVFTTIMTIVMTIWTAIWTFLSTIWNTIITIATTIWNLLVTVITTVFTTIMTIAITIWNAIWTFLQTLWNTIVTVATKVWNAITTAISTALQAAWSFISNIWNTIWSFLSGILTTIWNKVVSIFTQVVSTISDKMSQAWNFIVTKGMQWVSTITSTLINFVNRVVQGFVNVVNKVSQGMTNAVNKVKSFVDDFVSAGADMIRGLMRGIGNMARDLAEKAASVAKGALNAAKRALGIHSPSREFMDVGMYSMLGFVKGIDNHSSKVIRNVSNVADKVVDAFQPTLNAPDISSITGNLSNLGGNINAQVQHTHSIETSPNMKTVKVEFDVNNDALTSIVNGRNAKRNSEYYL

SEQ ID NO: 1599 - DNA, 945 bp, Staphylococcus aureus
atggacatagaattaacaaaaaaagatggtactgtaatcaaattaagtgaatacgggtttatcgttaacgatatagtaattgatagcatgcaaatcaacacaaagtatcaagacaaagaaaatatgaacggtcgtatattaatggggagcaattatatcagtagagatatagttgttccttgtttttgtaaagttaaaaatcgttcagacattgcttatatgcgagatatgttgtattcgttaacgacagacatagaacctatgtatttgcgagaaatcagaagaaaagaagagttgaattacaggtttactcaaccaacttctgatgattacgtgaaattagataaaaacaacttcccggattacgaatattcaagacacgatcaacaaatttatgtaaatggtaaacagtataaagttatttttaacggagttataaaccctaaacaaaaaggtaataaagtttcttttgaactaaaattcgaaactacagaattaccatacggtgaaagtattggaacaagcctagagttagaagaaaacaaaaaggttggattgtggtcgtttgattttaatattgattggcatgcaggcggagacaaaagaaagtatacatttgaaaatttgagcaaaggtacagtttactatcatggtagtgctcctaacgaccaattcaacatgtataaaaagataacaattattttaggcgaagatacagaatcgtttgtatggaatttaacgcatgctgaaataatgaaaatcgaagggatcaaactaaaagctggagacagaattgtttatgatagcttccgagtttataaaaacggtgttgaaataagtaccgaaacgaatatagcccaaccaaaatttaaatacggagctaataaatttgagtttaatcaaacggtacaaaaagttcagtttgatttgaaattttattataag

SEQ ID NO: 1600 - protein, 315 aa, Staphylococcus aureus
  MISC_FEATURE (1)..(315): hypothetical protein
MDIELTKKDGTVIKLSEYGFIVNDIVIDSMQINTKYQDKENMNGRILMGSNYISRDIVVPCFCKVKNRSDIAYMRDMLYSLTTDIEPMYLREIRRKEELNYRFTQPTSDDYVKLDKNNFPDYEYSRHDQQIYVNGKQYKVIFNGVINPKQKGNKVSFELKFETTELPYGESIGTSLELEENKKVGLWSFDFNIDWHAGGDKRKYTFENLSKGTVYYHGSAPNDQFNMYKKITIILGEDTESFVWNLTHAEIMKIEGIKLKAGDRIVYDSFRVYKNGVEISTETNIAQPKFKYGANKFEFNQTVQKVQFDLKFYYK

SEQ ID NO: 1601 - DNA, 1089 bp, Staphylococcus aureus
atgaaatttttaaaagatacttcaattgctgaaatatcgtctatactttatctgatttttcctattgccggtatattttttaatgaagtatatggtcccaaatggttgtatattatatcagtcattgtcttttcgttgtcgtatcttatattagttatagtaaataatagacttaatacattaatgttttacattttgttgattattcattattttattatttgttattttgttttcagtgtacatccaatgctaagtttgtttttcttttatagtgcttttgccgttccatttacttttaaaaataatgttaaaaaaacggcaactaatcttttcatactaacaatgattatatgtacaataataacgtacttattgtataacaactattttgttgcaatgatggtttattatgtcgttatatcgttaataatgctagataattttaaaaaaatgaaaaaccgtgaatatcaaaaagaaatagcagaaaaaaatagacatattaatacattaattgctgaacaagagcgacatagaattggtcaagacttacatgatacgttagggcatgtgtttgcaagtttatcattaaaatcagaattagcttataaactaatagatgctgatgtagaaaaagtaaaagctgaattattagcaattaataaattatctcgtgaatcattgaacaaagttcgagaaattattgatgatgtaaaattaccatcatttattgaagagattgatagtatacgtaaagttttaaaagatgctgatattgattttacatttgaaaataaagaattagcgcaagtattaagtcctactaaacaatctatgttagttatgattacgcgtgaagcgataaataatgttattaaacatgcaaatgcttcaaaagttcatggtaaattaaaaactgtaaacaatcataaattactgcttatgattgaagatgatggcaaaggtatcgatagtgattgtgaggtgaaaagtatttcacagcgtgtacaacatttaaatggaactttagcagtcgactcaacaaatggaactaaaataatcattgaaatctcaacaggaggaatagca

SEQ ID NO: 1602 - protein, 363 aa, Staphylococcus aureus
  MISC_FEATURE (1)..(363): hypothetical protein
MKFLKDTSIAEISSILYLIFPIAGIFFNEVYGPKWLYIISVIVFSLSYLILVIVNNRLNTLMFYILLIIHYFIICYFVFSVHPMLSLFFFYSAFAVPFTFKNNVKKTATNLFILTMIICTIITYLLYNNYFVAMMVYYVVISLIMLDNFKKMKNREYQKEIAEKNRHINTLIAEQERHRIGQDLHDTLGHVFASLSLKSELAYKLIDADVEKVKAELLAINKLSRESLNKVREIIDDVKLPSFIEEIDSIRKVLKDADIDFTFENKELAQVLSPTKQSMLVMITREAINNVIKHANASKVHGKLKTVNNHKLLLMIEDDGKGIDSDCEVKSISQRVQHLNGTLAVDSTNGTKIIIEISTGGIA

SEQ ID NO: 1603 - DNA, 1899 bp, Staphylococcus aureus
atgacaataactattaaaccacctaaaggtaatggcgcacctgtaccagtagaaacaactttagtaaaaaaagttaatgctgacggtgtattaacttttgatattctagaaaataaatatacttatgaagttattaacgctatagggaaaagatggattgttagtcatgtcgaaggtgaaaacgacaagaaagaatatgtaataactgtcattgataggaaatcagaaggcgacagacaactggttgaatgtactgctagagagattcccatagacaagttaatgattgatagaatttatgttaatgtaacaggatcttttacagtagaaagatattttaacattgtgtttcaaggtactggaatgctttttgaagtcgagggcaaagttaaatcttcaaagtttgaaaatggtggtgaaggcgatacaaggttagaaatgtttaaaaagggattagaacatttcggtttagaatataaaataacgtatgacaaaaagaaagacagatataagtttgtattgacgccttttgcaaatcaaaaagcgtcttattttatttctgacgaagtcaacgccaacgctataaaactcgaggaagatgcaagtgatttcgccaccttcattagaggatatggtaattattcaggagaagaaacattcgaacacgctgggctcgtaatggaagctagaagtgcattagctgaaatatacggcgacatccacgcagaaccatttaaagatggtaaagtgactgaccaagaaactatggataaagaattacaatcgagattgaaaaagtcgttaaaacaatctttgtctttggactttttggtgttaagagaatcatatccagaagcagacccacaacccggagacatagtacaaataaaatctaccaaactaggtttgaatgatttagtccgtatagtacaagttaaaacgattaggggtataaacaatgtaattgttaagcaagatgtaacgcttggtgagtttaatcgagaacaacgatatatgaaaaaagttaatactgcagctaactatgtttctggattaaatgatgttaacctttctaatcctagtaaagcggcagaaaacttgaagtctaaagtagcgtcaatagctaaatcaacactcgatttgatgagtagaactgatttgattgaagataaacaacagaaggtaagctctaaaactgtgactacatctgacggcactatcgttcatgattttatagataaatcaaacattaaagatgtaaaaacgattggaacgattggcgattctgtagctagaggatcacatgcgaaaactaatttcacagaaatgttaggcaagaagttaaaagctaaaacgaccaaccttgcaagaggtggcgcaacaatggcaacagttccaataggtaaagaagcggtagaaaacagcatttatagacaagcagagcaaataagaggagacctaatcatattacaaggtacagatgatgactggttacatggttattgggcaggcgtaccgataggcactgataaaaccgacactaaaacgttttacggcgccttttgttctgcaattgaagttatcaggaaaaataatccagcttcaaaaatacttgtaatgacagctactaggcaatgccctatgagtggtacaacgatacgccgtaaagatacggacaaaaacaaactagggttaactttagaggattatgtcaatgctcagatattggcttgtagtgaattggatgtaccagtatatgatgcttatcacacagattatttcaaaccatataatccagcatttagaaaatctagcatgcctgatggattacatcctaatgaaagaggtcatgaagttattatgtatgagcttattaaaaattattatcagttttatgga

SEQ ID NO: 1604 - protein, 633 aa, Staphylococcus aureus
  MISC_FEATURE (1)..(633): hypothetical protein
MTITIKPPKGNGAPVPVETTLVKKVNADGVLTFDILENKYTYEVINAIGKRWIVSHVEGENDKKEYVITVIDRKSEGDRQLVECTAREIPIDKLMIDRIYVNVTGSFTVERYFNIVFQGTGMLFEVEGKVKSSKFENGGEGDTRLEMFKKGLEHFGLEYKITYDKKKDRYKFVLTPFANQKASYFISDEVNANAIKLEEDASDFATFIRGYGNYSGEETFEHAGLVMEARSALAEIYGDIHAEPFKDGKVTDQETMDKELQSRLKKSLKQSLSLDFLVLRESYPEADPQPGDIVQIKSTKLGLNDLVRIVQVKTIRGINNVIVKQDVTLGEFNREQRYMKKVNTAANYVSGLNDVNLSNPSKAAENLKSKVASIAKSTLDLMSRTDLIEDKQQKVSSKTVTTSDGTIVHDFIDKSNIKDVKTIGTIGDSVARGSHAKTNFTEMLGKKLKAKTTNLARGGATMATVPIGKEAVENSIYRQAEQIRGDLIILQGTDDDWLHGYWAGVPIGTDKTDTKTFYGAFCSAIEVIRKNNPASKILVMTATRQCPMSGTTIRRKDTDKNKLGLTLEDYVNAQILACSELDVPVYDAYHTDYFKPYNPAFRKSSMPDGLHPNERGHEVIMYELIKNYYQFYG

SEQ ID NO: 1605 - DNA, 1908 bp, Staphylococcus aureus
atgagtaataaactaattacagatttaagtagagtctttgactacagatatgtagatgaaaatgagtataactttaaacttatttcagacatgctgacggattttaatttctctcttgaataccacagaaataaagaggtattcgcacatgatggagaacaaataaagtatgaacatttaaatgttacaagtaacgtctctgactttttaacatatttaaacggtcgatttagcaacatggtactaggtcataacggcgacggtatcaacgaagtaaaagacgcgcgcgttgataatacaggttatggtcataagacattgcaagatcgtttgtatcatgattattcaacactagatgttttcactaaaaaggttgagaaagctgtagatgaacactataaagaatatcgagcgacagaataccgattcgaaccaaaagagcaagaaccggaatttatcactgatttatcgccatatacaaatgcagtaatgcaatcattttgggtagaccctagaacgaaaattatttatatgacgcaagctcgtccaggtaatcattacatgttatctagattgaagcccaacggacaatttattgatagattgcttgttaaaaacggcggtcacggtacacacaatgcgtatagatacattgatggagaattatggatttattcagctgtattggacagtaacaaaaacaacaagtttgtacgtttccaatatagaactggagaaataacttatggtaatgaaatgcaagatgtcatgccgaatatatttaacgacagatatacgtcagcgatttataatccggtagaaaatttaatgatttttagacgtgaatataaacccactgaaagacaacttaagaattcgttgaactttgttgaggttagaagtgctgacgatattgataaaggtatagacaaagtattgtatcaaatggatatacctatggaatacacttcagatacacaacctatgcaaggtatcacttatgatgcaggtatcttatattggtatacaggtgattcgaatacagccaaccctaactacttacaaggcttcgatatcaaaacgaaagaattgttatttaaacgtcgcatcgatataggcggtgtgaataacaactttaaaggagatttccaagaggctgagggtctagatatgtattacgatctagaaacaggacgtaaagcacttctaatcggggtaactattggacctggtaacaacagacatcattcaatttattctatcggtcaaagaggtgtaaaccaattcttgaaaaacatcgcacctcaagtatcaatgactgattcaggcggacgtgttaaaccgttaccaatacagaacccagcatatctaagtgatattacggaagttggtcattactatatctatacgcaagacacacaaaatgcattagatttcccgttaccgaaagcgtttagagatgcagggtggttcttggatgtactgcctggacactataatggtgctctaagacaagtacttaccagaaacagcacaggtagaaatatgcttaaattcgaacgtgtcattgacattttcaataagaaaaacaacggagcatggaatttctgcccgcaaaacgccggttattgggaacatatccctaagagtattacaaaattatcagatttaaaaatcgttggtttagatttctatatcactactgaagaatcaaaccgatttactgattttcctaaagactttaaaggtattgcaggttggatattagaagtaaaatcgaatacaccaggtaatacaacacaagtattaagacgtaataacttcccgtctgcacatcaatttttagttagaaactttggtactggtggcgttggtaaatggagtttattcgaaggaaaggtggttgaa

SEQ ID NO: 1606 - protein, 636 aa, Staphylococcus aureus
  MISC_FEATURE (1)..(636): hypothetical protein
MSNKLITDLSRVFDYRYVDENEYNFKLISDMLTDFNFSLEYHRNKEVFAHDGEQIKYEHLNVTSNVSDFLTYLNGRFSNMVLGHNGDGINEVKDARVDNTGYGHKTLQDRLYHDYSTLDVFTKKVEKAVDEHYKEYRATEYRFEPKEQEPEFITDLSPYTNAVMQSFWVDPRTKIIYMTQARPGNHYMLSRLKPNGQFIDRLLVKNGGHGTHNAYRYIDGELWIYSAVLDSNKNNKFVRFQYRTGEITYGNEMQDVMPNIFNDRYTSAIYNPVENLMIFRREYKPTERQLKNSLNFVEVRSADDIDKGIDKVLYQMDIPMEYTSDTQPMQGITYDAGILYWYTGDSNTANPNYLQGFDIKTKELLFKRRIDIGGVNNNFKGDFQEAEGLDMYYDLETGRKALLIGVTIGPGNNRHHSIYSIGQRGVNQFLKNIAPQVSMTDSGGRVKPLPIQNPAYLSDITEVGHYYIYTQDTQNALDFPLPKAFRDAGWFLDVLPGHYNGALRQVLTRNSTGRNMLKFERVIDIFNKKNNGAWNFCPQNAGYWEHIPKSITKLSDLKIVGLDFYITTEESNRFTDFPKDFKGIAGWILEVKSNTPGNTTQVLRRNNFPSAHQFLVRNFGTGGVGKWSLFEGKVVE

SEQ ID NO: 1607 - DNA, 1821 bp, Staphylococcus aureus
atggtagtagataatttttcgaaagatgataacttaatcgagttacaaacaacatcacaatataatccggttattgacacaaacatcagtttctatgaatcagatagaggaactggtgttttaaattttgcagtaactaagaataacagacccttatctataagttctgaacatgttaaaacatctatcgtgttaaaaaccgatgattataacgtagatagaggcgcttatatttcagacgaattaacgatagtagacgcaattaatgggcgtttgcagtatgtgataccgaatgaatttttaaaacattcaggcaaggtgcatgctcaggcattctttacacaaaacgggagtaataatgttgttgttgaacgtcaatttagcttcaatattgaaaatgatttagttagtgggtttgatggtataacaaagcttgtttatatcaaatctattcaagatactatcgaagctgtcggtaaagattttaaccaattaaagcaaaatatggctgatacacaaacgttaatagcaaaagtgaatgatagtgcgacaaaaggcattcaacaaatcgaaatcaagcaaaacgaagctatacaagctattactgcgacgcaaactagtgcaacacaagctgttacagctgaattcgataaaatagttgaaaaagagcaagcgatttttgaacgtgttaacgaagttgaacaacaaatcaatggcgctgaccttgttaaaggtaattcaacaacgaattggcaaaagtctaaacttacagatgattacggtaaagcaattgaatcgtatgagcagtccatagatagcgttttaagcgcagttaacacatctaggattattcatattactaatgcaacagatgcgccagaaaagacggatataggcacgttagagaagcctggacaagatggtgttgatgacggttcttcgttcgatgaatcaacttatacatcaagcaaatctggtgtgttagttgtttatgttgttgataataatactgctcgtgcaacatggtacccagacgattcaaacgatgagtacacaaaatacaaaatctacggcacatggtacccgttttataaaaagaatgatggaaacttaactaagcaatttgttgaagaaacgtctaacaacgctttaaatcaagctaagcagtatgtagatgataaattcggaacaacgagctggcaacaacataagatgacagaggcgaatggtcaatcaattcaagttaacttaaataatgcgcaaggcgatttgggatatttaactgctggtaattactatgcaacaagagtgccggatttaccaggtagcgttgaaagttatgagggttatttatcggtattcgttaaagatgatacaaacaagctatttaacttcacaccttataactctaaaaagatttacacacgatcaatcacaaacggcagacttgagcaacagtggacagttcctaatgaacataaatcaacggtattgttcgacggtggcgcaaatggtgtaggtacaacaatcaatctaactgaaccgtacacaaactattctattttgttggtaagtggaacttatccaggtggcgttattgagggattcggactaaccgcattacctaacgcgattcaattgagtaaagcgaatgtagttgactcagacggcaacggtggcggtatttatgagtgcttactatccaaaacaagtagcactactttaagaatagataacgatgtgtactttgatttaggtaaaacatcaggttctggagcgaatgccaacaaagttactataactaaaattatggggtggaaa

SEQ ID NO: 1608 - protein, 607 aa, Staphylococcus aureus
  MISC_FEATURE (1)..(607): hypothetical protein
MVVDNFSKDDNLIELQTTSQYNPVIDTNISFYESDRGTGVLNFAVTKNNRPLSISSEHVKTSIVLKTDDYNVDRGAYISDELTIVDAINGRLQYVIPNEFLKHSGKVHAQAFFTQNGSNNVVVERQFSFNIENDLVSGFDGITKLVYIKSIQDTIEAVGKDFNQLKQNMADTQTLIAKVNDSATKGIQQIEIKQNEAIQAITATQTSATQAVTAEFDKIVEKEQAIFERVNEVEQQINGADLVKGNSTTNWQKSKLTDDYGKAIESYEQSIDSVLSAVNTSRIIHITNATDAPEKTDIGTLEKPGQDGVDDGSSFDESTYTSSKSGVLVVYVVDNNTARATWYPDDSNDEYTKYKIYGTWYPFYKKNDGNLTKQFVEETSNNALNQAKQYVDDKFGTTSWQQHKMTEANGQSIQVNLNNAQGDLGYLTAGNYYATRVPDLPGSVESYEGYLSVFVKDDTNKLFNFTPYNSKKIYTRSITNGRLEQQWTVPNEHKSTVLFDGGANGVGTTINLTEPYTNYSILLVSGTYPGGVIEGFGLTALPNAIQLSKANVVDSDGNGGGIYECLLSKTSSTTLRIDNDVYFDLGKTSGSGANANKVTITKIMGWK

SEQ ID NO: 1609 - DNA, 384 bp, Staphylococcus aureus
gtggaaataatgaaaatcacagtaaacgataaaaacgaagttatcggattcgttaatactggcggtttacgcaatagtttagatgtagatgataacaatgtgcctattaaatttaaagaagagttcgaacctagaaagtttgttttcactaacggcgaaattaaatacaatagcaatttcgaaaaagaagacgtaccgaatgcatcaaaccaacaaagtgcgtcagatttaagtgatgaggaacttcgcggaatggttgcgagtatgcaaatgcaggtggcacaagtaaacgtattaacaatggaattagctcaacaaaacgctatgttaacacaacagttgactgaactgaaaactaacaaaacaagtactgagggggacgtt

SEQ ID NO: 1610 - protein, 128 aa, Staphylococcus aureus
  MISC_FEATURE (1)..(128): hypothetical protein
VEIMKITVNDKNEVIGFVNTGGLRNSLDVDDNNVPIKFKEEFEPRKFVFTNGEIKYNSNFEKEDVPNASNQQSASDLSDEELRGMVASMQMQVAQVNVLTMELAQQNAMLTQQLTELKTNKTSTEGDV

SEQ ID NO: 1611 - DNA, 171 bp, Staphylococcus aureus
atgaagatgatttatccaacttttaaagacattaaaactttttatgtttggggttactataaaaacgagcaaattaagtggtacgtagacaagggtttaatcgataaagaagaatacgctttaatcactggagaaaaatatccagaaacaaaagatgaaaagtcacaggtg

SEQ ID NO: 1612 - protein, 57 aa, Staphylococcus aureus
  MISC_FEATURE (1)..(57): hypothetical protein
MKMIYPTFKDIKTFYVWGYYKNEQIKWYVDKGLIDKEEYALITGEKYPETKDEKSQV

SEQ ID NO: 1613 - DNA, 333 bp, Staphylococcus aureus
ttgtggctttttaatttgaataaagtgggtggcataatgtttggatttaccaaacgacatgaacaagattggcgtttaacgcgattagaagaaaatgataagactatgtttgaaaaattcgacagaatagaagatagtcttagagcgcaagaaaagatttatgacaaattagatagaaattttgaagaattaaagcgcgacaaggtagaagatgaaaagaataaagaaaagaatgccaagaatattagagacataaaaatgtggattctaggtttgatagggactatcttcagtacgattgtcatagctttactaagaactgtttttggtatt

SEQ ID NO: 1614 - protein, 111 aa, Staphylococcus aureus
  MISC_FEATURE (1)..(111): hypothetical protein
LWLFNLNKVGGIMFGFTKRHEQDWRLTRLEENDKTMFEKFDRIEDSLRAQEKIYDKLDRNFEELKRDKVEDEKNKEKNAKNIRDIKMWILGLIGTIFSTIVIALLRTVFGI

SEQ ID NO: 1615 - DNA, 1896 bp, Staphylococcus aureus
atgggattacctaatccgaaaaatagaaagcccacagctagtgaagtggttgaatgggcgttatatatcgctaaaaacaaaatagctattgatgtacctggttctggaatgggagcacaatgctgggatttacctaattatttactcgataaatattgggggtttagaacatggggaaatgctgatgctatggctcaaaaatccaattatagaggtagagatttcaagataattagaaatacaaaagattttgtaccacaaccaggcgactggggtgtttggactggtggttgggcaggacatgtaaacattgtagtgggaccatgcacaaaagactattggtatggcgtagatcaaaactggtatacaaataacgcaacaggaagtccaccttataaaattaaacactcttatcatgatggaccaggtggaggggttaaatattttgttagaccaccatatcatccagacaaaactacaccggcacctaaaccagaagatgatagtgatgataacgaaaaaaataataaaaaagttccaatttggaaagatgtaacaactataaagtacactatttctagccaagaggttaattatccagaatatatttatcactttatagtagaaggtaatcgacgactcgaaaaacctaaaggaataatgattagaaacgcacaaacgatgagctcggtagaaagtttatataacagtaggaagaaatacaaacaggatgtagaatatccccacttttatgttgatagacataatatttgggcacctagaagagctgtatttgaagttcctaatgaacctgattatatagttatagacgtatgtgaagattatagtgcgagtaaaaatgaatttatttttaatgagattcacgcaatggttgtagctgtagatatgatggccaaatatgagatacctctaagtattgaaaatttaaaagtagacgacagcatttggcgttcaatgttggaacatgttaattggaatatgattgacaacggtgttcctcctaaagataaatacgaagcattagaaaaggcattacttaatatatttaaaaacagagaaaaattattaaattctataactaagccaacagtaacaaaatctagaataaaagttatggtagataataaaaacgctgatatagctaatgtaagagactcgtcaccaacagccaacaatggttcggcatctaaacaaccgcagatcataacagaaacgagtccttatacattcaaacaagcactggataaacaaatggcaagaggtaacccgaaaaaatctaatgcttggggttgggctaacgctacacgagcacaaacgagttcagcaatgaatgtaaagcgtatatgggaaagtaacacacaatgctaccaaatgcttaatttaggcaagtatcaaggtgtttcagttagcgcacttaataagatacttaaaggtaagggaacattgaataatcaaggtaaagcgttcgcagaagcttgtaaaaagcacaacattaatgaaatttatttaatcgcgcatgctttcttagaaagtggatatggaacaagtaacttcgctaacggaaaagatggagtatacaactacttcggcattggcgcttacgacaacaatcctaactacgcaatgacgtttgcaaggaataaaggttggacatctccagcaaaagcaatcatgggcggtgctagcttcgtaagaaaggattacatcaataaaggtcaaaacacattgtaccgaattagatggaatcctaagaatccagctacccaccaatacgctactgctatagagtggtgccaacatcaagcaagtacaatcgctaagttatataaacaaatcggcttaaaaggtatctacttcacaagggataaatataaa

SEQ ID NO: 1616 - protein, 632 aa, Staphylococcus aureus
  MISC_FEATURE (1)..(632): hypothetical protein
MGLPNPKNRKPTASEVVEWALYIAKNKIAIDVPGSGMGAQCWDLPNYLLDKYWGFRTWGNADAMAQKSNYRGRDFKIIRNTKDFVPQPGDWGVWTGGWAGHVNIVVGPCTKDYWYGVDQNWYTNNATGSPPYKIKHSYHDGPGGGVKYFVRPPYHPDKTTPAPKPEDDSDDNEKNNKKVPIWKDVTTIKYTISSQEVNYPEYIYHFIVEGNRRLEKPKGIMIRNAQTMSSVESLYNSRKKYKQDVEYPHFYVDRHNIWAPRRAVFEVPNEPDYIVIDVCEDYSASKNEFIFNEIHAMVVAVDMMAKYEIPLSIENLKVDDSIWRSMLEHVNWNMIDNGVPPKDKYEALEKALLNIFKNREKLLNSITKPTVTKSRIKVMVDNKNADIANVRDSSPTANNGSASKQPQIITETSPYTFKQALDKQMARGNPKKSNAWGWANATRAQTSSAMNVKRIWESNTQCYQMLNLGKYQGVSVSALNKILKGKGTLNNQGKAFAEACKKHNINEIYLIAHAFLESGYGTSNFANGKDGVYNYFGIGAYDNNPNYAMTFARNKGWTSPAKAIMGGASFVRKDYINKGQNTLYRIRWNPKNPATHQYATAIEWCQHQASTIAKLYKQIGLKGIYFTRDKYK

SEQ ID NO: 1617 - DNA, 1170 bp, Staphylococcus aureus
atgtacaaaataaaagatgttgaaacgagaataaaaaatgatggtgttgacttaggtgacattggctgtcgattttacactgaagatgaaaatacagcatctataagaataggtatcaatgacaaacaaggtcgtatcgatctaaaagcacatggcttaacacctagattacatttgtttatggaagatggctctatattcaaaaatgagccccttattatcgacgatgttgtaaaaggtttccttacctacaagatacctaaaaaggttatcaaacacgctggttatgttcgctgtaagctgtttttagagaaagaagaagaaaaaatacatgtcgcaaacttttctttcaatatcgttgatagtggtattgaatctgctgtagcaaaagaaatcgatgttaaattggtagatgatgctattacgagaattttaaaagataacgcgacagatttattgagcaaagactttaaagagaaaatagataaagatgtcatttcttacatcgaaaagaatgaaagtagatttaaaggtgcgaaaggtgataaaggtgaaccgggacaacctggagcaaaaggtgaagcaggtaaaaaaggagaacaaggcgcacccggtaaaaacggtactgtagtatcaatcaatcctgacactaaaatgtggcaaattgatggtaaagatacagatatcaaagcagaacctgagttattggacaaaatcaatatcgcaaatgttgaagggttagaaaataaattgcaagaagttgaaaaaatcaaagatacaactctcaacgactctaaaacgtatacggatacaaaaattgctgaactagttgatagcgcgcctgaatctatgaacacattaagagaattagcagaagcaatacaaaacaactctatttcagaaagtgtattgcaacagattggctcaaaagttaatacagaagattttgaggaattcaaacaaacactaaatgatttatatgctccaaaaaatcataatcatgacgagcggtatgttttgtcatctcaagcttttactaaacaacaagcggataatttatatcaactaaaaagcgcatctcaaccgacggttaaaatttggacaggaacagaaaatgaatataactatatatatcaaaaagacccgaatacgttatatttaattaaaggg

SEQ ID NO: 1618 - protein, 390 aa, Staphylococcus aureus
  MISC_FEATURE (1)..(390): hypothetical protein
MYKIKDVETRIKNDGVDLGDIGCRFYTEDENTASIRIGINDKQGRIDLKAHGLTPRLHLFMEDGSIFKNEPLIIDDVVKGFLTYKIPKKVIKHAGYVRCKLFLEKEEEKIHVANFSFNIVDSGIESAVAKEIDVKLVDDAITRILKDNATDLLSKDFKEKIDKDVISYIEKNESRFKGAKGDKGEPGQPGAKGEAGKKGEQGAPGKNGTVVSINPDTKMWQIDGKDTDIKAEPELLDKINIANVEGLENKLQEVEKIKDTTLNDSKTYTDTKIAELVDSAPESMNTLRELAEAIQNNSISESVLQQIGSKVNTEDFEEFKQTLNDLYAPKNHNHDERYVLSSQAFTKQQADNLYQLKSASQPTVKIWTGTENEYNYIYQKDPNTLYLIKG

SEQ ID NO: 1619 - DNA, 402 bp, Staphylococcus aureus
gtgatttttatggaaggtaattttaaaaatgtaaagaagtttatttacgaaggtgaagaatatacaaaagtatatgctggaaatatccaagtatggaaaaagccttcatcttttgtaataaaacccttacctaaaaataaatatccggatagcatagaagaatcaacagcaaaatggacaataaatggagttgaacccaataaaagttatcaggtgacaatagaaaatgtacgtagcggtataatgaggatttcgcaaactaatttagggtcaagtgatttaggaatatcaggagtcaatagcggagttgcaagtaaaaatatcaactttagtaatccttcagggatgttgtacgtcactataagtgatgtttattcaggatctccgacattgaccattgaa

SEQ ID NO: 1620 - protein, 134 aa, Staphylococcus aureus
  MISC_FEATURE (1)..(134): hypothetical protein
VIFMEGNFKNVKKFIYEGEEYTKVYAGNIQVWKKPSSFVIKPLPKNKYPDSIEESTAKWTINGVEPNKSYQVTIENVRSGIMRISQTNLGSSDLGISGVNSGVASKNINFSNPSGMLYVTISDVYSGSPTLTIE

SEQ ID NO: 1621 - DNA, 435 bp, Staphylococcus aureus
atggatattaactggaaattgagattcaaaaacaaagcagtactaactggtttagttggagcattgttgctatttatcaagcaagtcacggatttattcggattagatttatctactcaattaaatcaagctagcgcaattataggcgctatcctcacgttacttacaggtattggcgttattactgacccaacgtcaaaaggcgtctcagattcatctatagcacagacatatcaagcgcctagagatagcaaaaaagaagaacaacaagttacgtggaaatcatcacaagacagtagtttaacgccggaattaagcgcgaaagcaccaaaagaatatgatacatcacaacctttcacagacgcctctaacgatgttggctttgatgtgaatgagtatcatcatggaggtggcgacaatgcaagcaaaattaac

SEQ ID NO: 1622 - protein, 145 aa, Staphylococcus aureus
  MISC_FEATURE (1)..(145): hypothetical protein
MDINWKLRFKNKAVLTGLVGALLLFIKQVTDLFGLDLSTQLNQASAIIGAILTLLTGIGVITDPTSKGVSDSSIAQTYQAPRDSKKEEQQVTWKSSQDSSLTPELSAKAPKEYDTSQPFTDASNDVGFDVNEYHHGGGDNASKIN

SEQ ID NO: 1623 - DNA, 774 bp, Staphylococcus aureus
ttgttgattcatacttcaacaataaaaagcaaaggggatctaattatgatactaagttacttgaaaatcgaatttaaagttataatgcgtaaaaaaacaacattaatattatctattttatttcctgttatattctatatattatttacttcgatattggaattgccggaagatgttaaacctaaattttataaagagtatatgtatagtatgacggtttatagtttgttaagttttagtttactaacttttccattagatattattaatgaaaaacaaaatgaatggcgccaaagattaatggtaacaccatttacttttactagttattatatttcaaaagtagtgaaaactatgctgcaatttgcaatagcgatattagttatttttatggttggacatttttataaaggtgttgcaatgagtgcagttcaatggttagagtcaggaatatttttatggttaggtgcgtctctattaataacttttggcatattattttctttgttaaatgatattcaaaaaacaagtgctttagctaatatcgtaacaattggtttagcagtattaggtggattgtggtttccgataaacacatttccaaattggcttcaacatgttgctcatgttttaccgagctatcatttgcgtaaactaggtgtagatattgcttcaaatcatcatatcaatttaatatcatttgctataatactcttgtatgctttagggagtataatagcagtatattgtattagtcattttaaaagggcggaa

SEQ ID NO: 1624 - protein, 258 aa, Staphylococcus aureus
  MISC_FEATURE (1)..(258): hypothetical protein
LLIHTSTIKSKGDLIMILSYLKIEFKVIMRKKTTLILSILFPVIFYILFTSILELPEDVKPKFYKEYMYSMTVYSLLSFSLLTFPLDIINEKQNEWRQRLMVTPFTFTSYYISKVVKTMLQFAIAILVIFMVGHFYKGVAMSAVQWLESGIFLWLGASLLITFGILFSLLNDIQKTSALANIVTIGLAVLGGLWFPINTFPNWLQHVAHVLPSYHLRKLGVDIASNHHINLISFAIILLYALGSIIAVYCISHFKRAE

SEQ ID NO: 1625 - DNA, 1458 bp, Staphylococcus aureus
atggaggtggcgacaatgcaagcaaaattaactaaaaatgagtttatagagtggttgaaaacttctgagggaaaacaattcaatgtggacttatggtatggatttcaatgctttgattatgccaatgctggttggaaagttttgtttggattacttctaaaaggtttaggtgcaaaagatattccgttcgctaacaacttcgacggattagctactgtataccaaaatacaccggacttcttagcacaacctggcgacatggtggtattcggtagcaactacggtgctggatatggtcacgttgcatgggtaattgaagcaactttagattacatcattgtatatgagcagaattggctaggcggtggctggactgacggaatcgaacaacccggctggggttgggaaaaagttacaagacgacaacatgcttatgatttccctatgtggtttatccgtccgaattttaaaagtgagacagcgccacgatcagttcaatctcctacacaagcacctaaaaaagaaacagctaagccacaacctaaagcagtagaacttaaaatcatcaaagatgtggttaaaggttatgacctacctaagcgtggtagtaaccctaaaggtatagttatacacaacgacgcagggagcaaaggggcgactgctgaagcatatcgtaacggattagtaaatgcacctttatcaagattagaagcgggcattgcgcatagttacgtatcaggcaacacagtttggcaagccttagatgaatcacaagtaggttggcataccgctaatcaaataggtaataaatattattacggtattgaagtatgtcaatcaatgggcgcagataacgcgacattcttaaaaaatgaacaggcaactttccaagaatgcgctagattgttgaaaaaatggggattaccagcaaacagaaatacaatcagattgcacaatgaatttacttcaacatcatgccctcatagaagttcggttttacacactggttttgacccagtaactcgcggtctattgccagaagacaagcggttgcaacttaaagactactttatcaagcagattagggcgtacatggatggtaaaataccggttgccactgtctctaatgagtcaagcgcttcaagtaatacagttaaaccagttgcaagtgcatggaaacgtaataaatatggtacttactacatggaagaaagtgctagattcacaaacggcaatcaaccaatcacagtaagaaaagtggggccattcttatcttgtccagtgggttatcagttccaacctggtgggtattgtgattatacagaagtgatgttacaagatggtcatgtttgggtaggatatacatgggaggggcaacgttattacttgcctattagaacatggaatggttctgccccacctaatcagatattaggtgacttatggggagaaatcagt

SEQ ID NO: 1626 - protein, 486 aa, Staphylococcus aureus
  MISC_FEATURE (1)..(486): amidase [Staphylococcus
MEVATMQAKLTKNEFIEWLKTSEGKQFNVDLWYGFQCFDYANAGWKVLFGLLLKGLGAKDIPFANNFDGLATVYQNTPDFLAQPGDMVVFGSNYGAGYGHVAWVIEATLDYIIVYEQNWLGGGWTDGIEQPGWGWEKVTRRQHAYDFPMWFIRPNFKSETAPRSVQSPTQAPKKETAKPQPKAVELKIIKDVVKGYDLPKRGSNPKGIVIHNDAGSKGATAEAYRNGLVNAPLSRLEAGIAHSYVSGNTVWQALDESQVGWHTANQIGNKYYYGIEVCQSMGADNATFLKNEQATFQECARLLKKWGLPANRNTIRLHNEFTSTSCPHRSSVLHTGFDPVTRGLLPEDKRLQLKDYFIKQIRAYMDGKIPVATVSNESSASSNTVKPVASAWKRNKYGTYYMEESARFTNGNQPITVRKVGPFLSCPVGYQFQPGGYCDYTEVMLQDGHVWVGYTWEGQRYYLPIRTWNGSAPPNQILGDLWGEIS

SEQ ID NO: 1627 - DNA, 108 bp, Staphylococcus aureus
atgacagaacaaatgtatttaatattgtttttattaagcctaccattgttattatttatcgggagaaagacacatttttattgtttagataaaaagaatggacgtaga

SEQ ID NO: 1628 - protein, 36 aa, Staphylococcus aureus
  MISC_FEATURE (1)..(36): hypothetical protein
MTEQMYLILFLLSLPLLLFIGRKTHFYCLDKKNGRR

SEQ ID NO: 1629 - DNA, 198 bp, Staphylococcus aureus
atggacgtagataatatgagtgattataaattaaaaataattgaattgatcaaaagtgatataacaggttaccaaattcacaaacaaactggcgtagcgcaatatgtaatttcacaattaaggcaaggaaagcgcgaagtagataacttaactttaaatacaactgaaaaactatacagttacgcacgacaagtgtta

SEQ ID NO: 1630 - protein, 66 aa, Staphylococcus aureus
  MISC_FEATURE (1)..(66): hypothetical protein
MDVDNMSDYKLKIIELIKSDITGYQIHKQTGVAQYVISQLRQGKREVDNLTLNTTEKLYSYARQVL

SEQ ID NO: 1631 - DNA, 99 bp, Staphylococcus aureus
atgcgtttttttgccttttttattttccttattttttctgttttacaacaaaatggtatcaaaaatggtatcatttgtagttattttagcttcacatat

SEQ ID NO: 1632 - protein, 33 aa, Staphylococcus aureus
MRFFAFFIFLIFSVLQQNGIKNGIICSYFSFTY

SEQ ID NO: 1633 - DNA, 159 bp, Staphylococcus aureus
atgaatgaacagcaaacaatcgaacagataaaagcgcgtttaaataagtttattgaggatatcgatcatgtaaatcctgatgaagtacgtgttgaagatatagatgaatggattggattgttagatcagcttgaagaaaaggttaaattagtatctaag

SEQ ID NO: 1634 - protein, 53 aa, Staphylococcus aureus
  MISC_FEATURE (1)..(53): conserved hypothetical
MNEQQTIEQIKARLNKFIEDIDHVNPDEVRVEDIDEWIGLLDQLEEKVKLVSK

SEQ ID NO: 1635 - DNA, 513 bp, Staphylococcus aureus
atgactaaaaaagtagcaattattctagcaaacgaatttgaagatatagaatattcaagccctaaagaggcattagagaatgcaggctttaatactgtagtgattggagatactgcaaatagtgaagttgttggtaaacacggtgaaaaagttactgtcgatgtaggcattgcagaagctaaaccagaagattatgatgcattattaattcctggaggattttcaccagatcatttacgtggagatacagaaggtcgatatggcacatttgctaaatactttactaaaaatgatgtaccaacatttgccatttgtcatgggccacaaatactaatagatacagacgatttaaaaggtcgtacgttaacagcagtattaaatgtacgcaaagatttatcaaatgcaggcgcacatgtagttgatgagtcagtagttgtagacaacaatattgtaacaagtcgagtaccagacgatttagatgattttaatcgagaaatcgttaaacaattacaa

SEQ ID NO: 1636 - protein, 171 aa, Staphylococcus aureus
  MISC_FEATURE (1)..(171): conserved hypothetical
MTKKVAIILANEFEDIEYSSPKEALENAGFNTVVIGDTANSEVVGKHGEKVTVDVGIAEAKPEDYDALLIPGGFSPDHLRGDTEGRYGTFAKYFTKNDVPTFAICHGPQILIDTDDLKGRTLTAVLNVRKDLSNAGAHVVDESVVVDNNIVTSRVPDDLDDFNREIVKQLQ

SEQ ID NO: 1637 - DNA, 834 bp, Staphylococcus aureus
gtgagttttaaaagaaggagcaaacgcatgaaaagaagcgataggtactcaaactcaaatgaacattttgagcatatgaaacacgaacctcactataatacgtattatcaaccagttggcaaaccgccgaaaaagaaaaaaagtaaacgaatactattaaaaatattattaaccattctaatcattatcgcattgtttattggtatcatgtattttttatctacacgcgataatgtggatgaactaagaaaaattgaaaataaaagtagttttgtgtcagctgataacatgccagagtatgttaaaggtgcctttatttcaatggaagatgaacgattctacaatcatcatggattcgatttgaaaggtacaactagagctttattttcaacgattagcgacagagatgtgcaaggtggtagtaccattacacaacaagttgtcaaaaattatttttatgataatgatcgttcatttactagaaaagtaaaagaattatttgtagctcatcgagttgaaaaacaatataataagaacgaaattttaagcttttatttaaataatatttactttggggataatcaatatacgcttgagggcgcagcaaaccattactttggaacaaccgtgaataaaaatagtacaacaatgtctcacataacagttttacaaagcgctattttagctagtaaagtcaatgcacctagcgtatataatatcaataatatgtcagagaattttacgcaacgtgtaagcacgaacttagaaaaaatgaagcaacaaaattatatcaatgaaacacaatatcaacaggctatgtcacaattaaatcgt

SEQ ID NO: 1638 - protein, 278 aa, Staphylococcus aureus
  MISC_FEATURE (1)..(278): conserved hypothetical
VSFKRRSKRMKRSDRYSNSNEHFEHMKHEPHYNTYYQPVGKPPKKKKSKRILLKILLTILIIIALFIGIMYFLSTRDNVDELRKIENKSSFVSADNMPEYVKGAFISMEDERFYNHHGFDLKGTTRALFSTISDRDVQGGSTITQQVVKNYFYDNDRSFTRKVKELFVAHRVEKQYNKNEILSFYLNNIYFGDNQYTLEGAANHYFGTTVNKNSTTMSHITVLQSAILASKVNAPSVYNINNMSENFTQRVSTNLEKMKQQNYINETQYQQAMSQLNR

SEQ ID NO: 1639 - DNA, 816 bp, Staphylococcus aureus
gtgccgaagattactaaaatagaagttcaaaagaaaaacaaagaacggtttaatctttttttagacgaacaatttgaaatgggtatagatattgatacattagtcaaatttaatttaaaaaaagggcaacaacttgaagctgctgacatggcagagattcaaaagtatgatcattatcgcataggtttaaataaagcaatccaatatttatcatataaaaagagaactgaaaaagaagttatacaatatttacaaaaagaagagatatcagagcaagcgatttctgaagtgattgaatattgttatcgcgaaaagttaatcgaccatcaagattatgcggaaagtttaaaaaatacaatgattcgcacgacagataaaggacctaaaatttatcaacaaaaactatatcaacttggtatagaaccaaatatcattgaaatatttacagaactttatagagaacaacaggaacttgatgatattatccaaattgctgaaaaaatatctaaaacaaaaaaagggccacaaaataaagttaaagaaaaagtaatgcaatctttaattcaaaaagggtttgaaatggaaaccattcatgctgtattgaatgaaatggattttacacaagatgaagcggttttagacgatttattacaacgagatttagaaaaaatttataataaaaatcgaaagaagtacacgcaacagaaattaatttcaaaaactatcgaaggccttatgagaaaaggatataaatatgataaaattaaagctaaattagaagaaagtggtattgccgatggaacagaagaaattgag

SEQ ID NO: 1640 - protein, 272 aa, Staphylococcus aureus
  MISC_FEATURE (1)..(272): conserved hypothetical
VPKITKIEVQKKNKERFNLFLDEQFEMGIDIDTLVKFNLKKGQQLEAADMAEIQKYDHYRIGLNKAIQYLSYKKRTEKEVIQYLQKEEISEQAISEVIEYCYREKLIDHQDYAESLKNTMIRTTDKGPKIYQQKLYQLGIEPNIIEIFTELYREQQELDDIIQIAEKISKTKKGPQNKVKEKVMQSLIQKGFEMETIHAVLNEMDFTQDEAVLDDLLQRDLEKIYNKNRKKYTQQKLISKTIEGLMRKGYKYDKIKAKLEESGIADGTEEIE

SEQ ID NO: 1641 - DNA, 324 bp, Staphylococcus aureus
gtggtattgccgatggaacagaagaaattgagtgagatgtctgagccagaattaagacacgaaatacaactttataaagagaaaatgagaaaagctgagatgaatggtattttaaatgaatatgacgtttatcaaagtaaagtaattgttgccgaaagttacttagtagacagaaaaaagatagaaattggtaaaatttataaactgactgatggcagtaatcaatattttaaagtagaaagattaaaaggtatttttgcgtgggggtttagatttaatagcgatgaacccgaagaaggattacctatagcgttattacaatta

SEQ ID NO: 1642 - protein, 108 aa, Staphylococcus aureus
  MISC_FEATURE (1)..(108): conserved hypothetical
VVLPMEQKKLSEMSEPELRHEIQLYKEKMRKAEMNGILNEYDVYQSKVIVAESYLVDRKKIEIGKIYKLTDGSNQYFKVERLKGIFAWGFRFNSDEPEEGLPIALLQL

SEQ ID NO: 1643 - DNA, 1515 bp, Staphylococcus aureus
atgggaagttcaattgttttaaagttactaaaagtaacacactactataggaataaacagaataagaaatggtatttaccttttggatatgatgctgaagatatcgatttaaacaatattagtttacatatttatcaaggagaagcattaggtataattggtgaacctgaatcttccaaagcgttggtaggtcaattgttggcaggtgcaattaaacctgataaaggtaaagtagtttgtactgaagatttgttctacggatatattgaagatcaatcgttaattcatcaaactgttgaagcttatacagcgcagttagttcaactatttccatatgaaattaatgatcataaagctgaacagattattcaatatgcacatttaggtgattataaaacgaagccggttaaccatatttcgaaagcggcatacgctcaattactattaagtattgcacgctcatcaaaatcaaatattattattttaaatcatgttattgactatttaacaccacaatttatggaacgtgcgattgaattaacaaatgattatattgaaaataatttaacgattgtgtcaattggtgatgatattgataaaatttcacaagtgagtaactacatagcttggttttcacatggtcaattaagaatggaagggtcacttaaacaagttattccatcttttaaagaacatgaacgtgatcgattaagtctaaactcaaaagaagaaattgaaaactttgatttagattggaaaaagaatcgtacaagaataccagagatgacctataatttcaaacgtgttgagcgctataatcatgcaaaaccgcctaagtttttagtgcgtttttggactttagcctcaggtactattttaggcttagcattgatgatgttgctcattttcaataatataggaattatttcgataacagattttacgaatcgtgctacgatgcaaaatgaaaataaagatccatatggcgaaaagttagcttatggaattgcttttaatggcagtgtggatatgcaaggggataaacaagtcacaattccaaaatatagtgtagttacaattactggcgaaaatagtaaaaattatcgtgttaccgccgataataagacttactatgttagtaaagataaattagaatattttaacccggcaggtttatatcaaacgcatagttttaaaaaattagcaccatatatgaaatcaaattatagtaattactatgcatactttaatagtcaattacataaaaagcatagttcagttataaaaactttagttcctgatgatgataaccgtttcgttgcatccgttacacaacaaccgatacaattacttttcaatgataataatcagttatacggttttgtttatccaattgtagataaaaaagaattaaaagataagtttaatattaacaataacatttggattactaaagttgggaatggatattgtattgccaatttgaaagaagacaaatggatttatattgaattg

SEQ ID NO: 1644 - protein, 505 aa, Staphylococcus aureus
  MISC_FEATURE (1)..(505): hypothetical protein
MGSSIVLKLLKVTHYYRNKQNKKWYLPFGYDAEDIDLNNISLHIYQGEALGIIGEPESSKALVGQLLAGAIKPDKGKVVCTEDLFYGYIEDQSLIHQTVEAYTAQLVQLFPYEINDHKAEQIIQYAHLGDYKTKPVNHISKAAYAQLLLSIARSSKSNIIILNHVIDYLTPQFMERAIELTNDYIENNLTIVSIGDDIDKISQVSNYIAWFSHGQLRMEGSLKQVIPSFKEHERDRLSLNSKEEIENFDLDWKKNRTRIPEMTYNFKRVERYNHAKPPKFLVRFWTLASGTILGLALMMLLIFNNIGIISITDFTNRATMQNENKDPYGEKLAYGIAFNGSVDMQGDKQVTIPKYSVVTITGENSKNYRVTADNKTYYVSKDKLEYFNPAGLYQTHSFKKLAPYMKSNYSNYYAYFNSQLHKKHSSVIKTLVPDDDNRFVASVTQQPIQLLFNDNNQLYGFVYPIVDKKELKDKFNINNNIWITKVGNGYCIANLKEDKWIYIEL

SEQ ID NO: 1645 - DNA, 906 bp, Staphylococcus aureus
gtgattaaattgattcaaatatctaatatcaacaagtcatttaataaaagatgtgttctaaaaaatatttcgttcgatattgaacaaggtaaatgtatcgctttaattggaaaaaatggtgctggaaagtcaacgttaattgatatattaattggtaatgttaatgctaattctggtgagatatttgataaagacaagttattacaaagtgaaaatcgcagtataatgttccaaaaaacgatgtttccagatcaattaaaagttattgagattatcaacttatatcaatcattttacgaaaatccattaccattggaagaaataatagaactgacgaaatttgattctagtcaactgaaccaatttgtaaataaactttctggtggtcaacaacgattactcgattttgtattatctttaatcggacaaccacaattgatcttattagatgaaccaacatcgactatggatatagaaattagagaatatttttggtcaattattgaaaatttaaaagaagataatcgaacgatactctatacatcgcactatattgaagaagtcgaacgtatgtcagacaaaattattctcattgaaaatggagaaataatacttaatgattcaacgtcacatattagaaccaatcagcaatctcagattacgttatccgatgaatatataagaaagttaaaactagataaagatgatttagttattcaaaaaaatcataatggcactatcaaaattattacttcaaatgtaaatgatacgattttatatcttcaacaacttcatattaatttggatgatattgaaatacaaaaagtctcaattgttgattcatacttcaacaataaaaagcaaaggggatctaattatgatactaagttacttgaaaatcgaatt

SEQ ID NO: 1646 - protein, 302 aa, Staphylococcus aureus
  MISC_FEATURE (1)..(302): ABC transporter homolog
VIKLIQISNINKSFNKRCVLKNISFDIEQGKCIALIGKNGAGKSTLIDILIGNVNANSGEIFDKDKLLQSENRSIMFQKTMFPDQLKVIEIINLYQSFYENPLPLEEIIELTKFDSSQLNQFVNKLSGGQQRLLDFVLSLIGQPQLILLDEPTSTMDIEIREYFWSIIENLKEDNRTILYTSHYIEEVERMSDKIILIENGEIILNDSTSHIRTNQQSQITLSDEYIRKLKLDKDDLVIQKNHNGTIKIITSNVNDTILYLQQLHINLDDIEIQKVSIVDSYFNNKKQRGSNYDTKLLENRI

SEQ ID NO: 1647 - DNA, 834 bp, Staphylococcus aureus
atgctagataatattattttatattttaaaaacttaccgcatactaaaaggtatgtaacagaacgtttaaaacaaagttggaaaagttttctaatcgtattagctgcatgtttaatacttattattgcaagtgaaacgctattttcctttagtcatttgaccgatgttaaagaggtgagatggttatttagaatcattgtattgattgtttttgcggtagtgatgttcacaatttatatctcttatcatcattatatgaatgactttttagttactaagttatttaatatttccgcagcgacgccagtagttattatgtctattttaagttttattatgctagtcattttgacgatgattagtgcattggttaaaccagtaaacttcgaaacatcatatatagcgctattctattttattgtgatggcaactatttttgtaggattaatatccgttacttttggtcttattcgactgttaactgaaaaaataaatatcatattttatggggtttgtgtattgtgtttcttattgttaccaattattttcataccaaatccaaatcatgtatttatcaatcacatcctaatgctaaatccaatgtattacattgttaatggtatagcacaatctatcatatttggtatatcaagtatggaaaacattccatatcatttttactttattttattcttatgtttaatagctgcagtaaatttcgtattagcaaggtatacgacacacgcaatttataataaaacatctaaagtgacacaaactgataatcaacaggatgtttcaaatgatagtacagacgaggcggatacttcttca

SEQ ID NO: 1648 - protein, 278 aa, Staphylococcus aureus
  MISC_FEATURE (1)..(278): hypothetical protein
MLDNIILYFKNLPHTKRYVTERLKQSWKSFLIVLAACLILIIASETLFSFSHLTDVKEVRWLFRIIVLIVFAVVMFTIYISYHHYMNDFLVTKLFNISAATPVVIMSILSFIMLVILTMISALVKPVNFETSYIALFYFIVMATIFVGLISVTFGLIRLLTEKINIIFYGVCVLCFLLLPIIFIPNPNHVFINHILMLNPMYYIVNGIAQSIIFGISSMENIPYHFYFILFLCLIAAVNFVLARYTTHAIYNKTSKVTQTDNQQDVSNDSTDEADTSS

SEQ ID NO: 1649 - DNA, 975 bp, Staphylococcus aureus
atggacactgcaacacatatcgcaattggggtgggccttacagcacttgcaactcaagatccagcaatggcttctacgtttggtgcaacagctacaacccttatcgttggttcattaattcctgatggggatactgttcttaaattaaaggacaatgcaacatatatttcgcatcatagaggtatcacgcattccatccctttcacaatactatggccaattttaattacatttttaatattcacgttctttagtggaaccaacccatttcatgtatggatgtgggctcagctcgcagtatttttacatgtctttgtagatatattcaattcttatggtacacaagcgcttagacctatcacaaacaaatggattcaattaagtgtgattaacacatttgaccctattattttcacagttctttgtattggtattgtattatgggttataggcttgcatccatttgcagtcttctttcctataatcgctttactaatcatttattacatgattcgttttaaaatgagagccgtaattaagcaacaagctttaaaagcaattcaacaagagcatcaccctgttaaagtatttgttgcgccaacaataaaatttatggaatggcgtgtcgcgatacaaactgatgcacatgactatgttggaaaagcatatggtaggaatgtggtgtttagtgataaagtggaacgtcaaacattatcaacagactccattttatggaaagtcaaaggtaataaagatatacgtacttttttaaacttttcatcaatctatcgttggcaaacaacaacgttagcagatggttctactgaaattcgtttgattgatttgcgttatttaaaaaatgatcattattcatttgtggcaattgcacatgtaacaaacgataatgtcatagaccactcttatattggctgggtatttacagaagataagttacaacgtaaactgtatgctaaa

SEQ ID NO: 1650 - protein, 325 aa, Staphylococcus aureus
  MISC_FEATURE (1)..(325): conserved hypothetical
MDTATHIAIGVGLTALATQDPAMASTFGATATTLIVGSLIPDGDTVLKLKDNATYISHHRGITHSIPFTILWPILITFLIFTFFSGTNPFHVWMWAQLAVFLHVFVDIFNSYGTQALRPITNKWIQLSVINTFDPIIFTVLCIGIVLWVIGLHPFAVFFPIIALLIIYYMIRFKMRAVIKQQALKAIQQEHHPVKVFVAPTIKFMEWRVAIQTDAHDYVGKAYGRNVVFSDKVERQTLSTDSILWKVKGNKDIRTFLNFSSIYRWQTTTLADGSTEIRLIDLRYLKNDHYSFVAIAHVTNDNVIDHSYIGWVFTEDKLQRKLYAK

SEQ ID NO: 1651 - DNA, 1035 bp, Staphylococcus aureus
atgtatcagcagtctagttttaaagaaaatttgatacactggtttgatgaaaatcaaagagaaatgccatggcgacaaacgaccaatccgtactatatttggttaagtgaggtcatgttacaacagacacaagttaaaacagttattgactattatcatcgttttgttgaacgatttccaactgtggaagttttgagtcaagcttcggaagatgaagtgttaaagtattgggaaggcttaggatattatagtagagctcgaaattttcatacggcgattaaagaagttcatgataaatatgaaggcttagttcccaaagatcctgatcaatttaaagcgttaaaaggtgttggcccatacacacaagctgcagtaatgagcattgcatataatgtaccactagcaactgtagacggaaatgtttttcgagtatggtctagattgaatgatgactatcgagatattaaattacaatcgacgaggaaatcgtacgaacaagaattattaccgtatgttactacagaagctggaacgtttaatcaagctatgatggaattaggggcgttaatttgtacaccaaaaaatccattatgcttattttgtccagttcaagaaaactgtgaggcatttgataaaggtacatttgaaaagttacctgttaaatctaaaaatgtaagtaaaaaagtaattgagcaatccgtctttttaattagaaataatcaaggtcaatatctgttgcaaaagcgtagcgaaaaattattgcatggtatgtggcaatttcctatgtttgaaagtgagcatgctagacgtaaaatgactgaaaaaatcggtcatgacattcaaccagtagaaacacctatttttgagttgaagcatcaatttactcatttaacatggaagattaaagtatacgccgtttcaggagcaattaacattgaaacattaccagatgacatgatttggtttgatttaagtgatcgagatcaatatacattccctgtacctatgtcaaagatttatcaatttataaatggg

SEQ ID NO: 1652 - protein, 345 aa, Staphylococcus aureus
  MISC_FEATURE (1)..(345): hypothetical protein
MYQQSSFKENLIHWFDENQREMPWRQTTNPYYIWLSEVMLQQTQVKTVIDYYHRFVERFPTVEVLSQASEDEVLKYWEGLGYYSRARNFHTAIKEVHDKYEGLVPKDPDQFKALKGVGPYTQAAVMSIAYNVPLATVDGNVFRVWSRLNDDYRDIKLQSTRKSYEQELLPYVTTEAGTFNQAMMELGALICTPKNPLCLFCPVQENCEAFDKGTFEKLPVKSKNVSKKVIEQSVFLIRNNQGQYLLQKRSEKLLHGMWQFPMFESEHARRKMTEKIGHDIQPVETPIFELKHQFTHLTWKIKVYAVSGAINIETLPDDMIWFDLSDRDQYTFPVPMSKIYQFING

SEQ ID NO: 1653 - DNA, 552 bp, Staphylococcus aureus
gtggtgtggagtatggtcagagaatccatacctaaagaaggggaaaacattaaaattcagagttataaacatgatggtaagattcatcgcgtttggtctgaaacaacaatattaaagggtactgatcatgttgtcattggtggaaatgatcatacgttagtgactgaaagtgacggaagaacttggataacacgtgaaccggcaattgtttactttcactcagaatattggtttaatgttatctgcatgtttagagaagatggaatttattactattgcaatttgtcatcaccatttgtttgtgatgaagaggcattaaaatatatagactatgatttagatattaaagtatatccaaacggaaagtatcatttattagatgaagatgaatatgagcaacatatgaatcaaatgaattatccgcatgatattgatattattttaagacgcaacgtggacattcttcaacaatggatagaacagaagaagggcccattcgcgccagattttatcaaagtttggaaagaacgttacaaaaaaattagacagtat

SEQ ID NO: 1654 - protein, 184 aa, Staphylococcus aureus
  MISC_FEATURE (1)..(184): conserved hypothetical
VVWSMVRESIPKEGENIKIQSYKHDGKIHRVWSETTILKGTDHVVIGGNDHTLVTESDGRTWITREPAIVYFHSEYWFNVICMFREDGIYYYCNLSSPFVCDEEALKYIDYDLDIKVYPNGKYHLLDEDEYEQHMNQMNYPHDIDIILRRNVDILQQWIEQKKGPFAPDFIKVWKERYKKIRQY

SEQ ID NO: 1655 - DNA, 1734 bp, Staphylococcus aureus
atgattaaacgatatttgcaatttgttaagccatacaaatatcgtatttttgcaacgattattgttgggataattaagtttggtataccaatgcttataccactattaattaaatatgcaatagatggcgtgattaataaccacgcactaacgactgatgaaaaagttcatcatttaactattgccattggtatcgcattatttatttttgtaatagtgagaccaccaattgaatttatacgtcaatatttggcgcaatggacaagtaataaaatattgtatgatatacgtaaaaagttatacaaccatttacaagctttaagtgcgagattttatgctaataatcaagtaggtcaagtaatatctagagtgattaatgatgttgaacaaacaaaagatttcattttaaccgggttaatgaatatttggttagattgtataacaattattattgcactatccataatgttctttttagatgtgaaattgactttagcagcactgtttatcttcccattttacattttaacggtgtacgttttctttggaagattaagaaaattgacacgtgaaagatctcaagcattagctgaggttcaaggattcttgcatgaacgtgttcaaggtatttcagtcgttaaaagttttgcgattgaagacaatgaagcgaaaaactttgataaaaagaatactaatttcctaacacgtgcgttgaaacatacaagatggaatgcctattcctttgccgcaattaatacagttacagatattggaccaattattgtcatcggtgttggtgcatatcttgctatttctggatcaatcacagtaggtacacttgcagcatttgttggatacttagagttattgttcgggcctttacgtcgtttagtcgcatcatttacaactttaacgcaaagttttgcttcaatggaccgtgtattccaattaattgatgaagattatgacatcaaaaatggtgttggtgctcaacctattgaaattaaacaaggtcgtattgatattgatcatgttagttttcaatataacgataacgaagctccaattttaaaagatattaatttgagtattgaaaaaggagaaacagttgctttcgtaggtatgagtggtggtggtaaatcaacattaattaacttaataccgagattttacgatgtaacttctgggcaaattttaatagatggtcacaacattaaagattttttaacgggaagtttaagaaatcaaataggattggtgcaacaggataatattttattctctgatacagttaaggaaaatattttacttggtcgtccaacagcaacagatgaagaagtagttgaagcggcgaaaatggctaatgcacatgactttattatgaacttgccacagggatatgacactgaagtaggtgaacgaggtgttaaattatcaggtggtcaaaaacaaagattatcgattgctagaatatttttaaataatccgccaattcttatcttggatgaagcaacaagtgcacttgatttagaaagtgaatccattattcaagaagcattagatgtgttgagtaaagatcgaacgacacttatcgtagcgcatcgcttgtccactattacacatgctgacaaaattgtcgtaattgaaaatggacatattgttgaaacaggtacgcatcgtgaattgattgcaaaacaaggtgcttacgagcatttatatagcattcaaaactta

SEQ ID NO: 1656 - protein, 578 aa, Staphylococcus aureus
  MISC_FEATURE (1)..(578): ABC transporter homolog
MIKRYLQFVKPYKYRIFATIIVGIIKFGIPMLIPLLIKYAIDGVINNHALTTDEKVHHLTIAIGIALFIFVIVRPPIEFIRQYLAQWTSNKILYDIRKKLYNHLQALSARFYANNQVGQVISRVINDVEQTKDFILTGLMNIWLDCITIIIALSIMFFLDVKLTLAALFIFPFYILTVYVFFGRLRKLTRERSQALAEVQGFLHERVQGISVVKSFAIEDNEAKNFDKKNTNFLTRALKHTRWNAYSFAAINTVTDIGPIIVIGVGAYLAISGSITVGTLAAFVGYLELLFGPLRRLVASFTTLTQSFASMDRVFQLIDEDYDIKNGVGAQPIEIKQGRIDIDHVSFQYNDNEAPILKDINLSIEKGETVAFVGMSGGGKSTLINLIPRFYDVTSGQILIDGHNIKDFLTGSLRNQIGLVQQDNILFSDTVKENILLGRPTATDEEVVEAAKMANAHDFIMNLPQGYDTEVGERGVKLSGGQKQRLSIARIFLNNPPILILDEATSALDLESESIIQEALDVLSKDRTTLIVAHRLSTITHADKIVVIENGHIVETGTHRELIAKQGAYEHLYSIQNL

SEQ ID NO: 1657 - DNA, 1176 bp, Staphylococcus aureus
ttgaattttgtaactagtaagtgtataacagtaatgaatacgaatattagatattcaataaacttaaaaggggcgtcattatttttgagactaggagctcggatttttaaaactggtatagccattattttagctatgtctatcgcttctttactaccggatgatgttggtctgaaagccttagctggtgtcagtgctgttgttgcaatgcaacctagtatttatcgttcatttaaaacagtttctgatcaagcattgggtaacattataggtgccatactatctgttacaatggtaacaatttttagtgataattttatcattatgggtgttaccgtcatagtacttattgctattttatttaaatttaatttagcacatgttgctactttggcgagtgtaacagcattaatcattatgggacaacataccggttctttctatattaccgccttttacaggtttgtacttgtaatgattggtgtcataagttcatctctagttaactttgtgtttctaccacctaaatttgaaacaaaaatttactataattcattaaatatatcctcagatatttttatgtggtttaaattagtattaaatgatacgacggagtttaataatattaaacaagatagtcataatttaaaacaacgtgtcgaaaagttagagaaaatttatgattactatagcgaagaacgtcctattacaaaaaaacatattcaccaacagaatagaaagaaaatacttttcagagaagtagttcagacgactagacaagcttatgaagtattaaacaaattgtcgcgttatcaaaacgacttatatttacttaataacaatttcctattacaaatcaaattagatttagattcattaactgcttttcacgagcaaattttagctagcctttctaaaaaagcacgttataatgtgacacatgttgattatgagttagataatccgcagaaaaaagatttattgtccacatttcagcatgagttaataaatcatccttatcaaacggaatattcgtttgccaatgttatgcaaattgttgcagccatcgaagagtatcgacaccatttagagcatttagaccgcataagaattagctttttcacatatcatagatctgatgcagacattgaaattgttgaagaagactttgattta

SEQ ID NO: 1658 - protein, 392 aa, Staphylococcus aureus
  MISC_FEATURE (1)..(392): conserved hypothetical
LNFVTSKCITVMNTNIRYSINLKGASLFLRLGARIFKTGIAIILAMSIASLLPDDVGLKALAGVSAVVAMQPSIYRSFKTVSDQALGNIIGAILSVTMVTIFSDNFIIMGVTVIVLIAILFKFNLAHVATLASVTALIIMGQHTGSFYITAFYRFVLVMIGVISSSLVNFVFLPPKFETKIYYNSLNISSDIFMWFKLVLNDTTEFNNIKQDSHNLKQRVEKLEKIYDYYSEERPITKKHIHQQNRKKILFREVVQTTRQAYEVLNKLSRYQNDLYLLNNNFLLQIKLDLDSLTAFHEQILASLSKKARYNVTHVDYELDNPQKKDLLSTFQHELINHPYQTEYSFANVMQIVAAIEEYRHHLEHLDRIRISFFTYHRSDADIEIVEEDFDL

SEQ ID NO: 1659 - DNA, 1287 bp, Staphylococcus aureus
atgaattttagtgaaagtgaacgtttacaacaactttcaaacgaatatattctaggcggtgtcaattccccttctcgttcttataaagctgtaggaggcggtgcacctgttgttatgaaagaaggacacggtgcatatttatatgatgtcgatggcaataaatttattgattaccttcaagcatacggtccaattattacggggcatgcacatcctcatattactaaagcaattcaagaacaagctgctaaaggtgttttatttggtacaccgactgaattagaaattgaattcagcaaaaaattacgtgatgcaattccatctcttgagaaaattcgctttgtaaattctggaacagaagcagtcatgacaacaattcgtgttgcacgtgcatatactaaaagaaataaaattataaaatttgctggatcttatcatggccattctgatttagtattggttgcagcaggtagcggcccatctcagctcggttctccagactcagctggtgttccagaaagcgtcgcacgtgaagtcattactgtacctttcaatgatattaacgcctataaagaagcaattgaattttggggtgatgaaattgccgcagtattagtagaaccaattgttggtaactttggaatggtaatgcctcaacctggatttttagaagaggttaatgaaatttcacataacaatgggaccctagtgatttatgatgaagtaattactgcattccgtttccattacggtgccgctcaagatttattaggtgttatccctgatttaactgcatttggtaaaattgttggcggtggtttaccaattggaggctatggtggacgtcaagatattatggaacaagtagcacctctaggacctgcatatcaagctggtacaatggctggtaacccgttatctatgaaagcaggtattgcattactcgaagtactagaacaagacggtgtttatgaaaaattagacagcttaggccaacaactagaagaaggtttacttaaattaatcgaaaaacataatatcacagctacaattaatcgtatttatggatctttaacattgtactttacagatgaaaaagtcacacattatgatcaagttgaacattctgacggcgaagcgttcggtaaatttttcaaattaatgttaaatcaaggtatcaatttagcaccttctaagtttgaagcttggttcttaacaactgaacatacagaagaagatattaaacaaactttaaaagctgcagactatgcttttagtcaaatgaaa

SEQ ID NO: 1660 - protein, 429 aa, Staphylococcus aureus
  MISC_FEATURE (1)..(429): glutamate-1-semialdehyde
MNFSESERLQQLSNEYILGGVNSPSRSYKAVGGGAPVVMKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIKQTLKAADYAFSQMK

SEQ ID NO: 1661 - DNA, 453 bp, Staphylococcus aureus
atgttgcaaaaaggagaacaatttccaatatttaaattagaaaatcaagacggaactgtcattacaaatgatacattaaaaggtaaaaaggcgattatatatttttatcctagagataatacacctacttgtaccacagaagcttgtgactttagagacaatttagaaatgttcaatgatttagatgttgcagtatatggtataagcggtgattcaaagaaaaaacaccaaaattttattgagaaacacggattgaatttcgatttattagtagatgaagattttaaattagctaaagaaactggcgtatatcagttaaaaaaatcatttggcaaagaaagtatgggcattgtaagaacgacttttataatagatgaacaaggtaaagtattagatgttatcgagaaggttaaggttaaaacacaaatagaagaacttaaaaacattttgggg

SEQ ID NO: 1662 - protein, 151 aa, Staphylococcus aureus
  MISC_FEATURE (1)..(151): conserved hypothetical
MLQKGEQFPIFKLENQDGTVITNDTLKGKKAIIYFYPRDNTPTCTTEACDFRDNLEMFNDLDVAVYGISGDSKKKHQNFIEKHGLNFDLLVDEDFKLAKETGVYQLKKSFGKESMGIVRTTFIIDEQGKVLDVIEKVKVKTQIEELKNILG

SEQ ID NO: 1663 - DNA, 957 bp, Staphylococcus aureus
gtgacatatatgaaagttgttgggttaaatcgtatgcgtgaagttgaaactgaattacaacaacgcttttcagatttagattttaaattttataaaaaagcatcagaaatacctgagagcgacttggctgatttagatatattagttggttatgatggcggtatcaatgaggcatttttacgacgttgcccgaatttaaaatggattgcatggtttgcaacgggtgtaaatacattgccgttagattatattgcagatcacggcatacttttaactaatggaaaaggtgttcaagctaaacaattatctgaatacattttagctttcattttagatgattataaaaagatgaaactatcatatgataaccaacgacaacatatatatgattcgaaaataactggtaaacgcctatcaggacaaacagttttatttttaggtacaggtgcaattgctactagaactgcgaagttagcaaaggcttttaatatgaatttaattggtctgagcaagtcaggtcagaacaaagatgagtttgacgagatatatactatcgaatcacttgaaagcacattaccaaatgctgacattattataaatgctttaccagaaacgcaagaaacgattcatttactaaagaaaaaacattttgaattaatgaaagatgaagcactttttataaatataggacgaggtagcatagttaaagaagcgctcttaatagaagtattaaaaagtaaagttattcgacatgcatatttagatgtgtttgaaaatgaacctttgaaacctaatcatgaattatatgaattggataatgtaactataacagcgcatataactggtaatgattatgaagcaaagtatgacttattagatatttttaaaaacaatctagttaattttctcaataagaatggtctaattgagaatgaagttgatgctaaaaaaggctat

SEQ ID NO: 1664 - protein, 319 aa, Staphylococcus aureus
  MISC_FEATURE (1)..(319): hypothetical protein
VTYMKVVGLNRMREVETELQQRFSDLDFKFYKKASEIPESDLADLDILVGYDGGINEAFLRRCPNLKWIAWFATGVNTLPLDYIADHGILLTNGKGVQAKQLSEYILAFILDDYKKMKLSYDNQRQHIYDSKITGKRLSGQTVLFLGTGAIATRTAKLAKAFNMNLIGLSKSGQNKDEFDEIYTIESLESTLPNADIIINALPETQETIHLLKKKHFELMKDEALFINIGRGSIVKEALLIEVLKSKVIRHAYLDVFENEPLKPNHELYELDNVTITAHITGNDYEAKYDLLDIFKNNLVNFLNKNGLIENEVDAKKGY

SEQ ID NO: 1665 - DNA, 444 bp, Staphylococcus aureus
atgagtgttgaaatagaatcaattgaacatgaactagaagaatcaattgcatcattgcgacaagcaggcgtaagaattacacctcaaagacaagcaatattacgttatttaatttcttcacatactcatccaacagctgatgaaatttatcaagcactttcacctgattttccaaatataagtgttgcgacaatatataataacttaagagtgtttaaagatattggaattgtaaaagaattaacatatggagactcatcaagtcgattcgactttaatacacataatcattatcatattatatgtgaacaatgtggtaagattgttgattttcaatatccacagttaaatgaaattgaaagattagctcagcatatgactgactttgacgtaacacatcatcgaatggaaatttatggagtttgtaaagaatgccaagataaa

SEQ ID NO: 1666 - protein, 148 aa, Staphylococcus aureus
  MISC_FEATURE (1)..(148): transcription regulator Fur
MSVEIESIEHELEESIASLRQAGVRITPQRQAILRYLISSHTHPTADEIYQALSPDFPNISVATIYNNLRVFKDIGIVKELTYGDSSSRFDFNTHNHYHIICEQCGKIVDFQYPQLNEIERLAQHMTDFDVTHHRMEIYGVCKECQDK

SEQ ID NO: 1667 - DNA, 1530 bp, Staphylococcus aureus
gtgaaaggtgcaaaatgtttttttgtgcctttctttataggagaaaagactatgcgatttacattttcaaacgatttaggaacgttatttactattattttagccattggattcatcattaatttagtattggcttttattattatctttttagaaagaaataggcgtacagcgagttcaacttgggcatggctatttgtactttttgtcttaccattgattggttttattctttacttgttttttggtagaaccgtttcggcacgcaaattgaataaaaacaatggtaacgtgttaacggatttcgatggacttttaaaacaacaaatagaaagctttgataaaggtaattatggtactgataacaaacaagttcaaaaacatcatgatttagtacgtatgcttttgatggatcaagatggttttttaactgaaaataataaagttgatcatttcattgatggaaatgatttatatgatcaagttttaaaagatattaaaaatgcaaaagaatatatccatttagagtactatactttcgctttagatggtttaggtaaaagaattttacatgctttagaagaaaaattgaaacaaggtctagaagtaaaaatattatatgatgatgttggatctaaaaatgttaagatggcaaattttgatcattttaaatcgttaggtggagaagttgaagcattttttgcttcaaaattaccgttattgaatttcagaatgaataatagaaatcatagaaaaatcatcgtaatcgatggtcaactaggttatgtcggaggatttaacattggtgatgaatatctaggattaggaaaattaggatattggagagatacgcatttacgtatacaaggggatgcggttgatgcactgcagttgcgatttattttagactggaattcgcaagcgcaccgtccacaatttgaatatgatgttaagtatttccctaaaaagaacggaccattgggcaattcaccaattcaaatagctgcaagtggcccggctagtgactggcatcaaattgaatacggttatacaaaaatgattatgagtgcaaagaaatctgtatatttacaatcaccatatttcattccggataattcatatataaatgccattaaaattgctgctaaatcaggtgtagatgtacatttaatgattccatgtaagccagatcatccattagtatattgggcgacattttcaaatgcctctgacttattatcaagtggtgttaaaatttatacgtatgaaaatggatttatacattctaaaatgtgcttaattgatgatgaaatcgtatcagtgggcacagcaaatatggactttagaagttttgaattaaattttgaagtaaatgcctttgtatatgatgaaaatcttgctaaagatttaagggtggcttatgaacatgatattacaaaatcaaaacaactaaccaaagaatcatatgccaatagaccgctgtctgttaaattcaaagaatcgttagcaaaattagtttcgccaatttta

SEQ ID NO: 1668 - protein, 510 aa, Staphylococcus aureus
  MISC_FEATURE (1)..(510): cardiolipin synthetase
VKGAKCFFVPFFIGEKTMRFTFSNDLGTLFTIILAIGFIINLVLAFIIIFLERNRRTASSTWAWLFVLFVLPLIGFILYLFFGRTVSARKLNKNNGNVLTDFDGLLKQQIESFDKGNYGTDNKQVQKHHDLVRMLLMDQDGFLTENNKVDHFIDGNDLYDQVLKDIKNAKEYIHLEYYTFALDGLGKRILHALEEKLKQGLEVKILYDDVGSKNVKMANFDHFKSLGGEVEAFFASKLPLLNFRMNNRNHRKIIVIDGQLGYVGGFNIGDEYLGLGKLGYWRDTHLRIQGDAVDALQLRFILDWNSQAHRPQFEYDVKYFPKKNGPLGNSPIQIAASGPASDWHQIEYGYTKMIMSAKKSVYLQSPYFIPDNSYINAIKIAAKSGVDVHLMIPCKPDHPLVYWATFSNASDLLSSGVKIYTYENGFIHSKMCLIDDEIVSVGTANMDFRSFELNFEVNAFVYDENLAKDLRVAYEHDITKSKQLTKESYANRPLSVKFKESLAKLVSPIL

SEQ ID NO: 1669 - DNA, 96 bp, Staphylococcus aureus
gtgaattggattatcgaattagatctatggttatggtgtgttggtgctattaatttgataaatgcggttaatgactatgcaaatgaaattcttttg

SEQ ID NO: 1670 - protein, 32 aa, Staphylococcus aureus
VNWIIELDLWLWCVGAINLINAVNDYANEILL

SEQ ID NO: 1671 - DNA, 594 bp, Staphylococcus aureus
atgcattatccagaacctatatcaaaacttattgatagctttatgaaattgccaggcattggtccaaagacagcccaacgtctggcttttcataccttagatatgaaagaagacgatgttgttcagtttgccaaagcattagtagatgttaagagagaattaacatattgtagcgtatgtggtcacattactgaaaatgatccatgttatatttgtgaagataagcaaagagatcgttcagttatttgtgttgtggaagatgacaaagatgtcatagctatggaaaaaatgagagaatacaaaggtttatatcacgttttacatgggtctatttcgcctatggatggcattggaccagaagatattaatattccttcattgattgaacgcttgaaaaacgatgaagttagcgaattaatcttagctatgaacccgaacttagagggggaatctacagccatgtatatttctagattagttaagcctataggtatcaaagtgacgagattagcacaagggttatcggtaggtggcgatttagagtatgctgacgaagtaacattatctaaagcaatcgcaggtagaacagaaatg

SEQ ID NO: 1672 - protein, 198 aa, Staphylococcus aureus
  MISC_FEATURE (1)..(198): recombination protein
MHYPEPISKLIDSFMKLPGIGPKTAQRLAFHTLDMKEDDVVQFAKALVDVKRELTYCSVCGHITENDPCYICEDKQRDRSVICVVEDDKDVIAMEKMREYKGLYHVLHGSISPMDGIGPEDINIPSLIERLKNDEVSELILAMNPNLEGESTAMYISRLVKPIGIKVTRLAQGLSVGGDLEYADEVTLSKAIAGRTEM

SEQ ID NO: 1673 - DNA, 315 bp, Staphylococcus aureus
atgcgcggtggcggaaacatgcaacaaatgatgaaacaaatgcaaaaaatgcaaaagaaaatggctcaagaacaagaaaaacttaaagaagagcgtattgtaggaacagctggcggtggcatggttgcagttactgtaactggtcataaagaagttgtcgacgttgaaatcaaagaagaagctgtagacccagacgatattgaaatgctacaagacttagtgttagcagctactaatgaagcgatgaataaagctgatgagcttactcaagaacgtttaggtaaacatactcaaggcttaaacatccctggaatg

SEQ ID NO: 1674 - protein, 105 aa, Staphylococcus aureus
  MISC_FEATURE (1)..(105): conserved hypothetical
MRGGGNMQQMMKQMQKMQKKMAQEQEKLKEERIVGTAGGGMVAVTVTGHKEVVDVEIKEEAVDPDDIEMLQDLVLAATNEAMNKADELTQERLGKHTQGLNIPGM

SEQ ID NO: 1675 - DNA, 1695 bp, Staphylococcus aureus
ttgaattatcaagccttatatcgtatgtacagaccccaaagtttcgaggatgtcgtcggacaagaacatgtcacgaagacattgcgcaatgcgatttcgaaagaaaaacagtcgcatgcttatatttttagtggtccgagaggtacggggaaaacgagtattgccaaagtgtttgctaaagcaatcaactgtctaaatagcactgatggagaaccttgtaatgaatgtcatatttgtaaaggcattacgcaggggactaattcagatgtgatagaaattgatgctgctagtaataatggcgttgatgaaataagaaatattagagacaaagttaaatatgcaccaagtgaatcgaaatataaagtttatattatagatgaggtgcacatgctaacaacaggtgcttttaatgcccttttaaagacgttagaagaacctccagcacacgctatttttatattggcaacgacagaaccacataaaatccctccaacaatcatttctagggcacaacgttttgattttaaagcaattagcctagatcaaattgttgaacgtttaaaatttgtagcagatgcacaacaaattgaatgtgaagatgaagccttggcatttatcgctaaagcgtctgaagggggtatgcgtgatgcattaagtattatggatcaggctattgcatttggtgatggtacgttaacattgcaagatgcgttgaatgtcacaggtagcgtacatgatgaagcgttggatcacttgtttgatgatattgtacaaggtgacgtacaagcatcttttaaaaaataccatcagtttataacagaaggtaaagaagtgaatcgcctaataaatgatatgatttattttgtcagagatacgattatgaataaaacatctgagaaagatactgagtatcgagcactgatgaacttagaattagatatgttatatcaaatgattgatcttattaatgatacattagtgtcgattcgttttagtgtgaatcaaaacgttcattttgaagtgttgttagtaaaattagctgagcagattaagggtcaaccacaagtgattgcgaatgtagctgaaccagcacaaattgcttcatcgccaaacacagatgtattgttgcaacgtatggaacagttagagcaagaactaaaaacactaaaagcacaaggagtgagtgtcgctcctgttcaaaaatcttcgaaaaagcctgcgagaggcatacaaaaatctaaaaatgcattttcaatgcaacaaattgcaaaagtgctagataaagcgaataaggcagatatcaaattgttgaaagatcattggcaagaagtgattgatcatgccaaaaataatgataaaaaatcactcgttagtttattgcaaaattcggaacctgtggcggcaagtgaagatcacgtacttgtgaaatttgaggaagagatccattgtgaaatcgtcaataaagacgacgagaaacgtagtagtatagaaagtgttgtatgtaatatcgttaataaaaacgttaaagttgttggtgtaccatcagatcaatggcaaagagttcgaacggaatatttacaaaatcgtaaaaacgaaggcgatgatatgccaaagcaacaagcacaacaaacagatattgctcaaaaagcaaaagatcttttcggtgaagaaactgtacatgtgatagatgaagag

SEQ ID NO: 1676 - protein, 565 aa, Staphylococcus aureus
  MISC_FEATURE (1)..(565): DNA polymerase III gamma
LNYQALYRMYRPQSFEDVVGQEHVTKTLRNAISKEKQSHAYIFSGPRGTGKTSIAKVFAKAINCLNSTDGEPCNECHICKGITQGTNSDVIEIDAASNNGVDEIRNIRDKVKYAPSESKYKVYIIDEVHMLTTGAFNALLKTLEEPPAHAIFILATTEPHKIPPTIISRAQRFDFKAISLDQIVERLKFVADAQQIECEDEALAFIAKASEGGMRDALSIMDQAIAFGDGTLTLQDALNVTGSVHDEALDHLFDDIVQGDVQASFKKYHQFITEGKEVNRLINDMIYFVRDTIMNKTSEKDTEYRALMNLELDMLYQMIDLINDTLVSIRFSVNQNVHFEVLLVKLAEQIKGQPQVIANVAEPAQIASSPNTDVLLQRMEQLEQELKTLKAQGVSVAPVQKSSKKPARGIQKSKNAFSMQQIAKVLDKANKADIKLLKDHWQEVIDHAKNNDKKSLVSLLQNSEPVAASEDHVLVKFEEEIHCEIVNKDDEKRSSIESVVCNIVNKNVKVVGVPSDQWQRVRTEYLQNRKNEGDDMPKQQAQQTDIAQKAKDLFGEETVHVIDEE

SEQ ID NO: 1677 - DNA, 522 bp, Staphylococcus aureus
atgcaaatatatttaagtactttaacagagttagattatgataaatctttaaatagtattgaagaaagttttgatgataatcctgaaacgagttggcaagcacgtgcgaaagtaaaacatttaagaaaatctccttgctataattttgaattagaagtaatagcgaaaaatgaaaataacgatgtcgttggacacgttttattaattgaagtagaaattaatagtgatgataagacgtattatggtttggcgattgcctctttatcagttcatcctgaattacgtggacaaaaattaggtcgtggcttggttcaagcagtagaagagcgtgccaaagcacaagagtatagtacggttgttgtagaccattgttttgactactttgaaaagttgggttatcaaaatgctgctgagcatgacattaaattagaatctggtgatgcaccgttacttgtaaaatatttatgggataatttgacggatgcaccacacggaatcgtaaaatttccagaacatttttat

SEQ ID NO: 1678 - protein, 174 aa, Staphylococcus aureus
  MISC_FEATURE (1)..(174): conserved hypothetical
MQIYLSTLTELDYDKSLNSIEESFDDNPETSWQARAKVKHLRKSPCYNFELEVIAKNENNDVVGHVLLIEVEINSDDKTYYGLAIASLSVHPELRGQKLGRGLVQAVEERAKAQEYSTVVVDHCFDYFEKLGYQNAAEHDIKLESGDAPLLVKYLWDNLTDAPHGIVKFPEHFY

SEQ ID NO: 1679 - DNA, 99 bp, Staphylococcus aureus
ttgaagacaattcagcgtattatacgtggaacatgtttgtgggaagtagcttttttatatgtgaagtttgattcaagtgaactcgatgtgcagtttgaa

SEQ ID NO: 1680 - protein, 33 aa, Staphylococcus aureus
LKTIQRIIRGTCLWEVAFLYVKFDSSELDVQFE

SEQ ID NO: 1681 - DNA, 744 bp, Staphylococcus aureus
ttgagtggatgcgtttatatggcgaaacaaaaaaagtttatgaagatttatgaggcgttgaaagaagatatattaaacgggcagattcaatatggtgaacaaattccgtctgaacatgatttggtgcaattgtaccagtcatctcgagagaccgtgcgtaaggcattagatttgttggcattagacggcatgattcaaaagattcatggtaaagggtcacttgtcatttatcaggaggttacagagtttccattttctgaacttgttagttttaaagaaatgcaagaagaaatgggcgtcgcatatttaactgaagttgttgtgaatgaggttgttgaagcgcatgaagttccagaagttcaacatgctttaaacatcaattctagtgaatcactcattcatattgttagaactcgtcggcttaaccaacatgtgaagattgttgatgaagattattttctaaagtcgattgtttcagatataggtaatgatgttgcgagtgattctatttatgattatttggaaaaggtattaaatcttaatattagttattcaagtaagtctattacttttgaaccgtttgatgaacaagcatatcaattgtttggtgatgtatcggtggcttattcagcaacagttcgaagtattgtgtatttagaaaatacaatgccgtttcaatataatatttcaaaacatcttgcaaatgaatttaaatttaatgacttctcaagacgtcgtataaag

SEQ ID NO: 1682 - protein, 248 aa, Staphylococcus aureus
  MISC_FEATURE (1)..(248): hypothetical protein
LSGCVYMAKQKKFMKIYEALKEDILNGQIQYGEQIPSEHDLVQLYQSSRETVRKALDLLALDGMIQKIHGKGSLVIYQEVTEFPFSELVSFKEMQEEMGVAYLTEVVVNEVVEAHEVPEVQHALNINSSESLIHIVRTRRLNQHVKIVDEDYFLKSIVSDIGNDVASDSIYDYLEKVLNLNISYSSKSITFEPFDEQAYQLFGDVSVAYSATVRSIVYLENTMPFQYNISKHLANEFKFNDFSRRRIK

SEQ ID NO: 1683 - DNA, 1638 bp, Staphylococcus aureus
gtgtcgaaagaaatagattggagaaaatccgttgtatatcaaatttatcctaagtcgtttaatgatacgacggggaatggtataggagatatcaatggaattatagaaaaattggattatatcaagttattgggtgttgattatatttggttaacaccagtgtatgaatcaccgatgaatgataatggctatgatatcagcaattatttagaaatcaatgaagactttggaacgatggatgattttgaaaagttaatcaaagttgcgcatcaaaaagacttgaaagtgatgttagatattgtcattaatcatacgtcgacggagcatgaatggtttaaagaagcccgtaaatctaaagataacccttatagagattattactttttcagatcatctgaagacgggccgccaacaaattggcattctaaattcggtggtaatgcatggaagtatgattctgagacagatgaatattatttacatttatttgatgtcagtcaagctgatttaaattgggataatccggaagtacgtcaatcgttatatcgcatagtcaatcattggatagacttcggcgttgatggttttcgatttgatgtcattaacttaatttctaaaggtgaatttaaggactctgacaaaataggtaaagaattttatacggatggtcctagagtgcatgagtttctgcatgaattaaatcgtcaaacgtttggtaacactgacatgatgactataggagaaatgtcttcgacgacgattgaaaattgtattaagtatacacaaccagaacgccaagaattgaatagtgtttttaattttcatcatctaaaggttgattatgttgatggtgaaaagtggacaaatgcgaagcttgattttcataagttaaaggaaattctgatgcaatggcaacgaggtatttatgacggtggcggatggaacgcgattttctggtgtaatcatgatcagccacgggtagtgtctagatttggtgatgatacgtcggaagagatgaggatacaaagtgctaaaatgttagctatcgcactgcatatgttgcaagggacgccatatatttaccaaggtgaagaaattggtatgacggacccacattttacatcaatagcacaatatcgtgatgttgaatcgattaatgcctaccatcagttgttaagtgaagggcatgctgaagcggatgtgttagcgattttaggacagaagtcacgagacaattcgagaacgcctatgcaatggagtgatgatgttaatgctggatttacagctggtaagccttggattgatatttcggaaaattatcatcaggtcaacgttagacaagcacttcagaataaagagtctattttctatacgtatcaaaaattaatacaattaagacatacgcatgatattattacgtatggagacattgtgccacgttttatggatcatgatcatttatttgtttatgaacgtcattataagaatcaacaatggctagtaattgcgaatttctcagcatcggctgttgatttgccagaaggattggctagagaaggttgtgttgtgattcaaacaggcacagtggaaaataatacgataagcgggtttggtgcaattgtaatcgaaacaaacgcg

SEQ ID NO: 1684 - protein, 546 aa, Staphylococcus aureus
  MISC_FEATURE (1)..(546): alpha-glucosidase
VSKEIDWRKSVVYQIYPKSFNDTTGNGIGDINGIIEKLDYIKLLGVDYIWLTPVYESPMNDNGYDISNYLEINEDFGTMDDFEKLIKVAHQKDLKVMLDIVINHTSTEHEWFKEARKSKDNPYRDYYFFRSSEDGPPTNWHSKFGGNAWKYDSETDEYYLHLFDVSQADLNWDNPEVRQSLYRIVNHWIDFGVDGFRFDVINLISKGEFKDSDKIGKEFYTDGPRVHEFLHELNRQTFGNTDMMTIGEMSSTTIENCIKYTQPERQELNSVFNFHHLKVDYVDGEKWTNAKLDFHKLKEILMQWQRGIYDGGGWNAIFWCNHDQPRVVSRFGDDTSEEMRIQSAKMLAIALHMLQGTPYIYQGEEIGMTDPHFTSIAQYRDVESINAYHQLLSEGHAEADVLAILGQKSRDNSRTPMQWSDDVNAGFTAGKPWIDISENYHQVNVRQALQNKESIFYTYQKLIQLRHTHDIITYGDIVPRFMDHDHLFVYERHYKNQQWLVIANFSASAVDLPEGLAREGCVVIQTGTVENNTISGFGAIVIETNA

SEQ ID NO: 1685 - DNA, 1434 bp, Staphylococcus aureus
gtgaaatatatggctgtaaaaagagaagatgtaaaagccatcgtaaccgctattgggggaaaagaaaatcttgaagctgcaacgcattgtgtaacacgattacgtttagtgctgaaggatgaaagtaaagttgataaagacgcattaagtaataacgcgttggtcaaggggcagtttaaagcagaccatcaatatcaaattgtcattggtccaggaacagtcgatgaagtgtataagcagtttattgatgaaacaggtgctcaagaagcttcgaaagatgaagcgaaacaagcagctgcacaaaaagggaatccagtacaacgtttgatcaaattgttgggggatatttttataccaatattacctgcgattgtgacagctggtttgttaatgggaatcaataatttacttacaatgaaaggtttatttggtccaaaagcacttattgagatgtatccacaaattgctgatatttcaaacatcattaatgtgattgcgagtacggcatttattttcttaccagcattaattggttggagtagtatgcgtgtatttggtggtagtccgattctaggcatagtcttaggtttgattttaatgcatccgcaattagtatctcagtatgatttggcaaaagggaatattccgacgtggaacttatttggcttagagattaagcagttgaattaccaaggtcaagtgttgccagttttaattgcagcttacgttctagctaaaattgaaaaaggattaaataaagtcgttcacgattcgataaaaatgttggtcgttggacccgtagcgcttttagttactggatttttagcatttattatcattggaccagttgcgttattgattggtacaggtattacatctggtgttacatttatattccaacatgcaggatggcttggcggagcaatatatggattgttatatgcaccacttgtaattacaggactacaccatatgtttttagcagtagatttccaattgatgggtagcagcttaggcggtacgtatttatggccaattgttgcgatttccaatatttgtcagggctctgcagcatttggagcatggtttgtctataaacgtcgtaaaatggttaaagaagaaggcttggcattaacatcttgtatttctggtatgttaggtgttactgaaccagccatgttcggtgtgaacttacctctgaaatatccatttatcgctgcgatatcaacgtcttgtgtattgggggcaatcgttggtatgaataacgtacttggaaaagttggtgttggtggcgtgccagcattcatttcaattcaaaaagaattttggccagtatatcttattgtgacagctattgctattgttgtaccatgtatactaacaattgtgatgtctcattttagtaaacaaaaagcgaaagaaattgttgaagat

SEQ ID NO: 1686 - protein, 478 aa, Staphylococcus aureus
VKYMAVKREDVKAIVTAIGGKENLEAATHCVTRLRLVLKDESKVDKDALSNNALVKGQFKADHQYQIVIGPGTVDEVYKQFIDETGAQEASKDEAKQAAAQKGNPVQRLIKLLGDIFIPILPAIVTAGLLMGINNLLTMKGLFGPKALIEMYPQIADISNIINVIASTAFIFLPALIGWSSMRVFGGSPILGIVLGLILMHPQLVSQYDLAKGNIPTWNLFGLEIKQLNYQGQVLPVLIAAYVLAKIEKGLNKVVHDSIKMLVVGPVALLVTGFLAFIIIGPVALLIGTGITSGVTFIFQHAGWLGGAIYGLLYAPLVITGLHHMFLAVDFQLMGSSLGGTYLWPIVAISNICQGSAAFGAWFVYKRRKMVKEEGLALTSCISGMLGVTEPAMFGVNLPLKYPFIAAISTSCVLGAIVGMNNVLGKVGVGGVPAFISIQKEFWPVYLIVTAIAIVVPCILTIVMSHFSKQKAKEIVED

SEQ ID NO: 1687 - DNA, 195 bp, Staphylococcus aureus
atggaacaaattaaacttaaaacttttacagctgagactttagagttattagaaaaaaacattaatgcttttttaagttctgaagaagctacaaatttaaaattagtaaatattactattaaagaaatagaagaaagaacattcccaaataatgaagaagaattcaatgcaattttaactttatctgtgaataaa

SEQ ID NO: 1688 - protein, 65 aa, Staphylococcus aureus
  MISC_FEATURE (1)..(65): hypothetical protein
MEQIKLKTFTAETLELLEKNINAFLSSEEATNLKLVNITIKEIEERTFPNNEEEFNAILTLSVNK

SEQ ID NO: 1689 - DNA, 177 bp, Staphylococcus aureus
  MISC_FEATURE (1)..(177): n = g, a, t, or c
atgaattataagcaatccgcagaagaaattttgaacgcgataggcggagaagagaatttagatgcaatggcgcattgtgcaacgagactacgattagttttaaatgatgaaagtttagtaaatgaagaggcgctaaacagggaacatagctcgaattcgtatcannnnntaaataat

SEQ ID NO: 1690 - protein, 59 aa, Staphylococcus aureus
  MISC_FEATURE (1)..(59): Xaa = any amino acid
  MISC_FEATURE (1)..(59): PTS system
MNYKQSAEEILNAIGGEENLDAMAHCATRLRLVLNDESLVNEEALNREHSSNSYXXXNN

SEQ ID NO: 1691 - DNA, 369 bp, Staphylococcus aureus
atgaaagaacgtggctatatcgaacagctttggcgtgaggaaaaatatcatgtattgttacacagtcaacagtcttaccaaatgataaggaatgctttaaaaacggatttatcacttcatcaagttcaacaaatgattgatgttgctttgttaattgaaccgagtataggaagtgtatgtaatgcttttgatcatatgtggggatatttaaaaaaatgtgcgaatgaagaagaaagacaacaatcaaaactacttaaagctgattttattaatggtaaaatcgacacccaaactttattagattttttagcagaacttgctaataaatatgatgttcaatatttactacaaagtcgtgttttaaacact

SEQ ID NO: 1692 - protein, 123 aa, Staphylococcus aureus
  MISC_FEATURE (1)..(123): probable type II DNA
MKERGYIEQLWREEKYHVLLHSQQSYQMIRNALKTDLSLHQVQQMIDVALLIEPSIGSVCNAFDHMWGYLKKCANEEERQQSKLLKADFINGKIDTQTLLDFLAELANKYDVQYLLQSRVLNT

SEQ ID NO: 1693 - DNA, 1461 bp, Staphylococcus aureus
atgggtgaatttaaaggatttatgaagtatgacaaacagtacttaggtgaattatcactggtagaccgtttgaagcatcataaagcatatcaacaacgatttactaaagaagatgcctctatccaaggtgcacgatgtatggattgtggaacgccgttttgtcaaaccggacaacagtatggtagggaaacaataggttgtccaattggaaactacattcctgaatggaacgacttagtgtatcatcaagattttaaaactgcttatgaacgcttaagcgaaacaaataactttcctgactttacagggcgtgtatgtcctgcaccatgcgaaagtgcttgtgtgatgaagattaatagagaatcgattgcgattaaaggtattgaacgcacaattattgatgaagcttttgaaaatggttgggtagcgccgaaagttccgagtcgccgtagagatgaaaaagtggcaatcgttggaagcggtccagcaggattagctgctgctgaagaacttaatctactaggatatcaagtaactatttatgaacgtgctagagaatcaggcggtttattaatgtatggtattccgaatatgaaacttgataaagatgtggttcgacgtcgtattaagttaatggaagaagcgggcattactttcattaatggtgttgaagtcggtgttgatattgataaagcaacgttagaatctgagtatgatgccattatattatgtactggtgcacaaaaaggtagagatttacctttagaaggacgcatgggtgatggtatacatttcgctatggattatttaactgaacaaacgcagttgttaaatggagaaattgatgatataacaataactgcaaaagataagaatgtcattatcattggtgctggtgatacaggggcagactgtgtagcgacagcattaagagaaaattgtaaatcgattgttcaatttaataaatatacgaaattgccagaagcaattacatttacagaaaatgcatcatggcctttagcaatgccggtgtttaaaatggactatgcgcaccaagagtacgaagctaagtttggtaaggaaccacgtgcatatggtgttcaaacaatgcgttacgatgttgacgataaaggacacatacgtggtttgtatactcaaattttagagcaaggcgaaaatggtatggtcatgaaagaaggacctgaaagattttggcctgctgaccttgtattattatcaatcggcttcgaaggtacagaaccaacagtaccgaatgcttttaacattaaaacggatagaaatcgaatcgtggcggatgatacaaactatcaaactaataatgaaaaggtatttgctgctggagatgctagacgtggtcaaagtttagttgtatgggcaattaaagaaggtagaggcgtagcgaaagcagtagatcagtatttagctagtaaagtttgtgta

SEQ ID NO: 1694 - protein, 487 aa, Staphylococcus aureus
  MISC_FEATURE (1)..(487): NADH-glutamate synthase
MGEFKGFMKYDKQYLGELSLVDRLKHHKAYQQRFTKEDASIQGARCMDCGTPFCQTGQQYGRETIGCPIGNYIPEWNDLVYHQDFKTAYERLSETNNFPDFTGRVCPAPCESACVMKINRESIAIKGIERTIIDEAFENGWVAPKVPSRRRDEKVAIVGSGPAGLAAAEELNLLGYQVTIYERARESGGLLMYGIPNMKLDKDVVRRRIKLMEEAGITFINGVEVGVDIDKATLESEYDAIILCTGAQKGRDLPLEGRMGDGIHFAMDYLTEQTQLLNGEIDDITITAKDKNVIIIGAGDTGADCVATALRENCKSIVQFNKYTKLPEAITFTENASWPLAMPVFKMDYAHQEYEAKFGKEPRAYGVQTMRYDVDDKGHIRGLYTQILEQGENGMVMKEGPERFWPADLVLLSIGFEGTEPTVPNAFNIKTDRNRIVADDTNYQTNNEKVFAAGDARRGQSLVVWAIKEGRGVAKAVDQYLASKVCV

SEQ ID NO: 1695 - DNA, 4506 bp, Staphylococcus aureus
gtgtgcatcatgcacaatgagaaattaattaaaggcttatatgactatcgtgaggaacatgatgcgtgtggtattggtttttatgcgaatatggataataaaaggtctcacgacatcattgataaatcgcttgaaatgttgcgacgcttagatcacaggggcggggtcggcgcagatggcatcactggtgatggcgcaggtattatgactgaaataccttttgcatttttcaaacaacatgtaacggactttgatatcccaggtgaaggtgaatatgccgtggggttatttttttccaaagaacgcattttaggttctgaacatgaagtagtttttaaaaaatattttgaaggcgaagggttatcaattcttggttatcgtaatgtaccagttaataaagatgccattgctaaacatgtagcagatacgatgccagtcattcaacaagtgtttattgatattagggacattgaagatgttgaaaagcgtttgtttttagcgagaaaacaattagagttctattcgactcagtgcgatttagaattgtattttacgagcttatcacgcaaaacaattgtatataaaggttggttacgatcagaccaaattaaaaaactatatacagatttatcggatgatttatatcaatcaaagctagggttagtgcattcgagatttagtacgaatacattcccgagttggaaaagggcacatcctaaccgtatgttaatgcataatggtgagattaacacgattaaaggtaatgtaaactggatgcgagcacgccaacataaattaatcgaaacattatttggcgaggatcaacataaagtgtttcaaattgtcgatgaggatggtagtgactctgccattgtagataatgcgctagagttcttatcgttagccatggagccagaaaaggcagcgatgttactcatacctgaaccttggttatataatgaagcgaatgatgcaaatgtacgtgcgttttatgaattttatagttatttaatggaaccgtgggatggtcctacaatgatttcgttctgtaacggtgacaaacttggcgcgcttacagatagaaatggattacgtccaggtcgttatacgattactaaagataactttattgtcttttcatctgaagtgggtgttgtggacgtacctgaaagtaatgttgcttttaaaggtcaattgaatcctggaaagttattgcttgttgattttaaacagaataaagtcattgaaaataatgatttaaaaggtgcgattgctggagaattaccatataaagcgtggattgataaccataaagttgactttgattttgaaaatatacaatatcaagattcgcaatggaaagatgagacgttatttaaattacaacgtcagtttgcatacacgaaagaagagattcataagtatattcaggaacttgtagaaggtaagaaggatcctatcggtgcaatgggatatgatgcgccaattgcagtgttgaacgagcgaccagaatcactatttaattactttaaacagctgtttgcacaagttacgaatccaccaattgatgcgtatcgtgaaaaaatcgtaacgagtgaactttcttatttaggtggcgaaggtaacttactagcacctgacgaaacggttttagatcgtattcaattgaaaaggccggtattgaatgaatcacacttagcagcgattgatcaggaacattttaaattaacttatttatcaacggtatatgaaggggatttggaagatgcgttagaagcattaggccgagaagcagtgaatgctgtaaagcaaggcgctcaaattctagtgttagatgatagtggattagttgatagcaatggctttgcaatgccgatgttactcgcaataagtcatgtgcatcaattacttattaaagcagatttacgtatgtctacaagtttagtcgctaaatctggtgagacacgagaagtgcatcatgttgcttgtttactcgcatatggcgcgaatgcaattgtgccatacctagcgcaacgtacagttgaacaactgacattgacagaagggttacaaggcaccgttgtcgataatgttaagacatatacggatgtattgtcagaaggtgtcattaaagtaatggctaagatgggaatttcgacagtgcaaagttatcaaggggcacaaatatttgaagcgattggcttgtctcatgatgtgattgatcgttattttactgggacacagtctaagttatctggtatttcgattgatcaaattgatgctgaaaataaagcacgtcaacaaagtgatgataattatcttgcatcaggtagtacattccaatggagacaacaaggtcaacatcatgcttttaatccggaatctattttcttattgcagcacgcatgtaaagaaaatgactatgcgcaatttaaagcatactctgaagcggtgaacaaaaatagaacagatcacattagacatttacttgaatttaaagcatgtacaccgattgacatcgaccaagttgaaccggtaagtgacattgtcaaacgctttaatacaggggcgatgagttatggatcgatttcagcggaagcacatgaaacgttagcacaagccatgaaccaattaggtggaaagagtaatagtggtgaaggtggcgaagatgcaaaacgttatgaagtacaagttgatggaagcaacaaagtaagtgcgattaaacaagttgcttctgggcgttttggtgtaactagtgattatttacaacatgccaaagaaattcaaattaaagttgcgcaaggtgcaaagcctggtgaaggtggtcaattacctggtactaaggtatatccgtggattgcgaagacaagagggtcaacgccaggtatcggtctgatttcaccaccgccacatcatgatatttattcaatagaagatttagcgcaactgatacatgatttgaaaaatgcgaataaagatgcagatatcgcggtaaaattagtttcgaaaacaggtgttggtaccattgcatctggggtggcaaaagcatttgcagataaaattgtcatcagtggttacgatggtggtacaggggcttcacccaaaacgagtattcagcatgccggtgttccttgggagattggtttagcagaaacacatcaaacattaaaactaaatgacttaagaagtcgtgttaagttagaaacagacggtaagttattaactggtaaagatgtagcgtacgcatgtgcgcttggagcggaagaatttggatttgcaactgcaccattagtggtgttgggctgtattatgatgcgtgtatgccataaagatacatgtccagtaggagttgcaactcaaaacaaagatttacgtgctttatatagaggtaaagcacatcatgttgttaattttatgcattttattgcacaagaattaagagaaattttagcatctttaggtttgaaacgtgtagaagacttagttggaagaactgatttattacaacgatcatcaacattaaaagcgaatagcaaagcggctagtattgatgttgaaaaactgttatgtcctttcgatgggccaaacacaaaagaaattcaacaaaatcataatcttgagcatggatttgatttaacaaatttatatgaagtaacgaagccatatattgctgaagggcgtcgctatacaggtagctttacagtaaataatgaacaacgtgatgtaggggttattacaggtagtgagatttcgaaacaatatggagaagcaggacttcctgaaaatacaattaatgtttatacgaatggtcatgctggtcaaagtcttgcagcatatgcaccgaaaggcttaatgattcatcatactggagatgcgaatgactatgttggtaaaggattatctggtggtacggtcattgtcaaagcaccttttgaagaacgacaaaatgaaattattgctggtaacgtctcattctatggtgcgacaagtggtaaggcatttattaacggtagtgcaggagaaagattctgtattagaaatagtggtgtagatgttgtcgttgaaggtatcggcgaccatggattagagtatatgactggtggacatgtcattaatttaggtgatgtaggtaagaacttcggtcaaggtatgagtggtggtattgcttacgttatcccgtctgatgtagaagcttttgttgaaaataatcaactagatacgctttcgtttacaaagattaaacaccaagaagaaaaagcattcattaagcaaatgctggaagaacatgtgtcacacacgaatagtacgagagcgattcatgtgttaaaacattttgatcgcattgaagatgtcgtcgttaaagttattcctaaagattatcaattaatgatgcaaaaaattcatttgcacaaatcattacatgacaatgaagatgaagcgatgttagctgcattttacgatgacagtaaaacaatcgatgctaaacataaaccagccgttgtgtat

SEQ ID NO: 1696 - protein, 1502 aa, Staphylococcus aureus
  MISC_FEATURE (1)..(1502): glutamate synthase large
VCIMHNEKLIKGLYDYREEHDACGIGFYANMDNKRSHDIIDKSLEMLRRLDHRGGVGADGITGDGAGIMTEIPFAFFKQHVTDFDIPGEGEYAVGLFFSKERILGSEHEVVFKKYFEGEGLSILGYRNVPVNKDAIAKHVADTMPVIQQVFIDIRDIEDVEKRLFLARKQLEFYSTQCDLELYFTSLSRKTIVYKGWLRSDQIKKLYTDLSDDLYQSKLGLVHSRFSTNTFPSWKRAHPNRMLMHNGEINTIKGNVNWMRARQHKLIETLFGEDQHKVFQIVDEDGSDSAIVDNALEFLSLAMEPEKAAMLLIPEPWLYNEANDANVRAFYEFYSYLMEPWDGPTMISFCNGDKLGALTDRNGLRPGRYTITKDNFIVFSSEVGVVDVPESNVAFKGQLNPGKLLLVDFKQNKVIENNDLKGAIAGELPYKAWIDNHKVDFDFENIQYQDSQWKDETLFKLQRQFAYTKEEIHKYIQELVEGKKDPIGAMGYDAPIAVLNERPESLFNYFKQLFAQVTNPPIDAYREKIVTSELSYLGGEGNLLAPDETVLDRIQLKRPVLNESHLAAIDQEHFKLTYLSTVYEGDLEDALEALGREAVNAVKQGAQILVLDDSGLVDSNGFAMPMLLAISHVHQLLIKADLRMSTSLVAKSGETREVHHVACLLAYGANAIVPYLAQRTVEQLTLTEGLQGTVVDNVKTYTDVLSEGVIKVMAKMGISTVQSYQGAQIFEAIGLSHDVIDRYFTGTQSKLSGISIDQIDAENKARQQSDDNYLASGSTFQWRQQGQHHAFNPESIFLLQHACKENDYAQFKAYSEAVNKNRTDHIRHLLEFKACTPIDIDQVEPVSDIVKRFNTGAMSYGSISAEAHETLAQAMNQLGGKSNSGEGGEDAKRYEVQVDGSNKVSAIKQVASGRFGVTSDYLQHAKEIQIKVAQGAKPGEGGQLPGTKVYPWIAKTRGSTPGIGLISPPPHHDIYSIEDLAQLIHDLKNANKDADIAVKLVSKTGVGTIASGVAKAFADKIVISGYDGGTGASPKTSIQHAGVPWEIGLAETHQTLKLNDLRSRVKLETDGKLLTGKDVAYACALGAEEFGFATAPLVVLGCIMMRVCHKDTCPVGVATQNKDLRALYRGKAHHVVNFMHFIAQELREILASLGLKRVEDLVGRTDLLQRSSTLKANSKAASIDVEKLLCPFDGPNTKEIQQNHNLEHGFDLTNLYEVTKPYIAEGRRYTGSFTVNNEQRDVGVITGSEISKQYGEAGLPENTINVYTNGHAGQSLAAYAPKGLMIHHTGDANDYVGKGLSGGTVIVKAPFEERQNEIIAGNVSFYGATSGKAFINGSAGERFCIRNSGVDVVVEGIGDHGLEYMTGGHVINLGDVGKNFGQGMSGGIAYVIPSDVEAFVENNQLDTLSFTKIKHQEEKAFIKQMLEEHVSHTNSTRAIHVLKHFDRIEDVVVKVIPKDYQLMMQKIHLHKSLHDNEDEAMLAAFYDDSKTIDAKHKPAVVY

SEQ ID NO: 1697 - DNA, 882 bp, Staphylococcus aureus
atggaaattaaacaattaagatattttatcgaggtcgctaaaagagaacatatctccgaaacagcacttgaactaaacattgctcaatcagcgataagccgtcaaattacattattagaacaagaacttaatgtgtctttatttaaaaagcaaggacgcaatattacgctcacatctgaagggaaattattatttaatgaagctctgcgtattattgaacatttagatagcacgattgaacaatttcaaagccatggattaactaaaaataaaagtatctacattggctatgatgagagtgacgtatcccacatgttactaccacttatccaaacgtttcatttacaaaatgatacacatgtcataccgagcttattagaacatgacacaattataaatagcgtattaaatgggaatatagacattggtttcacggaacttacaccagaaatacgtaaacacaaacaattacatatgctacctttattcgaagagcactatcatttatatgcgccttcagacgatccaattacgatggcgacacacccaccattaattcagtttgagcatagtcatatttattgcttggcaccatttgccgaaactgtaaaaaaacaattgcgcaagattactaaatcagatgtatacacaatcagtagccaaccacttgcgcagtatctccttcgtcaaaaagaaggttacatcatttcatcacaaaatatacatttaccagaatctaaatcatggatagatataaaattagatcatactgaattaaaaagaacgatatgtgctattacaaaggagccttatacaaagagtgatattggcatattattaacacttattcagcaattaatgactaaaacgtctacattccat

SEQ ID NO: 1698 - protein, 294 aa, Staphylococcus aureus
  MISC_FEATURE (1)..(294): transcription activator of
MEIKQLRYFIEVAKREHISETALELNIAQSAISRQITLLEQELNVSLFKKQGRNITLTSEGKLLFNEALRIIEHLDSTIEQFQSHGLTKNKSIYIGYDESDVSHMLLPLIQTFHLQNDTHVIPSLLEHDTIINSVLNGNIDIGFTELTPEIRKHKQLHMLPLFEEHYHLYAPSDDPITMATHPPLIQFEHSHIYCLAPFAETVKKQLRKITKSDVYTISSQPLAQYLLRQKEGYIISSQNIHLPESKSWIDIKLDHTELKRTICAITKEPYTKSDIGILLTLIQQLMTKTSTFH

SEQ ID NO: 1699 - DNA, 1116 bp, Staphylococcus aureus
ttgtttttgaaatatagaaatttatttacaaagccatttaatataattttaggtttgttctgcatcgcattcattggtgctattttatttacattcaataatgagaacttttacaacaaaccaattggtcaaattatagatgtcaaacatgtttcttcgacacctacaaaagatgcacaaaataatcgtgatattaaatataaaaatcaattaaaagtcaaaatattaaatggtcaatttgctggagaaacgacgacgattaatcatcagtacgtcaaatcgcaagcagattctgaggcatttcgcacacacgaaaaagtattattacatatttctaacaagccgagtgatgcttatattatagaaaagaagcgtgataccttaacggttatcatcactggtttgttcttattaactgtattattggttggtcgcaaagtcggactgcaatcgattttatcgttaatcttgaattctattgccatattaatcgcaatttacattcatattcaacatagcaatattaatttattcttactcatgaccattgccatgatctgttcaacaatactcactttattgctcgttacaggctggcatatgcgtacactcattaccatagccagtacaattatcggaacttttttgagtataggtttaacagaattaatcatatatatgacagatggtaaaggcattaaatatgaaacgatgaactttttatcattaccaccgaaagatatcttcctagcctcagtgttaataggttcacttggcgctattatggatgttgcaattacaattgctagtggtatgcatgaaattttacagcgtacgccacacatttcaatgaggagatgggcgcttgctgggcgaaacatcggccaagatattatgggaacaatgactaacatcttattattctcatatttatccggtgcactacctatgtttttaatctttttaaaaaatgccaatacagtgacttatactatttcgatgaattggtcgttagaaattgcgcgcgcactaacaggtggtataggtatcgtacttacaattcctatcacaatattgtttatggaaatatttgaaacattaaggagggcgaaacaa

SEQ ID NO: 1700 - protein, 372 aa, Staphylococcus aureus
  MISC_FEATURE (1)..(372): conserved hypothetical
LFLKYRNLFTKPFNIILGLFCIAFIGAILFTFNNENFYNKPIGQIIDVKHVSSTPTKDAQNNRDIKYKNQLKVKILNGQFAGETTTINHQYVKSQADSEAFRTHEKVLLHISNKPSDAYIIEKKRDTLTVIITGLFLLTVLLVGRKVGLQSILSLILNSIAILIAIYIHIQHSNINLFLLMTIAMICSTILTLLLVTGWHMRTLITIASTIIGTFLSIGLTELIIYMTDGKGIKYETMNFLSLPPKDIFLASVLIGSLGAIMDVAITIASGMHEILQRTPHISMRRWALAGRNIGQDIMGTMTNILLFSYLSGALPMFLIFLKNANTVTYTISMNWSLEIARALTGGIGIVLTIPITILFMEIFETLRRAKQ

SEQ ID NO: 1701 - DNA, 780 bp, Staphylococcus aureus
atgaatgctgtatttatattggcgttattgctcctctttctgatgataattttcggaggtaaaaagggattcatctcttatttaaccctatttttaaatttcgctattttaattattagtattgtattgattatttttggcgtaccgatttatgtcgtcacattctttttctgcattattattggcgcttgtaatttattcgtactcaatagttacaatgttaaaacacaagctgcatttatcagcactatcgttacaacaatattgttgattacactcatttatttatcggtctacttcggtcatctacaaggcttttcaaccgaacaacaagatgaaacatatgtgtattcaatgaatattggcattgatatggttcaatttatggtgttcactattattcttgctgttattgcagctgtgatagatttaacaattaccattagttcacccatttatgaattgcatcaagtgaatccaacgcttacgcaatacgaattattccaatctggcatgcgtgttggtagagaaattttagcgacatctgcgaacacgatttaccttgccttttttggtggccaacttgctttatttatttggtttttcaaacttaaatattcatttggtcatattataaactcgaaaatatttgcccaagaatttatttctattattttaggcggtattgccgttgcaatcagtattccgattacggcttggattacggcatttttaataaaaagaccatctcgacagcgcaaaaatgatgagtctatcaat

SEQ ID NO: 1702 - protein, 260 aa, Staphylococcus aureus
  MISC_FEATURE (1)..(260): conserved hypothetical
MNAVFILALLLLFLMIIFGGKKGFISYLTLFLNFAILIISIVLIIFGVPIYVVTFFFCIIIGACNLFVLNSYNVKTQAAFISTIVTTILLITLIYLSVYFGHLQGFSTEQQDETYVYSMNIGIDMVQFMVFTIILAVIAAVIDLTITISSPIYELHQVNPTLTQYELFQSGMRVGREILATSANTIYLAFFGGQLALFIWFFKLKYSFGHIINSKIFAQEFISIILGGIAVAISIPITAWITAFLIKRPSRQRKNDESIN

SEQ ID NO: 1703 - DNA, 504 bp, Staphylococcus aureus
ttgaaacttatggtggtaaacatgacaaataatgacaccatcatgttacgacattatgtcccacaagattattcgatgttagaagcttttcaattaagtgaaagtgatttgaagtttgttaaaacgccagaggaaaatattacagctgcaatgtctgataatgaaaggtatcccatcgttgtaatggatggcaggcaatgtgtggccttttttacattacatcgtggaaaaggggtcgcaccatttagcgataaccaagatgcagtatttttcaggtcatttagtgttgatcaacgttatcgtaatagaggaataggtaaagtggtaatggaaaaattggcgtcatttatcacttcaacatttcaggatattaatgagattgtgttaacggttaatactgacaatccacatgccatggcactttatcgccaacaaggatatcaatatatgggagatagtatgttcgtcggaagacctgttcatattatggcgttaactataaaa

SEQ ID NO: 1704 - protein, 168 aa, Staphylococcus aureus
  MISC_FEATURE (1)..(168): conserved hypothetical
LKLMVVNMTNNDTIMLRHYVPQDYSMLEAFQLSESDLKFVKTPEENITAAMSDNERYPIVVMDGRQCVAFFTLHRGKGVAPFSDNQDAVFFRSFSVDQRYRNRGIGKVVMEKLASFITSTFQDINEIVLTVNTDNPHAMALYRQQGYQYMGDSMFVGRPVHIMALTIK

SEQ ID NO: 1705 - DNA, 402 bp, Staphylococcus aureus
gtgtcaaagatgattaaatgtgtctgtttagttgaagaaacagctgataaaatattgcttgttcaagtaaggaatcgcgaaaagtattatttcccgggtggtaaaatagaagaaggggaatcacaagtacacgcgctgttaagagaagtaaaagaagaattaaatttaacattaacaatggatgaaattgaatatgtcgggacaattgtaggtcctgcatatccacaacaggatatgttaactgagttaaatggatttcgcgcattaaccaaaatcgattgggaaaacgtaactatcaataatgaaattacggatatacgctggattgataaagataatgatgcgttgattgcgcctgctgtcaaagtttggattgaaacttatggtggtaaacatgacaaa

SEQ ID NO: 1706 - protein, 134 aa, Staphylococcus aureus
  MISC_FEATURE (1)..(134): conserved hypothetical
VSKMIKCVCLVEETADKILLVQVRNREKYYFPGGKIEEGESQVHALLREVKEELNLTLTMDEIEYVGTIVGPAYPQQDMLTELNGFRALTKIDWENVTINNEITDIRWIDKDNDALIAPAVKVWIETYGGKHDK

SEQ ID NO: 1707 - DNA, 267 bp, Staphylococcus aureus
atggcaaaacgttccaaatcacaacgtttatcaagtttactaaatgtcgcaggtttcatagtcgacggctacaatggctataaatatcatgctaaaaataaaaaattagtatatctttcattaggtttaagcactgtaggaaccgtgttagacttttacatttcaattaagtcaccacgtaagttcaaaaaagcagtggcagttgttactttaataacaaacggtgctagattatttacaagcattcgcaaagtaaaacatgaatac

SEQ ID NO: 1708 - protein, 89 aa, Staphylococcus aureus
  MISC_FEATURE (1)..(89): hypothetical protein
MAKRSKSQRLSSLLNVAGFIVDGYNGYKYHAKNKKLVYLSLGLSTVGTVLDFYISIKSPRKFKKAVAVVTLITNGARLFTSIRKVKHEY

SEQ ID NO: 1709 - DNA, 1002 bp, Staphylococcus aureus
gtgcaaaaaaaagtaattgcagctattattgggacaagcgcgattagcgctgttgcggcaactcaagcaaatgcggctacaactcacacagtaaaaccgggtgaatcagtgtgggcaatttcaaataagtatgggatttcgattgctaaattaaagtcattaaacaatttaacatctaatctaattttcccaaaccaagtactaaaagtatctggctcaagtaattctacgagtaatagtagccgtccatcaacgaactcaggtggcggatcatactacacagtacaagcaggcgactcattatcattaatcgcatcaaaatatggtacaacttaccaaaacattatgcgacttaatggtttaaataatttctttatttatccaggtcaaaaattaaaagtatcaggtactgctagctcaagtaacgctgcgagcaatagtagccgtccatcaacgaactcaggtggcggatcatactatacagtacaagcaggtgactcattgtcattaattgcatcaaaatatggtacaacttatcaaaaaattatgagcttaaatggcttaaataatttctttatatatccgggtcaaaaattgaaagtaactggtaatgcatctacgaactcaggatctgcaacaacgacaaatagaggttacaatacaccagtattcagtcaccaaaacttatatacatggggtcaatgtacatatcatgtatttaatcgtcgtgctgaaattggtaaaggtattagtacttattggtggaatgctaataactgggataacgcagcggcagcagatggttacactatcgacaatagacctactgtaggttctatcgctcaaacagatgtaggttactatggtcatgttatgtttgtagaacgtgtaaataacgatggtagtattttagtttcagaaatgaactattcagctgcaccaggtattttaacttacagaacggtaccagcttaccaagtaaataattatagatatattcac

SEQ ID NO: 1710 - protein, 334 aa, Staphylococcus aureus
  MISC_FEATURE (1)..(334): hypothetical protein
VQKKVIAAIIGTSAISAVAATQANAATTHTVKPGESVWAISNKYGISIAKLKSLNNLTSNLIFPNQVLKVSGSSNSTSNSSRPSTNSGGGSYYTVQAGDSLSLIASKYGTTYQNIMRLNGLNNFFIYPGQKLKVSGTASSSNAASNSSRPSTNSGGGSYYTVQAGDSLSLIASKYGTTYQKIMSLNGLNNFFIYPGQKLKVTGNASTNSGSATTTNRGYNTPVFSHQNLYTWGQCTYHVFNRRAEIGKGISTYWWNANNWDNAAAADGYTIDNRPTVGSIAQTDVGYYGHVMFVERVNNDGSILVSEMNYSAAPGILTYRTVPAYQVNNYRYIH

SEQ ID NO: 1711 - DNA, 867 bp, Staphylococcus aureus
gtgaagattttgaaaggaattgatagaatgaaaagattgattgggttagttatcgtagcacttgtattattagcagcgtgtggtggtaacaatgataaaaaagtaacaattggtgtcgcatcaaatgacactaaggcttgggagaaggttaaagaattagctaaaaaagatgatattgatgtggagattaagcacttctcagattacaatttaccgaataaagcattaaatgatggtgatattgatatgaatgcattccaacattttgcatttttagatcaatataaaaaggcgcataaaggaacaaagatttcagcattaagtacaacagttttagcaccgttgggcatttactcagataaaattaaagatgtcaaaaaggttaaagatggtgctaaagttgtcattccaaatgatgtgtcaaaccaagcacgtgcacttaaactattagaagcagctggtttaataaaactgaaaaaagatttcggattagcaggcacggtgaaagatataacgtcaaatccaaaacatttaaaaattactgcagtagatgcacaacaaactgcacgtgctttatctgatgtcgatattgcagttattaataacggtgtagcaactaaagcgggtaaagatcctaaaaatgatccgatatttttagaaaaatcaaattcagatgcagtaaagccatatattaatattgttgcagttaatgacaaagacttggataacaaaacatatgctaaaatcgtagaattgtatcattcaaaagaagctcaaaaagcgttgcaggaagatgtcaaagatggagagaaacctgttaatttatctaaagatgagattaaggcaatagaaacgtcattagcaaaa

SEQ ID NO: 1712 - protein, 289 aa, Staphylococcus aureus
  MISC_FEATURE (1)..(289): hypothetical protein
VKILKGIDRMKRLIGLVIVALVLLAACGGNNDKKVTIGVASNDTKAWEKVKELAKKDDIDVEIKHFSDYNLPNKALNDGDIDMNAFQHFAFLDQYKKAHKGTKISALSTTVLAPLGIYSDKIKDVKKVKDGAKVVIPNDVSNQARALKLLEAAGLIKLKKDFGLAGTVKDITSNPKHLKITAVDAQQTARALSDVDIAVINNGVATKAGKDPKNDPIFLEKSNSDAVKPYINIVAVNDKDLDNKTYAKIVELYHSKEAQKALQEDVKDGEKPVNLSKDEIKAIETSLAK

SEQ ID NO: 1713 - DNA, 1077 bp, Staphylococcus aureus
ttgaaattggtttatcttattaaaatgttgatattagttttagggggaaatgtagtgatttcattcgaaaatgattatttagaaggtgctcatgaaaaagtattaaaacgattagtagatacaaatcttgtacaagcttcgggatatggctttgatcaattcacagctcaggcaattgaaaagattaaagatacaattgactgtccaaatgctacaattcgttttttagtaggtggaacacaaaccaatcaggttgttattaattcaatgttagaaagttacgaaggggtcatttcagcagacactggtcatgttgctgtgcatgagggcggtgcaattgaatatagtggacataaagtaattactataccctctaaggaaggaaaagttagtgcttcagatgttgaaacttacatggagacatttaaaagtgattttaaaaaggaccatatggtattcccaggaatggtatatatttctcatcctacagaatatggcacattatactctaaatcagaattggaagagttatgcaaagtatgtaagcaatatcagcttccattatttatggatggtgcacgattagggtatggattgatgagtgaccaatcagatatgactattaaagacatcgctaaatattgtgatgtattttatataggtggtacgaagataggtgcattatgcggggaagccattgtttttacgaaaaataatgaaccgaaacaatttaccactcgaatcaagcatcacggtgcccttttagcaaaaggacggttaacaggcatacaatttttagaattatttacggacaatttatattttaatataagcagacatgctatcgaaatggcaaataagatgaaagacgggtttaaaaataaaggctatcgtctttactttgattctccaaccaatcaacaattttttattttaagtaacgagaaaatagcagagttagaacaaaaagttaaatttgctgtttgggaaaaatacgatgatcaacatcgtgttgttagattcgcaaccagttgggcgacaaccgaagaaaatttaaataaactattagaattaatc

SEQ ID NO: 1714 - protein, 359 aa, Staphylococcus aureus
  MISC_FEATURE (1)..(359): conserved hypothetical
LKLVYLIKMLILVLGGNVVISFENDYLEGAHEKVLKRLVDTNLVQASGYGFDQFTAQAIEKIKDTIDCPNATIRFLVGGTQTNQVVINSMLESYEGVISADTGHVAVHEGGAIEYSGHKVITIPSKEGKVSASDVETYMETFKSDFKKDHMVFPGMVYISHPTEYGTLYSKSELEELCKVCKQYQLPLFMDGARLGYGLMSDQSDMTIKDIAKYCDVFYIGGTKIGALCGEAIVFTKNNEPKQFTTRIKHHGALLAKGRLTGIQFLELFTDNLYFNISRHAIEMANKMKDGFKNKGYRLYFDSPTNQQFFILSNEKIAELEQKVKFAVWEKYDDQHRVVRFATSWATTEENLNKLLELI

SEQ ID NO: 1715 - DNA, 657 bp, Staphylococcus aureus
atgtttggttctgatttagacagtgcacagttattacaagcattgtacgaaacgctatatatggtatctattgctttatttttaggagcagtgattggtattccattaggtgtcttattggtaattactcgaaaacaaggcatatggcccaatatagtgatacatcaagttttaaatcctttaatcaatattttaaggtcactaccatttattattttgttaattgcgattgtgccattcacaaaattagtagtaggtacttcaattggtacgactgctgccatcgtgcctttaacagtatatgtggcaccttacattgcaagacttgttgaaaactcattattggaagtagacgaggggattattgaagcggcgaaagcgatgggcgcttcaccactacaaatcattagatattttttaattcctgaagctttaggttcgttagtattagcaattaccactgcgattattggacttattggaagtacggcgatggcaggagctgttggcggtggtggtataggagacttagctttagtgtatggttatcaaagatttgatacgacggtcattattattaccgttattgtattagtcattattgtccaagtgattcaaacgctagggaatgttctagctagattcatacgtagacat

SEQ ID NO: 1716 - protein, 219 aa, Staphylococcus aureus
  MISC_FEATURE (1)..(219): hypothetical protein
MFGSDLDSAQLLQALYETLYMVSIALFLGAVIGIPLGVLLVITRKQGIWPNIVIHQVLNPLINILRSLPFIILLIAIVPFTKLVVGTSIGTTAAIVPLTVYVAPYIARLVENSLLEVDEGIIEAAKAMGASPLQIIRYFLIPEALGSLVLAITTAIIGLIGSTAMAGAVGGGGIGDLALVYGYQRFDTTVIIITVIVLVIIVQVIQTLGNVLARFIRRH

SEQ ID NO: 1717 - DNA, 1026 bp, Staphylococcus aureus
atgatgattgagtttcgacaggtaagtaagacctttaataaaaagaagcaaaaaatagatgctttgaaggacgtatcatttacggtcaatcgcaatgatatttttggtgtgattggatatagtggtgcaggaaaaagtacgttggtaagactcgtgaatcatcttgaagctgcctcgaatggacaagtgattgtagatggacatgatattacgaattatagcgataaaatgatgagggatattaagaaagatatcggtatgatatttcagcatttcaatttattaaattcagctaccgtatttaaaaatgtagcaatgccactcattttaagtaagaaaagcaaaacagaaattaagcaacgagtaacggaaatgcttgaatttgtaggattgagtgataaaaaagaccaatttcctgatgaattatctggtgggcagaagcaaagggtggctattgcaagagcgcttgttactaatccgaaaatactcctatgcgatgaagcaacaagcgcattggatccagcaacgactgcttcgatattgacgttattaaagaatgtcaatcaaacctttggcattacaattatgatgattacacatgaaatgcgcgttattaaagacatttgtaatcgtgttgctgtaatggaaaaggggaaagtggttgaaacaggaactgttaaagaggtgtttagtcatcctaaaacgacgattgctcaaaattttgtgtctacagttatacagactgagccaagtacatcattgattcgtcgattgaatgacgaacaagttggcgattttaaagattataaaatcttcgtcgaggaaactcaggtgacacaaccgattataaatgacttgattcaaatttgtggcagagaggttaaaattttattttcatctatgtcagaaatacaaggtaacaccgtatgttatatgtggcttcgatttaatatggatcaacaatttgaagacacggcaataaatcaatatttcaaagagaaaaatattcaatttgaggaggtgcat

SEQ ID NO: 1718 - protein, 342 aa, Staphylococcus aureus
  MISC_FEATURE (1)..(342): hypothetical protein
MMIEFRQVSKTFNKKKQKIDALKDVSFTVNRNDIFGVIGYSGAGKSTLVRLVNHLEAASNGQVIVDGHDITNYSDKMMRDIKKDIGMIFQHFNLLNSATVFKNVAMPLILSKKSKTEIKQRVTEMLEFVGLSDKKDQFPDELSGGQKQRVAIARALVTNPKILLCDEATSALDPATTASILTLLKNVNQTFGITIMMITHEMRVIKDICNRVAVMEKGKVVETGTVKEVFSHPKTTIAQNFVSTVIQTEPSTSLIRRLNDEQVGDFKDYKIFVEETQVTQPIINDLIQICGREVKILFSSMSEIQGNTVCYMWLRFNMDQQFEDTAINQYFKEKNIQFEEVH

SEQ ID NO: 1719 - DNA, 1140 bp, Staphylococcus aureus
atgaacaagaaaactaaattaattcatggtgggcacacaacagacgattatacaggtgccgttacaacaccaatttatcaaacaagtacatatttacaagatgatattggtgatttacgtcaaggatatgaatattctcgtactgcgaatccaacaagaagttctgtagaaagcgttattgcgacattagaaaatggcaaacatggctttgcatttagttcaggtgttgcagcaatcagtgcagttgttatgctgttggacaaaggagatcatattattttaaattcagatgtatacggcggtacttatcgcgcattgacaaaagtatttacacgatttggcattgaagtggattttgtagatacaacgcatacagattcaattgtacaagcgatacgcccaacaacaaagatgttgtttattgaaacaccttctaatccattattacgtgttactgacattaaaaagtctgctgaaattgcgaaagaacacggtttgatttcagttgttgataacacatttatgacaccttattatcagaatccattagatttaggtatcgatattgtcttacattctgcaacgaaatatttaggtggacatagtgatgtcgttgctggtttagttgcaacatcggatgacaagcttgcagaacgtttagcatttatttcaaattcaacaggtggcattttaggacctcaagatagctatttacttgtgaggggtattaaaacattaggtttacgtatggaacaaattaatcgcagcgttattgaaattattaaaatgttacaagcacatccagctgtgcaacaagtgttccatccaagtattgaaagtcatttaaatcatgatgtccatatggctcaagcggatggccatacaggtgtgattgcatttgaagtgaaaaatacagaaagtgccaaacaattgattaaagcaacatcgtattacacattagctgaaagtttaggtgcagtggaaagtttaatttcagtacctgcattgatgacacatgcatccattccagcagatattcgagctaaagaaggtattacagacggacttgtaagaatttctgtaggtattgaagatactgaagatttagtcgatgatttaaaacaagcactagatacttta

SEQ ID NO: 1720 - protein, 380 aa, Staphylococcus aureus
  MISC_FEATURE (1)..(380): cystathionine
MNKKTKLIHGGHTTDDYTGAVTTPIYQTSTYLQDDIGDLRQGYEYSRTANPTRSSVESVIATLENGKHGFAFSSGVAAISAVVMLLDKGDHIILNSDVYGGTYRALTKVFTRFGIEVDFVDTTHTDSIVQAIRPTTKMLFIETPSNPLLRVTDIKKSAEIAKEHGLISVVDNTFMTPYYQNPLDLGIDIVLHSATKYLGGHSDVVAGLVATSDDKLAERLAFISNSTGGILGPQDSYLLVRGIKTLGLRMEQINRSVIEIIKMLQAHPAVQQVFHPSIESHLNHDVHMAQADGHTGVIAFEVKNTESAKQLIKATSYYTLAESLGAVESLISVPALMTHASIPADIRAKEGITDGLVRISVGIEDTEDLVDDLKQALDTL

SEQ ID NO: 1721 - DNA, 963 bp, Staphylococcus aureus
atgaagaaaggtttcattcatttgatcggcatgtcagatgagggtgcatctatgattacttatgatttaattggcaatacaccattagtactgttagaacattatagtgatgataaagttaaaatttatgccaagcttgaacaatggaatcctggaggcagtgttaaagacagactcgggaaatatttagtagagaaggcaattcaagaagggcgtgtgcgtgcaggtcaaactattgttgaagcgactgctggtaatacaggcatagggttagctattgcagcgaatagacatcatttgaaatgtaagatctttgcgccgtatggtttttcagaagaaaagattaatattatgatagcgcttggtgcagaagtttcaaggacgagtcagtctgaaggtatgcatggggcacaattagctgcacgttcctatgctgaaaaatatggtgccgtttatatgaatcaatttgaatccgaacataatccggatacatattttcatacattgggacccgaattgacttcagcattacagcaaattgattattttgtggctggtattggctctggcggtacatttacaggtaccgcacgttatttaaagcaacatcacgtgcaatgttatgccgttgagccagaagggtccgtgttaaatggagggccagctcatgcacatgacactgaaggtatcggttctgagaaatggccgatatttttagagagacgtcttgtagatgggatatttacgattaaagatcaagatgcctttcgaaatgtcaaaagtttggctataaatgaagggttgttagtaggcagttcttcaggtgcagcattacaaggtgcattgaatttaaaagcgcaattatctgaaggtacgattgttgtcgtatttccagatggtagtgatcgatatatgtctaagcaaatatttaattatgaggagaataataatgaacaagaaaac

SEQ ID NO: 1722 - protein, 321 aa, Staphylococcus aureus
  MISC_FEATURE (1)..(321): cysteine synthase homologue
MKKGFIHLIGMSDEGASMITYDLIGNTPLVLLEHYSDDKVKIYAKLEQWNPGGSVKDRLGKYLVEKAIQEGRVRAGQTIVEATAGNTGIGLAIAANRHHLKCKIFAPYGFSEEKINIMIALGAEVSRTSQSEGMHGAQLAARSYAEKYGAVYMNQFESEHNPDTYFHTLGPELTSALQQIDYFVAGIGSGGTFTGTARYLKQHHVQCYAVEPEGSVLNGGPAHAHDTEGIGSEKWPIFLERRLVDGIFTIKDQDAFRNVKSLAINEGLLVGSSSGAALQGALNLKAQLSEGTIVVVFPDGSDRYMSKQIFNYEENNNEQEN

SEQ ID NO: 1723 - DNA, 1338 bp, Staphylococcus aureus
atgatgaaaagacaacaatcacaatggaagtcatcaactggatttattttagctagtgcgggttctgcaatcggtcttggtgccatgtggaaattcccatatatggcagggatttatggcggcggtgcctttctagctatgttcttaatattcaccatttttgttgggttgccattactcattatggaattcactgttgggaaaatgggacggacatatacaacacaaatatatagtaaattaactggtaaaaaatggctcaatatcattggctggaacggtaatttggcagtgtttattttatttggcttctatagtgttatcggtggttggattgtcatttacatcggacaagtattatggcaattagttatatttcaacgcatcaatcatctccaagaaatgaattttgaagcggtaatatcaaatccttggttaaccgttctagggcaaggtatattcatattcgctacgatgattattgtcatgttaggtgttgaaaaaggattagaaaaggcatcgaaagttatgatgccattgctgtttgtctttttaatcgtcattgtgattaagtctttaacattagatggcgtcttagaaggtgtgaaatttattttacaaccaagagtatcagagattactgctgatggcatcttgtttgcgctaggtcaatcattctttacgttatcattaggaactacaggtatgattacttatgcgagttatgcctctaaagacatgacgattaagtcatcagctatttctatcgttgttatgaatatctttgtatctgtattggcaggtctagctatatttccggctttacatagttttggctatgaaccacaagaagggcctggattattatttaaagtactgccaatggtctttagtcaaatgcatctaggcacattattctatttgggattcttagtgctgttcttatttgcggctttaacgtcatctatttctttattagaattaaatgtttctaacttcacgaagaatgacaatacaaaacgtaaaaaagtcgcagtgatcggtagtattttagtatttatcattagtattccagcaaccttatcttttggtatcttaaaagatgtaagattcggtgcgggaacgatttttgataatatggatttcatcgtttcgaatgtattgatgccattaggcgcattaggtactacgcttgtcgtaggacaattattagataaaaaattattacaacaatattttggtaaagatcgatttagattattcagtggttggtattacttaattaagtatgcgatgcctgtcgttattattttagtctttatcgtgcaattatttagt

SEQ ID NO: 1724 - protein, 446 aa, Staphylococcus aureus
  MISC_FEATURE (1)..(446): hypothetical protein
MMKRQQSQWKSSTGFILASAGSAIGLGAMWKFPYMAGIYGGGAFLAMFLIFTIFVGLPLLIMEFTVGKMGRTYTTQIYSKLTGKKWLNIIGWNGNLAVFILFGFYSVIGGWIVIYIGQVLWQLVIFQRINHLQEMNFEAVISNPWLTVLGQGIFIFATMIIVMLGVEKGLEKASKVMMPLLFVFLIVIVIKSLTLDGVLEGVKFILQPRVSEITADGILFALGQSFFTLSLGTTGMITYASYASKDMTIKSSAISIVVMNIFVSVLAGLAIFPALHSFGYEPQEGPGLLFKVLPMVFSQMHLGTLFYLGFLVLFLFAALTSSISLLELNVSNFTKNDNTKRKKVAVIGSILVFIISIPATLSFGILKDVRFGAGTIFDNMDFIVSNVLMPLGALGTTLVVGQLLDKKLLQQYFGKDRFRLFSGWYYLIKYAMPVVIILVFIVQLFS

SEQ ID NO: 1725 - DNA, 111 bp, Staphylococcus aureus
atgggcattgcacctgaagttgttatgtggcgagatgttggggatatagatggtgttgtatgtggcgagatattggcgcacgtatacagcgttgaaccagaaaatttaatg

SEQ ID NO: 1726 - protein, 37 aa, Staphylococcus aureus
MGIAPEVVMWRDVGDIDGVVCGEILAHVYSVEPENLM

SEQ ID NO: 1727 - DNA, 732 bp, Staphylococcus aureus
atgagaattaaaacaccgagtccatcgtatttaaaaggcacaaatggacatgcgatattattattacattcatttacaggtacaaatcgggatgtgaagcatcttgcagctgagttaaatgaccaaggatttagttgttatgcaccgaattatccaggtcatggtttattgttgaaagatttcatgacatataatgtagatgattggtgggaagaagttgagaaagcttaccaatttttagtcaatgaaggttatgaatctatcagtgcaacgggtgtgtctttaggtggattaatgacattaaaattggcgcaacactatcctttgaaacgtatcgctgtcatgtcagcaccaaaggaaaagagtgacgatggcttaatagaacatttagtttattatagtcaacgcatgtcgaatattttaaatttagatcagcaagcatcgagtgcgcaattagcagcaattgatgattatgaaggtgaaattacgaagtttcaacattttattgatgatatcatgacaaatttaaatgttattaaaatgccagctaatatattatttggtggtaaagatgcgccatcctatgaaacaagtgcacattttatttatgaacatttaggatcagtagacaaagaattaaatggtctgaaggattcgcatcatttaatgacgcatggagaaggcagagatattttagaagaaaatgttattcgctttttcaatgctttaaca

SEQ ID NO: 1728 - protein, 244 aa, Staphylococcus aureus
  MISC_FEATURE (1)..(244): hypothetical protein
MRIKTPSPSYLKGTNGHAILLLHSFTGTNRDVKHLAAELNDQGFSCYAPNYPGHGLLLKDFMTYNVDDWWEEVEKAYQFLVNEGYESISATGVSLGGLMTLKLAQHYPLKRIAVMSAPKEKSDDGLIEHLVYYSQRMSNILNLDQQASSAQLAAIDDYEGEITKFQHFIDDIMTNLNVIKMPANILFGGKDAPSYETSAHFIYEHLGSVDKELNGLKDSHHLMTHGEGRDILEENVIRFFNALT

SEQ ID NO: 1729 - DNA, 738 bp, Staphylococcus aureus
ttgtggcacattgatattatggataacatttgtaaaatgaaaatgatgatacgaggagattgtaagatgatagataaaaaattaacatcaccgaaaatgacagtgcctttatttttaatcgcgctgattgtatttataggtatgttttacagtgtagtgacaaatcaagaatggcttaaaaatatagatatgggatcattaacatggtttacagattatttcggtgagccacaacgtcagtatgttaacaatttgtttaattactatatgacgtttagtgcggaaattggagatgtcaaaggtgtcgtgttgatttccattatcgtcacaatcatactgtttattaaacagaggcatttagcggtttggtttgtgacatatttggtttcaggtgtcatcatgaacaaattaattaaagatactgtattacgtccaagaccatataatcatttagccgttgatacaggcttttcatttccgagtggacattccaacgccagcacattattatatttcgccttaatgatcattattatttcacttgctgctaagacaataacaaaagtgttgagtgcgttggttatgggaatattatggcttagcatattattttgtcgcctttattttcatgcacattacttttcagatgtcattggcggcacgtcactagcaatcatttgggtagcgttattcttaatggtatacccatactttattaatcatcgacgacaacgcgtt

SEQ ID NO: 1730 - protein, 246 aa, Staphylococcus aureus
  MISC_FEATURE (1)..(246): conserved hypothetical
LWHIDIMDNICKMKMMIRGDCKMIDKKLTSPKMTVPLFLIALIVFIGMFYSVVTNQEWLKNIDMGSLTWFTDYFGEPQRQYVNNLFNYYMTFSAEIGDVKGVVLISIIVTIILFIKQRHLAVWFVTYLVSGVIMNKLIKDTVLRPRPYNHLAVDTGFSFPSGHSNASTLLYFALMIIIISLAAKTITKVLSALVMGILWLSILFCRLYFHAHYFSDVIGGTSLAIIWVALFLMVYPYFINHRRQRV

SEQ ID NO: 1731 - DNA, 414 bp, Staphylococcus aureus
atgttatccataatatcaatgtgccacaaatttcactttaccgacaatatcaaaattataaagttcatattgttatgtatattgcaaataaaacattgtataattgaaataacaatattttgctattttcaatttagtacgatttatatttattatacagagggggtaaggcgtatcaatagagttatttttgtctatatagcgttaatcattacattagttagattctttacccctattcatccatcattttcaaatttgatttactggatatttgtattatattttattcctattatactatgcgttatcggtttcaaggccgaaaaacttattgcaacaatggtcattatacctaattttttaggaatactttatcgattatatgcctacgtcacacatatactctttatg

SEQ ID NO: 1732 - protein, 138 aa, Staphylococcus aureus
  MISC_FEATURE (1)..(138): hypothetical protein
MLSIISMCHKFHFTDNIKIIKFILLCILQIKHCIIEITIFCYFQFSTIYIYYTEGVRRINRVIFVYIALIITLVRFFTPIHPSFSNLIYWIFVLYFIPIILCVIGFKAEKLIATMVIIPNFLGILYRLYAYVTHILFM

SEQ ID NO: 1733 - DNA, 360 bp, Staphylococcus aureus
atgaaaagaacgaaaggtgaaatcgaagctgaaatcagtaaagccattacgcaatgggaaaaagatttccttggcagaggttccttgtcagttaaatcagacattttaagagatatggtgattattagtttacaaggtatcttaacgccagctgaatatcgtgtatgtagtacgaatgaaggattattaaatattaaacgaacacgttctgaattagttgaatccggtgagcaagatttgaatgatatcatttttaaaattacaggtatcaaagtgatgagcttccatagtgatttaagtacagttacaggtgaacgtattatcgtattcaaacttgaggataatttggaaaagcatatt

SEQ ID NO: 1734 - protein, 120 aa, Staphylococcus aureus
  MISC_FEATURE (1)..(120): conserved hypothetical
MKRTKGEIEAEISKAITQWEKDFLGRGSLSVKSDILRDMVIISLQGILTPAEYRVCSTNEGLLNIKRTRSELVESGEQDLNDIIFKITGIKVMSFHSDLSTVTGERIIVFKLEDNLEKHI

SEQ ID NO: 1735 - DNA, 429 bp, Staphylococcus aureus
ttgaatacgataatacgttcacctgtaactgtacttaaatcactatggaagctcatcactttgatacctgtaattttaaaaatgatatcattcaaatcttgctcaccggattcaactaattcagaacgtgttcgtttaatatttaataatccttcattcgtactacatacacgatattcagctggcgttaagataccttgtaaactaataatcaccatatctcttaaaatgtctgatttaactgacaaggaacctctgccaaggaaatctttttcccattgcgtaatggctttactgatttcagcttcgatttcacctttcgttcttttcatatcactaactccaataatattaaaattgattacttcatctttgtatcgttatcacgacatcaactattacattaagtttatcatttttagtatattt

SEQ ID NO: 1736 - protein, 143 aa, Staphylococcus aureus
LNTIIRSPVTVLKSLWKLITLIPVILKMISFKSCSPDSTNSERVRLIFNNPSFVLHTRYSAGVKIPCKLIITISLKMSDLTDKEPLPRKSFSHCVMALLISASISPFVLFISLTPIILKLITSSLYRYHDINYYIKFIIFSIF

SEQ ID NO: 1737 - DNA, 2712 bp, Staphylococcus aureus
gtgaaaggtatgacaacacagttaaatatcaattcagtcattgaaaatgcgaaacgtgttattacaccattatcaccaatttcgatttttgcagcacgaaatccatgggaaggattagaagcggatacgtttgaagatgtcgcaaaatggttacgtgatgttcgagatgtggatattttcccaaataaagcattaatagaaagcgctgtggcacgtggtgaattagatgaaagtgtctttaatcaacttgttactgatatgttacttgaacatcactacaatatcccgcaacactacatcaatctttatattgataacattaaaacattaaaagacgtacctgcatcatatatgaatcattcaaatgttgatgttgttgctgatctactattagaaaaatcaaaacgtgatatggctgaatcatatcatcactatgatgtacgtccgatgagtgatgcaataatagatgaacaaggtgagccacttagcgaacaagtgaatcgtcaaatgattaaatggacgaaactttatatcgatcaatttctatcgagttggacaatgccgaagcgtgagcaaagtttttaccatgcatggttgcatttagcgcaacatgaccatagttttactaaagcacagcgccaagtgattaaaggcttacccaatgatcctgaaatgacgatagagtcagtattaactcatttttcaatagatcaggaagactaccaagcttatgttgaaggacatcttttggcgttaccgggttgggcaggtatgttgtattaccgttcacaacagcatcactttgaacaacatttgttaacggattatttggcaattcggttagttgtcgaacaattgctagttggtgatgagtttaagtcagtcgctaaagattgtgaaagtagatcggaaaattggtttaagcaaactgttgcatcatggtgttactacagtgatatgcctagcgatgtattactacaacatgacgtcaatgaaattcaaacgtttattcattttgcagcaactatgaataaaaatgtatttaaaaatttatggctaattgcctgggaaatgacatacgaatctcagttaaaacaaaaaattaaagcaggtcatgaaagtgtggcgggcgcattagatgtaaaccaagtaaatgtctcagaaaatgataacgctaatcagccacattcagtattgttaaatgacacacaagcagttgatgaaaataatagcgagctaaatcagatgggcacatcaacgaaagcgcaaattgcattttgtatagatgttcgttcagaaccatttcgtagacatatcgaagcagcagggccctttgaaacgattggtattgcaggcttctttggattacctattcaaaaagatgccgtagacgaacaattcaaacatgattcattacctgtcatggtaccgccggcatatcgcattaaagaatttgcagaccgctacgatatgaatgtttatcgacaacagcaacagacaatgtcatcgatgttttacacatttaaattgatgaaaaataatgtcatgcctagtctgttattgcctgaattaagtgggccatttttaagcttaagtaccattgtcaattcgattatgcctagaaaaagtcgcgcgtctttacaaaaaataaaacaaaagtggttgaaaaagcctgaaacaaagttgacgattgatcgtgagtttgaccgaacatcagacttacctgttggatttactgagcaagagcaaattgatttcgcgttacaagcgttgaaattgatggatttaaccgaagcatttgcgccgttcgttgtgttagcaggtcatgctagtcattctcacaataatccacatcatgcatcacttgaatgtggggcttgtggtggcgcatcaagcggttttaatgctaagttattagcgatgatatgtaatcgtccaaatgtcagacaaggattaaaacaatcaggtgtgtatattccagagacaactgtttttgcggtagcagaacatcatacgtctactgatacgttggcatgggtatatgtgccagacacattatcttctattgctttagatgcatatgaatcattgaatgacgcgatgccgatgatttctgaacacgcgaatcgcgaacgtttggacaaactgccaacgattggtcgtgtgaatcatccagtggaagaagcgcagcggtttgcgagtgattggagtgaggtacgtccagaatggggattggctaaaaatgcatcatttataattggacgacgccaattaacaaaaggcattgatttagaagggcggacatttttacacaattatgattggcgtaaagataaagatggcacattattaaataccatcatttctggtccggcacttgtggcacaatggattaatttacaatattatgcgtcgacagttgcgccgcatttttacggaagtgggaataaagcgacacaaaccgtcacgtcaggtgttggtgtcatgcaaggtaatgcgagtgatctgatgtatggcttatcatggcaatctgttatggctgctgatcggacgatgtatcattcgccaattcgtttacttgtcgttattcaggcacccgactatgttgtagcaagactactcgcgaataatgagcatttcgctaggaaggtgtctaatcattggctgcgtttaatgagcgttaatgaggaagggcgttttaaaagttggatt

SEQ ID NO: 1738 - protein, 904 aa, Staphylococcus aureus
  MISC_FEATURE (1)..(904): conserved hypothetical
VKGMTTQLNINSVIENAKRVITPLSPISIFAARNPWEGLEADTFEDVAKWLRDVRDVDIFPNKALIESAVARGELDESVFNQLVTDMLLEHHYNIPQHYINLYIDNIKTLKDVPASYMNHSNVDVVADLLLEKSKRDMAESYHHYDVRPMSDAIIDEQGEPLSEQVNRQMIKWTKLYIDQFLSSWTMPKREQSFYHAWLHLAQHDHSFTKAQRQVIKGLPNDPEMTIESVLTHFSIDQEDYQAYVEGHLLALPGWAGMLYYRSQQHHFEQHLLTDYLAIRLVVEQLLVGDEFKSVAKDCESRSENWFKQTVASWCYYSDMPSDVLLQHDVNEIQTFIHFAATMNKNVFKNLWLIAWEMTYESQLKQKIKAGHESVAGALDVNQVNVSENDNANQPHSVLLNDTQAVDENNSELNQMGTSTKAQIAFCIDVRSEPFRRHIEAAGPFETIGIAGFFGLPIQKDAVDEQFKHDSLPVMVPPAYRIKEFADRYDMNVYRQQQQTMSSMFYTFKLMKNNVMPSLLLPELSGPFLSLSTIVNSIMPRKSRASLQKIKQKWLKKPETKLTIDREFDRTSDLPVGFTEQEQIDFALQALKLMDLTEAFAPFVVLAGHASHSHNNPHHASLECGACGGASSGFNAKLLAMICNRPNVRQGLKQSGVYIPETTVFAVAEHHTSTDTLAWVYVPDTLSSIALDAYESLNDAMPMISEHANRERLDKLPTIGRVNHPVEEAQRFASDWSEVRPEWGLAKNASFIIGRRQLTKGIDLEGRTFLHNYDWRKDKDGTLLNTIISGPALVAQWINLQYYASTVAPHFYGSGNKATQTVTSGVGVMQGNASDLMYGLSWQSVMAADRTMYHSPIRLLVVIQAPDYVVARLLANNEHFARKVSNHWLRLMSVNEEGRFKSWI

SEQ ID NO: 1739 - DNA, 1482 bp, Staphylococcus aureus
gtgttaagttttcaattgctattttcactgtttgttattgcgcttatcattgcattgataagtggcttgttgtttttagcaccagttatgccaatgagatatattaaattacatttatacatactagtcatgccagtattatttgcagtcattggctttttcggtattcatggtcaacatgtcttaggtccatttaaaatagatcgtttatcttggttattagctggctttgtaatggcgcttggctttattattcaaaagttttcaatgcgatatttactaggtgatcatcattatagacattactttccattgttcactgcgattacgtcgtttgcatctttagcatggatgtctgaagacttaagactgatggcactctgctggggtattacattattatgtttaacattgctgatgaacgttaatcgtttttggaaagtgccacgtgagtctgcgaaattatcaagcatgacatttttatgtggttggcttgcattcgttggagcaattgtaactatttatattgcgactggcgagtggcgggtaccacaacatatagttcatccgacatggtcattgttgacgaatgtactacttgtattagctgtcatgataccggcagcacaatttccttttcatcgatggttgattgaatctgtaacggcaccaacgccagtatcggcaattatgcatgcaggaattgtgaatgcaggtggtgttattctaactcgttttgcgccgatatttgataatggatttgcgttatcattattacttatcctttctagtatttctgtattgttaggatcgggtattagcttagttcaagttgactataaacgccaattagtgggctctacgatgagtcaaatgggctttatgttagttcaatgtgcattgggtgtatattcagcagcgattattcatttaatattgcacggtatttttaaagcaacattatttttacaatcaggttctatcgtgaagcgattcaatattccaaaacaagcatctgctaaagacgcttatggctggattgtcatgggacgtgtattagctattatcgtggcatttctattttggatgagtagtgacagaagtgcatatgaagtgttaagtgcactcattctaggatggtcattacttgtatcttggaatcaaatggtagcctttagtaaaggacgcatggcacgtcttgttggtatgattttgattgcaatcgtgacatttatctacgtcatcacacataattatttttacgctgtattacaaaatataacaacacatgcgacaacgccgcctacagtgagtgtcatcattagtgttgttattttaatctttggcagtttattaagtatttgggtggcgcggcatcgatactctaaggcttttgcggtattgtacgtgtggttagttaatctaggtgaagcacgctcgaaagcgatagaaagtcatccgaattatttgaagaagtattta

SEQ ID NO: 1740 - protein, 494 aa, Staphylococcus aureus
  MISC_FEATURE (1)..(494): NADH dehydrogenase subunit
VLSFQLLFSLFVIALIIALISGLLFLAPVMPMRYIKLHLYILVMPVLFAVIGFFGIHGQHVLGPFKIDRLSWLLAGFVMALGFIIQKFSMRYLLGDHHYRHYFPLFTAITSFASLAWMSEDLRLMALCWGITLLCLTLLMNVNRFWKVPRESAKLSSMTFLCGWLAFVGAIVTIYIATGEWRVPQHIVHPTWSLLTNVLLVLAVMIPAAQFPFHRWLIESVTAPTPVSAIMHAGIVNAGGVILTRFAPIFDNGFALSLLLILSSISVLLGSGISLVQVDYKRQLVGSTMSQMGFMLVQCALGVYSAAIIHLILHGIFKATLFLQSGSIVKRFNIPKQASAKDAYGWIVMGRVLAIIVAFLFWMSSDRSAYEVLSALILGWSLLVSWNQMVAFSKGRMARLVGMILIAIVTFIYVITHNYFYAVLQNITTHATTPPTVSVIISVVILIFGSLLSIWVARHRYSKAFAVLYVWLVNLGEARSKAIESHPNYLKKYL

SEQ ID NO: 1741 - DNA, 126 bp, Staphylococcus aureus
atgagtgaagtaaatgcagctatcaatgtactattaacacttacggtcacacgagtgtttcagtctaaacgtgcaacgcaattccgcacgtggccaatatatcttgcgctagatcatgaaaatcat

SEQ ID NO: 1742 - protein, 42 aa, Staphylococcus aureus
MSEVNAAINVLLTLTVTRVFQSKRATQFRTWPIYLALDHENH

SEQ ID NO: 1743 - DNA, 141 bp, Staphylococcus aureus
ttgtaccttcaattaacagttggtacgatggttttgccatttttcatcaacgtaaatataaaaaggactaagacacatacatgtcctagccctatggataaaatgcaaatttctgctttatcaaaactatcacactttaga

SEQ ID NO: 1744 - protein, 47 aa, Staphylococcus aureus
LYLQLTVGTMVLPFFINVNIKRTKTHTCPSPMDKMQISALSKLSHFR

SEQ ID NO: 1745 - DNA, 1200 bp, Staphylococcus aureus
atggctaaaattccagttacggtattaagtggttatttaggctcggggaagacaacgttgttaaatcatattttacaaaatcgagaaggtcgacgtatcgcggtaattgtaaatgatatgagtgaagtaaatatcgataaagatcttgtcgcagatggtgggggactatcgcgtacagatgaaaaattagtcgaactttctaatggttgtatctgttgtacacttagagacgatttattaaaagaagttgagcgtttagtgaaaaaaggtggcatcgatcaaattgttattgagtcaacagggatttcagagccagtacctgttgcacaaactttctcatatattgatgatgaacttggcattgatcttacagcgatttgccgtttagatacaatggttacagttgtggatgctaaccgcttcgtacatgacatcaactcagaagatttattgatggatcgtgatcaaagcgttgacgaaacagatgagcgttcgattgctgatttattaattgaccaagttgaattttgtgatgtattgattattaataaaattgatttaattagtgaagaagaactagcgaagttagaaaaaatgttaagcgcattgcaaccgactgctaaaattattaagacaacaaattctgaagtagatttaaaagaagtcttgaatacgcagcgttttgattttgaaaaagcgagcgagtcagcaggatggatcaaagaacttgagtctggtgggcatgcatcgcatacacctgaaacagaagaatatggtatatcatcgtttgtatataaacgtcgtctacctttccatgctaaaaggttcaatgattggttagaaagcatgccaaataatgtcgttcgatcaaaaggtatcgtatggctagcacaatacaatcacgtagcatgtttattatctcaagcagggtcatcttgcaatattcatccagttacatattgggtggctagtatgtctgaagcgcaacaaacacaaatattagcagaacgtcaagatgtcgcagctgaatgggatccagaatatggcgatcgtcatacacaatttgtcattattggtacagaattagatgaagaaaaattaacaaaagaactcgacgcatgcttagtcaatgcgcaagaaattgatgcagattggcaacaatttgaagatccatatcaatggcaaattagaccagcacga

SEQ ID NO: 1746 - protein, 400 aa, Staphylococcus aureus
  MISC_FEATURE (1)..(400): conserved hypothetical
MAKIPVTVLSGYLGSGKTTLLNHILQNREGRRIAVIVNDMSEVNIDKDLVADGGGLSRTDEKLVELSNGCICCTLRDDLLKEVERLVKKGGIDQIVIESTGISEPVPVAQTFSYIDDELGIDLTAICRLDTMVTVVDANRFVHDINSEDLLMDRDQSVDETDERSIADLLIDQVEFCDVLIINKIDLISEEELAKLEKMLSALQPTAKIIKTTNSEVDLKEVLNTQRFDFEKASESAGWIKELESGGHASHTPETEEYGISSFVYKRRLPFHAKRFNDWLESMPNNVVRSKGIVWLAQYNHVACLLSQAGSSCNIHPVTYWVASMSEAQQTQILAERQDVAAEWDPEYGDRHTQFVIIGTELDEEKLTKELDACLVNAQEIDADWQQFEDPYQWQIRPAR

SEQ ID NO: 1747 - DNA, 258 bp, Staphylococcus aureus
ttgagcgctttactttataatggagacaaagatatatctcacgaaagagaatcgaggtgtataaacatgttatttgtcattttagttttatatgttactggtattgcatttattctactcagtgtttttggttcaaagactgaaggattatctacgaaacatactttatataccattggcagtgctattataacgattgctattttcatttcaattggctatgccattcaatacttaactgcagcgctttatggtttg

SEQ ID NO: 1748 - protein, 86 aa, Staphylococcus aureus
  MISC_FEATURE (1)..(86): hypothetical protein
LSALLYNGDKDISHERESRCINMLFVILVLYVTGIAFILLSVFGSKTEGLSTKHTLYTIGSAIITIAIFISIGYAIQYLTAALYGL

SEQ ID NO: 1749 - DNA, 312 bp, Staphylococcus aureus
atgactctaatagaaccagatatgaccttaagaatgccagatataagtactacagtagaaacacttaatctcatatctaaaatggaagcgcaaaaagaaaatattcgcacagttattgcacctgaacataagcataaatacaaagatattgaaaacggattaaaaggtgaagaaaaagtattaattgaacaaatggcgcaacattgcgaagcttttaaagctaattttaaaggtgcagctcaaggagattgggttaaaagtgccatgtctgagatagacagcattaaggatgacctgaaaaaaattaatagc

SEQ ID NO: 1750 - protein, 104 aa, Staphylococcus aureus
  MISC_FEATURE (1)..(104): hypothetical protein
MTLIEPDMTLRMPDISTTVETLNLISKMEAQKENIRTVIAPEHKHKYKDIENGLKGEEKVLIEQMAQHCEAFKANFKGAAQGDWVKSAMSEIDSIKDDLKKINS

SEQ ID NO: 1751 - DNA, 189 bp, Staphylococcus aureus
atgaatttacagtcatacataggcaaattagtcaaattaacgcttactaataataaaatattaattggaaaagtgatagactttgatgataaagttgataattttgatggttataattcgatagaaattgatacaggtagaattacatatgatatatcagaaaataaaattaaaactattgttttacaa

SEQ ID NO: 1752 - protein, 63 aa, Staphylococcus aureus
  MISC_FEATURE (1)..(63): hypothetical protein
MNLQSYIGKLVKLTLTNNKILIGKVIDFDDKVDNFDGYNSIEIDTGRITYDISENKIKTIVLQ

SEQ ID NO: 1753 - DNA, 321 bp, Staphylococcus aureus
atgatgtttaatcaaattaataataaaaatgaattagaagaatcatatgaatctgagaaaaaacgtatagagaatgaactgcaaaatttaaatgaacttaggcatagaactcgaaaagaaaatgaacgtagttatgatgtttttcaatatttgaagcacgaaatgaattatagtgaagatgcccaaaggaaaatgacgagaaatatagaagcgtatgagcaagaaatcaatgagataattagaaagcaagaatggaaattagaagaatataaagaagacttaaaaaagtcttatgaaaagcagttagataagctaagtgac

SEQ ID NO: 1754 - protein, 107 aa, Staphylococcus aureus
  MISC_FEATURE (1)..(107): conserved hypothetical
MMFNQINNKNELEESYESEKKRIENELQNLNELRHRTRKENERSYDVFQYLKHEMNYSEDAQRKMTRNIEAYEQEINEIIRKQEWKLEEYKEDLKKSYEKQLDKLSD

SEQ ID NO: 1755 - DNA, 1347 bp, Staphylococcus aureus
ttggaccgtctgaaggtgagaatgttgagtaggaagtataaaatagatttaaaagcaattaatcaaaatactgagtctacaagtgctatttcgaaagcgtcatacgaagttgagaatgctaataataatggtctatcaaaaagagacgtgattaatcaatttaatgatttgaaaaaaatgaaaaaattcccttctaatcttgaatatgttgatagttacactgattctcttactggagtaacaacttctgcttttttaaataaagatacaggcaaagtaactctcgggatgactgggactaatttacaagacgaagcctttaaaaagttaaaagaaggtgaattttcaagacaaaatgttaccaatgctttggaaacagttaaagatggatatgcagatcttaaaatattatattctcctgcatctgatcaaaactatagatatgcgaatacacaagaatttataaataaaataaaaagtaagtatgacattgattttattactggacattcactaggtggaagagatgcggtagttctaggaatgagtaatggtattccgaacattgtggtttataatccagctcctatttctataactagtttgaatcctaattccccagatggaaaacgtttattagaattatataaaaattataaaggtaatattactaggtttgttgcagaaaatgatgcattgacagaaaatctgaagaaatataagcattatgtttttttcggtaatgataaagtctttaaaaatggtaaaggtcatgaaatggaaggctttctgaccgaagaagaacaaaaagctataaaaaaagaacttaaaaaactacaaggttatgcagaagaaaataataagtcatttgtaaagaattcaaataatgctatctctaaattagctagtatagaattacttagagcaaatatgatgactacaaatggaggaggattatcttcttcgcagcaaaaagttttagaaagtttaacagctttaacaattgcgcagtcattcagtcaactgatagacgatgaaattaatcaaatcaaaaaaatgtataatgaaaagaaaaagaaatttggaaaaaattgggaagacgctcaaaaagctggaaaagctgtaggtgaagatttgagtgtaaatggagttctcaatgctttagatgaaggtcaagtgaatgaaagtagtatggtaagagaacctgaacaaatgatatctgcaaaagaaagacaactttcaacgatagggtcttctgtatcaaattatattatgagagttagactcagtattaatgaaatcgttgataaagatcaagtgcttgcatcacaaataggtggattacta

SEQ ID NO: 1756 - protein, 449 aa, Staphylococcus aureus
  MISC_FEATURE (1)..(449): hypothetical protein
LDRLKVRMLSRKYKIDLKAINQNTESTSAISKASYEVENANNNGLSKRDVINQFNDLKKMKKFPSNLEYVDSYTDSLTGVTTSAFLNKDTGKVTLGMTGTNLQDEAFKKLKEGEFSRQNVTNALETVKDGYADLKILYSPASDQNYRYANTQEFINKIKSKYDIDFITGHSLGGRDAVVLGMSNGIPNIVVYNPAPISITSLNPNSPDGKRLLELYKNYKGNITRFVAENDALTENLKKYKHYVFFGNDKVFKNGKGHEMEGFLTEEEQKAIKKELKKLQGYAEENNKSFVKNSNNAISKLASIELLRANMMTTNGGGLSSSQQKVLESLTALTIAQSFSQLIDDEINQIKKMYNEKKKKFGKNWEDAQKAGKAVGEDLSVNGVLNALDEGQVNESSMVREPEQMISAKERQLSTIGSSVSNYIMRVRLSINEIVDKDQVLASQIGGLL

SEQ ID NO: 1757 - DNA, 858 bp, Staphylococcus aureus
atgaaatattcaaatgtttataaaattaaaacagagagatgtgaaatgatggagtatataaaaaaaattgctttgtacatgagtgtattacttttaatcatttttattgggggatgtggaaatatgaaagatgaacagaaaaaagaggaacaaacgaataaaacagattcaaaagaagaacaaatcaaaaagagttttgcgaaaacgttagatatgtatccaattaagaatctcgaggatttatacgacaaagaaggatatcgagatggtgagtttaaaaaaggcgataaaggtacgtggactatacttacaggtttttcaaaaagtaacaaaccaggagtattagatgatgaaggcatggtgttatatcttaatagaaataccaaaaaggcaacaggttattattttgtaaataaagtttatgatgatattagcaaaaatcataatgagaaaaaatatcgtgttgaactaaaaaataataagattgttcttttggataatgtagaagacaaaaaacttaaacaaaaaattgaaaattttaaattttttagtcagtatgctgattttaaagatttaaaaaattatcaagatggaaatataacaactaatgaaaacgtaccgagctatgaagcacaatataaaatgaacaatagtgataaaaatgtaaaaaaacttagagaaatttatccaattacaactaataactctccaaatctaaaattatatatagatggtgatataaaaggaagctcagtaggatataaaaaaatagaatataaattttcaaaagataaaggtcaagagacaacattaagagattatttgaattttggaccgtctgaaggtgagaatgttgag

SEQ ID NO: 1758 - protein, 286 aa, Staphylococcus aureus
  MISC_FEATURE (1)..(286): hypothetical protein
MKYSNVYKIKTERCEMMEYIKKIALYMSVLLLIIFIGGCGNMKDEQKKEEQTNKTDSKEEQIKKSFAKTLDMYPIKNLEDLYDKEGYRDGEFKKGDKGTWTILTGFSKSNKPGVLDDEGMVLYLNRNTKKATGYYFVNKVYDDISKNHNEKKYRVELKNNKIVLLDNVEDKKLKQKIENFKFFSQYADFKDLKNYQDGNITTNENVPSYEAQYKMNNSDKNVKKLREIYPITTNNSPNLKLYIDGDIKGSSVGYKKIEYKFSKDKGQETTLRDYLNFGPSEGENVE

SEQ ID NO: 1759 - DNA, 783 bp, Staphylococcus aureus
atgaagtctataaaaaggattggattgtgcattagtttgttgattttaatcatctttgttacatcttgtgatggtgataataagatcattggagattcaaaagaagaacaaatcaaaaagagctttgcgaaaacgttagatatctaccctattaagaatctcgaggatttatacgacaaagaaggatatcgagatggcgaatttaaaaaagatgataaaggtacttggctaattagatctgaaatgaaaatccaattaaaaggagaaaatctggaatctagaggagcagttttagaaattaacagaaatactagaacggctaaagggcattatattgttagagaagttgttgaagatagcgatggaatgacacacaatcatacaaaaagatatcctgtgaaaatggaaaataataaaatgattccattaaaaccaatcgatgacgaaaaagtaaaaaaagaaatcgaagaatttaacttctttgtacaatacgggaatttcaaagaattggaaaactataaagaggacgaagtgtcatataacccagaagtaccaatttactctgcaaaatatcaattgaaaaacagtgattacaatgttgaacaattaaggaagcgatataatatcccgacgcaaaaagcgcccaaattattattgaaaggctcaggtaatttaaaaggttcatcagtcggatataaaaatattgaatttacctttattgaaaacaaggaagaaaatatttacttcacagatagtatctactttaatccaagcgaggataaa

SEQ ID NO: 1760 - protein, 261 aa, Staphylococcus aureus
  MISC_FEATURE (1)..(261): hypothetical protein
MKSIKRIGLCISLLILIIFVTSCDGDNKIIGDSKEEQIKKSFAKTLDIYPIKNLEDLYDKEGYRDGEFKKDDKGTWLIRSEMKIQLKGENLESRGAVLEINRNTRTAKGHYIVREVVEDSDGMTHNHTKRYPVKMENNKMIPLKPIDDEKVKKEIEEFNFFVQYGNFKELENYKEDEVSYNPEVPIYSAKYQLKNSDYNVEQLRKRYNIPTQKAPKLLLKGSGNLKGSSVGYKNIEFTFIENKEENIYFTDSIYFNPSEDK

SEQ ID NO: 1761 - DNA, 816 bp, Staphylococcus aureus
atgaagtataaaacagagagacgtgaagcgatgggatatttaaaaaggtttgcattgtacataagcgttatgattttaatatttgcgatagcaggttgtggcaaaggtaatgaaacaaaagaagattcaaaggaagaacaaatcaaaaagagctttgcgaaaacattagatatgtatccaattaagaatctcgaggacttatacgacaaagaaggataccgagatggcgaatttaaaaagggtgataaagggatgtggacgatatatacagatttcgccaaaagtaataaacaaggtggattgagtaatgaaggtatggtcttatacttagatagaaatacacggactgcaaagggacattattttgttaagacattctataataagggcaaattcccagatagaaaaaattataaagttgaaatgaaaaataataaaattatcttattagataaagtagaagatacaaatctaaaaaagagaatagaaaactttaaattttttggacaatatgcaaaccttaaagaattgaaaaactacaacaatggtgatgtctcaattaatgagaatgttccaagttatgacgcaaaatttaaaatgagcaataaagatgaaaatgttaagcaattaagaagtcgttataatattcctactgataaagcaccggtattaaaaatgcatattgatggtaatttgaaaggaagttctgtgggttataaaaagttggaaattgacttttcaaaaggtggaaaaagcgatttgtcagtaatagattctttgaatttccagccggcgaaggtagatgaagatgatgaa

SEQ ID NO: 1762 - protein, 272 aa, Staphylococcus aureus
  MISC_FEATURE (1)..(272): hypothetical protein
MKYKTERREAMGYLKRFALYISVMILIFAIAGCGKGNETKEDSKEEQIKKSFAKTLDMYPIKNLEDLYDKEGYRDGEFKKGDKGMWTIYTDFAKSNKQGGLSNEGMVLYLDRNTRTAKGHYFVKTFYNKGKFPDRKNYKVEMKNNKIILLDKVEDTNLKKRIENFKFFGQYANLKELKNYNNGDVSINENVPSYDAKFKMSNKDENVKQLRSRYNIPTDKAPVLKMHIDGNLKGSSVGYKKLEIDFSKGGKSDLSVIDSLNFQPAKVDEDDE

SEQ ID NO: 1763 - DNA, 315 bp, Staphylococcus aureus
gtgatagatatgaaatttaaaaaggttttagtagctacggcaatggtaggtgttttagcaactggcgttgttggatatggtaatcaagcagatgcgaaagtttattctcaaaatggactcgtactacatgatgatgcaaacttcttagaacatgaattaagttatattgatgtgttattagataagaatgctgaccaagctacaaaagacaacttaagatcatacttcgccgataaaggactacattcaatcaaagacattatcaacaaagctaaacaagacggctttgatgtttcaaaatatgaacacgtaaaa

SEQ ID NO: 1764 - protein, 105 aa, Staphylococcus aureus
VIDMKFKKVLVATAMVGVLATGVVGYGNQADAKVYSQNGLVLHDDANFLEHELSYIDVLLDKNADQATKDNLRSYFADKGLHSIKDIINKAKQDGFDVSKYEHVK

SEQ ID NO: 1765 - DNA, 1506 bp, Staphylococcus aureus
atgagggaaaattttaagttacgtaaaatgaaagtcggtttagtatctgttgcaattacaatgttatatattatgacaaacggacaagcagaagcatctgaaaatcaaaacgctttaatctctaatataaatgtagacaatcaggaaaaacagaataatgtaaatcaagctgttcagcctcaaaataatactaatgaaacatcaaaagtaccggctaattttgtcaaattgaatgatattaaaccaggtgatacttctatacaaggaacaactttaccaaatcaatttatactattaactattgataaaaaagatgtgagctcagttgaagattctgacagcagctttgttatgtctgataaagatgggaattttaagtatgacttaaatggtcgcaaaattgttcataatcaagaaattgaagtgtcttcatcagatccctatttaggtgacgatgaagaagatgaagaagtagaagaaacttcaactgaagaagttggtgctgaggaagaaagtacagaagctaaagctacatatacaacaccgcgatatgaaaaagcgtatgaaataccgaaagaacagctaaaagaaaaagatggacatcaccaagtttttatcgaacctattactgaaggttcaggtattattaaaggccatacctctgtaaaaggtaaagttgctctatctattaataataaatttattaactttgagacaaatgctaatggtggtccaaataaagaagaagcgaaatctggatcagaaggaatctggatgcctattgatgacaaaggatactttaattttgacttcaaaacgaaacgtttcgatgatttagagttaaagaaaaatgatgagatctcattaacatttgcacctgatgacgaagatgaggcattgaagtcattaattttcaaaactaaggtaacgagtttagaagatattgataaagcagaaactaaatatgaccatactaaagtggaaaaagtaaaagtattgaaagatgttaaagaagatttacatgtagatgaaatttacggaagcttatatcatacagaaaaaggtaaaggtattcttgataaagaaggtactaaagtaattaaaggtaagactaaattcgcaaatgcagttgtgaaggtagactctgaactaggtgaaggtcaagaattccctgatttgcaagtcgatgaaaaaggtgaattcagctttgatgtagatcatgctggatttagattacaaaatggagaaacactaaacttcacagtagttgatcctattacaggtgaattattaagtggaaattttgtttctaaaaacatagatatttatgaatctcctgaagaaaaagcagatcgtgagtttgatgaaagaatggaaaacacacctgcatatcataaattacatggtgataaaattgtcggctacgatactaacggattcccgattacctggttttatccattaggtgaaaagaaagttgaacgtaaggcaccaaaattagaaaaa

SEQ ID NO: 1766 - protein, 502 aa, Staphylococcus aureus
  MISC_FEATURE (1)..(502): hypothetical protein
MRENFKLRKMKVGLVSVAITMLYIMTNGQAEASENQNALISNINVDNQEKQNNVNQAVQPQNNTNETSKVPANFVKLNDIKPGDTSIQGTTLPNQFILLTIDKKDVSSVEDSDSSFVMSDKDGNFKYDLNGRKIVHNQEIEVSSSDPYLGDDEEDEEVEETSTEEVGAEEESTEAKATYTTPRYEKAYEIPKEQLKEKDGHHQVFIEPITEGSGIIKGHTSVKGKVALSINNKFINFETNANGGPNKEEAKSGSEGIWMPIDDKGYFNFDFKTKRFDDLELKKNDEISLTFAPDDEDEALKSLIFKTKVTSLEDIDKAETKYDHTKVEKVKVLKDVKEDLHVDEIYGSLYHTEKGKGILDKEGTKVIKGKTKFANAVVKVDSELGEGQEFPDLQVDEKGEFSFDVDHAGFRLQNGETLNFTVVDPITGELLSGNFVSKNIDIYESPEEKADREFDERMENTPAYHKLHGDKIVGYDTNGFPITWFYPLGEKKVERKAPKLEK

SEQ ID NO: 1767 - DNA, 675 bp, Staphylococcus aureus
atgaaattaaaaaatattgctaaagcaagtttagcactagggattttaacaacagggatgattacaactactgctcagccagtaaaagcaagtacattagaggttagatcacaagctactcaagacttgagtgaatattataatagaccgttctttgagtatacaaatcagtcaggatataaagaggaaggaaaagtgacgtttactcctaattatcaacttatagatgtaactttaactgggaatgaaaagcaaaattttggtgaagatatttctaatgtagatatatttgttgtaagagaaaattctgatagatctggtaatacagcttcaattggtggtattactaaaacaaacggttcaaattatattgataaagtaaaagatgtaaatttaataattactaaaaacatcgatagtgttacatcaacgtcaacatcatctacatatacaattaataaagaagaaatttcattaaaagaacttgattttaaattaagaaagcatttaattgataaacataacctttataagacagaacctaaagacagtaaaattcgaattactatgaaagatggtgggttctacacatttgaattgaataaaaagttacaaacacaccgtatgggtgatgttattgatggcagaaatatagaaaaaattgaagtgaattta

SEQ ID NO: 1768 - protein, 225 aa, Staphylococcus aureus
  MISC_FEATURE (1)..(225): exotoxin 15 [Staphylococcus
MKLKNIAKASLALGILTTGMITTTAQPVKASTLEVRSQATQDLSEYYNRPFFEYTNQSGYKEEGKVTFTPNYQLIDVTLTGNEKQNFGEDISNVDIFVVRENSDRSGNTASIGGITKTNGSNYIDKVKDVNLIITKNIDSVTSTSTSSTYTINKEEISLKELDFKLRKHLIDKHNLYKTEPKDSKIRITMKDGGFYTFELNKKLQTHRMGDVIDGRNIEKIEVNL

SEQ ID NO: 1769 - DNA, 1209 bp, Staphylococcus aureus
atgagtaatacacaaaagaaaaatgtgccagaattgaggttcccagggtttgaaggcgaatgggaagagaagcagttaggggatcttacagatagagtaattaggaaaaataaaaacttagaatcgaaaaagcctttaacaatatccggacagttaggtttaattgatcaaacagaatattttagtaaatcagtttcgtcgaaaaatctagaaaattatacactaataaagaatggagaattcgcgtataacaaaagttattctaatggatacccattaggggctattaaaagattaactagatatgatagtggtgtattgtcctctttgtatatttgtttttctattaaaagtgaaatgtctaaagacttcatggaagcatattttgattcgacacactggtatagagaagtttctggaattgcagttgagggtgcaagaaatcacggattattaaatgtttctgtgaatgatttttttactattctaattaaatatccaagtttagaagaacagcaaaaaataggcaagttcttcagcaaactcgaccgacaaattgaattagaagaacaaaagcttgaattacttcaacaacagaaaaaaggctatatgcagaaaattttctcacaggaactgcgattcaaagatgagaatggtgaagattatccagattgggaaaatagcaaaatagaaaaatatttaaaagagagaaacgaacgttctgacaaagggcaaatgctttcagtaactataaatagtggcattataaaatttagtgaattggatagaaaagataattcaagtaaagataaaagtaattataaagtagttaggaaaaatgatattgcatataattctatgagaatgtggcaaggggctagtggtaaatcaaattataatgggattgttagccctgcatatactgtgctttatccaacacaaaatactagctcattatttattggatataagtttaaaacacatagaatgattcataaatttaaaattaattcacaaggattaacatcagatacatggaacttaaaatataaacaattaaaaaatataaatatagatatacctgtattggaggaacaagaaaagataggtgatttctttaaaaaaatggatatattgataagtaaacagaaaatgaaaattgaaatattagaaaaagagaaacaatcctttttacaaaaaatgttctta

SEQ ID NO: 1770 - protein, 403 aa, Staphylococcus aureus
  MISC_FEATURE (1)..(403): probable restriction
MSNTQKKNVPELRFPGFEGEWEEKQLGDLTDRVIRKNKNLESKKPLTISGQLGLIDQTEYFSKSVSSKNLENYTLIKNGEFAYNKSYSNGYPLGAIKRLTRYDSGVLSSLYICFSIKSEMSKDFMEAYFDSTHWYREVSGIAVEGARNHGLLNVSVNDFFTILIKYPSLEEQQKIGKFFSKLDRQIELEEQKLELLQQQKKGYMQKIFSQELRFKDENGEDYPDWENSKIEKYLKERNERSDKGQMLSVTINSGIIKFSELDRKDNSSKDKSNYKVVRKNDIAYNSMRMWQGASGKSNYNGIVSPAYTVLYPTQNTSSLFIGYKFKTHRMIHKFKINSQGLTSDTWNLKYKQLKNINIDIPVLEEQEKIGDFFKKMDILISKQKMKIEILEKEKQSFLQKMFL

SEQ ID NO: 1771 - DNA, 1554 bp, Staphylococcus aureus
atgtctattactgaaaaacaacgtcagcaacaagctgaattacataaaaaattatggtcgattgcgaatgatttaagagggaatatggatgcgagtgaattccgtaattacattttaggcttgattttctatcgcttcttatctgaaaaagcggaacaagaatatgcagatgccttgtcaggtgaagacatcacgtatcaagaagcatgggcagacgaagaataccgtgaagacttaaaagcagaattaattgaccaagtcggttacttcattgagccagaagatttattcagtgcgatgattcgtgaaattgaaacgcaagatttcgatatcgaacacctggcgacggcaattcgtaaagttgaaacatcaacattaggtgaagaaagtgaaaatgactttatcggtctgttcagcgatatggatttgagttcaacgcgactaggtaacaatgtcaaagaacgtactgctttaatctctaaagtcatggttaatcttgacgacttaccattcgttcacagtgacatggaaattgatatgttaggtgatgcatatgaattcctaattgggcgctttgcggcgacagcgggtaaaaaagcaggcgagttctatacaccacaacaagtatctaagatactggcgaagattgtcacagacggtaaagataaattacgtcacgtgtatgacccaacatgtggttcaggttcactgttgttacgtgttggtaaagaaacacaagtgtatcgttatttcggtcaagaacgtaacaatactacatacaacttagcacgcatgaatatgttattacatgatgtgcgttatgagaacttcgatatccgtaatgatgacacattggaaaacccagcctttttaggcaatacatttgatgcggttattgcgaacccaccgtatagtgcgaaatggactgcagattcaaagtttgaaaatgacgaacgattcagtggttacggcaaacttgcgcctaagtctaaagcagactttgcctttattcaacacatggtacattacctagacgatgaaggtaccatggccgttgtactcccacatggtgtattattccgaggtgctgcagaaggtgtcattcgtcgttatttaattgaagaaaagaactacttagaagctgtgattggtttgccagcgaatattttctatgggacaagtattccaacatgtattttagtatttaaaaaatgtcgccaacaagacgacaacgtactatttatcgatgcatccaatgattttgaaaaaggaaaaaatcaaaatcatttaagcgatgcccaagtcgaacgtattatagacacatataagcgtaaggaaacaattgataaatatagctacagcgcgacactacaagagattgccgataacgattacaacctaaatataccgagatatgtcgatacattcgaagaagaagcaccgattgatttagatcaagtccaacaagatttgaaaaatatcgataaagaaatcgcagaaattgagcaagaaatcaatgcatacctgaaagaacttggggtgttgaaagatgag

SEQ ID NO: 1772 - protein, 518 aa, Staphylococcus aureus
  MISC_FEATURE (1)..(518): type I restriction enzyme
MSITEKQRQQQAELHKKLWSIANDLRGNMDASEFRNYILGLIFYRFLSEKAEQEYADALSGEDITYQEAWADEEYREDLKAELIDQVGYFIEPEDLFSAMIREIETQDFDIEHLATAIRKVETSTLGEESENDFIGLFSDMDLSSTRLGNNVKERTALISKVMVNLDDLPFVHSDMEIDMLGDAYEFLIGRFAATAGKKAGEFYTPQQVSKILAKIVTDGKDKLRHVYDPTCGSGSLLLRVGKETQVYRYFGQERNNTTYNLARMNMLLHDVRYENFDIRNDDTLENPAFLGNTFDAVIANPPYSAKWTADSKFENDERFSGYGKLAPKSKADFAFIQHMVHYLDDEGTMAVVLPHGVLFRGAAEGVIRRYLIEEKNYLEAVIGLPANIFYGTSIPTCILVFKKCRQQDDNVLFIDASNDFEKGKNQNHLSDAQVERIIDTYKRKETIDKYSYSATLQEIADNDYNLNIPRYVDTFEEEAPIDLDQVQQDLKNIDKEIAEIEQEINAYLKELGVLKDE

SEQ ID NO: 1773 - DNA, 348 bp, Staphylococcus aureus
atgcttgaaatgataagtaatggtaaaatgacgatgaaattgaataatgttaagcaaaagcgtcatattttatgcacaaatgaatataataataagaaaaataattcatctttattaccaagttatactataatagattctaatgaaagtgaaaagatgactaaaaaagaatttattgatattccagttttgtttgatgatgaagggaattttagaataaaacaagttatagattataaaaagataataggtaaatcttatgtgaatggtaaatatattgaaacgaaattaggtaaggttcattattctaaaactggttttcatgtagttccgtatattaaaaaggag

SEQ ID NO: 1774 - protein, 116 aa, Staphylococcus aureus
MLEMISNGKMTMKLNNVKQKRHILCTNEYNNKKNNSSLLPSYTIIDSNESEKMTKKEFIDIPVLFDDEGNFRIKQVIDYKKIIGKSYVNGKYIETKLGKVHYSKTGFHVVPYIKKE

SEQ ID NO: 1775 - DNA, 99 bp, Staphylococcus aureus
gtggagaattttgatgttggtggtggaaattttacctttatggagattgggataggattcatgacacacaaaccaaaacggcttaacgacgatatcgat

SEQ ID NO: 1776 - protein, 33 aa, Staphylococcus aureus
VENFDVGGGNFTFMEIGIGFMTHKPKRLNDDID

SEQ ID NO: 1777 - DNA, 696 bp, Staphylococcus aureus
ttggagcaaataaatatgaaatttacagcattagcaaaagcgacattagctttaggaattttaacaacaggaactttaacaacagaagttcattcaggtcatgcaaaacaaaatcaaaagtcagtaaataaacatgacaaggaagcattataccgatactacactggaaagactatggaaatgaaaaatattagtgctttgaaacatggtaaaaacaacttacgttttaagtttagaggtattaagattcaagttttactgcctggaaatgataaaagtaaatttcaacagcgtagttatgaggggttagatgttttctttgttcaagaaaaaagagataagcacgatatattttatactgttggtggtgtaatacagaataataaaacatctggagttgtcagtgcaccaatattaaatatttcaaaagaaaagggtgaagatgcttttgtgaaaggttacccttattacattaaaaaagaaaaaataacactaaaagaactggattataagttgagaaagcatctaattgaaaaatacggactttataaaacaatctcaaaagatggtagggtcaaaattagcttgaaagatggcagtttttataaccttgatttaagatctaaattaaaatttaaatatatgggggaagtcatagaaagcaaacaaattaaagatattgaagttaacttaaag

SEQ ID NO: 1778 - protein, 232 aa, Staphylococcus aureus
  MISC_FEATURE (1)..(232): exotoxin 14 [Staphylococcus
LEQINMKFTALAKATLALGILTTGTLTTEVHSGHAKQNQKSVNKHDKEALYRYYTGKTMEMKNISALKHGKNNLRFKFRGIKIQVLLPGNDKSKFQQRSYEGLDVFFVQEKRDKHDIFYTVGGVIQNNKTSGVVSAPILNISKEKGEDAFVKGYPYYIKKEKITLKELDYKLRKHLIEKYGLYKTISKDGRVKISLKDGSFYNLDLRSKLKFKYMGEVIESKQIKDIEVNLK

SEQ ID NO: 1779 - DNA, 711 bp, Staphylococcus aureus
ttggagcaaaaaaatatgaaattaacaacgatagctaaagcaacattagcattaggaatattaactacaggtgtgtttacagcagaaagtcaaactggtcacgcgaaagtagaacttgatgagacacaacgcaaatattatatcaatatgctacatcaatactattctgaagaaagttttgaaccaacaaacattagtgttaaaagtgaagattactatggctctaacgttttaaactttaaacaacgaaataaagcttttaaagtatttttacttggtgacgataaaaataaatataaagaaaaaacacatggccttgatgtctttgcagtacctgaattaatagatataaaaggtggcatatatagcgttggcggtataacaaagaaaaatgtgagatcagtgtttggatttgtaagtaatccaagtctacaagttaaaaaagttgatgctaaaaatggcttttcgataaacgagttgttttttattcaaaaggaagaagtatcattgaaggaactggactttaaaataagaaaactcttaatcgaaaaatatagattgtataaaggaacgtctgataaaggtagaattgttatcaatatgaaagacgaaaagaagcatgaaattgatttaagtgaaaaattaagttttgaacgtatgtttgatgtaatggatagtaagcaaattaaaaatattgaagtgaatttgaat

SEQ ID NO: 1780 - protein, 237 aa, Staphylococcus aureus
  MISC_FEATURE (1)..(237): exotoxin 13 [Staphylococcus
LEQKNMKLTTIAKATLALGILTTGVFTAESQTGHAKVELDETQRKYYINMLHQYYSEESFEPTNISVKSEDYYGSNVLNFKQRNKAFKVFLLGDDKNKYKEKTHGLDVFAVPELIDIKGGIYSVGGITKKNVRSVFGFVSNPSLQVKKVDAKNGFSINELFFIQKEEVSLKELDFKIRKLLIEKYRLYKGTSDKGRIVINMKDEKKHEIDLSEKLSFERMFDVMDSKQIKNIEVNLN

SEQ ID NO: 1781 - DNA, 711 bp, Staphylococcus aureus
ttggagcacatgaatatgaaatttacagtgatagctaaagcgatatttatattaggaatattaacaacaagtgtaatgataacagaaaatcaatcggttaatgcaaaaggaaagtatgaaaaaatgaaccgtttatatgatacaaacaagttacatcaatactattcaggacctagttatgagttaacaaatgttagtggccaaagtcaaggttattatgactctaacgttttgctttttaaccaacaaaatcaaaagttccaagtgtttttattgggaaaagatgaaaataaatacaaagaaaaaacacatggtttagatgtctttgcggtaccagaattagtagatttagatggaagaatatttagtgttagtggtgtaacaaagaaaaacgtaaaatcaatatttgagtctctaagaacgccgaacttactagttaaaaaaatagacgataaagacggtttttctattgatgaatttttctttattcaaaaggaagaagtgtcattgaaggaacttgattttaaaataagaaaactgttgattaaaaaatacaaactgtatgaagggtcagctgataaaggtagaattgttattaatatgaaagatgaaaataagtatgaaattgatttaagtgataaattagatttcgagcgtatggcagatgtcattaatagtgaacaaattaaaaacatcgaagtgaatttgaaa

SEQ ID NO: 1782 - protein, 237 aa, Staphylococcus aureus
  MISC_FEATURE (1)..(237): exotoxin 12 [Staphylococcus
LEHMNMKFTVIAKAIFILGILTTSVMITENQSVNAKGKYEKMNRLYDTNKLHQYYSGPSYELTNVSGQSQGYYDSNVLLFNQQNQKFQVFLLGKDENKYKEKTHGLDVFAVPELVDLDGRIFSVSGVTKKNVKSIFESLRTPNLLVKKIDDKDGFSIDEFFFIQKEEVSLKELDFKIRKLLIKKYKLYEGSADKGRIVINMKDENKYEIDLSDKLDFERMADVINSEQIKNIEVNLK

SEQ ID NO: 1783 - DNA, 693 bp, Staphylococcus aureus
gtgaaattaaaaacgttagctaaagcaacattggcattaggcttattaactactggtgtgattacatcagaaggccaagcagttcaagcaaaagaaaagcaagagagagtacaacatttatatgatattaaagacttacatcgatactactcatcagaaagttttgaattcagtaatattagtggtaaggttgaaaattataacggttctaacgttgtacgctttaaccaagaaaatcaaaatcaccaattattcttattaggtaaagataaagagaaatataaagaaggcattgaaggcaaagatgtctttgtggtaaaagaattaattgatccaaacggtagattatctactgttggtggtgtgactaagaaaaataacaaatcttctgaaactaatacacatttatttgttaataaagtgtatggcggaaatttagatgcatcaattgactcattttcaattaataaagaagaagtttcactgaaagaacttgatttcaaaattagacaacatttagttaaaaattatggtttatataaaggtacgactaaatacggtaagatcactatcaatttgaaagatggagaaaagcaagaaattgatttaggtgataaattgcaattcgagcgcatgggtgatgtgttgaatagtaaggatattaataagattgaagtgactttgaaacaaatt

SEQ ID NO: 1784 - protein, 231 aa, Staphylococcus aureus
  MISC_FEATURE (1)..(231): exotoxin 11 [Staphylococcus
VKLKTLAKATLALGLLTTGVITSEGQAVQAKEKQERVQHLYDIKDLHRYYSSESFEFSNISGKVENYNGSNVVRFNQENQNHQLFLLGKDKEKYKEGIEGKDVFVVKELIDPNGRLSTVGGVTKKNNKSSETNTHLFVNKVYGGNLDASIDSFSINKEEVSLKELDFKIRQHLVKNYGLYKGTTKYGKITINLKDGEKQEIDLGDKLQFERMGDVLNSKDINKIEVTLKQI

SEQ ID NO: 1785 - DNA, 693 bp, Staphylococcus aureus
atgaaattaaaaacgttagctaaagcaacattagtattgggattgttagctactggtgtaataacaacagaaagtcaaacagtaaaagcggcagaatcaactcaaggtcaacacaattataaatcgttaaaatactactatagcaagccaagtatagagttaaaaaatcttgatggtttgtatagacagaaagtgacagataaaggagtatatgtttggaaggatcgaaaagattattttgttggcttgcttggtaaagatattgaaaaataccctcaaggtgagcatgataagcaagatgcatttttagtcatcgaggaggaaactgttaatggaagacaatattcaattggtggtttaagtaagacaaatagtaaagaatttagtaaagaagtcgatgttaaagtaacaagaaaaattgatgaatcatcggaaaagtctaaagatagtaaatttaaaattactaaagaagaaatctcgttaaaagagttggactttaaattaagaaaaaaattgatggaagaagaaaaattatatggtgctgttaataatagaaaaggtaaaattgtagttaaaatggaagatgataagttttatactttcgaacttacaaaaaaactacaaccgcatcgcatgggtgacacgatagatggtaccaaaatcaaagaaattaatgttgagctagaatataaa

SEQ ID NO: 1786 - protein, 231 aa, Staphylococcus aureus
  MISC_FEATURE (1)..(231): exotoxin 8 [Staphylococcus
MKLKTLAKATLVLGLLATGVITTESQTVKAAESTQGQHNYKSLKYYYSKPSIELKNLDGLYRQKVTDKGVYVWKDRKDYFVGLLGKDIEKYPQGEHDKQDAFLVIEEETVNGRQYSIGGLSKTNSKEFSKEVDVKVTRKIDESSEKSKDSKFKITKEEISLKELDFKLRKKLMEEEKLYGAVNNRKGKIVVKMEDDKFYTFELTKKLQPHRMGDTIDGTKIKEINVELEYK

SEQ ID NO: 1787 - DNA, 717 bp, Staphylococcus aureus
atggagcatacaactatgaaaatgacagcaattgcgaaagcaagtttagcattaggtattttagcaacaggaacaataacgtcattgcatcaaactgtaaatgcgagtgaacataaagcaaaatatgaaaatgtgacaaaagatatctttgacttaagagattactatagtggcgcaagtaaggaacttaaaaatgttactggttatcgttatagcaaaggtggcaagcattaccttatctttgataaaaatagaaaattcacaagagtacagatatttggtaaagatattgaaagatttaaagcacgtaaaaatccgggattagacatatttgttgttaaagaagcggaaaaccgtaatggcacagtgttttcatatggtggtgtcactaagaaaaatcaagacgcttattatgattatataaacgcaccaagatttcaaatcaagagagatgaaggtgacggtattgctacgtacggtagagtacactacatttataaagaagagatttcacttaaagaactcgactttaaattgagacagtatttaattcaaaattttgatctgtataaaaagtttcctaaagatagtaagataaaagtgataatgaaagatggcggctattatacgtttgaacttaataaaaaattacaaacaaatcgcatgagtgacgtcattgacggtagaaatattgaaaaaatagaagccaacattaga

SEQ ID NO: 1788 - protein, 239 aa, Staphylococcus aureus
  MISC_FEATURE (1)..(239): exotoxin 10 [Staphylococcus
MEHTTMKMTAIAKASLALGILATGTITSLHQTVNASEHKAKYENVTKDIFDLRDYYSGASKELKNVTGYRYSKGGKHYLIFDKNRKFTRVQIFGKDIERFKARKNPGLDIFVVKEAENRNGTVFSYGGVTKKNQDAYYDYINAPRFQIKRDEGDGIATYGRVHYIYKEEISLKELDFKLRQYLIQNFDLYKKFPKDSKIKVIMKDGGYYTFELNKKLQTNRMSDVIDGRNIEKIEANIR

SEQ ID NO: 1789 - DNA, 939 bp, Staphylococcus aureus
atggagcatacaactatgaaaataacaacgattgctaaaacaagtttagcactaggccttttaacaacaggtgtaatcacaacgacaacgcaagcagcaaacgcgacaacactatcttccactaaagtggaagcaccacaatcaacaccgccctcaactaaaatagaagcaccgcaatcaaaaccaaacgcgacaacaccgccctcaactaaagtagaagcaccgcaacaaacagcaaatgcgacaacaccgccttcaactaaagtgacaacacctccatcaacaaacacgccacaaccaatgcaatctactaaatcagacacaccacaatcgccaaccacaaaacaagtaccaacagaaataaatcctaaatttaaagatttaagagcgtattatacgaaaccaagtttagaatttaaaaatgagattggtattattttaaaaaaatggacgacaataagatttatgaatgttgtcccagattatttcatatataaaattgctttagttggtaaagatgataaaaaatatggtgaaggagtacataggaatgtcgatgtatttgtcgttttagaagaaaataattacaatctggaaaaatattctgtcggtggtatcacaaagagtaatagtaaaaaagttgatcacaaagcaggagtaagaattactaaggaagataataaaggtacaatctctcatgatgtttcagaattcaagattactaaagaacagatttccttgaaagaacttgattttaaattgagaaaacaacttattgaaaaaaataatctgtacggtaacgttggttcaggtaaaattgttattaaaatgaaaaacggtggaaagtacacgtttgaattgcacaaaaaattacaagaaaatcgcatggcagatgtcatagatggcactaatattgataacattgaagtgaatataaaa

SEQ ID NO: 1790 - protein, 313 aa, Staphylococcus aureus
  MISC_FEATURE (1)..(313): exotoxin 8 [Staphylococcus
MEHTTMKITTIAKTSLALGLLTTGVITTTTQAANATTLSSTKVEAPQSTPPSTKIEAPQSKPNATTPPSTKVEAPQQTANATTPPSTKVTTPPSTNTPQPMQSTKSDTPQSPTTKQVPTEINPKFKDLRAYYTKPSLEFKNEIGIILKKWTTIRFMNVVPDYFIYKIALVGKDDKKYGEGVHRNVDVFVVLEENNYNLEKYSVGGITKSNSKKVDHKAGVRITKEDNKGTISHDVSEFKITKEQISLKELDFKLRKQLIEKNNLYGNVGSGKIVIKMKNGGKYTFELHKKLQENRMADVIDGTNIDNIEVNIK

SEQ ID NO: 1791 - DNA, 135 bp, Staphylococcus aureus
ttgtttgtaaaagtggcatttctatgtcttaaaagtgacgaaacttcaaatgtgccaagtgttgaatcacatcaaaatcatttttatttaacgaacattatggatttcttaatttacttaacgatgattcaaata

SEQ ID NO: 1792 - protein, 45 aa, Staphylococcus aureus
LFVKVAFLCLKSDETSNVPSVESHQNHFYLTNIMDFLIYLTMIQI

SEQ ID NO: 1793 - DNA, 192 bp, Staphylococcus aureus
ttgagaattgaagatgcatatcgtaaagatgttattatcacgcttttgaataatgaagaatacgaagggtttgtaactgactatgaaaatgaattcgagagcgaaacaggaaatcttgttgtagatatacagactgattttgctgtttattcgtttgatgaaactgagataaaaagtattagattattaaaa

SEQ ID NO: 1794 - protein, 64 aa, Staphylococcus aureus
LRIEDAYRKDVIITLLNNEEYEGFVTDYENEFESETGNLVVDIQTDFAVYSFDETEIKSIRLLK

SEQ ID NO: 1795 - DNA, 1083 bp, Staphylococcus aureus
ttggagcatacaattatgaaaatgagaacaattgctaaaaccagtttagcactagggcttttaacaacaggcgcaattacagtaacgacgcaatcggtcaaagcagaaaaaatacaatcaactaaagttgacaaagtaccaacgcttaaagcagagcgattagcaatgataaacataacagcaggtgcaaattcagcgacaacacaagcagctaacacaagacaagaacgcacgcctaaactcgaaaaggcaccaaatactaatgaggaaaaaacctcagcttccaaaatagaaaaaatatcacaacctaaacaagaagagcagaaaacgcttaatatatcagcaacgccagcgcctaaacaagaacaatcacaaacgacaaccgaatccacaacgccgaaaactaaagtgacaacacctccatcaacaaacacgccacaaccaatgcaatctactaaatcagacacaccacaatctccaaccataaaacaagcacaaacagatatgactcctaaatatgaagatttaagagcgtattatacaaaaccgagttttgaatttgaaaagcagtttggatttatgctcaaaccatggacgacggttaggtttatgaatgttattccaaataggttcatctataaaatagctttagttggaaaagatgagaaaaaatataaagatggaccttacgataatatcgatgtatttatcgttttagaagacaataaatatcaattgaaaaaatattctgtcggtggcatcacgaagactaatagtaaaaaagttaatcacaaagtagaattaagcattactaaaaaagataatcaaggtatgatttcacgcgatgtttcagaatacatgattactaaggaagagatttccttgaaagagcttgattttaaattgagaaaacaacttattgaaaaacataatctttacggtaacatgggttcaggaacaatcgttattaaaatgaaaaacggtgggaaatatacgtttgaattacacaaaaaactgcaagagcatcgtatggcagacgtcatagatggcactaatattgataacattgaagtgaatataaaa

SEQ ID NO: 1796 - protein, 361 aa, Staphylococcus aureus
  MISC_FEATURE (1)..(361): exotoxin 8 [Staphylococcus
LEHTIMKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMADVIDGTNIDNIEVNIK

SEQ ID NO: 1797 - DNA, 753 bp, Staphylococcus aureus
gtgtatgattcaaattacgtaataaaacaatctaattataatagattggagcatacaactatgaaaatgaaaaatattgcaaaaataagtttgttattaggaatattagcaacaggtgtaaacactacaacggaaaaaccagttcatgccgaaaagaaacctattgtaataagtgaaaatagcaaaaaattaaaagcttattataatcaacctagtattgaatataaaaatgtgacaggttatatcagtttcattcaaccaagtattaaatttatgaatatcatagatggtaattctgttaataatattgctttaattggcaaagataagcaacattatcatacgggtgtacatcgtaatcttaatatattttacgttaatgaggataagagatttgaaggtgcaaagtactctattgggggtatcacgagtgcaaacgataaagctgtcgacctaatagcagaagcaagagttattaaagaagatcatactggtgaatatgattatgactttttcccatttaaaatagataaagaagcgatgtcattgaaagagattgattttaaattaagaaaataccttattgataattatggtctttacggtgaaatgagtacaggaaaaattacagtcaaaaagaaatactatggaaagtatacatttgaattggataaaaagttacaagaagaccgtatgtccgatgttatcaatgtcacagatattgatagaattgaaatcaaagttataaaagca

SEQ ID NO: 1798 - protein, 251 aa, Staphylococcus aureus
  MISC_FEATURE (1)..(251): exotoxin 7 [Staphylococcus
VYDSNYVIKQSNYNRLEHTTMKMKNIAKISLLLGILATGVNTTTEKPVHAEKKPIVISENSKKLKAYYNQPSIEYKNVTGYISFIQPSIKFMNIIDGNSVNNIALIGKDKQHYHTGVHRNLNIFYVNEDKRFEGAKYSIGGITSANDKAVDLIAEARVIKEDHTGEYDYDFFPFKIDKEAMSLKEIDFKLRKYLIDNYGLYGEMSTGKITVKKKYYGKYTFELDKKLQEDRMSDVINVTDIDRIEIKVIKA

SEQ ID NO: 1799 - DNA, 693 bp, Staphylococcus aureus
ttggggctaaaaattatgaaatttaaagcgatagcaaaagcaagtttagcattgggaatgttagcaacaggtgtaattacatcgaatgtacaatcagtacaagcgaaagcagaagttaaacaacaaagtgaatcagagttaaaacactattataataaaccaattttagagcgtaaaaatgtgactggatttaaatatactgatgagggtaaacactatttagaagtcacagtagggcaacagcattctcgaatcactttacttggatctgataaagataaatttaaagacggagaaaactcaaatatagatgtgtttatccttagagaaggtgacagtagacaagcaacaaattactcaattggtggcgttacaaaatcaaatagtgtgcagtatattgattatatcaatacgccaattttagaaatcaagaaagataatgaagatgtacttaaagatttttactacatttcaaaagaagacatctcattaaaagaacttgattatagattaagagaacgtgcgattaaacaacacggcttgtattcaaatggtcttaaacaaggtcaaattacaattacaatgaatgatggcacaacacatacaatcgatttaagtcaaaaacttgaaaaagaacgtatgggtgagtcaatcgacggcactaagattaataaaattctagtagaaatgaaa

SEQ ID NO: 1800 - protein, 231 aa, Staphylococcus aureus
  MISC_FEATURE (1)..(231): exotoxin 6 [Staphylococcus
LGLKIMKFKAIAKASLALGMLATGVITSNVQSVQAKAEVKQQSESELKHYYNKPILERKNVTGFKYTDEGKHYLEVTVGQQHSRITLLGSDKDKFKDGENSNIDVFILREGDSRQATNYSIGGVTKSNSVQYIDYINTPILEIKKDNEDVLKDFYYISKEDISLKELDYRLRERAIKQHGLYSNGLKQGQITITMNDGTTHTIDLSQKLEKERMGESIDGTKINKILVEMK

SEQ ID NO: 1801 - DNA, 843 bp, Staphylococcus aureus
atgaatattatgttaacaggtgctacaggtcatttaggcacacatattacaaatcaagccattgcaaatcacatagatcattttcacattggtgttagaaatgttgagaaagttccagaagattggcgcggaaaagttcctgttcgacaattagattattttaatcaagaaagcatggtagaagcatttaaaggaatggataccgttgtgtttattccaagtattatccatccatcattcaaacgtattcctgaagtggaaaatttagtatatgcggcaaagcagagcggcgttgctcatatcattttcataggttattacgcagatcagcataataatccattccatatgagtccttattttggttatgcagcacgtctattggcaacaagtggcattgactatacgtatgtaagaatggcaatgtacatggatccacttaaaccatatttaccagaattgatgaatatgcataaactgatttatccagctggcgatggtcgtattaattatattactagaaatgatattgctagaggtgtcattgctattattaaaaatccagatacttggggcaaacgctacttattatcaggctacagttatgatatgaaagaacttgctgcaattttatctgaggcatcaggcacagaaattaaatatgagcccgtttcattagagacatttgcagaaatgtatgatgaacctaaaggctttggtgcattattggcatcaatgtacgacgcaggagcaagaggactattagaccaagaatccaatgatttccaacaattagtcaatgatcaaccacagacactgcaatcatttttacaagaaaatatt

SEQ ID NO: 1802 - protein, 281 aa, Staphylococcus aureus
  MISC_FEATURE (1)..(281): conserved hypothetical
MNIMLTGATGHLGTHITNQAIANHIDHFHIGVRNVEKVPEDWRGKVPVRQLDYFNQESMVEAFKGMDTVVFIPSIIHPSFKRIPEVENLVYAAKQSGVAHIIFIGYYADQHNNPFHMSPYFGYAARLLATSGIDYTYVRMAMYMDPLKPYLPELMNMHKLIYPAGDGRINYITRNDIARGVIAIIKNPDTWGKRYLLSGYSYDMKELAAILSEASGTEIKYEPVSLETFAEMYDEPKGFGALLASMYDAGARGLLDQESNDFQQLVNDQPQTLQSFLQENI

SEQ ID NO: 1803 - DNA, 357 bp, Staphylococcus aureus
gtgaatatcatctcaacaattttaatcatatttgtggcattagagtttttctatattatgtaccttgaaacgattgctacaacttccaaaaagactagcgagacatttaatataagcgtcgataaattgaaagacaaaaatattaacctacttttgaagaaccaaggcgtatataacggtttaatcggagttttgctaatatacggtttgtttatcagcagtaatccaaaagaaatatgcgcagctattttagtgtatatcattggcgttgctatttatggtggcctttcaagcaatattagtatctttttcaaacaaggcacattgccagtattggcactcatatcaatgctttgg

SEQ ID NO: 1804 - protein, 119 aa, Staphylococcus aureus
  MISC_FEATURE (1)..(119): conserved hypothetical
VNIISTILIIFVALEFFYIMYLETIATTSKKTSETFNISVDKLKDKNINLLLKNQGVYNGLIGVLLIYGLFISSNPKEICAAILVYIIGVAIYGGLSSNISIFFKQGTLPVLALISMLW

SEQ ID NO: 1805 - DNA, 159 bp, Staphylococcus aureus
gtgattatcatggtaccagaagaaaaaggttctattactttgtcaaaagaagcagctatcatatttgcaatcgcaaaattcaaaccatttaagaacagaattaaaaataacccacaaaaaacaaatccatttcttaaattacatgaaaacaaaaaatct

SEQ ID NO: 1806 - protein, 53 aa, Staphylococcus aureus
  MISC_FEATURE (1)..(53): hypothetical protein
VIIMVPEEKGSITLSKEAAIIFAIAKFKPFKNRIKNNPQKTNPFLKLHENKKS

SEQ ID NO: 1807 - DNA, 270 bp, Staphylococcus aureus
atgacaaaagaaagaagaacatttagttcagagtttaagttacaaatggttagattatataaaaatggtaagcttaagaatgaaattatacgaaagtatgatttaaaaccctcaattatctcaaattcgataaaacaacaccaaaatactggacccttcaatcatcaagataatttaaaaagtgatgaaaaagagttaataaaattacgcaaagaagttcaacatttaaaaatggaacatgatgttttaaagcaaattttaaagttgatt

SEQ ID NO: 1808 - protein, 90 aa, Staphylococcus aureus
  MISC_FEATURE (1)..(90): probable transposase
MTKERRTFSSEFKLQMVRLYKNGKLKNEIIRKYDLKPSIISNSIKQHQNTGPFNHQDNLKSDEKELIKLRKEVQHLKMEHDVLKQILKLI

SEQ ID NO: 1809 - DNA, 702 bp, Staphylococcus aureus
atgtctaaaaatatcaatcaagcaaatagtaaattaaatacgtcaaacaaaaaactaaaacaagcttattcaaaatccgacagtaaaaacatgaaagttatatacatgcctcattggctagagttttattcaattgctatacatagcgatgttacaagcaataaaaaaagatattataaatcatatagtagaggaacagtggtatatgtaaaactagggagtaatattggaagtgagttttctggtaatcatttttgtgtaatattagataacaaagacaataaaggaaaagaaacagttacaatagttccactttcttccaaaggtaataaaaattatttgaagttaaacgaatcggtgctaaatctaacagcaacagatttaaaaaaacagattatcgatatcagtagtaaagtacaagcattagcccaaaaatatagagaaattgacattaaacttagcacagaagataaaaagcttttgtctaacttaaatcaaaaagctaatgaactgtatagagtgataggtgtttattccaagcacaaagggaaagatacatacgttaatatatcagcaattacaacaataagcaaaagacgtataagcaaaataaatgattctgatcctactggaacgataataatttcagaagatgacatgaatgaaatcgaaaagcaattaaagataaagttcttttctaat

SEQ ID NO: 1810 - protein, 234 aa, Staphylococcus aureus
  MISC_FEATURE (1)..(234): hypothetical protein
MSKNINQANSKLNTSNKKLKQAYSKSDSKNMKVIYMPHWLEFYSIAIHSDVTSNKKRYYKSYSRGTVVYVKLGSNIGSEFSGNHFCVILDNKDNKGKETVTIVPLSSKGNKNYLKLNESVLNLTATDLKKQIIDISSKVQALAQKYREIDIKLSTEDKKLLSNLNQKANELYRVIGVYSKHKGKDTYVNISAITTISKRRISKINDSDPTGTIIISEDDMNEIEKQLKIKFFSN

SEQ ID NO: 1811 - DNA, 534 bp, Staphylococcus aureus
atgcacaacaataatgaattcaacaaaaaactgaaagattttataggtagcgataaacggatggctttagtaaagggttatgttaacgagtataaattaacaactgttttaagagctttaaataattccgattacacaaaagggacgatacacactcgttcaataggcaacctaaaacaaatagtagataatcgaattattcctaaaaatataactcaaaacacaatcttcaaattgagtaatttaaccttagaggttaacctctatgaaagaaacacaatttatcacggagactttgctatttactatcctgtagaatctgctctaataatagaaacagatactcctaggctaattaatcatataaataacaacccagtccaaaaaatatttataataacaacaaatgactggagctttaatacacttgaattagaaaaaatagtagacgaaactataatttatgatttaaaacaagaagatcctaaacaatatgaaattttatataaaaataaacacggaaaattgccttat

SEQ ID NO: 1812 - protein, 178 aa, Staphylococcus aureus
  MISC_FEATURE (1)..(178): hypothetical protein
MHNNNEFNKKLKDFIGSDKRMALVKGYVNEYKLTTVLRALNNSDYTKGTIHTRSIGNLKQIVDNRIIPKNITQNTIFKLSNLTLEVNLYERNTIYHGDFAIYYPVESALIIETDTPRLINHINNNPVQKIFIITTNDWSFNTLELEKIVDETIIYDLKQEDPKQYEILYKNKHGKLPY

SEQ ID NO: 1813 - DNA, 288 bp, Staphylococcus aureus
atgttaggtcatcacctatataatgaaaataaaaaaagagccattttaaataataagaaattgcctagctatacaatactttctatagatttattgaatgaattgttaagagaaaaaatgtcaacaggcaatctaatattaagtgatgagcgatttgatttgaaagagattattaattttaatcaaattattggaaaaatacatatcgaaaatgtgtatattgaaaccagaaagggaaaagtgcattattcgaagacaggtgctcatatagtaccttatattgataag

SEQ ID NO: 1814 - protein, 96 aa, Staphylococcus aureus
MLGHHLYNENKKRAILNNKKLPSYTILSIDLLNELLREKMSTGNLILSDERFDLKEIINFNQIIGKIHIENVYIETRKGKVHYSKTGAHIVPYIDK

SEQ ID NO: 1815 - DNA, 1539 bp, Staphylococcus aureus
atggaaatggcaaaagaacaagagttaatccttgtcttagactttggtagccaatacaaccaattaattacacgccgaattcgtgaaatgggcgtttatagtgaattacacgatcatgaaatttcaattgaagaaattaagaaaatgaatccaaaaggtattatcttatcaggtggtccaaattcagtttatgaagaaggttcatttacaattgatccggaaatatataatttaggaattccagtacttggtatttgttacggcatgcaattaactactaaattattaggtggtaaagttgaacgtgccaatgaacgtgaatacggtaaagcaatcattaatgcgaagtcagatgagttattcgctggcttaccagcagaacaaactgtttggatgagtcattctgataaagttattgaaattccagaaggctttgaagttatcgctgatagcccaagcacagactatgcagcaatcgaagataagaaacgtcgcatttatggtgttcaattccatccagaagtacgtcatacagaatatggtaatgatttattaaataattttgtccgtcgtgtttgtgattgtagaggtcaatggacaatggaaaactttatcgaaatcgaaattgaaaagattcgtcaacgcgtaggagaccgtcgtgtattatgtgcgatgagtggcggcgtagattcatctgttgtagctgtactattgcataaagcaataggtgatcaactaacatgtatctttgtagaccatggcttacttcgtaaaggtgaaggcgacatggttatggagcaattcggtgaaggtttcaacatgaatattattcgtgttaatgcgaaagatcgctttatgaataaattaaaaggtgtttcagatcctgaacaaaaacgtaaaatcattggtaatgaatttgtatacgtatttgatgatgaagcatcaaaactgaaaggtgtagacttccttgcgcaaggaacactatatacagacgtcatcgaatcaggtactaaaacagcacaaacaatcaaatcacaccacaatgttggtggattaccagaagacatggaattcgaattaatcgaaccaatcaatacattgtttaaagatgaagtacgtaaattaggtattgagttaggtattccagaacatttagtatggagacaaccattcccaggacctggtcttggtattcgtgtacttggagaaattactgaagataaactagaaatcgttagagaatcagacgcgattttacgccaagtgattagagaagaaggtcttgaaagagaaatttggcaatacttcacagtgttaccaaacattcaatcagtaggtgttatgggagactaccgtacgtatgatcacacagtaggtattcgtgcagtaacatctatcgacggtatgacaagtgacttcgcacgcatcgattgggaagtcttacaaaagatttctagtcgtatcgtaaacgaagtagatcacgtcaaccgcgtagtctatgacattacatcaaaaccaccaagcacaattgagtgggaa

SEQ ID NO: 1816 - protein, 513 aa, Staphylococcus aureus
  MISC_FEATURE (1)..(513): GMP synthase
MEMAKEQELILVLDFGSQYNQLITRRIREMGVYSELHDHEISIEEIKKMNPKGIILSGGPNSVYEEGSFTIDPEIYNLGIPVLGICYGMQLTTKLLGGKVERANEREYGKAIINAKSDELFAGLPAEQTVWMSHSDKVIEIPEGFEVIADSPSTDYAAIEDKKRRIYGVQFHPEVRHTEYGNDLLNNFVRRVCDCRGQWTMENFIEIEIEKIRQRVGDRRVLCAMSGGVDSSVVAVLLHKAIGDQLTCIFVDHGLLRKGEGDMVMEQFGEGFNMNIIRVNAKDRFMNKLKGVSDPEQKRKIIGNEFVYVFDDEASKLKGVDFLAQGTLYTDVIESGTKTAQTIKSHHNVGGLPEDMEFELIEPINTLFKDEVRKLGIELGIPEHLVWRQPFPGPGLGIRVLGEITEDKLEIVRESDAILRQVIREEGLEREIWQYFTVLPNIQSVGVMGDYRTYDHTVGIRAVTSIDGMTSDFARIDWEVLQKISSRIVNEVDHVNRVVYDITSKPPSTIEWE

SEQ ID NO: 1817 - DNA, 1464 bp, Staphylococcus aureus
atgtgggaaagtaaatttgcaaaagaatcattaacgtttgatgatgtgttattaattccagcacaatctgatattttaccgaaagacgttgatttaagcgtacaattatcagacaaagttaaattaaatattccagttatttctgctggtatggatactgtaactgaatctaaaatggcgattgctatggctcgtcaaggtggtttaggtgttattcataaaaatatgggcgttgaagaacaagcggacgaagttcaaaaagtaaaacgctcagaaaatggtgtcatttcaaacccatttttcttaacgccagaagaaagcgtttatgaagcagaagcattaatgggtaaataccgtatttcaggtgtaccaattgttgataataaagaagatcgcaacttagtaggtattttaacaaaccgtgacttacgttttattgaagacttctcgattaaaattgtagatgtaatgacgcaagaaaatttaattacagctccagtgaatacaacacttgaagaagcagaaaaaattctccaaaaacataagattgaaaagttaccattagttaaagacggacgtctagaaggtcttattactattaaagatattgaaaaagttatcgaattccctaatgcagcaaaagatgaacatggtcgtctacttgtagccgcagcaattggtatttcaaaagatactgatattcgtgctcaaaaattagtcgaagcaggtgtggatgtcttagttatcgatacagcacatggtcactctaaaggtgttatcgatcaagtgaaacatattaagaagacttacccagaaatcacattagtagcaggtaacgtagcaactgcagaagcaacaaaagatttatttgaagcgggtgcagatattgttaaagttggtattggcccaggttcaatttgtacgacgcgtgttgtagcaggtgttggtgtaccacaaattacagcaatttatgattgtgcaactgaagcacgcaaacatggtaaagctatcattgctgatggtggtattaaattctcaggagatatcattaaagcattagctgctggtggacatgcggttatgttaggtagcttattagcaggtactgaagaaagcccaggcgcaacagaaattttccaaggtagacaatataaagtataccgtggtatgggctctttaggtgcgatggaaaaaggttcaaacgaccgttacttccaagaggacaaagcgcctaagaaatttgttcctgaaggtatcgaaggacgtacggcttataaaggtgcgttacaagatacaatttaccaattaatgggcggtgtgcgtgctggtatgggttatactggttcacacgatttaagagaattacgcgaagaagcacaatttacacgtatgggtcctgctggtttagcagaaagccatccacataatattcaaattacgaaagaatcaccgaactactcattc

SEQ ID NO: 1818 - protein, 488 aa, Staphylococcus aureus
  MISC_FEATURE (1)..(488): inositol-monophosphate
MWESKFAKESLTFDDVLLIPAQSDILPKDVDLSVQLSDKVKLNIPVISAGMDTVTESKMAIAMARQGGLGVIHKNMGVEEQADEVQKVKRSENGVISNPFFLTPEESVYEAEALMGKYRISGVPIVDNKEDRNLVGILTNRDLRFIEDFSIKIVDVMTQENLITAPVNTTLEEAEKILQKHKIEKLPLVKDGRLEGLITIKDIEKVIEFPNAAKDEHGRLLVAAAIGISKDTDIRAQKLVEAGVDVLVIDTAHGHSKGVIDQVKHIKKTYPEITLVAGNVATAEATKDLFEAGADIVKVGIGPGSICTTRVVAGVGVPQITAIYDCATEARKHGKAIIADGGIKFSGDIIKALAAGGHAVMLGSLLAGTEESPGATEIFQGRQYKVYRGMGSLGAMEKGSNDRYFQEDKAPKKFVPEGIEGRTAYKGALQDTIYQLMGGVRAGMGYTGSHDLRELREEAQFTRMGPAGLAESHPHNIQITKESPNYSF

SEQ ID NO: 1819 - DNA, 1266 bp, Staphylococcus aureus
atgaaaaatttaatcctaagtgttcaacatcttttagctatgtacgcaggtgctatcttagttccaatcattgttggtacaagtttgaagtttacacctgaacaaatcgcttacttagttacagtagatatatttatgtgtggggttgccacatttttacaagccaataaagtaacaggaacaggattaccaatcgttcttggatgtacattcacggctgttgcgcccatgattttaattggtcaaacgaaaggaatagatgtactttatggttcgctatttttatcagggatattagttattatcatcgcgcctttcttttcacatcttgtaaaattcttcccaccagtagtaacgggtagtgttgttactatcattggtatcaatttaatgccagtagcaatgaattacttagctggaggtcaaggtgcaaaggactatggagatgttaagaacattttgttaggtttaatgacattaatcattattcttcttttacaaagattcacaactggatttattaagagtattgccatattaattggactcgttttaggaacgataggtgctggcttacttgggatggtcgatattaatcaagtcaatcatgccggttggttaggcatcccagtgccgtttagattctctggatttagctttgatgtgacatcgacgttagtgttctttattgtagctatcgttagtttaattgagtcgacaggtgtctatcatgcgttaagtgaaattaccggtaagaagttagaaagaaaagattttcgtaaaggttatactgcggaaggtctagcgatagtgttaggttctatattcaattcatttccgtatacagcctattcgcaaaatgtaggacttgtttctttatccggcgctaagaaaaacaatgttatatacggcatggtcgtgttattacttatatgtggttgtatacctaagcttggcgcattagcaaatatcataccgctacctgtgttaggcggtgcgatgatagctatgtttggcatggtaatggcatatggtgttagtatattaggacatatcgattttaaaaatcaaaacaatttattaattatcgctgtatcagtaggattaggtactggtataagcgctgtaccacaagcatttaaaggtttaggtgaacaatttgcatggttgactcaaaacggaattgttttaggcgcaatctctgcaattattcttaatttcttttttaatggaataaagtataaacaaacggaagaaaatgtgaaa

SEQ ID NO: 1820 - protein, 422 aa, Staphylococcus aureus
  MISC_FEATURE (1)..(422): xanthine permease
MKNLILSVQHLLAMYAGAILVPIIVGTSLKFTPEQIAYLVTVDIFMCGVATFLQANKVTGTGLPIVLGCTFTAVAPMILIGQTKGIDVLYGSLFLSGILVIIIAPFFSHLVKFFPPVVTGSVVTIIGINLMPVAMNYLAGGQGAKDYGDVKNILLGLMTLIIILLLQRFTTGFIKSIAILIGLVLGTIGAGLLGMVDINQVNHAGWLGIPVPFRFSGFSFDVTSTLVFFIVAIVSLIESTGVYHALSEITGKKLERKDFRKGYTAEGLAIVLGSIFNSFPYTAYSQNVGLVSLSGAKKNNVIYGMVVLLLICGCIPKLGALANIIPLPVLGGAMIAMFGMVMAYGVSILGHIDFKNQNNLLIIAVSVGLGTGISAVPQAFKGLGEQFAWLTQNGIVLGAISAIILNFFFNGIKYKQTEENVK

SEQ ID NO: 1821 - DNA, 576 bp, Staphylococcus aureus
gtggagttactaggacaaaaagtaaaggaagacggcgttgtcattgatgagaagattttaaaagtcgatggatttttaaatcatcaaattgatgcaaagttaatgaatgaagttggtcgcactttttacgagcaatttaaagataaagggattactaaaatcttaaccattgaagcttccggtatcgcacctgcaatcatggctgcactgcattttgatgtgccatgtttatttgcgaaaaaagcaaaacctagcactttgacggatggttattatgaaacatctattcattcatttactaaaaataaaacaagtacggtcattgtttcaaaagagtttttatcagaagaagatactgtacttatcatcgatgactttttagcaaatggtgatgcttcattaggattatacgatatcgcacagcaagcgaatgctaagacagctggtattggtattgttgttgaaaagagtttccaaaatgggcatcaacgtttagaagaagcaggtttaacagtttcttctctctgcaaggttgcttcactagaaggaaacaaagtgacattggtgggagaagaa

SEQ ID NO: 1822 - protein, 192 aa, Staphylococcus aureus
  MISC_FEATURE (1)..(192): xanthine
VELLGQKVKEDGVVIDEKILKVDGFLNHQIDAKLMNEVGRTFYEQFKDKGITKILTIEASGIAPAIMAALHFDVPCLFAKKAKPSTLTDGYYETSIHSFTKNKTSTVIVSKEFLSEEDTVLIIDDFLANGDASLGLYDIAQQANAKTAGIGIVVEKSFQNGHQRLEEAGLTVSSLCKVASLEGNKVTLVGEE

SEQ ID NO: 1823 - DNA, 405 bp, Staphylococcus aureus
atggcagatattactgtagtaaatgacactggcgaattatacaacgtaatcaatcaaaagaaatctgaaggttatttagaatcagagctaacaattattagtaaaagtaaattacacctaaatgacttacacgactctgaaatctcccttatctcaacaagtggaacatttagtgatagaatgactaaactgttaacaggagaagatggtgaacatgcagttttatcacgctacaacttagcgcctgatgaattagaaaaatataaacaacttattttagacgataaaatgttagttgtagcggttcgtgacaaatcatcacatcaagaagtgcatgaaaataattcagcttatgaagagattgatattacacattttgctgaagcatctaaaggtcccaaagct

SEQ ID NO: 1824 - protein, 135 aa, Staphylococcus aureus
  MISC_FEATURE (1)..(135): hypothetical protein
MADITVVNDTGELYNVINQKKSEGYLESELTIISKSKLHLNDLHDSEISLISTSGTFSDRMTKLLTGEDGEHAVLSRYNLAPDELEKYKQLILDDKMLVVAVRDKSSHQEVHENNSAYEEIDITHFAEASKGPKA

SEQ ID NO: 1825 - DNA, 660 bp, Staphylococcus aureus
atggaatttaaaaccattcaatctgtcaaagatccacattacaacgaagcacttaaactttacgatactaagttaaatttatctttaactgaagataaacgtatcatcaaacgctcattagaaaacaacaaaaccgaaaacgattatgtctttatcgtaggcttagaaaacgatgttgttgtcagtctagcaactgcacattatgaagccacaaccaattcagcatttttaatttatttattcgcaaaagacctacccaaccatgatgagttaatgacgcaaacattacatcaaattgaacatgaactaaacttattatcaaaccttgttcattctagaagtattaactttttaatgatggaagtccctaaagaacctgcagatttaacacaagataacggcctcattattgaacaccgtagacagtttttatacgaacatcaatttgaaagacaaactgaaattgattacattcatccaactaatgatggtcacactaaaaaagtggacttatttttaaagaaaaatattaaactgacaaaggatatctacggtacaagtgttaaatcaaattatattttgaagtatgtatttgccaatggtatcgcacgtgaaattatttatgctttattagaagaaatggatttacgtaaaccattt

SEQ ID NO: 1826 - protein, 220 aa, Staphylococcus aureus
  MISC_FEATURE (1)..(220): hypothetical protein
MEFKTIQSVKDPHYNEALKLYDTKLNLSLTEDKRIIKRSLENNKTENDYVFIVGLENDVVVSLATAHYEATTNSAFLIYLFAKDLPNHDELMTQTLHQIEHELNLLSNLVHSRSINFLMMEVPKEPADLTQDNGLIIEHRRQFLYEHQFERQTEIDYIHPTNDGHTKKVDLFLKKNIKLTKDIYGTSVKSNYILKYVFANGIAREIIYALLEEMDLRKPF

SEQ ID NO: 1827 - DNA, 954 bp, Staphylococcus aureus
atgttaactaaagaatttgcacaacgcgtagaactaagtgagaagcaagtacgtaaaattgttcaacatttagaagaacgtggttaccaactaagcaagactgaatatcgtggtcgtgaagcaactgatttcaaagaagaagatatcgagcttttcaaagacattgccgacaaagtaaaacaaacaaatagttatgatctagcgtttgatgaattagaaaaagaaaaagacttcctgcaagtcattgtcaaaaacgatgacaaaaacttacctactaatcaaaatgtcgctcaactagtagaagatttacgcctagaaatccagaaaatgcgcgaagaacgtcacctacttggtcaaatgatgaatcaagtacatcagcaacaacaagaattaaaagaacttcaaaatcaacttacatctaaaatcgattcaaatagcgaatccttaaaagccatccaaacatcacaagaggctatccaagaagcgcaagcctctcaagcaaaagcattagctgaatcaacaaataaagttgaaaagaatgctgttactgaagataaagctgacagtaaagattcgaaggttgctggagtgaatacatcaacagacgctaagacggatactaaagcagaaaatgcaggcgatggcactgctactaaagtagataaagaggatcaaatttctgcaactgaagcaattgaaaaagccagcgttgagcagtctaaaaatgacaatgcagctgagacttcaaataaagaagctacagtagatgcagaagcgcaacatgatgctgaacaacaagtagcagaagcccatgcagaagcttctaaacaagctacttcgaacgattcattggaagcgaaagcagaaaatgacagcacagcttcacagtcagaaatgtcagaaccaaaacctcaagaagagaaaaaaggtttcttcgcacgtttattcaacctg

SEQ ID NO: 1828 - protein, 318 aa, Staphylococcus aureus
  MISC_FEATURE (1)..(318): conserved hypothetical
MLTKEFAQRVELSEKQVRKIVQHLEERGYQLSKTEYRGREATDFKEEDIELFKDIADKVKQTNSYDLAFDELEKEKDFLQVIVKNDDKNLPTNQNVAQLVEDLRLEIQKMREERHLLGQMMNQVHQQQQELKELQNQLTSKIDSNSESLKAIQTSQEAIQEAQASQAKALAESTNKVEKNAVTEDKADSKDSKVAGVNTSTDAKTDTKAENAGDGTATKVDKEDQISATEAIEKASVEQSKNDNAAETSNKEATVDAEAQHDAEQQVAEAHAEASKQATSNDSLEAKAENDSTASQSEMSEPKPQEEKKGFFARLFNL

SEQ ID NO: 1829 - DNA, 99 bp, Staphylococcus aureus
ttgcaattaaatgtaaacatgatgaaattcgaccgttggcataaggggatttgtaaacaaatcgttttgaattcagtagtgataggtggaaagggtaaa

SEQ ID NO: 1830 - protein, 33 aa, Staphylococcus aureus
LQLNVNMMKFDRWHKGICKQIVLNSVVIGGKGK

SEQ ID NO: 1831 - DNA, 1395 bp, Staphylococcus aureus
gtgacgttcatgaatgcttttcttacactgattaatattattgtattggtgattttcatcgtaatattgcacatgatggctcgcaaacatatatcttttgcgaaacgtgtgtttacagctttagggattggtatagtattcggtgtgttattgcatcttatttatggcacacattcgaatgttattacatcaacaagtgactggttcaacattgtcggacaaggttacgttgcattgttgcaaatgattgttatgcctttaattttcatttctattgtagctgcattcactaaaattcaaatcggagaaaagtttgctaaaattggtagtctcatttttatctttttaattggcactgtcaccattgctgcgattgttggtgttgtgtatgccttggtgtttggtttagatgcatcaacaattaaccttggtaacgctgaacaagcacgtggaagcgaaattgctaaacaagcgaaagatttaacagcacatacgttaccacaacaaattttggaattattgcctaaaaatccattcttagatttcactggacaacgtgcaacttccacgattgctgtcgtgatatttgcttcgtttataggatttgcttatttacgcgtagcacgcaaacaacctgatcatggtgaattgcttaagcgtgcgattgacgctatctattcactagtaatggcgattgtgacgttcgtcttacgtttaacgccatacggtgtattagcaattatggccaacacattatcgacaagtgactttggcgccatttggactttaggaaaattcttaatcgcatcgtacgctgcattaattacgatgtatatcattcacttaattattttaagcctgttaggtattagcccaattcgctatgttaaaaagactttggaagtattaatctttgcattcacatcacgctcaagcgcgggtgccttaccattgaatgtacaaacacaaacaagacgtctaggcgtgccagaaggtattgccaatttcgctgcgacatttggattgtcgattggacaaaatggttgtgcaggcatttaccctgccatgcttgcaattatggtcgcacccgtcgctaatgtagaaattgatttacaatttattgtaacgttaatcgctgtcgtgattattagttcattcggcgttgctggcgtcggtggcggggctacatttgcatccatattggtgttgtcaacgttaaacttgccagtcgctttagccggcgtgctcatctccgttgaaccattgattgacatgggtagaacagcattaaacgtgaacgattcaatgctagctggtacaggtaccgccaagttaactaaacattgggataaagatactttcgattcaaatgataatgctgcattaacttcacac

SEQ ID NO: 1832 - protein, 465 aa, Staphylococcus aureus
  MISC_FEATURE (1)..(465): hypothetical protein
VTFMNAFLTLINIIVLVIFIVILHMMARKHISFAKRVFTALGIGIVFGVLLHLIYGTHSNVITSTSDWFNIVGQGYVALLQMIVMPLIFISIVAAFTKIQIGEKFAKIGSLIFIFLIGTVTIAAIVGVVYALVFGLDASTINLGNAEQARGSEIAKQAKDLTAHTLPQQILELLPKNPFLDFTGQRATSTIAVVIFASFIGFAYLRVARKQPDHGELLKRAIDAIYSLVMAIVTFVLRLTPYGVLAIMANTLSTSDFGAIWTLGKFLIASYAALITMYIIHLIILSLLGISPIRYVKKTLEVLIFAFTSRSSAGALPLNVQTQTRRLGVPEGIANFAATFGLSIGQNGCAGIYPAMLAIMVAPVANVEIDLQFIVTLIAVVIISSFGVAGVGGGATFASILVLSTLNLPVALAGVLISVEPLIDMGRTALNVNDSMLAGTGTAKLTKHWDKDTFDSNDNAALTSH

SEQ ID NO: 1833 - DNA, 804 bp, Staphylococcus aureus
ttgcaatatgaagattttaaattaattgtaaagtatcgaggagtgggtaacgtgtcagaacatgtatataatcttgtgaaaaagcatcattctgttagaaaatttaagaataaacctttaagtgaagacgttgttaagaaattggtagaagctggacaaagcgcttcgacgtcaagtttcctgcaagcatactcaattattggtatcgacgatgagaagattaaagaaaatttacgagaagtttctggacaaccttatgttgtagaaaatggctatttattcgtctttgttattgattattatcgtcatcatttagttgatcaacatgctgaaactgatatggaaaatgcatatggttcaacggaaggtttgctagtaggtgcaatcgatgcagcattagttgccgaaaatattgcggtaactgctgaagatatggggtatggcattgtctttttaggatcattaagaaatgatgttgaacgcgttcgagaaattttagacttacctgactatgtcttcccggtatttggtatggcagtaggggaacccgcagatgacgaaaatggtgcagccaagccacgcttaccatttgaccatgtcttccatcataataagtatcatgctgataaggaaacacagtatgcacaaatggcagattacgaccagacaatcagcgagtactatgatcaacgtacaaacgggaatcgcaaagaaacatggtcgcagcaaattgagatgttcctaggaaacaaagcaagattagatatgttagaacaattgcaaaaatcaggcttaatacagcga

SEQ ID NO: 1834 - protein, 268 aa, Staphylococcus aureus
  MISC_FEATURE (1)..(268): hypothetical protein
LQYEDFKLIVKYRGVGNVSEHVYNLVKKHHSVRKFKNKPLSEDVVKKLVEAGQSASTSSFLQAYSIIGIDDEKIKENLREVSGQPYVVENGYLFVFVIDYYRHHLVDQHAETDMENAYGSTEGLLVGAIDAALVAENIAVTAEDMGYGIVFLGSLRNDVERVREILDLPDYVFPVFGMAVGEPADDENGAAKPRLPFDHVFHHNKYHADKETQYAQMADYDQTISEYYDQRTNGNRKETWSQQIEMFLGNKARLDMLEQLQKSGLIQR

SEQ ID NO: 1835 - DNA, 132 bp, Staphylococcus aureus
atgataccaggtgtgaatgcgccacctatgcatccttggtgtagaagtaccacagtgccacatgttggcaattggcgggacaagttctttaaagagcgtgaaggtaaatatcaagtagaagtaaaagaagca

SEQ ID NO: 1836 - protein, 44 aa, Staphylococcus aureus
MIPGVNAPPMHPWCRSTTVPHVGNWRDKFFKEREGKYQVEVKEA

SEQ ID NO: 1837 - DNA, 567 bp, Staphylococcus aureus
atgtcattaattaacaaagaaatcttaccatttacagcgcaagctttcgatccaaaaaaagatcaatttaaagaagttacacaagaagatttaaaaggttcttggagcgtagtatgcttctatcctgctgacttctcattcgtttgtccaactgaattagaagacttacaaaaccaatatgaagaattacaaaaattaggcgtaaatgtattctcagtatcaactgatactcacttcgtacacaaagcatggcatgaccattcagatgcaattagcaaaatcacttacactatgattggtgacccatcacaaacaatcactcgtaattttgatgtattagatgaagctactggtttagctcaacgtggtacattcattatcgacccagacggtgttgtacaagcatctgaaattaacgctgacggaattggccgtgacgctagtacattagctcacaaaatcaaagcagctcaatatgttcgtaaaaaccctggcgaagtatgcccagctaaatgggaagaaggcgctaaaacattgcaacctggtttagatttagtaggtaaaatc

SEQ ID NO: 1838 - protein, 189 aa, Staphylococcus aureus
  MISC_FEATURE (1)..(189): alkyl hydroperoxide
MSLINKEILPFTAQAFDPKKDQFKEVTQEDLKGSWSVVCFYPADFSFVCPTELEDLQNQYEELQKLGVNVFSVSTDTHFVHKAWHDHSDAISKITYTMIGDPSQTITRNFDVLDEATGLAQRGTFIIDPDGVVQASEINADGIGRDASTLAHKIKAAQYVRKNPGEVCPAKWEEGAKTLQPGLDLVGKI

SEQ ID NO: 1839 - DNA, 1521 bp, Staphylococcus aureus
atgcttaatgctgatttaaaacaacaacttaaacaactattagaactaatggagggcaacgttgaattcgttgccagccttggttcagatgataaatccaaagaacttaaagatttgttgacagaaattactgatatgtcacctagactatctctttctgaaaaatctttaaaacgtacaccaagtttctcagtcaatcgtcctggcgaagaaacaggtgtaacatttgcaggtattccattaggtcacgagtttaactcacttgttttagcaattttacaggttagtggtcgtgcacctaaagaaaaacagtcaatcattgaccaaattaaaaaattagaaggttcattccattttgaaacattcattagtttaacgtgtcaaaaatgtcctgatgtcgttcaagcacttaacttaatgagtgtgatcaaccctaacatcacgcattctatgattgatggtgcagtgttccgtgaagaatctgaaaacatcatggcagtccctgctgtctttttaaatggcgaagaatttggcaatggtcgtatgacaatccaagatattctttcgaaactaggcagtacggcagatgcatctgagtttgaaaataaagaaccttatgatgtcttaatcgttggtggtggtcctgctagtggtagtgcagcgatttacacagcacgtaaaggtttacgtactggtatagttgctgatcgtatcggtggccaagttaatgatactgctggtattgagaacttcattactgttaaagaaacaactggttctgaattttcttctaacttagcagcgcacattgatcaatatgacattgatgcaatgacaggtatacgtgctacagatatcgaaaagactgacgaagcaattaaagttacgttagaaaacggtgctgtcttagaaagtaaaacagtcattattgctactggtgcaggttggcgtaagctaaacattccaggtgaagagcaattgattaataaaggtgttgcattctgccctcactgtgacggacctctatttgaaaataaagacgtagcagttatcggtggcggtaactctggggttgaagcagcaattgaccttgctggtatcgttaatcatgttacattattcgaattcgctagcgaattaaaagcagacaacgtgttacaagatcgtttacgttctttatcaaatgttgatatcaaaacaaatgccaaaactactgaagttgtcggagaagaccatgttacaggtatacgttacgaagacatgaacaccggcgaagaacatctacttaacttagatggtatctttgttcaaattggtttacttccaaacacatcatggttaaacgatgctgttgaattaaacgaacgtggtgaaattgtgattgatcgtaacaataatacgaatgttcctggaatatttgctgctggcgatgtcacagatcagaagaacaaacaaattatcatttcaatgggcgctggtgcaaatgcagcattaaatgcctttgactatattatcagaaac

SEQ ID NO: 1840 - protein, 507 aa, Staphylococcus aureus
  MISC_FEATURE (1)..(507): alkyl hydroperoxide
MLNADLKQQLKQLLELMEGNVEFVASLGSDDKSKELKDLLTEITDMSPRLSLSEKSLKRTPSFSVNRPGEETGVTFAGIPLGHEFNSLVLAILQVSGRAPKEKQSIIDQIKKLEGSFHFETFISLTCQKCPDVVQALNLMSVINPNITHSMIDGAVFREESENIMAVPAVFLNGEEFGNGRMTIQDILSKLGSTADASEFENKEPYDVLIVGGGPASGSAAIYTARKGLRTGIVADRIGGQVNDTAGIENFITVKETTGSEFSSNLAAHIDQYDIDAMTGIRATDIEKTDEAIKVTLENGAVLESKTVIIATGAGWRKLNIPGEEQLINKGVAFCPHCDGPLFENKDVAVIGGGNSGVEAAIDLAGIVNHVTLFEFASELKADNVLQDRLRSLSNVDIKTNAKTTEVVGEDHVTGIRYEDMNTGEEHLLNLDGIFVQIGLLPNTSWLNDAVELNERGEIVIDRNNNTNVPGIFAAGDVTDQKNKQIIISMGAGANAALNAFDYIIRN

SEQ ID NO: 1841 - DNA, 291 bp, Staphylococcus aureus
atgataaacttaatatatacaacgagatgtgcgataatgcttaaagtatgtacctctcgcaaacaaatcaatatgaaaaatgatattgagaaagaaaagtatgtgaacgaaattattatgcttttacgtacgatacctacgtctaaattagtacaaccaattatgcagttatttatagataaagctatccttaacaacgtccaaaatgatgcattattgatagaaaaagcaactcatgcacgtaatcatttacgtctatggtcattgcaaggtcatcgtgacattccaaac

SEQ ID NO: 1842 - protein, 97 aa, Staphylococcus aureus
  MISC_FEATURE (1)..(97): hypothetical protein
MINLIYTTRCAIMLKVCTSRKQINMKNDIEKEKYVNEIIMLLRTIPTSKLVQPIMQLFIDKAILNNVQNDALLIEKATHARNHLRLWSLQGHRDIPN

SEQ ID NO: 1843 - DNA, 624 bp, Staphylococcus aureus
atgaaaaagagattactactaagtacatttttagcatcgacattaattcttacaggttgcgcgtccgatcaatctgataacgaagatcatcatacaagtactggcatccatgcacctaaaagcgctaaaaaattagaaacaaaagatatctttaactcagataagaaaaatagtgatattagtgatgcagagatgaagcaagctatagaaaagtatttgtctgtaaatagcgatatacttgataacaaatatattatgcaacataaactagataaacaaattgacagtcaaacaaaagtgactgaaaaacaagcagaaacacttagccacttatctaacttagctgttaaaaacgatttgcatttcaagaaatttgtcactgaaaacaatattcctaaagaatataagaaacccgttgaattaatgatgaattacttcaaagctttaaatagtacaatcgccaatgttgatgaagatattgaaaagcttagctatcaaccgcaaaataaaatcaatgttgtcgacgtgccaacaaaatatgccggtgatgttaataaaaagcaacaagataaaattaaagatttcttaaaatctaaaggtatcaagagtgatgttatcgataaa

SEQ ID NO: 1844 - protein, 208 aa, Staphylococcus aureus
  MISC_FEATURE (1)..(208): hypothetical protein
MKKRLLLSTFLASTLILTGCASDQSDNEDHHTSTGIHAPKSAKKLETKDIFNSDKKNSDISDAEMKQAIEKYLSVNSDILDNKYIMQHKLDKQIDSQTKVTEKQAETLSHLSNLAVKNDLHFKKFVTENNIPKEYKKPVELMMNYFKALNSTIANVDEDIEKLSYQPQNKINVVDVPTKYAGDVNKKQQDKIKDFLKSKGIKSDVIDK

SEQ ID NO: 1845 - DNA, 390 bp, Staphylococcus aureus
atgatcatgatgaaagttcgaattacttttattattttagcaattttatcgacgattgtttgcttgttcttagcagcaatgcatccaacaggaccaaacacagtaacttttgaacagccatatttattcaccctcaacatcattataatggtattagtcgcattaccttcacttgttttagctatatatgattatatgagttttagaatttcttctgctattttacaatttctaggggctatctcttggttctttttatcattgatattatcgctcacacaatttacaccttttacattagcgtcatttataacttcaattattttgttcacaagcacaattatcacattagccattggtggtaagtctgttgaaaagaatgattcccct

SEQ ID NO: 1846 - protein, 130 aa, Staphylococcus aureus
  MISC_FEATURE (1)..(130): conserved hypothetical
MIMMKVRITFIILAILSTIVCLFLAAMHPTGPNTVTFEQPYLFTLNIIIMVLVALPSLVLAIYDYMSFRISSAILQFLGAISWFFLSLILSLTQFTPFTLASFITSIILFTSTIITLAIGGKSVEKNDSP

SEQ ID NO: 1847 - DNA, 579 bp, Staphylococcus aureus
atgacgatttatttagttagacatggcgaatcaaaatcgaattatgataataaacattttcgatcttatttttgtggacaattagatgtgccgttaacggatactggcacaaaaagtgcagacgatttatgtgattattttaaagagaaacagattaaacatgtatatgtttcagacttattaagaacacagcaaacgtttgaacatatttttccatatgacattgcatcaacgactacccctctattaagagaacgttcacttggcgtatttgagggtgaatataaagatgaaatcagtgcgaatccgaaatatgaaaaatatttcaatgatccaaactttaaagactttcgtcatagtttttcacaaaaagcgcctgaaggagaaagttatgaagatgtatatcaacgcgtagaacattttatgaatcatgttgtcaatgaagatacacaaaaagatgatattgtcattgttgcacatcaagttgtcattcgttgtttgatggtttattttaacaaagtttcaagggcagaagctgtggatttaaaggtagaaaattgcaaaccatatatcattgaa

SEQ ID NO: 1848 - protein, 193 aa, Staphylococcus aureus
  MISC_FEATURE (1)..(193): hypothetical protein
MTIYLVRHGESKSNYDNKHFRSYFCGQLDVPLTDTGTKSADDLCDYFKEKQIKHVYVSDLLRTQQTFEHIFPYDIASTTTPLLRERSLGVFEGEYKDEISANPKYEKYFNDPNFKDFRHSFSQKAPEGESYEDVYQRVEHFMNHVVNEDTQKDDIVIVAHQVVIRCLMVYFNKVSRAEAVDLKVENCKPYIIE

SEQ ID NO: 1849 - DNA, 249 bp, Staphylococcus aureus
atgtttggatttattggaatgttaattgtcggtggcttaattggatgggctgctggtgctattatgggtaaagatatcccaggtggtattttaggcaatattatcgcaggtattattggatcatgggtaggtggcaaactattcggacaatggggtcctgaattaggaagtatttacatcttgccagcattaattggttcaattatcttaattgcaatcgtaacgttaattttaagagctatgcgtaaa

SEQ ID NO: 1850 - protein, 83 aa, Staphylococcus aureus
  MISC_FEATURE (1)..(83): conserved hypothetical
MFGFIGMLIVGGLIGWAAGAIMGKDIPGGILGNIIAGIIGSWVGGKLFGQWGPELGSIYILPALIGSIILIAIVTLILRAMRK

SEQ ID NO: 1851 - DNA, 261 bp, Staphylococcus aureus
atgaatatgcatattttatataacttacgaactaaacataatttagaaattgacgaattagcacagcaattaaatgagaaatatggtactaaatatgaagcacatcaaatttgggaatgggagaatcatcaccatgaacctaaatttaaagatgccatgcatttagctgacttctttgatgcaccatatgaaatgtttttagaaagtaaggttaaagaatatcagaaacatttagaagaagtcgatattcgcatggataaa

SEQ ID NO: 1852 - protein, 87 aa, Staphylococcus aureus
  MISC_FEATURE (1)..(87): hypothetical protein
MNMHILYNLRTKHNLEIDELAQQLNEKYGTKYEAHQIWEWENHHHEPKFKDAMHLADFFDAPYEMFLESKVKEYQKHLEEVDIRMDK

SEQ ID NO: 1853 - DNA, 570 bp, Staphylococcus aureus
atgaaattaaaatcattagcagtgttatcaatgtcagcggtggtgcttactgcatgtggcaatgatactccaaaagatgaaacaaaatcaacagagtcaaatactaatcaagacactaatacaacaaaagatgttattgctttaaaagatgttaaaacaagcccagaagatgctgtgaaaaaagctgaagaaacttacaaaggccaaaagttgaaaggaatttcatttgaaaattctaatggtgaatgggcttataaagtgacgcaacaaaaatctggtgaagagtcagaagtacttgttgctgataaaaataaaaaagtgattaacaaaaagactgaaaaagaagatacaatgaatgaaaatgataactttaaatatagcgatgctatagattacaaaaaagccattaaagaaggacaaaaagaatttgatggtgatattaaagaatggtcacttgaaaaagatgatggcaaacttgtttacaatatcgatttgaaaaaaggtaataaaaaacaagaagttactgttgatgctaagaacggtaaagtattaaagagtgagcaagatcac

SEQ ID NO: 1854 - protein, 190 aa, Staphylococcus aureus
  MISC_FEATURE (1)..(190): conserved hypothetical
MKLKSLAVLSMSAVVLTACGNDTPKDETKSTESNTNQDTNTTKDVIALKDVKTSPEDAVKKAEETYKGQKLKGISFENSNGEWAYKVTQQKSGEESEVLVADKNKKVINKKTEKEDTMNENDNFKYSDAIDYKKAIKEGQKEFDGDIKEWSLEKDDGKLVYNIDLKKGNKKQEVTVDAKNGKVLKSEQDH

SEQ ID NO: 1855 - DNA, 366 bp, Staphylococcus aureus
ttgaaaacgattttaaaaacaataacatatcttgtacttactatcattggcgcttatgctgctttattcattttaaaaacaatagactcccatggtataacagatcaatttaacccattagtaaagaaggatgattcttatgttaaaacgacagaggtgtctactagaatggatgatcaactccgaagttatagtcaaagtgtttttaataaagaagggaaagagacgcaattaatgtatactgctacatttgatgttaaaccgcatagatacttgaaaattacacataaaggtcatcatgtagaaacttttgaagaagttgaaaaggaagaagtaccaaagaaagcattagacaaactgagtcga

SEQ ID NO: 1856 - protein, 122 aa, Staphylococcus aureus
  MISC_FEATURE (1)..(122): conserved hypothetical
LKTILKTITYLVLTIIGAYAALFILKTIDSHGITDQFNPLVKKDDSYVKTTEVSTRMDDQLRSYSQSVFNKEGKETQLMYTATFDVKPHRYLKITHKGHHVETFEEVEKEEVPKKALDKLSR

SEQ ID NO: 1857 - DNA, 135 bp, Staphylococcus aureus
atgattttaattatgttagattcacaattagatggaaatgtaactgcaaaagaattgagtgaatcttttaaagaattagttgaagaatttgaaagtatagaaaaagcgaaaaagaattcaaattcaaaagataaa

SEQ ID NO: 1858 - protein, 45 aa, Staphylococcus aureus
MILIMLDSQLDGNVTAKELSESFKELVEEFESIEKAKKNSNSKDK

SEQ ID NO: 1859 - DNA, 609 bp, Staphylococcus aureus
atgttcaaaaaatatgactcaaaaaattcaatcgtattaaaatctattctatcgctaggtatcatctatgggggaacatttggaatatatccaaaagcagacgcgtcaacacaaaattcctcaagtgtacaagataaacaattacaaaaagttgaagaagtaccaaataattcagaaaaagctttggttaaaaaactttacgatagatacagcaaggatacaataaatggaaaatctaataaatctaggaattgggtttattcagagagacctttaaatgaaaaccaagttcgtatacatttagaaggaacatacacagttgctggcagagtgtatacacctaagaggaatattactcttaataaagaagttgtcactttaaaagaattggatcatatcataagatttgctcatatttcctatggcttgtatatgggagaacatttgcctaaaggtaacatcgtcataaatacaaaagatggtggtaaatatacattagagtcgcataaagagctacaaaaagatagggaaaatgtaaaaattaatacagccgatataaaaaatgtaactttcaaacttgtgaaaagtgttaatgacattgaacaagtt

SEQ ID NO: 1860 - protein, 203 aa, Staphylococcus aureus
  MISC_FEATURE (1)..(203): hypothetical protein
MFKKYDSKNSIVLKSILSLGIIYGGTFGIYPKADASTQNSSSVQDKQLQKVEEVPNNSEKALVKKLYDRYSKDTINGKSNKSRNWVYSERPLNENQVRIHLEGTYTVAGRVYTPKRNITLNKEVVTLKELDHIIRFAHISYGLYMGEHLPKGNIVINTKDGGKYTLESHKELQKDRENVKINTADIKNVTFKLVKSVNDIEQV

SEQ ID NO: 1861 - DNA, 156 bp, Staphylococcus aureus
atggtaaaagctatggtacagtttcaaattgctaatgacatgcgtatcggtgagctacttgcaataaagagagtaaatataaactatgaagataaaacgctagatatcgacggtaaagttaattggataactgaaaaaagacgggagcattcggag

SEQ ID NO: 1862 - protein, 52 aa, Staphylococcus aureus
MVKAMVQFQIANDMRIGELLAIKRVNINYEDKTLDIDGKVNWITEKRREHSE

SEQ ID NO: 1863 - DNA, 309 bp, Staphylococcus aureus
atgcttggaatgataagtttattgatagagagtacatattcacaaatacgtctggtagccctatcgactcgaacaaaattagccacattattaaaggggggcgctgatattagttctattaagaaacctataacgacgcatacattacatcattcgcatatatctacacttgctcaattaggaattaacttaaaagcaatgcaagagcatgtaggtcattcagattataaaaaaaatctagagatatacacacatgttactaatcagatggcgaaagatatgatgaataaatttgaacgattggggagt

SEQ ID NO: 1864 - protein, 103 aa, Staphylococcus aureus
  MISC_FEATURE (1)..(103): truncated integrase
MLGMISLLIESTYSQIRLVALSTRTKLATLLKGGADISSIKKPITTHTLHHSHISTLAQLGINLKAMQEHVGHSDYKKNLEIYTHVTNQMAKDMMNKFERLGS

SEQ ID NO: 1865 - DNA, 972 bp, Staphylococcus aureus
ttggaaaaagatgatacactagcagaaattaagcctatgctcaattttgatgagcaaatagcaaaattaaaacagatgaatatattttttaatattattgacaccgaaaaagcaaatgaaattcttagaaaaaataattacttcttcaaactagcttatttccgaaaaaatttcgaaaaaaagaatggcggctatttcatagaatttgcttatttatcagatttagcaactatagatatgaaattaagatacacaatgttgcatttaactttagatattgaacatagtttaaagtatctagtcttaaaactaataacagaaaataaccaagaagatggttataaaataatagatgagttcttatgtattgataaatcatatagcaattcaaattttgacacaaattcaagaacaccagaagaagttatggaaaccaaaatcaaaaataaaaacgaaatattcaagcatatgaataaacgaggacaactacccgagaagttgaataaatactatcaaaatccacccgcatgggtttgcattgaattcatgcaactaggtcaattcgtttcgtttctcaacttctattacaagaagtacaatgacgaagaattgagagttgctaatattttaatgcctttagttaaaaatataagaaacaaatcagctcataaccaacccatcatagcaaatctaaattatgacagtagattacctcaatatttatttgaaaaagggaataatataggcatatctagaaacatgttcggaataaaaaatttcatagatactttcgctacgctagaattacataatcaagtttgtagtaatgcaattatccaagcaagatatcacgatttggaccaacttcaaaagcgatataaaagaaacgaaagctattataataatgcattagctatcaaaagattttttatagctttagataaaattattgacttcaacagaccaaaagta

SEQ ID NO: 1866 - protein, 324 aa, Staphylococcus aureus
  MISC_FEATURE (1)..(324): hypothetical protein
LEKDDTLAEIKPMLNFDEQIAKLKQMNIFFNIIDTEKANEILRKNNYFFKLAYFRKNFEKKNGGYFIEFAYLSDLATIDMKLRYTMLHLTLDIEHSLKYLVLKLITENNQEDGYKIIDEFLCIDKSYSNSNFDTNSRTPEEVMETKIKNKNEIFKHMNKRGQLPEKLNKYYQNPPAWVCIEFMQLGQFVSFLNFYYKKYNDEELRVANILMPLVKNIRNKSAHNQPIIANLNYDSRLPQYLFEKGNNIGISRNMFGIKNFIDTFATLELHNQVCSNAIIQARYHDLDQLQKRYKRNESYYNNALAIKRFFIALDKIIDFNRPKV

SEQ ID NO: 1867 - DNA, 240 bp, Staphylococcus aureus
atggcaggtggaccaagaagaggcggacgtcgtcgtaaaaaagtatgctatttcacagcaaatggtattacacatatcgactacaaagacactgaattattaaaacgttttatctcagaacgcggtaaaattttaccacgtcgtgtaactggtacttcagctaaatatcaacgtatgttgactacagctatcaaacgttctcgtcatatggcattattaccatatgttaaagaagaacaa

SEQ ID NO: 1868 - protein, 80 aa, Staphylococcus aureus
  MISC_FEATURE (1)..(80): 30S ribosomal protein S18
MAGGPRRGGRRRKKVCYFTANGITHIDYKDTELLKRFISERGKILPRRVTGTSAKYQRMLTTAIKRSRHMALLPYVKEEQ

SEQ ID NO: 1869 - DNA, 501 bp, Staphylococcus aureus
atgctaaatagagttgtattagtaggtcgtttaacgaaagatccggaatacagaaccactccctcaggtgtgagtgtagcgacattcactcttgcagtaaatcgtacgttcacgaatgctcaaggggagcgcgaagcagattttattaactgtgttgtttttagaagacaagcagataatgtaaataactatttatctaaaggtagtttagctggtgtagatggtcgcttacaatcccgtaattatgaaaatcaagaaggtcgtcgtgtgtttgttactgaagttgtgtgtgatagcgttcaattccttgaacctaaaaatgcgcaacaaaatggtggccaacgtcaacaaaatgaattccaagattacggtcaaggattcggtggtcaacaatcaggacaaaacaattcgtacaataattcatcaaacacgaaacaatctgataatccatttgcaaatgcaaacggaccgattgatataagtgatgatgacttaccattc

SEQ ID NO: 1870 - protein, 167 aa, Staphylococcus aureus
  MISC_FEATURE (1)..(167): single-strand DNA-binding
MLNRVVLVGRLTKDPEYRTTPSGVSVATFTLAVNRTFTNAQGEREADFINCVVFRRQADNVNNYLSKGSLAGVDGRLQSRNYENQEGRRVFVTEVVCDSVQFLEPKNAQQNGGQRQQNEFQDYGQGFGGQQSGQNNSYNNSSNTKQSDNPFANANGPIDISDDDLPF

SEQ ID NO: 1871 - DNA, 294 bp, Staphylococcus aureus
atgagaacatatgaagttatgtacatcgtacgcccaaacattgaggaagatgctaaaaaagcgttagttgaacgtttcaacggtatcttagctactgaaggtgcagaagttttagaagcaaaagactggggtaaacgtcgcctagcttatgaaatcaatgatttcaaagatggcttctacaacatcgtacgtgttaaatctgataacaacaaagctactgacgaattccaacgtctagctaaaatcagtgacgatatcattcgttacatggttattcgtgaagacgaagacaag

SEQ ID NO: 1872 - protein, 98 aa, Staphylococcus aureus
  MISC_FEATURE (1)..(98): 30S ribosomal protein S6
MRTYEVMYIVRPNIEEDAKKALVERFNGILATEGAEVLEAKDWGKRRLAYEINDFKDGFYNIVRVKSDNNKATDEFQRLAKISDDIIRYMVIREDEDK

SEQ ID NO: 1873 - DNA, 189 bp, Staphylococcus aureus
atgaatttaaatattgattggtctaaagattttcaagaattccaagagatacttaatagtggtattcatcctgaatggctttattgtgcaaaggctaatcttgttttagagcctgcttatactggcgaaggcaaacaatttttcagcactcaagatattattaacgcgagtaaaattattccattcttt

SEQ ID NO: 1874 - protein, 63 aa, Staphylococcus aureus
  MISC_FEATURE (1)..(63): hypothetical protein
MNLNIDWSKDFQEFQEILNSGIHPEWLYCAKANLVLEPAYTGEGKQFFSTQDIINASKIIPFF

SEQ ID NO: 1875 - DNA, 1095 bp, Staphylococcus aureus
atggctttaacagcaggtatcgttggattgccaaacgttggtaaatcaacattatttaatgcaataacaaaagcaggtgctttagcagcgaactatccattcgctacgattgatcctaatgtagggatagtagaagtgccagatgctagattacttaaattagaagaaatggttcaacctaaaaagacattgccgactacatttgaatttacagatatcgctggtattgtgaaaggtgcttcaaagggagaagggttaggtaataaattcttatcacatattagagaagtagatgcgatttgtcaggtcgttcgtgcatttgatgatgataacgtaactcatgttgctggtcgagtagaccctattgatgatattgaagttattaatatggaattagtactagcggacttagaatctgttgagaaacgtttgcctagaattgaaaaattagcacgtcaaaaagataagactgctgaaatggaagtacgtattttaacaactattaaagaagctttagaaaatggtaaacccgctcgtagtattgactttaatgaagaagatcaaaaatgggtgaatcaagcgcaattactgacttctaaaaaaatgctttatatcgctaatgttggtgaagatgaaattggtgatgatgataatgataaagtaaaagcgattcgtgaatatgcagcgcaagaagactctgaagtgattgttattagtgcaaaaattgaagaagaaattgctacattagatgatgaagataaagaaatgttcttagaagatttaggtatcgaagaaccaggattagatcgattaattagaacaacttatgaattattaggattatcaacatattttactgctggtgtgcaagaagtacgtgcttggacatttaaacaaggtatgactgcacctcaatgtgctggtatcattcatactgattttgaacgtggatttatccgtgccgaagtaacaagttatgacgactatgtacaatatggtggcgaaagtggcgctaaagaagcgggcagacaacgattagaaggtaaagaatatattatgcaagatggcgatatcgttcatttcagatttaatgta

SEQ ID NO: 1876 - protein, 365 aa, Staphylococcus aureus
  MISC_FEATURE (1)..(365): hypothetical protein
MALTAGIVGLPNVGKSTLFNAITKAGALAANYPFATIDPNVGIVEVPDARLLKLEEMVQPKKTLPTTFEFTDIAGIVKGASKGEGLGNKFLSHIREVDAICQVVRAFDDDNVTHVAGRVDPIDDIEVINMELVLADLESVEKRLPRIEKLARQKDKTAEMEVRILTTIKEALENGKPARSIDFNEEDQKWVNQAQLLTSKKMLYIANVGEDEIGDDDNDKVKAIREYAAQEDSEVIVISAKIEEEIATLDDEDKEMFLEDLGIEEPGLDRLIRTTYELLGLSTYFTAGVQEVRAWTFKQGMTAPQCAGIIHTDFERGFIRAEVTSYDDYVQYGGESGAKEAGRQRLEGKEYIMQDGDIVHFRFNV

SEQ ID NO: 1877 - DNA, 201 bp, Staphylococcus aureus
atggcgtcaaaatatggaataaatgatatagtagaaatgaaaaaacaacatgcgtgtggaacaaaccgttttaagattattagaatgggtgcagacataagaattaaatgtgaaaattgtcaaagaagtattatgattccacgtcaaacgtttgataaaaaacttaaaaaaatcatcgaatctcatgatgatacacaaaga

SEQ ID NO: 1878 - protein, 67 aa, Staphylococcus aureus
  MISC_FEATURE (1)..(67): conserved hypothetical
MASKYGINDIVEMKKQHACGTNRFKIIRMGADIRIKCENCQRSIMIPRQTFDKKLKKIIESHDDTQR

SEQ ID NO: 1879 - DNA, 264 bp, Staphylococcus aureus
atgttacataaccatcctggacagtcaggattttcagaatatgatttatttacattttttaagcatccatcaataaaatcaatgacaatcgttactaataagggacaagtaaaatttattaccaagtcaaataggtttcatggtaaaatagtgagtaaattttgtgctaaatattttacgcatattaatatcattaatgatagccatattgaaaaattattgaaaaaactttatagtataaatatgattaaatataaagtgaga

SEQ ID NO: 1880 - protein, 88 aa, Staphylococcus aureus
MLHNHPGQSGFSEYDLFTFFKHPSIKSMTIVTNKGQVKFITKSNRFHGKIVSKFCAKYFTHINIINDSHIEKLLKKLYSINMIKYKVR

SEQ ID NO: 1881 - DNA, 879 bp, Staphylococcus aureus
atgaatcaagtcatgaatattatttcatctctatttgagccattaacaaaaatagaaacatatgaaaacattgcaactaaaatcgctatgattgttatttatattatcgtagccctcatagttattaaaatactgaataaaatgattgaacagggatttaagattcaaaataaaagtaaaaagagtaacaaaaagcgctctaaaactttaatatctcttgttcaaaatgtagtgaagtatatcgtttggtttatagttattacgacgattttaagtaaatttggcattagtgttgaaggggtaattgccagtgctggtgtcgtaggcttagcagtaggttttggtgctcaaactatagttaaagacgtaattacaggattctttattatatttgaaagccaatttgatgtaggtgattatgttaagataaataacggtggtacaactgtagcagagggaacagttaaatcaattggacttcgttcaacacgaatcaatacaatttcaggagaattaacaattttaccaaatagtagtatgggtgaaataacgaactactcaattacaaatggtacagctatcgttaaaattccagtgtctgtcgaagaaaacattgataatgttgataaaaaactaaacaaactatttacttctttacgtagtaaatattacttatttgttagtgatccggttgttattggtattgatgctattgaagatacaagagtaatattgagaatatctgcagaaacaattccaggtgaaggatttgctggagctcgaattattcgcaaagaagtacaaaaaatgtttttacaagaaggtattaaaacacctcaaccaattatgactgcttataatcatagtgaaaacggtgtt

SEQ ID NO: 1882 - protein, 293 aa, Staphylococcus aureus
  MISC_FEATURE (1)..(293): conserved hypothetical
MNQVMNIISSLFEPLTKIETYENIATKIAMIVIYIIVALIVIKILNKMIEQGFKIQNKSKKSNKKRSKTLISLVQNVVKYIVWFIVITTILSKFGISVEGVIASAGVVGLAVGFGAQTIVKDVITGFFIIFESQFDVGDYVKINNGGTTVAEGTVKSIGLRSTRINTISGELTILPNSSMGEITNYSITNGTAIVKIPVSVEENIDNVDKKLNKLFTSLRSKYYLFVSDPVVIGIDAIEDTRVILRISAETIPGEGFAGARIIRKEVQKMFLQEGIKTPQPIMTAYNHSENGV

SEQ ID NO: 1883 - DNA, 843 bp, Staphylococcus aureus
gtgagtgaattgtcaaaaagtgaagatcaacgtattactaaaacaaaagatgaacaaattaagcaaatagatatatcggatatcaaaccgaatccgtatcagccccgaaaaactttcgatgaaaatcatttaaatgatttggcagattcaattaagcaatatggaattttgcaaccaattgtgcttagaaaaacagttcaaggttattacattgtagttggtgaaagaaggtttagagcttcgaaaattgctggtctaaaatacgtatcagcgattatcaaagatttaacagatgaagatatgatggaactggcggtcatcgaaaatttacaacgagaagacttaaatgcgattgaagaagctgaaagttatcaacgtttgatgacagatttgaaaattacacaacaagaagtagcgaaacgattgagtaagtcgcgcccgtatatagcgaatatgttgaggttattacatttgccgaaaaagattgctgacatggtaaaagatgggcgactgacaagtgcacatggacgaacgttattggcaattaaagatgaacaacaaatgcttaggttagcgaaacgggttgttaaagaaaagtggagtgtcagatatttagaaaaccatgttaatgaattaaaaaatgtttcgtcaaagtcggaaacagacaaagtagatataactaagcctaaatttataaagcagcaagaacgacagttgcgagaacagtatggtaccaaagtagatatatcaataaaaaaatcggttggtaaaatctcatttgagtttgattcacaagaagattttgtgagaataattgaacaattaaatcgtaggtatggtaaa

SEQ ID NO: 1884 - protein, 281 aa, Staphylococcus aureus
  MISC_FEATURE (1)..(281): hypothetical protein
VSELSKSEDQRITKTKDEQIKQIDISDIKPNPYQPRKTFDENHLNDLADSIKQYGILQPIVLRKTVQGYYIVVGERRFRASKIAGLKYVSAIIKDLTDEDMMELAVIENLQREDLNAIEEAESYQRLMTDLKITQQEVAKRLSKSRPYIANMLRLLHLPKKIADMVKDGRLTSAHGRTLLAIKDEQQMLRLAKRVVKEKWSVRYLENHVNELKNVSSKSETDKVDITKPKFIKQQERQLREQYGTKVDISIKKSVGKISFEFDSQEDFVRIIEQLNRRYGK

SEQ ID NO: 1885 - DNA, 387 bp, Staphylococcus aureus
atgcttactgaacaattatcacaattaaagtcagtaagtaaggatatagtaatgtgctatcccatacttattaacaaaaaatcgtgcgtaaagaatccagtacgccatttaacatcaatgttaatactgtatcgctataacgggcgaacccgtagacacctcatattggcatcaacactccaaggccattttcaaacacgctttcaaaatcttctctcagctactaaagactctctgtataagcagggtgtgttttactttcctctttattgtgtttacgtttcattaaactgttataagatattaattagcttacagagtaaaaaaagatttgtcaacaattattcagaaaattttgatttaaaagttaatttgtttgtgaaattg

SEQ ID NO: 1886 - protein, 129 aa, Staphylococcus aureus
MLTEQLSQLKSVSKDIVMCYPILINKKSCVKNPVRHLTSMLILYRYNGRTRRHLILASTLQGHFQTRFQNLLSATKDSLYKQGVFYFPLYCVYVSLNCYKILISLQSKKRFVNNYSENFDLKVNLFVKL

SEQ ID NO: 1887 - DNA, 1101 bp, Staphylococcus aureus
atgaaggatacacagttagcccaaatcacattaaccgatgattcaaccggtgctatagcgaatccaatccatttatctactgcctacaagcatccaaaactaggacaatcgacaggttttgattatacacgtactaaaaatcctacacgctcaacatttgaaacctgttttgccaaacttgagcatggtattgcatcattcgctacatcaagtggaatgtcagccattcaattaatatgtaatctatttaaacctcatgatgaaattttagtttcattcgatttatatggtggcacatttagattatttgaattttacgagcaacaatacgatatcaaatttaagtacgttgattttacagattatgaacaagttgaaaaagaaatcactgataaaacagttgcattattcattgaaccaatatctaacccacaaatgattgctattgatgtaaagccatactatcaactttgtaaagctaaaggcttattgtcaattatcgacaatacttttttaacaccttatctttcaacaccactagcagaaggtgctgatatagtcttacattcagccacgaaatatattggcggacataacgatgtactagcaggtgtcgtaaccgtcaaagatgaatcactcgcgcaacagttgtttgattttcacaacatgactggcgcaacactttcaccaatagatagttatttgttgttacgtggacttaaaactttgcatttacgcattgagcgtgcgcaatcaaacgctagaaaacttgctaaaaaatgtcagtcacttcaagcaattgacgaagtactatatagcgggcaaactggcatgcttagtttaagacttaacaaggcctatagcgtcgctaaattattagaaaatttagacatttgcatttttgcagaaagtttaggaggtactgaaacattagtgaccttcccttacacccaaacacatgttgatatgccagatgctgaaaaagataaacgtggcattgatgagtatttaatccgcttatcactaggtgttgaaaattatgaagacatcgaacgcgatatcatccaagcattagataaagctcagattggagagattgta

SEQ ID NO: 1888 - protein, 367 aa, Staphylococcus aureus
  MISC_FEATURE (1)..(367): hypothetical protein
MKDTQLAQITLTDDSTGAIANPIHLSTAYKHPKLGQSTGFDYTRTKNPTRSTFETCFAKLEHGIASFATSSGMSAIQLICNLFKPHDEILVSFDLYGGTFRLFEFYEQQYDIKFKYVDFTDYEQVEKEITDKTVALFIEPISNPQMIAIDVKPYYQLCKAKGLLSIIDNTFLTPYLSTPLAEGADIVLHSATKYIGGHNDVLAGVVTVKDESLAQQLFDFHNMTGATLSPIDSYLLLRGLKTLHLRIERAQSNARKLAKKCQSLQAIDEVLYSGQTGMLSLRLNKAYSVAKLLENLDICIFAESLGGTETLVTFPYTQTHVDMPDAEKDKRGIDEYLIRLSLGVENYEDIERDIIQALDKAQIGEIV

SEQ ID NO: 1889 - DNA, 1158 bp, Staphylococcus aureus
atgacactttcaaaagagacagaagtgatattcgattggcgtagaggtgtggaatatcattcagctaacccaccactctatgattcttcaacattccatcaaacaagtcttggtggcgatgttaaatatgattatgcacgaagtggcaaccctaaccgtgaacttttagaagagaagttagcacgattagaacagggaaaattcgcttttgcttttgcatcaggtattgctgctatttcagcagtacttttgactttcaaatctggtgatcatgtcatcttacccgatgatgtatatggcggtacttttcgcctcactgagcaaattttgaatcgatttaatattgaatttacaaccgtagatactacaaagctcgaacaaatcgagggtgccattcaatcaaacacaaaattaatttatatcgaaacaccatcgaatccctgttttaaaattactgatatcaaagctgtttctaaaatagccgaaaagcatgaactactggtagctgtggacaatacatttatgacaccgttaggtcaatcacctttattacttggcgctgatattgtcattcatagtgctacaaaatttttaagtggacatagcgatttaattgctggtgctgtcataactaataatgaggcaattagtgacgctctttatttaatacaaaatggtacaggcaatatgttatctgctcaggatagctggacacttgctaaacatttaaaaacttttccaatcagatttaaacaatctgtcgaaaacgctcaaaaaatcgtgtcatttttaataaagcaagatgaaatttcagaagtttattatccgggactcactactgctcatttagaacaagctaaaaatggcggtgccgttattggctttcgtttagctgatgagtctaaagcacaacaatttgtcgatgcactgacattaccactcgtttcagtgagtctgggcggtgttgaaacgatcctttcacatccagcaacaatgtctcacgctgcactacctgaagaagtgagacaagaacgtggtatcactttcggtctattccgattaagtgttggtctcgaagatcctgatgaactcattgcagacatcaaatacgcattaaaggaggcattcaatgagtcaattcctcacacaattgaaaga

SEQ ID NO: 1890 - protein, 386 aa, Staphylococcus aureus
  MISC_FEATURE (1)..(386): hypothetical protein
MTLSKETEVIFDWRRGVEYHSANPPLYDSSTFHQTSLGGDVKYDYARSGNPNRELLEEKLARLEQGKFAFAFASGIAAISAVLLTFKSGDHVILPDDVYGGTFRLTEQILNRFNIEFTTVDTTKLEQIEGAIQSNTKLIYIETPSNPCFKITDIKAVSKIAEKHELLVAVDNTFMTPLGQSPLLLGADIVIHSATKFLSGHSDLIAGAVITNNEAISDALYLIQNGTGNMLSAQDSWTLAKHLKTFPIRFKQSVENAQKIVSFLIKQDEISEVYYPGLTTAHLEQAKNGGAVIGFRLADESKAQQFVDALTLPLVSVSLGGVETILSHPATMSHAALPEEVRQERGITFGLFRLSVGLEDPDELIADIKYALKEAFNESIPHTIER

SEQ ID NO: 1891 - DNA, 1839 bp, Staphylococcus aureus
atgagtcaattcctcacacaattgaaagataatgttttagtagctgatggcgctataggaaccattttatactctgaaggattagacacctgtccagaagcatataatcttagccatccagataaagttgaacgcatccatcgttcatatattgaagccggtgctgatgtcattcaaaccaatacttatggtgcaaattttgaaaagttaaaacgattcggtcttgaagataaagttaaagcaatacatcaagccgccgttcgcatcgcaaaaaaagcagcaaataaagatacgtatatattaggcacagttggtgggtttagaggtatcaaacaagaggatatcagcttacaaactattctttatcatactgaaattcaaatagacaccttaattgaagaaggcgttgacgcgctacttttcgaaacgtattacgacctagaagagttaacaaatgtcatttcacgaacgagaaagaaatacgacattccaatcattgctcaattaaccgcttcaaacacaaattacttagttaatggtcaggcaatcaatgaaggattaaaacaactcgttcaatgtggtgcaaacatcgtgggactcaattgtcatcatggcccgcaccatatgcaagagtctttcacacatattgaattaccagagcacgcattcttatcttgttatccaaatgccagcttattagatattgaaaatagtgaatttaagtatagtgacaatgcacaatatttcggtcaagttgctcaaaatctaattcgcgaaggtgttcgtttaattggtggttgctgtggtacaacgccagagcacatcaaatttattaaagaatctattcagacacttaaacctgttaatgacaaaaaagtgattccgataccaacgaaagcacttttcaatccatctcaaaataaagttagacaatcattaacatctaaggttcaagaacgtccaaccgttattatcgaattggatacaccgaaacatttagacacggatagattttttgaaaatatcgctaaacttgataaagctaatgtagatgcggtaacactcgcagataattcattggcaactgtcagaattagcaatattgctgctgctagcttaattaagcaatattacaatattgaaccactcgtacatattacatgtcgagaccgaaacttaatcggcttgcagtcccatttacttggattatcgctcattggcgttaacgaaatattagccataactggtgatccttcaaaagttggtcacttaccaggtgcaaccaatgtctatgatgttaattctaaaggattaactgaactcgctctaagatttaatcaaggtattaacactgacggtgatgcgctgaagaaacgtacacacttcaacatcgctggcgcctttaaccctaatgttcgtaaattatatggtgccgtcaaaagattagagaaaaagatagaaagcggaatgtcttattttataacacaacccgtgtacagcaaagagaaaatcattgaaatttaccatgccactaagcacttgaacaaaccatttttcataggcattatgcctatcgcaagttacaaaaacgcactctttttgcataatgaagtgccaggaatcaagatgtcagatgaaattttacaacaatttgaagcagttaaagatgataaagccaaaacacgagaactaagtcttaagctttcaaaggatttaatcgatactgttcatgaatattttaatggtttatacattatcacaccgtttcaaaatgtcgaagattcattagaacttgcagcatactcaaaatctattactgctcacaaggaggcaatatta

SEQ ID NO: 1892 - protein, 613 aa, Staphylococcus aureus
  MISC_FEATURE (1)..(613): conserved hypothetical
MSQFLTQLKDNVLVADGAIGTILYSEGLDTCPEAYNLSHPDKVERIHRSYIEAGADVIQTNTYGANFEKLKRFGLEDKVKAIHQAAVRIAKKAANKDTYILGTVGGFRGIKQEDISLQTILYHTEIQIDTLIEEGVDALLFETYYDLEELTNVISRTRKKYDIPIIAQLTASNTNYLVNGQAINEGLKQLVQCGANIVGLNCHHGPHHMQESFTHIELPEHAFLSCYPNASLLDIENSEFKYSDNAQYFGQVAQNLIREGVRLIGGCCGTTPEHIKFIKESIQTLKPVNDKKVIPIPTKALFNPSQNKVRQSLTSKVQERPTVIIELDTPKHLDTDRFFENIAKLDKANVDAVTLADNSLATVRISNIAAASLIKQYYNIEPLVHITCRDRNLIGLQSHLLGLSLIGVNEILAITGDPSKVGHLPGATNVYDVNSKGLTELALRFNQGINTDGDALKKRTHFNIAGAFNPNVRKLYGAVKRLEKKIESGMSYFITQPVYSKEKIIEIYHATKHLNKPFFIGIMPIASYKNALFLHNEVPGIKMSDEILQQFEAVKDDKAKTRELSLKLSKDLIDTVHEYFNGLYIITPFQNVEDSLELAAYSKSITAHKEAIL

SEQ ID NO: 1893 - DNA, 2226 bp, Staphylococcus aureus
atgacaacaattaaaacatcaaacttaggattcccaagattaggtagaaaaagagaatggaaaaaagccatcgaaagttattgggcaaagaagatttctaaagaagaattagatcaaacattaactgatctacataaagaaaatttattattacaaaagtactatcacttagatagcatcccagttggtgatttctctttatatgaccatatattagatacgtcattattattcaacatcatccctgaacgtttccaaggaagaactattgatgatgatttattatttgatattgctcgcggtaataaagaccatgttgcaagtgcacttataaaatggtttaacactaactatcattacatcgtacctgaatgggacaatgttgagcctaaagtgagtcgcaatgtattattagatcgctttaaatatgcccaatctttaaacgttaacgctcaccctgtcattgttggtccgattacttttgttaaattatcaaaaggcggtcaccaaacttttgaagaaaaagttaaaacgttattaccactttataaagaagtgtttgaatcattaattgatgcaggtgctgagtacattcaagttgatgagccaatcttagttacagacgacagcgaaagctatgaaaatattacacgtgaagcttatgactatttcgaaaaagctggtgttgctaaaaaattagtcattcaaacatactttgaacgtgcacatcttaaattcttaagttctttacctgttggtggtataggtttagactttgtccatgataatggctataaccttaaacaaattgaagctggagattttgataaatcaaaaacattatacgctggaattattgatggtcgtaatgtatgggcaagtgacattgaagctaaaaaagtcttaatcgataaattgttagcacacactaatgaacttgtcattcaaccatcatcttcattattacatgttccagtatctttagatgatgaaacattagatacaagtgttggcgaaggcttaagctttgcaactgaaaaattagacgaattagatgcattgcgtcgcctatttaatcaaaacgatagtgttaaatatgataaattaaaagcacgttatgagcgtttccaaaatcaatcattcaaaaacttagattatgatttcgaaagcgtgcgtacttcaagacaatcaccattcgcgcaacgtattgaacaacaacaaaaacgtttgaacttaccggatttaccaacaacaactattggatcattcccacaaagccgagaagttcgaaaataccgtgcagattggaagaacaaacgcattacagacgaagcatatgaaacattcttaaaaaatgaaattgctcgatggattaaaattcaagaagacattggcttagatgtattagttcacggtgaatttgaacgtaatgacatggttgaattcttcggagaaaaattacaaggtttcttagtaactaaattcggttgggtgcaatcatatggttcacgtgccgtaaaaccaccaatcatttatggtgatgtaaaatggacagcgcctttaactgttgatgaaacagtttatgcacaaagcttaacagataaaccagttaaaggtatgttaactggacctgtaacaattctaaactggtcatttgaacgtgttgatttaccacgtaaagtcgttcaagatcaaattgctttagcaatcaacgaagaagtattagcacttgaagctgcaggaatcaaagttatccaagttgacgaacctgcattacgtgaaggcttaccattacgctctgaatatcacgaacaatatcttaaagatgctgttttatcatttaaacttgcaacgtcttcagttcgtgatgaaactcaaatccatacacatatgtgttattctcaattcggtcaaatcattcatgctattcatgacttagatgctgatgttatttcaattgaaacatctcgtagccatggtgatttaattaaagactttgaagatattaattatgatttaggtattggtctaggtgtatatgatattcatagtccacgtattccaacaaaagaagaaattactacagcaatcaatcgttcactacaacaaatcgaccgctcattattctgggtaaaccctgactgtggtttaaaaacgcgaaaagaagaagaagttaaagatgcattgactgtgcttgtgaatgctgttaaagctaaacgccaagaa

SEQ ID NO: 1894 - protein, 742 aa, Staphylococcus aureus
MTTIKTSNLGFPRLGRKREWKKAIESYWAKKISKEELDQTLTDLHKENLLLQKYYHLDSIPVGDFSLYDHILDTSLLFNIIPERFQGRTIDDDLLFDIARGNKDHVASALIKWFNTNYHYIVPEWDNVEPKVSRNVLLDRFKYAQSLNVNAHPVIVGPITFVKLSKGGHQTFEEKVKTLLPLYKEVFESLIDAGAEYIQVDEPILVTDDSESYENITREAYDYFEKAGVAKKLVIQTYFERAHLKFLSSLPVGGIGLDFVHDNGYNLKQIEAGDFDKSKTLYAGIIDGRNVWASDIEAKKVLIDKLLAHTNELVIQPSSSLLHVPVSLDDETLDTSVGEGLSFATEKLDELDALRRLFNQNDSVKYDKLKARYERFQNQSFKNLDYDFESVRTSRQSPFAQRIEQQQKRLNLPDLPTTTIGSFPQSREVRKYRADWKNKRITDEAYETFLKNEIARWIKIQEDIGLDVLVHGEFERNDMVEFFGEKLQGFLVTKFGWVQSYGSRAVKPPIIYGDVKWTAPLTVDETVYAQSLTDKPVKGMLTGPVTILNWSFERVDLPRKVVQDQIALAINEEVLALEAAGIKVIQVDEPALREGLPLRSEYHEQYLKDAVLSFKLATSSVRDETQIHTHMCYSQFGQIIHAIHDLDADVISIETSRSHGDLIKDFEDINYDLGIGLGVYDIHSPRIPTKEEITTAINRSLQQIDRSLFWVNPDCGLKTRKEEEVKDALTVLVNAVKAKRQE

SEQ ID NO: 1895 - DNA, 750 bp, Staphylococcus aureus
atgacacaatatcctttatggcaacaattaaatactttaaaacaagcaacttgggttgatttaacgcatacatttgatccggaaataccacgttttagtgagtttgaaaaaggcgaagtttcaactttattcacggttaaagatcatggtttctatgtgcaacgttggaatattgtaacgcaatatggtactcacattgatgcaccaattcactttgtcgagaataaacgttatttagaagacattgatttaaaagaattggtattgccgttaattgtattagacttttcaacagaagtagcgaacaacaatgatttcatcgtaacacgtgcgcatatagaagcatgggaaaaagagcatggtactattgaacctggcacttttgttgcacttcgtaccgattggtcaaaacgttggcctaatattgaaaagtttgaaaacaaagatgcgaacggacaacaacatgcaccgggttggggattagatgctttgaagtacttaattgaagaacgtcgtgttgaagctgttggtcatgaaacattcgataccgatgcatctgtggacgttgtaaaaaatggtgatttagttggcgaacgttatattcttggtcaggataaataccaagtcgagttattaactaatttagatcaattaccaactcgtggcgccatcatttacgctatcagccctaaaccaaaagatgcacctgggttccctgttagagcatttgcaattaaaccatcaaatgac

SEQ ID NO: 1896 - protein, 250 aa, Staphylococcus aureus
  MISC_FEATURE (1)..(250): conserved hypothetical
MTQYPLWQQLNTLKQATWVDLTHTFDPEIPRFSEFEKGEVSTLFTVKDHGFYVQRWNIVTQYGTHIDAPIHFVENKRYLEDIDLKELVLPLIVLDFSTEVANNNDFIVTRAHIEAWEKEHGTIEPGTFVALRTDWSKRWPNIEKFENKDANGQQHAPGWGLDALKYLIEERRVEAVGHETFDTDASVDVVKNGDLVGERYILGQDKYQVELLTNLDQLPTRGAIIYAISPKPKDAPGFPVRAFAIKPSND

SEQ ID NO: 1897 - DNA, 1179 bp, Staphylococcus aureus
atgacgagagtcgtattagcagcagcatacaggacacctattggcgtttttggaggtgcgtttaaagacgtgccagcctatgatttaggtgcgactttaatagaacatattattaaagagacgggtttgaatccaagtgagattgatgaagttatcatcggtaacgtactacaagcaggacaaggacaaaatccagcacgaattgctgctatgaaaggtggcttgccagaaacagtacctgcatttacggtgaataaagtatgtggttctgggttaaagtcgattcaattagcatatcaatctattgtgactggtgaaaatgacatcgtgctagctggcggtatggagaatatgtctcaatcaccaatgcttgtcaacaacagtcgctttggttttaaaatgggacatcaatcaatggttgatagcatggtatatgatggtttaacagatgtatttaatcaatatcatatgggtattactgctgaaaatttagtagagcaatatggtatttcaagagaagaacaagatacatttgctgtaaactcacaacaaaaagcagtacgtgcacagcaaaatggtgaatttgatagtgaaatagttccagtatcgattcctcaacgtaaaggtgaaccaatcgtagtcactaaggatgaaggtgtacgtgaaaatgtatcagtcgaaaaattaagtcgattaagaccagctttcaaaaaagacggtacagttacagcaggtaatgcatcaggaatcaatgatggtgctgcgatgatgttagtcatgtcagaagacaaagctaaagaattaaatatcgaaccattggcagtgcttgatggctttggaagtcatggtgtagatccttctattatgggtattgcaccagttggcgctgtagaaaaggctttgaaacgtagtaaaaaagaattaagcgatattgatgtatttgaattaaatgaagcatttgcagcacaatcattagctgttgatcgtgaattaaaattacctcctgaaaaggtgaatgttaaaggtggcgctattgcattaggacatcctattggtgcatctggtgctagagtattagtgacattattgcatcaactgaatgatgaagttgaaactggtttaacatcattgtgtattggtggcggtcaagctatcgctgcagttgtatcaaagtataaa

SEQ ID NO: 1898 - protein, 393 aa, Staphylococcus aureus
  MISC_FEATURE (1)..(393): acetyl-CoA
MTRVVLAAAYRTPIGVFGGAFKDVPAYDLGATLIEHIIKETGLNPSEIDEVIIGNVLQAGQGQNPARIAAMKGGLPETVPAFTVNKVCGSGLKSIQLAYQSIVTGENDIVLAGGMENMSQSPMLVNNSRFGFKMGHQSMVDSMVYDGLTDVFNQYHMGITAENLVEQYGISREEQDTFAVNSQQKAVRAQQNGEFDSEIVPVSIPQRKGEPIVVTKDEGVRENVSVEKLSRLRPAFKKDGTVTAGNASGINDGAAMMLVMSEDKAKELNIEPLAVLDGFGSHGVDPSIMGIAPVGAVEKALKRSKKELSDIDVFELNEAFAAQSLAVDRELKLPPEKVNVKGGAIALGHPIGASGARVLVTLLHQLNDEVETGLTSLCIGGGQAIAAVVSKYK

SEQ ID NO: 1899 - DNA, 99 bp, Staphylococcus aureus
atggaaaacaatgatagcaatgaagtagcttatttgttaaaagatggtaaatttacaaaagtatatgtcaatcaagatagtgtatcttttgtgccaggg

SEQ ID NO: 1900 - protein, 33 aa, Staphylococcus aureus
MENNDSNEVAYLLKDGKFTKVYVNQDSVSFVPG

SEQ ID NO: 1901 - DNA, 2103 bp, Staphylococcus aureus
atgacatgccaacttaaaatacatcatacattatcgacaataccaagtcgtaatattaataatattatggtgctattttcacttacaagtaaactcaatattacgattaatggtgaaaccaaagacgtaagtaattatattatcttaattaaccatggtgatatttataatattaaccacggcgaaaatataatcgaattaatgatacccgttttttatttttatcaacaagatgatgatttctttaatggttatttagatcgtcatttattacaatcaagtaattatattaagtcattaattgccgatttaatcagtacaccaacaagttcttctttaatggggaaaaatataggtcaaagtattatagacactttacttaaagaagcttttataagaatagatcatgaatatttaccaaatattgctttaagcaatccggtgttcatagactgtgtaaactatattcatgacaatattgatgcgcacttgtctttaaaagatatagcgatgcattgcaacatctctgaatcatattgttctaatctttttgttcgatatttgagtatgaattttaaagattattttacaagtattaaacttgttaacgccatcaatttattactttctacaaaacattctattacaactgtttctgaattggccggttttaacagtcatacaaattttgcaaatcaatttaagaattacttgcattttagtcctaaacagttccgttcactcgtttccaagattactgaaccaccacaaatacacttccaacaagataacgtatcacaattcactgagttaatttcaacaattgatttaacagctcaactggctacaaatacaacagatattcatatagatgattttaatccgaaagatcgaagtcagcgtgccaaagtatttgttcgatttagtaatttcaatgaactatttcaatttattttcaatgaatattacgatattaactttgagcacttaccaaaacctgtcgttttcattgacgatattcacgatattgagattagccaaacgaattacaacctgttaaatagatgttttgaaaagcttttcgaaaaaaatataggtttagcaatcgctattaaatcaacacaacaattcgaaacgatgaagcaattaatactaacatttttacaaggcaatcaagactataagacaagcaagaaattagttaaatttatgctcgtattttgctctaattctatgacagcagaagaaattcatttatgtcatcttaaaattaaaaacaaaaataaagaaattaaatatagtgtgacagtcgatggctttttagaaacttattcaaccgtggaacaagtttatgatgtcatgcagcgtcttaaattccattattactttattgatattgaaaattcaaaaactgcaacacatcttatcactaaaaaccaacactatcatcaaactgacactcattttgaacagtataagaaatttattttagattcaggtatatcatcaacacaatttgtatataataacctgtctgtaagcggatttaaatatactaatgatggtaagaatccaattcaattatctgacatagtgtatcacttaatcgcattattacgatatggcggtggcattagctatcaattattagatgaccattcaaattatatttccttgtacaacaaatatggtagccccctaccattaatgcatttatataaaatgtttagaccttttgttaatgaagatattgaaattacaaataattatgtattgagtcgtaaagataataactaccatttcttattattcaataaaattaatgatcgatatatgtcagacgtaaaacaagatttcattttccataatgaattacctcaagactctttgatgattattaaaacattgaatcatgaacatggttcaattcaacatttgcttccaataagcgatcaacttgtttatatagaaaaagaaattttagatgaattagacaaaacgaattaccctaaaacggagcttgcagttcaagaagaaactggtcgtacatttgaactcaagttaaatcacgacgaggttaaatatatttgctttaaaccaagc

SEQ ID NO: 1902 - protein, 701 aa, Staphylococcus aureus
  MISC_FEATURE (1)..(701): hypothetical protein
MTCQLKIHHTLSTIPSRNINNIMVLFSLTSKLNITINGETKDVSNYIILINHGDIYNINHGENIIELMIPVFYFYQQDDDFFNGYLDRHLLQSSNYIKSLIADLISTPTSSSLMGKNIGQSIIDTLLKEAFIRIDHEYLPNIALSNPVFIDCVNYIHDNIDAHLSLKDIAMHCNISESYCSNLFVRYLSMNFKDYFTSIKLVNAINLLLSTKHSITTVSELAGFNSHTNFANQFKNYLHFSPKQFRSLVSKITEPPQIHFQQDNVSQFTELISTIDLTAQLATNTTDIHIDDFNPKDRSQRAKVFVRFSNFNELFQFIFNEYYDINFEHLPKPVVFIDDIHDIEISQTNYNLLNRCFEKLFEKNIGLAIAIKSTQQFETMKQLILTFLQGNQDYKTSKKLVKFMLVFCSNSMTAEEIHLCHLKIKNKNKEIKYSVTVDGFLETYSTVEQVYDVMQRLKFHYYFIDIENSKTATHLITKNQHYHQTDTHFEQYKKFILDSGISSTQFVYNNLSVSGFKYTNDGKNPIQLSDIVYHLIALLRYGGGISYQLLDDHSNYISLYNKYGSPLPLMHLYKMFRPFVNEDIEITNNYVLSRKDNNYHFLLFNKINDRYMSDVKQDFIFHNELPQDSLMIIKTLNHEHGSIQHLLPISDQLVYIEKEILDELDKTNYPKTELAVQEETGRTFELKLNHDEVKYICFKPS

SEQ ID NO: 1903 - DNA, 1131 bp, Staphylococcus aureus
atggttaatgcattaacaccaaaacatttagctgaaaagcgtgcaggattccatgagttgttctttgatttaattttcgtctatgccattcaaaaaattgcacatgtgattttaacaacacaaaacggttccatttcagctgatttatttttcaaatacatcgtcatgagtttgttcttatggttaatgtggtctcatcaaacattttttacaaatcgatttggtcaagttacattcaaagacgtctcgtttatgatgtttaatatgttcatcatggtcttcctatctaacagcctatatccggactttgaaaagacattcttcccattcttcttatgcgtggcaattatgtatttaagtatcggattacagtatttattacatatacgtacagggttagattatggcgataagcgtacatgtcaagcttttgcgagcgtagcctttgtgatttcatttttatcatttctatcattagtactaccacaaagtatccattacatccctggatttttaggcgtattcattgcagcgacaggacttattccatttcagaaatatcttgtattatcacctgttaatatgatgcatttagtagaacgtttttcgttactaacaattattatctttggcgaggtactggttggtttagcttcgtcatcatttagcattgatcattttagttacatttatatattccaatttatgattttaattagtcttttcggtgtatattggatcattactgaaaattatattaatcataaattaacatctatcggtttccgtttatcgtatacgcatctattaatcaatatcgctttaggtgtgattaatgctgcaattgtttttagtaataacaataaactaaatgacttgtttgaaattaatatgatgtatatcagtgttttaatattctatattggattatggttaatcacgccttatttccataatgaactgacaaacgcgaagtatatttcatattcactaggtatactcgttatgtcttatattgtcagccttttatttaaaggtcacgaccatgtaatgattatctcagtatcagttgcaaccttctgcatcatgctgatttattttaaaaatcaacgtctacgtaataaacatgaa

SEQ ID NO: 1904 - protein, 377 aa, Staphylococcus aureus
  MISC_FEATURE (1)..(377): hypothetical protein
MVNALTPKHLAEKRAGFHELFFDLIFVYAIQKIAHVILTTQNGSISADLFFKYIVMSLFLWLMWSHQTFFTNRFGQVTFKDVSFMMFNMFIMVFLSNSLYPDFEKTFFPFFLCVAIMYLSIGLQYLLHIRTGLDYGDKRTCQAFASVAFVISFLSFLSLVLPQSIHYIPGFLGVFIAATGLIPFQKYLVLSPVNMMHLVERFSLLTIIIFGEVLVGLASSSFSIDHFSYIYIFQFMILISLFGVYWIITENYINHKLTSIGFRLSYTHLLINIALGVINAAIVFSNNNKLNDLFEINMMYISVLIFYIGLWLITPYFHNELTNAKYISYSLGILVMSYIVSLLFKGHDHVMIISVSVATFCIMLIYFKNQRLRNKHE

SEQ ID NO: 1905 - DNA, 627 bp, Staphylococcus aureus
atgaaaggtatgttcctaagtagtttttatgcaacgagaaagcaaacatatatttattttatagtcgctattatagctgcaggatactttgcagtatttaatccgttgatgagttcggcaatggctggggttatgttaatcacacctattactgataatattaaacatgaaaaagactcaagatggatgtattatgtatctactttaccggttaaacgtagtgattatattaagtcatactttgccttttatttaatcttattcggtgcaagtttaatgattggattagttgtgactacgattgtgacccaaagtgtgatgattggtattatgtcaggtttaatgagttttggtatcataggggcatactctatcattttcccattgacatttaaatttggcgctgaaaactccaatgtcattatgatatgtgcatctatactactacttatttctttcgtggtctttttctttatatatggtatggttagtggtgcatctgcattagaatttgaaaaaattagcactgaaggatggctagttgtcatagcatatgcggtcattggtatagttataacgagcgtttcttatatgttgtctattaaaatttttaacaaacaagaacta

SEQ ID NO: 1906 - protein, 209 aa, Staphylococcus aureus
  MISC_FEATURE (1)..(209): conserved hypothetical
MKGMFLSSFYATRKQTYIYFIVAIIAAGYFAVFNPLMSSAMAGVMLITPITDNIKHEKDSRWMYYVSTLPVKRSDYIKSYFAFYLILFGASLMIGLVVTTIVTQSVMIGIMSGLMSFGIIGAYSIIFPLTFKFGAENSNVIMICASILLLISFVVFFFIYGMVSGASALEFEKISTEGWLVVIAYAVIGIVITSVSYMLSIKIFNKQEL

SEQ ID NO: 1907 - DNA, 846 bp, Staphylococcus aureus
atggatatgacaacattgttaaacgtagatagtgtgaacaaacaatacaaagattcggattttaaattgcaagatgcatctttaacgatttctactaatgagacagttggattaattgggaaaaatggctcaggtaaatcgacattaattaatattctagtaggcaatcgacataaagataacggtagtatcacattttttggagaagaacataccgtggatgatgtcgaatataaagaacacataggtgtagtgtttgatgatttgagagtgcctaataaattgactattaaagatattgataaagtatttcaatctatttatatgacttggaatagtcaaaaattctttgatttaatcaaatatttcgagttaccactacaaactaaaattaaaactttttcaagagggatgcgaatgaagatagctttaacgattgcgctttctcatgatgtgaagttattaatcttagatgaagcaactgcaggtatggatgtttctggaagagaagaagtaatggaaatactagaagattttgtcgcacaaggtggaggcatcttaatatcatcgcatatttctgaagatatagaacatttagctgataaattagtgtttatgaaagatggacgaatgattttaactgaacagaaagatatacttttagcacaatatggaattgttacgacagaagataaagatgttgaaattcctaagcatttaatcattgcttctagattgtcaaaggggaaatatcaaattttagttaaagattatgcagaaattgaaaatgcagagcctttaaaacacattgatgacgctacaaaaatcataatgcgaggtgaagta

SEQ ID NO: 1908 - protein, 282 aa, Staphylococcus aureus
  MISC_FEATURE (1)..(282): hypothetical protein
MDMTTLLNVDSVNKQYKDSDFKLQDASLTISTNETVGLIGKNGSGKSTLINILVGNRHKDNGSITFFGEEHTVDDVEYKEHIGVVFDDLRVPNKLTIKDIDKVFQSIYMTWNSQKFFDLIKYFELPLQTKIKTFSRGMRMKIALTIALSHDVKLLILDEATAGMDVSGREEVMEILEDFVAQGGGILISSHISEDIEHLADKLVFMKDGRMILTEQKDILLAQYGIVTTEDKDVEIPKHLIIASRLSKGKYQILVKDYAEIENAEPLKHIDDATKIIMRGEV

SEQ ID NO: 1909 - DNA, 711 bp, Staphylococcus aureus
atgaaaatactaagatatatcggatatcttttactgggtggacttgtagggggtatcataggtggaattttaggtaattttgatggatttggtattgagaacttgacgtttgcgacatataacaatgtcgttgtaatatcgattgttgcgacgattattatcatattggtagaagccattgttttgatgaatcaaagacgtgcattgaagtataagcaacttgtagataaagaggtagatatcgatgcaacagatcaatatgagttgcttgcgaatcgttatgttttaaatggaagtatattaagtattctgcagacagttattgcttttttagtattgcttatttttgtggtagggcacgctgcagcaaatgcaatactattctttttaataccattttttgctagtgctattttcaatacacaatttacactgtttaatagaaggtttgatgacagaataccaaaaattgcagataagaattacactgaaaagcgattggaaatattggatgaaggtgaacgccatatagaattaattgcattatttaaaacatatgcgatcaacttatcaatattgatactagccattgtagtaattgggctttattcaattactactggaattaatcaaagctttagtttgctacttatcattgctattttcatatataacgcctttagttatttattgaagagaagacgtttttat

SEQ ID NO: 1910 - protein, 237 aa, Staphylococcus aureus
  MISC_FEATURE (1)..(237): hypothetical protein
MKILRYIGYLLLGGLVGGIIGGILGNFDGFGIENLTFATYNNVVVISIVATIIIILVEAIVLMNQRRALKYKQLVDKEVDIDATDQYELLANRYVLNGSILSILQTVIAFLVLLIFVVGHAAANAILFFLIPFFASAIFNTQFTLFNRRFDDRIPKIADKNYTEKRLEILDEGERHIELIALFKTYAINLSILILAIVVIGLYSITTGINQSFSLLLIIAIFIYNAFSYLLKRRRFY

SEQ ID NO: 1911 - DNA, 201 bp, Staphylococcus aureus
gtgcgtaatcgattgaaagaattacgagcacgagatggcttaaaccaaacgcaacttgctaaacaagcgggcgtttcaagacaaaccatatcgctaattgagcgaaacaattttatgccatcagtattaacggcaataaaaattgctcgcattttcaatgaaacggtggaaactgtttttattattgaggaggatgaggca

SEQ ID NO: 1912 - protein, 67 aa, Staphylococcus aureus
  MISC_FEATURE (1)..(67): hypothetical protein
VRNRLKELRARDGLNQTQLAKQAGVSRQTISLIERNNFMPSVLTAIKIARIFNETVETVFIIEEDEA

SEQ ID NO: 1913 - DNA, 387 bp, Staphylococcus aureus
atggcatttacattatctgcaattcaacaagcacatcaacaatttactggtgttgactttccaaaactattcaaagcttttaaagatatggggatgacttacaatatcgtcaacattcaagatggcactgcaacatacgtacatcaatcagaagatgatatcgttacgtcatctgtaaaaagtaatcatcctgttgctcaaaaatcaaacaaaacaatagttcaagacgtcttaactagacatcaacaagggcaaacagattttgaaacattttgtgatgaaatggctgaagctggcatttataaatggcatatcgatattcaagcgggcacttgtacttatatcgacttgcaagaccaagctgttatttcagaattaatccctcaa

SEQ ID NO: 1914 - protein, 129 aa, Staphylococcus aureus
  MISC_FEATURE (1)..(129): hypothetical protein
MAFTLSAIQQAHQQFTGVDFPKLFKAFKDMGMTYNIVNIQDGTATYVHQSEDDIVTSSVKSNHPVAQKSNKTIVQDVLTRHQQGQTDFETFCDEMAEAGIYKWHIDIQAGTCTYIDLQDQAVISELIPQ

SEQ ID NO: 1915 - DNA, 228 bp, Staphylococcus aureus
gtgaggttgattatcatgataactaacacttttattttaggcatcacaggcccaacaagtcttgtcgtcattagcattatcgctttaattatttttggtccgaaaaaattaccacaatttggccgtgccatcggttctactttaaaagaatttaaatctgcaacagaagatttagataaagagtctcacgatacacccagtaaggaatcgaaacaacagcgagagcaa

SEQ ID NO: 1916 - protein, 76 aa, Staphylococcus aureus
  MISC_FEATURE (1)..(76): conserved hypothetical
VRLIIMITNTFILGITGPTSLVVISIIALIIFGPKKLPQFGRAIGSTLKEFKSATEDLDKESHDTPSKESKQQREQ

SEQ ID NO: 1917 - DNA, 654 bp, Staphylococcus aureus
ttgtcgttcgtcattacggtcatcgtcgtatatgtttcatcattttggtggatgacaccattcataacgtatattacccgtgcacatgtgtccttacatgcattttcattcacagaaatgatacaaatatacgtgatgattatatttttcatcgcgttttgtttcatttcaccagtcatgttttatcaattgtgggcattcattgcacctggattacataataatgaacgtcaatttatttataaatatagttttttcagcgtgttattattctgtgctggcgtcgcttttgcattttatgttggctttccaatgatcattcaattcgcgttaaaattatcattaactttaaacatttcgcctgtcattggctttaaagcatatttgattgaactcatacgttggttattcacatttggtcttctatttcaattaccaatattatttatgggtcttgcaaaattcggtcttatagataccacatcattgaaacattatcgtaaatatatttatttcgcttgctttgtattagcaagtatcattgcaccacccgatttaacattaaatatattactcacattgccactcatattgctctttgagttcagtatgttcatcgttaagttcacatgccgaggcaaaccgccaacacat

SEQ ID NO: 1918 - protein, 218 aa, Staphylococcus aureus
  MISC_FEATURE (1)..(218): conserved hypothetical
LSFVITVIVVYVSSFWWMTPFITYITRAHVSLHAFSFTEMIQIYVMIIFFIAFCFISPVMFYQLWAFIAPGLHNNERQFIYKYSFFSVLLFCAGVAFAFYVGFPMIIQFALKLSLTLNISPVIGFKAYLIELIRWLFTFGLLFQLPILFMGLAKFGLIDTTSLKHYRKYIYFACFVLASIIAPPDLTLNILLTLPLILLFEFSMFIVKFTCRGKPPTH

SEQ ID NO: 1919 - DNA, 1734 bp, Staphylococcus aureus
gtgttagtaagggaggataccttggtgaaacattatttgactaaatttgtagcaatgctaataactgctgctatggtgtgtagctttgggttactgaaaagtcaggcagcagaacaacaaagtattagtgatgtatatagtgtgataacggatgcgaaatctgcactttctaataattcgatatcgaatgacaataagcagaaagcaattgagcaagtggtaagtgcagttaagaaattatcgcttgaagataatagtgaaagtaatgctgtcaaatcagatgtgagaaagcttgaagatgcaaaagcgaatgataatcaaaaagatacactttcgcaattaacgaagtcattaattgcttatgaagagaaattggctagtaaagatgcgggttctaaaattaaactattgcaacagcaagtcgatgctaaagatgctgcgatgacaaaagcgattaaagataaaaataaagcggaattagaatctttgaacaatagtttgaatcagatttggacaagtaatgaaacagtgattcgcaattatgacgcaaatcaatatggacaaattgaagtcgcattattacaacttagaattgcaattcataagtcaccattagatacggcaaaagtgtcacatgcttggacaacttttaaatcaaatattgatcatgtcgataaaaaaagtaatacgtctgcaaatgatcaataccatgtatcacaattaaatgatgcgttagagaaggcgattaaagctatcgacgacaatcaattgtcggatgctgatgctgcgcttacacattttatagaaacttggccgtatgttgaaggtcaaattcaaactaaagacggtgctttgtatacgaaaattgaagataaaataccatattatcaaagtgtattagacgaacataataaagcacatgtgaaagatggtttagtagatttaaataaccaaattaaagaggttgttggccatagttatagcttcgtcgatgtgatgattatctttttacgtgaagggctagaagtgttgttaattgtaatgacattgactaccatgacgcgtaatgtaaaagataagaaagggactgcaagtgtgattggtggtgcaattgccggacttgtactgagtattatcttagcaattacgtttgtagaaactttagggaatagtggcattcttcgtgaaagtatggaagcgggattaggtatcgttgcggtcatattaatgtttatcgttggtgtttggatgcacaaacgttcaaatgcaaaacgttggaatgacatgattaaaaatatgtatgctaatgcgattagtaatggtaatttggtattgttagcgacgattggtttaatatctgtgttgcgtgaaggtgtcgaggttatcattttctatatggggatgataggtgagctagcgaccaaagattttattattggtattgctttagctatcgttattttaatcatctttgcattattatttagatttatagttaaattaatacctattttctatatatttagagtgttgtcgatctttatttttattatgggattcaaaatgcttggcgtaagtattcaaaagttacaattattaggtgcgatgccaagacatgttattgaaggattcccaacgattaactggttgggcttttatccaagttatgaaccattgatagcacaaggtgcttatattatggtagttgctatcttaatctttaaatttaaaaaa

SEQ ID NO: 1920 - protein, 578 aa, Staphylococcus aureus
  MISC_FEATURE (1)..(578): conserved hypothetical
VLVREDTLVKHYLTKFVAMLITAAMVCSFGLLKSQAAEQQSISDVYSVITDAKSALSNNSISNDNKQKAIEQVVSAVKKLSLEDNSESNAVKSDVRKLEDAKANDNQKDTLSQLTKSLIAYEEKLASKDAGSKIKLLQQQVDAKDAAMTKAIKDKNKAELESLNNSLNQIWTSNETVIRNYDANQYGQIEVALLQLRIAIHKSPLDTAKVSHAWTTFKSNIDHVDKKSNTSANDQYHVSQLNDALEKAIKAIDDNQLSDADAALTHFIETWPYVEGQIQTKDGALYTKIEDKIPYYQSVLDEHNKAHVKDGLVDLNNQIKEVVGHSYSFVDVMIIFLREGLEVLLIVMTLTTMTRNVKDKKGTASVIGGAIAGLVLSIILAITFVETLGNSGILRESMEAGLGIVAVILMFIVGVWMHKRSNAKRWNDMIKNMYANAISNGNLVLLATIGLISVLREGVEVIIFYMGMIGELATKDFIIGIALAIVILIIFALLFRFIVKLIPIFYIFRVLSIFIFIMGFKMLGVSIQKLQLLGAMPRHVIEGFPTINWLGFYPSYEPLIAQGAYIMVVAILIFKFKK

SEQ ID NO: 1921 - DNA, 1167 bp, Staphylococcus aureus
atgttaggtattggcggtgccggtgttgcaattggcgcaagtggtgttggtagcatgtggtctttcaaatcaatgttcaatacaccagaagatccggaaaaagatgcgtatgaattttatggtaaagtgcaaccaggcattaccacacccacgcaaaaaacatgcaatttcgttgcgttagatttgaagtcaaaagatagagatgcaattaaggcaatgtttaaaaagtggacggttatggctgatcgtatgatggatggtgatacagttggcaagccgagtaacaatcctttaatgccaccagtagataccggtgaatcgataggattaggtgcaagcaagttaacgattacctttgggattagtaagtctttgatgaagaaaattgggttatctagtaaaattcccgatgcctttaaagatttaccgcattttccgaatgatcagttaatagacgattacagcgatggtgatattatgattcaagcatgctcaaatgattcgcaagtatcctttcatgcggttcataatttagttcgtccatttcgagatattgttaaggtacgttgggcgcaatctggttttatctctgctaaaggtaaggaaacacctagaaatttaatggcatttaaagatggaacaattaatcctaggaagaataatcaacttaaagattatgtgtttattgatgacggatgggcgaaacatggaacttattgcgttgtcagacgtattcaaatacacattgaaacgtgggatcgtactgcgctggaagaacaagaggctacatttggtcggaaacgacatagtggtgcaccgttaacaggtgggaaagagtttgatgaaattgacttaaaagcgaaagatagtcatggcgagtatattattgataaagatgcccatacgaggctagcgaaagaagcaaatacgtcaattttacgtagagcctttaattatgtggatggtacggatgaccgcacaggtaacttcgaaacaggcttactttttattgcttttcaaaaagcgacaaaacaatttatcgatatacaaaataatttaggtagtaatgataaattaaatgaatatattacacatagaggttctgcttcatttttagtattaccaggtgttagtaagggaggataccttggtgaaacattatttgac

SEQ ID NO: 1922 - protein, 389 aa, Staphylococcus aureus
  MISC_FEATURE (1)..(389): conserved hypothetical
MLGIGGAGVAIGASGVGSMWSFKSMFNTPEDPEKDAYEFYGKVQPGITTPTQKTCNFVALDLKSKDRDAIKAMFKKWTVMADRMMDGDTVGKPSNNPLMPPVDTGESIGLGASKLTITFGISKSLMKKIGLSSKIPDAFKDLPHFPNDQLIDDYSDGDIMIQACSNDSQVSFHAVHNLVRPFRDIVKVRWAQSGFISAKGKETPRNLMAFKDGTINPRKNNQLKDYVFIDDGWAKHGTYCVVRRIQIHIETWDRTALEEQEATFGRKRHSGAPLTGGKEFDEIDLKAKDSHGEYIIDKDAHTRLAKEANTSILRRAFNYVDGTDDRTGNFETGLLFIAFQKATKQFIDIQNNLGSNDKLNEYITHRGSASFLVLPGVSKGGYLGETLFD

SEQ ID NO: 1923 - DNA, 120 bp, Staphylococcus aureus
gtgaaggttattttttattgtccaaaacgtgctgatgacattttaaaagcaagtatggaatatcagtcgacagactataaacggaggtatatctcatggaaaacaatgatagcaatgaag

SEQ ID NO: 1924 - protein, 40 aa, Staphylococcus aureus
VKVIFYCPKRADDILKASMEYQSTDYKRRYISWKTMIAMK

SEQ ID NO: 1925 - DNA, 852 bp, Staphylococcus aureus
atgaaaaagttaacaacgctattattagcatcaacgttattaattgctgcatgtgggaacgacgatagtaagaaggatgattcaaagacatcgaaaaaagatgatggtgttaaagcagaattaaaacaagcaacaaaagcatatgataaatatactgatgaacagttaaatgaatttttaaaaggtacagaaaaatttgttaaagcgattgaaaataatgatatggcccaagcaaaagcgttatatccaaaagttcgtatgtattatgaacgctctgaaccagttgcagaagcatttggagatttagatcctaaaattgatgcacgtcttgcagatatgaaagaagagaaaaaggaaaaagaatggtcaggatatcataagattgaaaaagcattatacgaagataagaaaattgatgatgtgactaaaaaagatgcacaacaattattgaaagatgcaaaagaattgcatgccaaagctgatacattagatatcacaccaaaattaatgttacaaggttctgttgacctattaaatgaagttgcaacttctaaaatcacaggtgaagaagaaatttattcacatacagatttatatgattttaaagcgaacgttgaaggcgcacaaaaaatttatgacttatttaaacctattttagagaaaaaagataaaaaattaagtgatgatatccaaatgaacttcgataaagtgaatcaattattggataaatataaagataacaacggcggttatgagtcatttgaaaaagtatcgaagaaagaccgtaaagcatttgcggatgctgttaatgcattaggagagccactaagtaaaatggctgtgattactgaa

SEQ ID NO: 1926 - protein, 284 aa, Staphylococcus aureus
  MISC_FEATURE (1)..(284): conserved hypothetical
MKKLTTLLLASTLLIAACGNDDSKKDDSKTSKKDDGVKAELKQATKAYDKYTDEQLNEFLKGTEKFVKAIENNDMAQAKALYPKVRMYYERSEPVAEAFGDLDPKIDARLADMKEEKKEKEWSGYHKIEKALYEDKKIDDVTKKDAQQLLKDAKELHAKADTLDITPKLMLQGSVDLLNEVATSKITGEEEIYSHTDLYDFKANVEGAQKIYDLFKPILEKKDKKLSDDIQMNFDKVNQLLDKYKDNNGGYESFEKVSKKDRKAFADAVNALGEPLSKMAVITE

SEQ ID NO: 1927 - DNA, 543 bp, Staphylococcus aureus
atgtttggaatgaaagtgaatgaacaaataacattaaaaattttagaagctcatgacacagaagcgcttttcaatttagtcaatcgttcaagaaattcacttagggaatggttaccttgggtagatgcaactgagcaaccatcagatacgcgtgcatttattaaaagaggacttttgcaatttgctgatggtaatggatttcagtgtggcatttggtatgaaggaacgctagttggtgtcatcggtttacatgaaattaatcacatgcacagaaaaacttcattagggtactatttagataaagaatttgagggtcatgggattatgacacaagcagttgaggcattgataaagtattgtttcgaagagcttgacttaaaccgaattgagattagtgccgcagttaataatgaaaaaagccgggctattcctgaaaggctgggatttactagagaaggtatgttacgtgacaatgaattactaaatggtatttattcatcgagttacatctatagtttattaaaatcagaatacgaccaaaaa

SEQ ID NO: 1928 - protein, 181 aa, Staphylococcus aureus
  MISC_FEATURE (1)..(181): hypothetical protein
MFGMKVNEQITLKILEAHDTEALFNLVNRSRNSLREWLPWVDATEQPSDTRAFIKRGLLQFADGNGFQCGIWYEGTLVGVIGLHEINHMHRKTSLGYYLDKEFEGHGIMTQAVEALIKYCFEELDLNRIEISAAVNNEKSRAIPERLGFTREGMLRDNELLNGIYSSSYIYSLLKSEYDQK

SEQ ID NO: 1929 - DNA, 405 bp, Staphylococcus aureus
atgagcagtgcctcctttaatagcattttagcactgttttgtcgtatttttaaatataaatttggaatgaataataaagtagtgattaaattaagttgtgtgataggaaacttggacatcaatcaaagtaataggcactacaacgcttattggcggggccccaacaaagaagctgacgaaaagtcagcttgcaataatgtgcaagttggggatgggccccaacatagagaaattgggtccgtaatttctacagacaatgcaagttggcggggccccaacatagagaatttcgaaaagaaattctacaagcaatgcaagttggggaaggacaacaaatttaagatacaatgcgtaacattaatatgttattataatgataatttacagaattatatgaaaaatgaa

SEQ ID NO: 1930 - protein, 135 aa, Staphylococcus aureus
MSSASFNSILALFCRIFKYKFGMNNKVVIKLSCVIGNLDINQSNRHYNAYWRGPNKEADEKSACNNVQVGDGPQHREIGSVISTDNASWRGPNIENFEKKFYKQCKLGKDNKFKIQCVTLICYYNDNLQNYMKNE

SEQ ID NO: 1931 - DNA, 993 bp, Staphylococcus aureus
atggcatcattgaaaaataagcattttatgattgggctatcactaacatttatagtcgcattatttagctttttagcagctaaattgccaatcctagataaggttggcgcattaactatcgcgatattaatcgctattctatatcgtcactttagaggatatcctgaacaatatagctcaggtattacgttttcatctaaatatttattaagatttgcaatcatcctatatggacttaaactcaatatattcgatattatcggtcaaggtagtaaactattagccatcgatgtaggtgtcgttattttcagtattgtaatgatgctctttgtcaacaaactgttgcatggtgacaaaaacatcgcattattactaggtgtcggcacaggcgtttgtggtgctgctgctattgccgcagtcgctccaatattcaaatcacgtgaaaaggatacagctattagtatcggtatcatcgcattgattggtacgatattttcacttatatatacagctatctacgctatcttttcaatgacgacaaatgtttatggcgcttggtctggtgttagtcttcatgaaattgcacacgttgtcttagctggtggctttggtggtagtgatgcacttaaaattgcacttcttggtaaacttggtagagtattcttactgattccattaaccatcgtacttattttaattatgcgtttccgttcatcagaatcatctagcaagggtcgaataagcattccatactttttaattggatttgtcattatggccttagtgaatacatatgtaactattccgtcagcattgctaaatattttaaatactgtatcaacaatttgcttattaatggccatggttgctttagggttaaatgttgcatttaaagatcttaaaaatcgcgcacttaaaccgcttatgacaatcattattacctcaatatgcttgtcatcacttgcctttatcgtcgttcattggctatatagt

SEQ ID NO: 1932 - protein, 331 aa, Staphylococcus aureus
  MISC_FEATURE (1)..(331): conserved hypothetical
MASLKNKHFMIGLSLTFIVALFSFLAAKLPILDKVGALTIAILIAILYRHFRGYPEQYSSGITFSSKYLLRFAIILYGLKLNIFDIIGQGSKLLAIDVGVVIFSIVMMLFVNKLLHGDKNIALLLGVGTGVCGAAAIAAVAPIFKSREKDTAISIGIIALIGTIFSLIYTAIYAIFSMTTNVYGAWSGVSLHEIAHVVLAGGFGGSDALKIALLGKLGRVFLLIPLTIVLILIMRFRSSESSSKGRISIPYFLIGFVIMALVNTYVTIPSALLNILNTVSTICLLMAMVALGLNVAFKDLKNRALKPLMTIIITSICLSSLAFIVVHWLYS

SEQ ID NO: 1933 - DNA, 624 bp, Staphylococcus aureus
ttggcaacgacattataccggcgattaaaaagcatttatcaaaataggaggggcgtcatcatgaatattgtattattgtcaggttccacagtaggttctaaaacgagaattgctatggatgatttaaaaaatgaactagaagtcatcaatgagggacatcaaatagagttgatggatttacgagaacttgaattagaatttagcgttggaaagaattatctagatactacaggagatgtatataaattaacgacgtcgttaatgcaggctgatgtgatttttattggttttccaatttttcaagcttccatccctggtgctttgaaaaatgtgtttgatctacttccagtcaatgcgtttcgtgacaaggtaataggacttgtagcgacagcaggttctagtaaacattatttaattcctgaaatgcatttaaaaccaatattgagttacatgaaagcacatacgatgcaaacgtatgtatttattgaagagaaagatttttcaaatcaacaaattgtcaatgatgatgttgtatttcggttaaaagcgttggcacaatccacaatgcgaactgccaaagtacaacaacaagtgtttgaagaagaaaacaaccaatacgacttt

SEQ ID NO: 1934 - protein, 208 aa, Staphylococcus aureus
  MISC_FEATURE (1)..(208): hypothetical protein
LATTLYRRLKSIYQNRRGVIMNIVLLSGSTVGSKTRIAMDDLKNELEVINEGHQIELMDLRELELEFSVGKNYLDTTGDVYKLTTSLMQADVIFIGFPIFQASIPGALKNVFDLLPVNAFRDKVIGLVATAGSSKHYLIPEMHLKPILSYMKAHTMQTYVFIEEKDFSNQQIVNDDVVFRLKALAQSTMRTAKVQQQVFEEENNQYDF

SEQ ID NO: 1935 - DNA, 1107 bp, Staphylococcus aureus
gtgaacaaattgaaagtaagttacacgaaatataaaggagaatgtttaatggccaaattagaaatgaataaaaatacgcctcttgagtttggtttgtattccttaggtgatcatttattgaatccattgaaaggtgaaaaagttagttatgagcaacgtattaatgaaattattgaagcaagtaaattagcagatgaagcaggtattgatgtttttgcagttggtgaaagtcatcaggagcattttacaacacaggcacatacggttgtgttaggtgcaattgcccaagcgacaaagcatattaaagtttcaagttcttcaacgattattagtgcaacagatcctgtaagagtatttgaagacttcgcgacattagatttgatttctcatggtagagccgaaattgtagctggcagagcatcaagaacaggtatttttgacttgtttggctatgatttaaaagactatgatgaattgtttgaagaaaaattaggtttacttttagagttaaataaaactgagcgtattacttggtctggaaaatatcgtccagaacttagaaatatgaaaatattcccaagaccaatcgataatatattgccaatatggcgtgctgttggtggtccacctgcaagtgctattaaagcgggaaaacaaggtgtgccaatgatgattacaacccttggtggcccagcaatgaactttaaaggttctatagatgcttatcgtcaagcggcaactgaagcaggtttcgatgcttcgcctaagtctttaccagtaagtacagcgagtctgttttatacagctgaaacaactcaggatgctatgagagaattttatccacatttgaatacagggatgtcatttattcgtggtgttggttatccgaaacagcaatttgctaattcgtcagattatcgagaagcgctaatggttggaagcccgcaacaaattattgaaaagatattgtatcaacacgagttgtatggtcatcaacgttttatggcacagcttgattttggcggtgtgccatttgaaaatgttatgaagaatattgagttaattggcaacgacattataccggcgattaaaaagcatttatcaaaa

SEQ ID NO: 1936 - protein, 369 aa, Staphylococcus aureus
  MISC_FEATURE (1)..(369): conserved hypothetical
VNKLKVSYTKYKGECLMAKLEMNKNTPLEFGLYSLGDHLLNPLKGEKVSYEQRINEIIEASKLADEAGIDVFAVGESHQEHFTTQAHTVVLGAIAQATKHIKVSSSSTIISATDPVRVFEDFATLDLISHGRAEIVAGRASRTGIFDLFGYDLKDYDELFEEKLGLLLELNKTERITWSGKYRPELRNMKIFPRPIDNILPIWRAVGGPPASAIKAGKQGVPMMITTLGGPAMNFKGSIDAYRQAATEAGFDASPKSLPVSTASLFYTAETTQDAMREFYPHLNTGMSFIRGVGYPKQQFANSSDYREALMVGSPQQIIEKILYQHELYGHQRFMAQLDFGGVPFENVMKNIELIGNDIIPAIKKHLSK

SEQ ID NO: 1937 - DNA, 987 bp, Staphylococcus aureus
atggcatataactatcttttttatgtaagctggtataaaatttatactaataggagggatagtatgaatatagtagggcatcatcacatatccatgtatacaaaagatgcaaaacgtaataaggatttttacacaaatgtccttggattacgattagttgaaaagtcggttaatcaagacaatccttcaatgtatcatttgttttatggggacgaagtaggtacagccggaacaattttaagcttttttgaaattcccaatgcgggtcataagcagccaggtactgaaacgatttatcgattttcattattagtaccaaatcaagcggcacttcattattttgaaaaacgtcttgagaataatggtattaagtctgaacgtttgtactatcttggacaagaaggtgttgtctttaaagatgaagacgacttagaaatcatattgcttgttaatgatagttttgaagtaccacatcaatggcaacataacgcttatagtgaaatacctcaagcatatcaaattttaggaatagggccagtcgaattaagagttagaaatgcagcgcgtacggtagaatttttggaaaatgtcttaggttatcgcaaaagagataataaatcattcgatgtgctgacattagcaccacaaggtttatattcggattttgtagttattgagcaacagggacaacgtgaaagacctggacgaggttatatccatcatattgcagttaatacaccacaaatgagtgacttagatgcaatttacaagaaattacaacaacaaccacaaagtaattcaggtataattgatcgctatttctttaaatcattatactatcgccataattcaattatgtatgaatttgcgactgaagcgcctggatttactattgatacacctgttgaacaattaggaagtcaattgaacttgcctgactttttagaagcagaacgtgaacaaattgaaagtaagttacacgaaata

SEQ ID NO: 1938 - protein, 329 aa, Staphylococcus aureus
  MISC_FEATURE (1)..(329): conserved hypothetical
MAYNYLFYVSWYKIYTNRRDSMNIVGHHHISMYTKDAKRNKDFYTNVLGLRLVEKSVNQDNPSMYHLFYGDEVGTAGTILSFFEIPNAGHKQPGTETIYRFSLLVPNQAALHYFEKRLENNGIKSERLYYLGQEGVVFKDEDDLEIILLVNDSFEVPHQWQHNAYSEIPQAYQILGIGPVELRVRNAARTVEFLENVLGYRKRDNKSFDVLTLAPQGLYSDFVVIEQQGQRERPGRGYIHHIAVNTPQMSDLDAIYKKLQQQPQSNSGIIDRYFFKSLYYRHNSIMYEFATEAPGFTIDTPVEQLGSQLNLPDFLEAEREQIESKLHEI

SEQ ID NO: 1939 - DNA, 1356 bp, Staphylococcus aureus
atgaattttcttaaacctgcaaagcatattaagcctttgccagaaaatcagatagatgatacctataaacgattacgtctccaagtatttcttggtattttcatcggttacgctgggtactatttattacgtaaaaacttttcgttagcgatgccggcattgcaagagcaaggttttacaaaagcggaactaggttttgcactttctgctgtttccatcgcatatggatttagtaagttctttatgggtactgtaagtgatcggagcaatgctcggatattcttagttcttggattagcactcactgctatcgtcaatttgttaatgggatttgtaccgttctttacatcaggtatcggtattatgtttgtcctattattcttaaatggatggtttcaaggtatgggctggccaccttcaggccgtgttctcgttcactggtttagtgtaagtgaacgcggaagtaagactgccctttggaacgttgcgcataatgttggtggaggtattatggcacctattgctgcttggggtattacaacaactgcatttatcaactttggttatttaaaaggtttcgaaggtgtattcatttaccctgcactcttagcacttatcattgccgcaatttcatacgtattgattagagacacacctcaatctcaaggtttacctccaatcgaaatttataaaaatgactttgctacaagcgataagaaaacattagaaacagaattaactacaaaagaaattttatttaaatatgtactgaacaataaatgggtatgggcaattgcctttgcaaatatatttgtttatttcgtgcgttatggtgtacttgattgggcgccagtctacttaagtgaagaaaaacatttcgacttaaaagcatcaggttgggcatacttcttatacgaatgggctggaattcctggtacattattatgtggttacatttctgataaattattcaaaggtcgtcgtggacctgcaggtttcttctttatgttaggtgtcacagtatttgtattaatttattggttaaatcctccaggcaatgcttggttagacaatgtctcattaattgccattggtttcttaatatatggaccagttatgttaattggtttacaagcattagattatgtacctaaaaaagcagctggcacagcagctggattaacaggattatttggttatctgtttggtgctgtaatggccaacatcgtcttaggtgctgtagttgataaattcggatgggatgtcggttttattttattaacagcaattagtgtgtttgcaatgttgagctttatcctcacttggaataaagtaggacaagaaaccgttcatcat

SEQ ID NO: 1940 - protein, 452 aa, Staphylococcus aureus
  MISC_FEATURE (1)..(452): glycerol-3-phosphate
MNFLKPAKHIKPLPENQIDDTYKRLRLQVFLGIFIGYAGYYLLRKNFSLAMPALQEQGFTKAELGFALSAVSIAYGFSKFFMGTVSDRSNARIFLVLGLALTAIVNLLMGFVPFFTSGIGIMFVLLFLNGWFQGMGWPPSGRVLVHWFSVSERGSKTALWNVAHNVGGGIMAPIAAWGITTTAFINFGYLKGFEGVFIYPALLALIIAAISYVLIRDTPQSQGLPPIEIYKNDFATSDKKTLETELTTKEILFKYVLNNKWVWAIAFANIFVYFVRYGVLDWAPVYLSEEKHFDLKASGWAYFLYEWAGIPGTLLCGYISDKLFKGRRGPAGFFFMLGVTVFVLIYWLNPPGNAWLDNVSLIAIGFLIYGPVMLIGLQALDYVPKKAAGTAAGLTGLFGYLFGAVMANIVLGAVVDKFGWDVGFILLTAISVFAMLSFILTWNKVGQETVHH

SEQ ID NO: 1941 - DNA, 438 bp, Staphylococcus aureus
atgtgtaaatctaaaatactgttgaaaaatatttttagtgaagaatcagaagttaaagatttaactgaagaaaaatataatcaagattacgaagcattaacatttagctttaaagaggaaacatatcaaagtaggttagctaagaaaacaccgactaaatcgggatatttcgtgacatgttggacaaaagacgaagataattataatcggccatacaaaattgaagagtttgctgattacctgattgttgctgttatcgatgatgaattaaatggctactttctatttcctagggaattattggtagaaaaaggtatcttagcttcatctaagtatcaagggaaaatggcttttagagtttatcctaagtggtgtaatcaattgaataaaacagcagggcaaacacaaaagtggcaatgtaaatatttttttgaatac

SEQ ID NO: 1942 - protein, 146 aa, Staphylococcus aureus
  MISC_FEATURE (1)..(146): hypothetical protein
MCKSKILLKNIFSEESEVKDLTEEKYNQDYEALTFSFKEETYQSRLAKKTPTKSGYFVTCWTKDEDNYNRPYKIEEFADYLIVAVIDDELNGYFLFPRELLVEKGILASSKYQGKMAFRVYPKWCNQLNKTAGQTQKWQCKYFFEY

SEQ ID NO: 1943 - DNA, 246 bp, Staphylococcus aureus
ttgctaatattaaaaataaaagaaattaatgataaaagtgttacatataaatattttcctaataatgatgaaaatattaagcctggtattattcaaatggatatagatagtcttgaagttatcaatgctgaaaaatctagtttagaaaaaaatacaagagataattattttattcatgccatagacagaatatacataaatactagtaaagggctatttcctgaatctgaactcgtagcatgggga

SEQ ID NO: 1944 - protein, 82 aa, Staphylococcus aureus
LLILKIKEINDKSVTYKYFPNNDENIKPGIIQMDIDSLEVINAEKSSLEKNTRDNYFIHAIDRIYINTSKGLFPESELVAWG

SEQ ID NO: 1945 - DNA, 1353 bp, Staphylococcus aureus
atgaaagacgaacaattatattattttgagaaatcgccagtatttaaagcgatgatgcatttctcattgccaatgatgatagggactttattaagcgttatttatggcatattaaatatttactttataggatttttagaagatagccacatgatttctgctatctctctaacactgccagtatttgctatcttaatggggttaggtaatttatttggcgttggtgcaggaacttatatttcacgtttattaggtgcgaaagactatagtaagagtaaatttgtaagtagtttctctatttatggtggtattgcactaggacttatcgtgattttagttactttaccattcagtgatcaaatcgcagcaattttaggggcgagaggtgaaacgttagctttaacaagtaattatttgaaagtaatgtttttaagtgcaccttttgtaattttgttcttcatattagaacaatttgcacgtgcaattggggcaccaatggtttctatgattggtatgttagctagtgtaggcttaaatattattttagatccaattttaatttttggttttgatttaaacgttgttggtgcagctttgggtactgcaatcagtaatgttgctgctgctctgttctttatcatttattttatgaaaaatagtgacgttgtgtcagttaatattaaacttgcgaaacctaataaagaaatgctttctgaaatctttaaaatcggtattcctgcatttttaatgagtatcttaatgggattcacaggattagttttaaatttatttttagcacattatggaaacttcgcgattgcaagttatggtatctcatttagacttgtgcaatttccagaacttattatcatgggattatgtgaaggtgttgtaccactaattgcatataactttatggcaaataaaggccgtatgaaagacgttatcaaagcagttatcatgtctatcggcgttatctttgttgtatgtatgagtgctgtatttacaattggacatcatatggtcggactatttactactgatcaagccattgttgagatggcgacatttattttgaaagtaacaatggcatcattattattaaatggtataggtttcttgtttactggtatgcttcaagcgactgggcaaggtcgtggtgctacaattatggccattttacaaggtgcaattatcattccagtattatttattatgaatgctttgtttggactaacaggtgtcatttggtcattattaattgctgagtcactttgtgctttagcagcaatgttaatcgtctatttattacgtgatcgtttgacagttgatacatctgaattaatagaaggt

SEQ ID NO: 1946 - protein, 451 aa, Staphylococcus aureus
  MISC_FEATURE (1)..(451): conserved hypothetical
MKDEQLYYFEKSPVFKAMMHFSLPMMIGTLLSVIYGILNIYFIGFLEDSHMISAISLTLPVFAILMGLGNLFGVGAGTYISRLLGAKDYSKSKFVSSFSIYGGIALGLIVILVTLPFSDQIAAILGARGETLALTSNYLKVMFLSAPFVILFFILEQFARAIGAPMVSMIGMLASVGLNIILDPILIFGFDLNVVGAALGTAISNVAAALFFIIYFMKNSDVVSVNIKLAKPNKEMLSEIFKIGIPAFLMSILMGFTGLVLNLFLAHYGNFAIASYGISFRLVQFPELIIMGLCEGVVPLIAYNFMANKGRMKDVIKAVIMSIGVIFVVCMSAVFTIGHHMVGLFTTDQAIVEMATFILKVTMASLLLNGIGFLFTGMLQATGQGRGATIMAILQGAIIIPVLFIMNALFGLTGVIWSLLIAESLCALAAMLIVYLLRDRLTVDTSELIEG

SEQ ID NO: 1947 - DNA, 417 bp, Staphylococcus aureus
atggaattcacttattcgtatttatttagaatgattagtcatgagatgaaacaaaaggctgatcaaaagttagagcaatttgatattacaaatgagcaaggtcatacgttaggttatctttatgcacatcaacaagatggactgacacaaaatgatattgctaaagcattacaacgaacaggtccaactgtcagtaatttattaaggaaccttgaacgtaaaaagctgatctatcgctatgtcgatgcacaagatacgagaagaaagaatatagggctgactacctctgggattaaactcgtagaagcattcacttcgatatttgatgaaatggaacaaacactcgtatcgcagttatctgaagaagaaaatgaacaaatgaaagcaaacttaactaaaatgttatctagtttacaa

SEQ ID NO: 1948 - protein, 139 aa, Staphylococcus aureus
  MISC_FEATURE (1)..(139): hypothetical protein
MEFTYSYLFRMISHEMKQKADQKLEQFDITNEQGHTLGYLYAHQQDGLTQNDIAKALQRTGPTVSNLLRNLERKKLIYRYVDAQDTRRKNIGLTTSGIKLVEAFTSIFDEMEQTLVSQLSEEENEQMKANLTKMLSSLQ

SEQ ID NO: 1949 - DNA, 1953 bp, Staphylococcus aureus
ttgttaagttatagacaaatcgaaattttgtatcttttaattcatgagcaaacgtttattccaatcaataccattgctaatcaacttggtgtatcacctcgtaccattcaatatgatatagcatatattgagcaatatgctgaaacttatcattaccaagtcagccgtaataaagctgcaggcatcaaagtaacaacagctcacgcgacactattaaatgaattagagcacaatctaacaaatcaaattcatttttcaaaagatgaacgactcacacatatcgctttaaagttattcgaaacaaccgatcctgtttcaacaaagcaacttgcgcaagatgttaatgtttcgcgtcggacaattgcagatgatattaaaatgattcaagcccaactagatcaataccatttaaagttaaattatgtccacaataaaggattcaatattattggtgaggaagatcattatcgtaaagcgtatgcacactttatacatcaatatatgaaacaagctgcaccttttatagaggcggatatctttaattcagaatcaatcgcattggttcgccgtgccattattaagacattaaatagtgaaaattatcatttagttcagtcggctatcgatggcttaatctatcatatactcattgccattcagcgtttaaatgaaaatttttcgttcgatatacctatcaatgaaattgataaatggcgacatactaatcagtatgctattgcttcaaaaatgatagaaaacttagaacgcagttgtaatgtcacatttccagagtctgaaattatctttatcacgttacatttactaggctctaaaatgactgaacatacagcatcttcaattacctttgaataccatgatttatcgcaaaatatacatgaattgatcacttgtgttagccaagaattaggcattgatatgtcaaaagacaacaagttacataccagtctgatcacacatatcaaaccagctatacatcgtattaaatacgatatgctacaacctaatcctttgaggcaagaagttatgcgtcgctatcctcaaatcattgaagccgttagcaagcatattagtccaattgaacaagatgctgctattcgcttcaacgaagatgaattaacatacattacaattcacttcgcatcaagtatagagcgtgttgcaacacataaacaatcaatgattaaggttgtcttactatgtggttctggtataggcacgtcacaacttttaaaatcaaaactaaatcacctgtatcctgagtttcacatttgggatgcctattccatttatcaattggaagaaagtcgattattgcaagataacattgattatgtcatttcaacagtaccttgtgaaatatcagctgtaccagttattcatgtcgatccatttatcaatcaacaatctcgtcaaaaattgaatcaaattatcaatgactcaagagaacaacgagtcatgaaaatggcaactgatggcaagtcactcgcagatttattgcctgaacatcgcatcattataaataaacaaccattatcaattgaatccgcaattgcagtggctgtgcaacctttaatcaatgatggcattgtctattcaaattatacagctgcaattttaaaacaatttgaacaattcgggtcatatatggtcattagtccacatattgcacttattcacgctggtactgattatgtacagaatggtgtaggtttcgcactaacatatttcactgaagggattatctttggtagtaaagctaacgatcccgttcaccttgtaattacattagcaacggaccaccccaatgcacatttaaaggcattgggacagttaagcgaatgcttaagcaacgacttatatcgacaagatttcttagatgggaatatttttaaaattaaacaacacattgctttaactatgacaaaggaggct

SEQ ID NO: 1950 - protein, 651 aa, Staphylococcus aureus
  MISC_FEATURE (1)..(651): hypothetical protein
LLSYRQIEILYLLIHEQTFIPINTIANQLGVSPRTIQYDIAYIEQYAETYHYQVSRNKAAGIKVTTAHATLLNELEHNLTNQIHFSKDERLTHIALKLFETTDPVSTKQLAQDVNVSRRTIADDIKMIQAQLDQYHLKLNYVHNKGFNIIGEEDHYRKAYAHFIHQYMKQAAPFIEADIFNSESIALVRRAIIKTLNSENYHLVQSAIDGLIYHILIAIQRLNENFSFDIPINEIDKWRHTNQYAIASKMIENLERSCNVTFPESEIIFITLHLLGSKMTEHTASSITFEYHDLSQNIHELITCVSQELGIDMSKDNKLHTSLITHIKPAIHRIKYDMLQPNPLRQEVMRRYPQIIEAVSKHISPIEQDAAIRFNEDELTYITIHFASSIERVATHKQSMIKVVLLCGSGIGTSQLLKSKLNHLYPEFHIWDAYSIYQLEESRLLQDNIDYVISTVPCEISAVPVIHVDPFINQQSRQKLNQIINDSREQRVMKMATDGKSLADLLPEHRIIINKQPLSIESAIAVAVQPLINDGIVYSNYTAAILKQFEQFGSYMVISPHIALIHAGTDYVQNGVGFALTYFTEGIIFGSKANDPVHLVITLATDHPNAHLKALGQLSECLSNDLYRQDFLDGNIFKIKQHIALTMTKEA

SEQ ID NO: 1951 - DNA, 441 bp, Staphylococcus aureus
gtgtcattagacattttgtcaacaacacgcatcattgtaaaagaacaagtaaatgattggactgaagctataactatagcttctcagccattactacaagaacaaattattgaacaaggctatgttcaagcaatgattgatagcgttaatgaacttggaccttatatcgttatcgcacctgaaattgcaattgcacatgcaagaccgaacaatgacgtacatcaagttggtttaagtctattaaagttgaatcaacatgtggcattttgtgatgaagatcactacgcatctctcatttttgtattgagtgccatcgacaatcattcacacttatctgtattacaaaatttagcaaccgtactgggcgataaccaaacagtccagcaactattaactgcaacaaatgcacaagacattaaaaacattttaaaggagcatgat

SEQ ID NO: 1952 - protein, 147 aa, Staphylococcus aureus
  MISC_FEATURE (1)..(147): hypothetical protein
VSLDILSTTRIIVKEQVNDWTEAITIASQPLLQEQIIEQGYVQAMIDSVNELGPYIVIAPEIAIAHARPNNDVHQVGLSLLKLNQHVAFCDEDHYASLIFVLSAIDNHSHLSVLQNLATVLGDNQTVQQLLTATNAQDIKNILKEHD

SEQ ID NO: 1953 - DNA, 291 bp, Staphylococcus aureus
atgattaatatgaaaattttagtagtatgtggccacggtttaggaagtagttttatggtagaaatgaacgcacaagaagcacttaggcaacttaatgcaccatctgatatcgaagttgaacatagtgacattatgacagcaagtccagagatggctgacttgtttatttgtggtagagatttagctgaaaatgccgaacgtctaggggatgtcttagttcttgataatattttagataaagctgaattacaacaaaagctctcagaaaaattacaacaacttaacatgatt

SEQ ID NO: 1954 - protein, 97 aa, Staphylococcus aureus
  MISC_FEATURE (1)..(97): conserved hypothetical
MINMKILVVCGHGLGSSFMVEMNAQEALRQLNAPSDIEVEHSDIMTASPEMADLFICGRDLAENAERLGDVLVLDNILDKAELQQKLSEKLQQLNMI

SEQ ID NO: 1955 - DNA, 1344 bp, Staphylococcus aureus
atgcaagcaatccttaattttatagtcgatattttaagtcaaccagccattcttgttgcactgattgcctttataggtttaatcgttcagaaaaaacctgccgcaacgatcacttcaggaaccattaaaacgatattaggcttcttaattttaagtgcaggtgctgatgtcgtcgttcgatctcttgaaccattcggcaaaatattccaacacgcatttggtgtgcaaggtatcgtacctaacaacgaagctatcgtctcactagccttaaaagattttggaacaacagctgcactcatcatggtctgtggcatgattgttaatattttaattgcccgcttcactaatttaaaatatatctttttaacaggtcatcatacattttacatggctgcgtttttagcaatcattttaacagtcagtcatattaaaggctggctaacgattgttatcggcgcactcgtattaggattaatcatggcagtattacctgcattactccaacctacgatgcgaaaaattacagggaatgaccaagtagctttaggtcattttggctcaatcagttactttgccgcaggtgctgtaggtcaattattcaaaggtaagtctaaatcaacggaagagattaaatttccaaaaggcttaagtttcttacgagaaagtacaattagtatctcgattacgatggcattactttacttcatcgcatgcttatttgcgggcgttagttatgtacacgaatctattagtgatggtcaaaactttattgtcttttcattaattcaaggtgtgacatttgctgctggtgtatttattattttaacgggcgttcgtttaatcttagctgaaatcgtcccagcatttaaaggaatttctgaaaagcttgtaccaaattctaaacctgcattagactgccctattgtgttcccttatgcacaaaatgcagtattaattggattctttgtcagctttattacaggtgtcatcggtatgtttatcttattcttatttggtggcgtcgtcattttacctggcgtagttgcacacttcttcttaggtgcaacggctgctgtattcggtaatgcaagaggcggtattaaaggtgctattgctggcgccgctctaaatggtatcctaatcacgtttttaccattattattcttgccatttttaggcgaattaggtggtgctgcaacaacattctcagatacagactttttagctgtcggtatcgtgttcggtaacgcagtaaaatatatgggattatttggtgcgattctatttattattatcgtaggtgcgacaacaattttattaaaaggccgtcaaaaagaacagcaa

SEQ ID NO: 1956 - protein, 448 aa, Staphylococcus aureus
  MISC_FEATURE (1)..(448): hypothetical protein
MQAILNFIVDILSQPAILVALIAFIGLIVQKKPAATITSGTIKTILGFLILSAGADVVVRSLEPFGKIFQHAFGVQGIVPNNEAIVSLALKDFGTTAALIMVCGMIVNILIARFTNLKYIFLTGHHTFYMAAFLAIILTVSHIKGWLTIVIGALVLGLIMAVLPALLQPTMRKITGNDQVALGHFGSISYFAAGAVGQLFKGKSKSTEEIKFPKGLSFLRESTISISITMALLYFIACLFAGVSYVHESISDGQNFIVFSLIQGVTFAAGVFIILTGVRLILAEIVPAFKGISEKLVPNSKPALDCPIVFPYAQNAVLIGFFVSFITGVIGMFILFLFGGVVILPGVVAHFFLGATAAVFGNARGGIKGAIAGAALNGILITFLPLLFLPFLGELGGAATTFSDTDFLAVGIVFGNAVKYMGLFGAILFIIIVGATTILLKGRQKEQQ

SEQ ID NO: 1957 - DNA, 1026 bp, Staphylococcus aureus
gtgatgaataataaagtattagtaaccggtggtacagggtttgttggcatgcgaattatttcacgattattagaacaaggttatgacgtacaaacgacgatacgtgatttaagtaaagctgataaagtaattaaaacaatgcaagacaatggcatttccacagagcgattaatgtttgtcgaagcggatttatcacaagatgaacattgggatgaagcaatgaaagattgcaagtatgtcttgagtgtagcatctccggtgtttttcggtaaaacagacgatgcagaagtgatggcgaagcctgcaattgaaggtatacaacgtattttaagagctgcagaacatgcgggtgttaaacgtgtggtaatgactgcaaactttggtgcagttggttttagtaataaagataaaaattcaatcacaaatgaaagtcattggacaaatgaagatgaaccaggcttatcagtatatgaaaaatcaaaattgttagctgaaaaggcagcgtgggattttgttgagaatgaaaatacaacagtagaatttgccacaatcaatccagttgcaatttttgggccatcattagatgcacacgtttcaggaagctttcatttattagaaaatttattgaatggttcaatgaaacgtgtaccgcaaattccgttaaatgttgttgatgtgagagacgtagctgaactgcacattttggcaatgacaaatgaacaagctaatggcaagcgatttattgcgacggctgatggacaaattaatttgttggaaattgcaaaattaattaaagaaaagagacctgaaatagctcaaaaagtttctactaaaaaattaccagactttattttgagtctaggtgctaaatttaatcatcaagctaaagaaggtaaacttttattagatatgaaccgcaatgtaagtaacgaacgtgcaaaaacattacttggttgggaaccgattgcgacacaagaagaagcaattttagcagctgtcgatagtatggctaagtatcatttaata

SEQ ID NO: 1958 - protein, 342 aa, Staphylococcus aureus
  MISC_FEATURE (1)..(342): hypothetical protein
VMNNKVLVTGGTGFVGMRIISRLLEQGYDVQTTIRDLSKADKVIKTMQDNGISTERLMFVEADLSQDEHWDEAMKDCKYVLSVASPVFFGKTDDAEVMAKPAIEGIQRILRAAEHAGVKRVVMTANFGAVGFSNKDKNSITNESHWTNEDEPGLSVYEKSKLLAEKAAWDFVENENTTVEFATINPVAIFGPSLDAHVSGSFHLLENLLNGSMKRVPQIPLNVVDVRDVAELHILAMTNEQANGKRFIATADGQINLLEIAKLIKEKRPEIAQKVSTKKLPDFILSLGAKFNHQAKEGKLLLDMNRNVSNERAKTLLGWEPIATQEEAILAAVDSMAKYHLI

SEQ ID NO: 1959 - DNA, 1035 bp, Staphylococcus aureus
ttggagagacagaagatgtacttaatagaaccgattagaaatggagaatatattactgatggtgcgattgcactcgctatgcaagtttatgttaaccagcatatctttttagatgaagatattttattcccttattattgtgatccaaaagtggaaattggacgttttcaaaatactgctatagaagtgaatcaagattatatagataaacacagtattcaagtagttcgccgagatactggtggtggcgctgtgtatgttgataaaggtgccgttaatatgtgttgtattttagaacaagacacttcaatttatggtgattttcaacgattttatcaaccagctataaaggcgttgcatacattaggtgcaacagatgtggtacaaagcggtagaaatgatttaacattgaatggtaaaaaagtgtcaggcgccgcaatgacattaatgaataatcgtatttatggcggttattcgctattacttgatgttaattatgaagcaatggataaagtgttaaagcctaatcgcaaaaagattgcatcgaaagggattaaatctgtgcgcgcacgtgttggtcatcttagagaagcactggatgaaaagtatcgtgatataaccattgaagaatttaaaaatttaatggtgacgcagattttgggaatcgatgacattaaagaggcgaaacgatatgaattaacggatgcagattgggaagcgattgatgaattagctgataaaaagtataaaaattgggattggaattatggcaagtcacccaaatatgaatacaatcgaagtgaaagattatcttcaggtacggtagacataacaatttctgttgaacaaaatcgtatcgcagattgtcgtatttatggggatttctttggacaaggtgatataaaagatgtggaagaagcattacaaggaacaaaaatgacaagagaagatttaacgcatcagttaaagcaattagacatcgtttattattttggcaatgttacggtagaagcattagtggatatgattttaagt

SEQ ID NO: 1960 - protein, 345 aa, Staphylococcus aureus
  MISC_FEATURE (1)..(345): hypothetical protein
LERQKMYLIEPIRNGEYITDGAIALAMQVYVNQHIFLDEDILFPYYCDPKVEIGRFQNTAIEVNQDYIDKHSIQVVRRDTGGGAVYVDKGAVNMCCILEQDTSIYGDFQRFYQPAIKALHTLGATDVVQSGRNDLTLNGKKVSGAAMTLMNNRIYGGYSLLLDVNYEAMDKVLKPNRKKIASKGIKSVRARVGHLREALDEKYRDITIEEFKNLMVTQILGIDDIKEAKRYELTDADWEAIDELADKKYKNWDWNYGKSPKYEYNRSERLSSGTVDITISVEQNRIADCRIYGDFFGQGDIKDVEEALQGTKMTREDLTHQLKQLDIVYYFGNVTVEALVDMILS

SEQ ID NO: 1961 - DNA, 993 bp, Staphylococcus aureus
atgtatttacagataaggatttacaactgtataaggaggcatttaaccgtgatgcagagtagtaagtggaatgcaatgtctctgttaatggatgacaagacaaagcaggctgaagtattgcgtactgcgattgatgaagcagatgcgatagtgattggaattggtgcaggcatgtctgcatctgacggatttacatatgtaggagagcgttttacggaaaatttcccagattttattgaaaaatatcgcttctttgatatgttgcaagcgagtttacatccttatggcagttggcaagagtattgggcatttgagagtcgttttattacattaaactatttagatcaacctgtaggtcagtcttacctcgctttaaaatccttggtggaaggtaaacagtaccacattataactacgaatgcagataatgctttcgatgtagctgattatgatatgactcatgtatttcatatacaaggggagtatatactgcaacagtgtagtcagcattgtcatgctcaaacgtatcgcaatgatgatttaattcgtaaaatggttgttgcgcaacaagatatgcttataccttgggagatgattccaagatgtccaaaatgtgatgccccaatggaagtgaataaacgtaaagcggaagttgggatggttgaagatgctgaatttcatgcgcaactacatcgttataatgcttttctagagcaacatcaagatgataaagtgttgtatttggaaattggaattggttatactacaccacaatttgtgaagcatccttttcagcgtatgacacgtaaaaatgaaaatgccctttatatgacgatgaataaaaaggcatatcgcattccgaattcaattcaagaacgtaccatacatttaactgaggatatctcaacattgattacagcagcactccggaacgacagcacaacgaaaaataacaacattggagagacagaagatgtacttaatagaaccgat

SEQ ID NO: 1962 - protein, 331 aa, Staphylococcus aureus
  MISC_FEATURE (1)..(331): hypothetical protein
MYLQIRIYNCIRRHLTVMQSSKWNAMSLLMDDKTKQAEVLRTAIDEADAIVIGIGAGMSASDGFTYVGERFTENFPDFIEKYRFFDMLQASLHPYGSWQEYWAFESRFITLNYLDQPVGQSYLALKSLVEGKQYHIITTNADNAFDVADYDMTHVFHIQGEYILQQCSQHCHAQTYRNDDLIRKMVVAQQDMLIPWEMIPRCPKCDAPMEVNKRKAEVGMVEDAEFHAQLHRYNAFLEQHQDDKVLYLEIGIGYTTPQFVKHPFQRMTRKNENALYMTMNKKAYRIPNSIQERTIHLTEDISTLITAALRNDSTTKNNNIGETEDVLNRTD

SEQ ID NO: 1963 - DNA, 747 bp, Staphylococcus aureus
atgcatcgagagagaaatgacaatgacgtattggtaatgccatcttcatttgaagatttgtgggaattatatcgaggcttagcaaatgtcagaccggcattacctgtaagtgatgaatatttagctgtacaagatgctatgttaagtgatttgaatcgtcaacatgttacggatttgaaggatttgaagccgataaaaggtgacaatatctttgtttggcaaggtgatatcacgacgttaaaaatcgatgctattgttaatgctgcaaatagtcgttttctaggatgtatgcaagctaatcatgactgcattgataatattattcatacaaaagcgggtgttcaagttcgacttgattgtgcagagatcattcgacaacaagggcgcaatgaaggtgtaggtaaagccaaaataacacgtggatataatttgccagcaaagtatataattcatacggttggtccgcaaatacgtcgattgcctgtttcaaagatgaatcaggacttgttagctaaatgttatcttagctgtcttaaattggctgatcaacatagtttaaatcatgtcgctttttgctgtatatctacaggtgtatttgcttttcctcaagatgaagcagcagaaattgctgttcgaacagtagaaagctatctcaaagaaacaaattcaacattgaaagtcgtgttcaatgtatttacagataaggatttacaactgtataaggaggcatttaaccgtgatgcagag

SEQ ID NO: 1964 - protein, 249 aa, Staphylococcus aureus
  MISC_FEATURE (1)..(249): conserved hypothetical
MHRERNDNDVLVMPSSFEDLWELYRGLANVRPALPVSDEYLAVQDAMLSDLNRQHVTDLKDLKPIKGDNIFVWQGDITTLKIDAIVNAANSRFLGCMQANHDCIDNIIHTKAGVQVRLDCAEIIRQQGRNEGVGKAKITRGYNLPAKYIIHTVGPQIRRLPVSKMNQDLLAKCYLSCLKLADQHSLNHVAFCCISTGVFAFPQDEAAEIAVRTVESYLKETNSTLKVVFNVFTDKDLQLYKEAFNRDAE

SEQ ID NO: 1965 - DNA, 582 bp, Staphylococcus aureus
atgcttttttcattattcgttgaaaaagaagagtcacaaaagttaacatatttaaaagaacttggtgaagatggcgaatataaatatgttgccaaaatagatagtaaaacatctaaattatgtcattcactcaacggaaaaatatttaaagttaaagatatgataccaggtgtgaatgcgccacctatgcatccttggtgtagaagtaccacagtgccacatgtcggcaattggcgagacaagttctttaaagagcgtgaaggtaaatatcaagtagaaggttgttttattgaatcaggtgcacttaataataaaagtgatgaatacggtatcaaaaggaacagacatgctcaaatttattataattcagttagaaatcgagataaacagatagagatttctaaaattgctaaaaatactaatataaataaaaatttaattcaaagagtttatgaacatatatttgaaaataagtatttattagaaagtggatttaaacaatttgatcctgacttttatatggctcaaagttggcaacgtttaagagaagggaaaaatattaaaaaaatggatataataatg

SEQ ID NO: 1966 - protein, 194 aa, Staphylococcus aureus
  MISC_FEATURE (1)..(194): hypothetical protein
MLFSLFVEKEESQKLTYLKELGEDGEYKYVAKIDSKTSKLCHSLNGKIFKVKDMIPGVNAPPMHPWCRSTTVPHVGNWRDKFFKEREGKYQVEGCFIESGALNNKSDEYGIKRNRHAQIYYNSVRNRDKQIEISKIAKNTNINKNLIQRVYEHIFENKYLLESGFKQFDPDFYMAQSWQRLREGKNIKKMDIIM

SEQ ID NO: 1967 - DNA, 330 bp, Staphylococcus aureus
atgaaaaagttagccaattatttatgggtagaaaaagtaggagatttgtatgtgtttagtatgacacctgaattgcaagatgatattgggacagtaggttatgttgaattcgtaagtccagatgaagttaaagtggatgatgaaattgtgagtatcgaagcatcgaaaacggtcattgatgtgcaaacgccattgtcaggaacgattattgagcgaaatacaaaagcggaagaagaaccgacaattttaaactctgaaaaaccagaagaaaattggttgttcaaattggatgatgtcgataaagaagcattcctagcattaccggaggct

SEQ ID NO: 1968 - protein, 110 aa, Staphylococcus aureus
  MISC_FEATURE (1)..(110): hypothetical protein
MKKLANYLWVEKVGDLYVFSMTPELQDDIGTVGYVEFVSPDEVKVDDEIVSIEASKTVIDVQTPLSGTIIERNTKAEEEPTILNSEKPEENWLFKLDDVDKEAFLALPEA

SEQ ID NO: 1969 - DNA, 999 bp, Staphylococcus aureus
ttggttaaattaagcgtattagactatgccttaatagatgaaggtaaggatgcacaaaaggcattgcaagattcagtgacacttgcaaaattagcagatcgacttggctttaagcgaatttggtttacggaacatcataatgtaccagcgtttgcgtgtagtagtccagaacttttgatgatgcatacattggcgcagacaaatcacatacgagttggctctggtggtgtgatgctgccgcactatcgaccttataaaattgctgagcattttagaatgatggcagcgttatatccaaatcgtattgatttaggtattggtaataatccaggtactactatggtaaagcaagctttagatggaataaatcctacatatgatagttacgatgaatcgatttcgttattacgtgattatcttacaataaaggataaaccaagtgcgcatacgttaggtgtccaaccacacattgatcattttccagaaatgtggttattaagtagtagcgcaacatctgccaaaatagctgccgaactaggtatagggctttctgttggaacatttttgctaccagatataaatgcgatacatacagcgaaggataacattgatatttacaaaaaacatttccaagcatcaacgattaaaatggacgcaaaggtgatggcatctgtatttgtcattgtagctgataacgaagcggaagtagcagcattacaacatgccttagatgtttggttattaggtaaattacaatttgcagaatttgaagattttccttcagtagacacagcacaaaagtataagcttaatgatcgagacaaagagatgattcaagcacatcaagcacgcatcattgcaggtacacaagaaaaggttaaagcacaattagatgatttcattgctacgtttgaagttgatgaggtgttagtagcaccgcttattccaggtattgaacagcgttgtaaaacattaaaattactcgcggaaatttatttg

SEQ ID NO: 1970 - protein, 333 aa, Staphylococcus aureus
  MISC_FEATURE (1)..(333): hypothetical protein
LVKLSVLDYALIDEGKDAQKALQDSVTLAKLADRLGFKRIWFTEHHNVPAFACSSPELLMMHTLAQTNHIRVGSGGVMLPHYRPYKIAEHFRMMAALYPNRIDLGIGNNPGTTMVKQALDGINPTYDSYDESISLLRDYLTIKDKPSAHTLGVQPHIDHFPEMWLLSSSATSAKIAAELGIGLSVGTFLLPDINAIHTAKDNIDIYKKHFQASTIKMDAKVMASVFVIVADNEAEVAALQHALDVWLLGKLQFAEFEDFPSVDTAQKYKLNDRDKEMIQAHQARIIAGTQEKVKAQLDDFIATFEVDEVLVAPLIPGIEQRCKTLKLLAEIYL

SEQ ID NO: 1971 - DNA, 90 bp, Staphylococcus aureus
atggaaagtatttttaaaattaaactaatgaatggcatttgtaggtctgaaaatatgaatatgaaaaagaaaaataaaggcgaaaagata

SEQ ID NO: 1972 - protein, 30 aa, Staphylococcus aureus
MESIFKIKLMNGICRSENMNMKKKNKGEKI

SEQ ID NO: 1973 - DNA, 1197 bp, Staphylococcus aureus
atgtaccgatacaaaccacttttacaatcaatccacttacctaatggcatcaaaatttcgaatcgctttgtattatcaccaatgaccgtaaacacatcaacaaaagaaggctatattacaaaagaagacttggcttatgctgcacgtcgctctaattcagctggaatgcaagtcaccggcgctgcttacattgaaccttatggtcaattgtttgaatatggctttaatattgatcatgatgcttgtatccctggattaactaacatggcatctacgatgaaacaacatggtagcctcgctattatccagctagcgcatgctggtcgtttttcaaatcaagccattttaaattttggaaaggtgtatggaccaagccctatgacattgcattcaccgattgaacacgatgttatcgccatgtctcatgagaaaatcaatagcatcattcagcagtatcgcgatgctacattacgcgcgattaaagcaggttttgatggtgtggaaatttcgattgcacaacgtttgctgattcaaacatttttctcaactttttcgaataaacgtacagaccattacggtgccgactcattaaaaaatcgtgcaagattatgtttagaagttatgcgtgcggtacaagaagtgattgataaagaagcacctgacaattttattttaggatttcgagcaacgccagaagaaaccagaggcagtgatttaggatataccattgacgagttcaaccaattaatcaattgggtcatggacgtttcaaacatccaatacttagcaatcgctagctggggtcgacatatttatcaaaatacgtctcgtacaccaggtgatcatttcggtcgaccagttaaccaaattgtctatgaacatttagcaggtcgtatccctttaattgcaagtggcgggattaattctccagagtctgctttagatgctttacaacatgcagatatggtcggcatgtcttcgccttttgtcacagaacctgactttgtgcataaacttgctgaacagcgaccacatgatatcaatcttgaattttctatggcagatttagaagatttagccattccacatgctgcttttaaagatattgttaaaatgatggattatggggaaggtctaaagaagcatacccgtgacgctttacgtcaattggaacagaattatcatgactcatcgtct

SEQ ID NO: 1974 - protein, 399 aa, Staphylococcus aureus
  MISC_FEATURE (1)..(399): hypothetical protein
MYRYKPLLQSIHLPNGIKISNRFVLSPMTVNTSTKEGYITKEDLAYAARRSNSAGMQVTGAAYIEPYGQLFEYGFNIDHDACIPGLTNMASTMKQHGSLAIIQLAHAGRFSNQAILNFGKVYGPSPMTLHSPIEHDVIAMSHEKINSIIQQYRDATLRAIKAGFDGVEISIAQRLLIQTFFSTFSNKRTDHYGADSLKNRARLCLEVMRAVQEVIDKEAPDNFILGFRATPEETRGSDLGYTIDEFNQLINWVMDVSNIQYLAIASWGRHIYQNTSRTPGDHFGRPVNQIVYEHLAGRIPLIASGGINSPESALDALQHADMVGMSSPFVTEPDFVHKLAEQRPHDINLEFSMADLEDLAIPHAAFKDIVKMMDYGEGLKKHTRDALRQLEQNYHDSSS

SEQ ID NO: 1975 - DNA, 825 bp, Staphylococcus aureus
gtgactgaaattaaagataaagtaattactaaagatgcatttgcattaccttacacaattattaaagcaaaaaatcaaccaacaaaaggcgctattgtctacatccacggtggtggattaatgttcggtaaagctaacgatttatccccacagtatatcgatatccttacggaacattacgatttaattcaactaagttatcgtttattaccagaagtaagtctcgattgcattattgaggatgtctacgcatcattcgatgcgattcaatcacaatattctaattgccctatttttacctttggcagatcatcaggtgcatatttaagtctattaattgcacgagacagagatattgatggtgttattgatttttatggttatagtcgcatcaacactgaaccttttaaaacaactaatagttattacgcaaaaatagctcaaagcgtaaacgaaacaatgattgcacaactcacttcaccaacaccggttgttcaagatcaaatcgcacaacgttttttaatctacgtttatgcacgtggcacaggtaaatggataaatatgattaacattgctgattatactaattcaaaatataatattgcaccagatgaacttaaaacacttccacctgttttcattgcgcattgtaatggcgattatgatgttcccgttgaggaaagcgaacatatcatgaatcatgttccacattcaacatttgaacgcgtgaataaaaacgagcatgattttgatcgtagacctaatgacgaagcaatcactatttatcgtaaagttgttgatttcttaaacgctataacaatgatg

SEQ ID NO: 1976 - protein, 275 aa, Staphylococcus aureus
  MISC_FEATURE (1)..(275): hypothetical protein
VTEIKDKVITKDAFALPYTIIKAKNQPTKGAIVYIHGGGLMFGKANDLSPQYIDILTEHYDLIQLSYRLLPEVSLDCIIEDVYASFDAIQSQYSNCPIFTFGRSSGAYLSLLIARDRDIDGVIDFYGYSRINTEPFKTTNSYYAKIAQSVNETMIAQLTSPTPVVQDQIAQRFLIYVYARGTGKWINMINIADYTNSKYNIAPDELKTLPPVFIAHCNGDYDVPVEESEHIMNHVPHSTFERVNKNEHDFDRRPNDEAITIYRKVVDFLNAITMM

SEQ ID NO: 1977 - DNA, 2070 bp, Staphylococcus aureus
atgttaagaggacaagaagaaagaaagtatagtattagaaagtattcaataggcgtggtgtcagtgttagcggctacaatgtttgttgtgtcatcacatgaagcacaagcctcggaaaaaacatcaactaatgcagcggcacaaaaagaaacactaaatcaaccgggagaacaagggaatgcgataacgtcacatcaaatgcagtcaggaaagcaattagacgatatgcataaagagaatggtaaaagtggaacagtgacagaaggtaaagatacgcttcaatcatcgaagcatcaatcaacacaaaatagtaaaacaatcagaacgcaaaatgataatcaagtaaagcaagattctgaacgacaaggttctaaacagtcacaccaaaataatgcgactaataatactgaacgtcaaaatgatcaggttcaaaatacccatcatgctgaacgtaatggatcacaatcgacaacgtcacaatcgaatgatgttgataaatcacaaccatccattccggcacaaaaggtaatacccaatcatgataaagcagcaccaacttcaactacacccccgtctaatgataaaactgcacctaaatcaacaaaagcacaagatgcaaccacggacaaacatccaaatcaacaagatacacatcaacctgcgcatcaaatcatagatgcaaagcaagatgatactgttcgccaaagtgaacagaaaccacaagttggcgatttaagtaaacatatcgatggtcaaaattccccagagaaaccgacagataaaaatactgataataaacaactaatcaaagatgcgcttcaagcgcctaaaacacgttcgactacaaatgcagcagcagatgctaaaaaggttcgaccacttaaagcgaatcaagtacaaccacttaacaaatatccagttgtttttgtacatggatttttaggattagtaggcgataatgcacctgctttatatccaaattattggggtggaaataaatttaaagttatcgaagaattgagaaagcaaggctataatgtacatcaagcaagtgtaagtgcatttggtagtaactatgatcgcgctgtagaactttattattacattaaaggtggtcgcgtagattatggcgcagcacatgcagctaaatacggacatgagcgctatggtaagacttataaaggaatcatgcctaattgggaacctggtaaaaaggtacatcttgtagggcatagtatgggtggtcaaacaattcgtttaatggaagagtttttaagaaatggtaacaaagaagaaattgcctatcataaagcgcatggtggagaaatatcaccattattcactggtggtcataacaatatggttgcatcaatcacaacattagcaacaccacataatggttcacaagcagctgataagtttggaaatacagaagctgttagaaaaatcatgttcgctttaaatcgatttatgggtaacaagtattcgaatatcgatttaggattaacgcaatggggctttaaacaattaccaaatgagagttacattgactatataaaacgcgttagtaaaagcaaaatttggacatcagacgacaatgctgcctatgatttaacgttagatggctctgcaaaattgaacaacatgacaagtatgaatcctaatattacgtatacgacttatacaggtgtatcatctcatactggtccattaggttatgaaaatcctgatttaggtacatttttcttaatggctacaacgagtagaattattggtcatgatgcaagagaagaatggcgtaaaaatgatggtgtcgtaccagtgatttcgtcattacatccgtccaatcaaccatttgttaatgttacgaatgatgaacctgccacacgcagaggtatctggcaagttaaaccaatcatacaaggatgggatcatgtcgattttatcggtgtggacttcctggatttcaaacgtaaaggtgcagaacttgccaacttctatacaggtattataaatgacttgttgcgtgttgaagcgactgaaagtaaaggaacacaattgaaagcaagt

SEQ ID NO: 1978 - protein, 690 aa, Staphylococcus aureus
  MISC_FEATURE (1)..(690): glycerol ester hydrolase
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 1979 - DNA, 1383 bp, Staphylococcus aureus
atgattcatctcattaaggggaagatgcatcatacagttttgtgtattcatttaaacaaaggggttgctttaatgaatcaatatcattctaatgcacaacaaccaagtgcatggcgtttttttgtctatagtttagtgggcatactatgtttctttattccttttacgattaatggtaacaacactattttcgtcgatcatgttcatctagccattcgctcaatcataggtccacttatgccctatgttgcactgattatgattttaattggtacagcgttaccaatagtgagacgtacttttatgacttcaatcacaaacttggtcattacattatttaaagttgcaggtgcaatgatcggtataatgtatgtatttaaaatcggtccatcaatactatttaaagctaactatggtccgtttttgtttgaaaaattaatgatgccattaagtatcttaattccagtaggtgcaattgcgctttctttattagtgggctatggcttattagaatttgtcggtgtttatatggagcctattatgagacctatttttaaaacaccaggaaaatccgctgtcgatgcagtggcttcgtttgtcggcagttattccttaggattattgattactaatcgtgtctataagcaagggatgtacaacaaacgagaagccacgattattgcgactggcttttcaacagtttcagcaacttttatgattatcgttgctaaaactttaggattaatgccgcattggaatttatacttttggataactttagtcatcacatttgtcgtgactgcaattactgcatggctaccgccaatcagcaatgaatcaacagaatattataacggacaagaaggagaacaagaagttgctattgaaggaagcagactgaaaactgcatatgcagaggcgatgaaacaaaatgcattaacaccatctctcgtgaagaacgtttgggacaatttgaaagacggtttagaaatgactgttggtattttaccttctatattatcgattggttttttaggactgattgtagcgaactatacaccattcattgattggcttggctatatcttctatccatttatttatattttcccaattgctgatcaggctttactagcaaaagcgtcagcgatttctattgtagagatgtttctaccatctttgttagtaactaaagctgcaatgagtactaaatttgtcgtcggtgtagtaagcgtatcagccattatctttttctcagcattagtgccatgtatactagcaactgaaattaaaatacctgtctggaaactcatcatcatttggtttttacgcgtggcgttgtcgctattaatcaccatccccgtcgctttacttatttttgga

SEQ ID NO: 1980 - protein, 461 aa, Staphylococcus aureus
  MISC_FEATURE (1)..(461): conserved hypothetical
MIHLIKGKMHHTVLCIHLNKGVALMNQYHSNAQQPSAWRFFVYSLVGILCFFIPFTINGNNTIFVDHVHLAIRSIIGPLMPYVALIMILIGTALPIVRRTFMTSITNLVITLFKVAGAMIGIMYVFKIGPSILFKANYGPFLFEKLMMPLSILIPVGAIALSLLVGYGLLEFVGVYMEPIMRPIFKTPGKSAVDAVASFVGSYSLGLLITNRVYKQGMYNKREATIIATGFSTVSATFMIIVAKTLGLMPHWNLYFWITLVITFVVTAITAWLPPISNESTEYYNGQEGEQEVAIEGSRLKTAYAEAMKQNALTPSLVKNVWDNLKDGLEMTVGILPSILSIGFLGLIVANYTPFIDWLGYIFYPFIYIFPIADQALLAKASAISIVEMFLPSLLVTKAAMSTKFVVGVVSVSAIIFFSALVPCILATEIKIPVWKLIIIWFLRVALSLLITIPVALLIFG

SEQ ID NO: 1981 - DNA, 666 bp, Staphylococcus aureus
atgttaccacatggattaatagtatcttgtcaggcactaccagatgaaccattgcattcatcttttattatgtcgaaaatggcattagctgcgtatgaaggtggtgctgttggtattcgcgcaaatactaaggaagacattttagcaattaaagaaacggtagatttaccagttattggcattgtgaaacgtgactatgatcactcagatgttttcattactgcaacgtcaaaagaagttgatgaactgatagaaagccaatgtgaagtcattgcattggatgcaacgttacagcaacgtccgaaagaaacgttagacgaattagtatcatatattagaacacatgcaccgaacgttgaaatcatggctgatatcgcgaccgttgaagaagctaaaaatgccgcacgacttggctttgattatattggcacgacgttacatggctatactagttatacgcaaggacaattactttatcaaaatgacttccaatttttaaaagatgtactacaaagtgttgatgcaaaagttattgcggaaggtaatgtcattacaccggatatgtataaacgtgtgatggacttaggcgttcattgttcagtcgttggtggtgcgataacacgaccaaaagaaattacgaaacgttttgttcaaattatggaagat

SEQ ID NO: 1982 - protein, 222 aa, Staphylococcus aureus
  MISC_FEATURE (1)..(222): conserved hypothetical
MLPHGLIVSCQALPDEPLHSSFIMSKMALAAYEGGAVGIRANTKEDILAIKETVDLPVIGIVKRDYDHSDVFITATSKEVDELIESQCEVIALDATLQQRPKETLDELVSYIRTHAPNVEIMADIATVEEAKNAARLGFDYIGTTLHGYTSYTQGQLLYQNDFQFLKDVLQSVDAKVIAEGNVITPDMYKRVMDLGVHCSVVGGAITRPKEITKRFVQIMED

SEQ ID NO: 1983 - DNA, 798 bp, Staphylococcus aureus
atgaaatttgagaatcgtgttcaacgttatcaacatttatttacaaaaactgataaacgcatcgtcaattatataagacaaaatggttatagcgatgccttttcaacgattaactccttagcccatgcgattggtacatcaccagcaacgatgacacgctttagtcataagctggattatgagaatttccaagatttaaaatttaatattcaacaagaaatgacagagacagttattgaaaatagcccaattattcaaagaattcataaatatcatcaacaaatcattcaacaaactggtgaatttattgataacgacattatccaaacctttatcgacaaacttcaatcaagtcgacatatactctttgctggactaggtagctctggtttatcagcgactgaattttattatcgtatgattcgtatggggctaaaaggtaatgttactaccgattcacatttaatgaaaatatcggcatccctactatctcattcggatatgtttattgctatgtcaaatagtggtaatacttcggaattaatttctgcagcggaagtcgccaaatctcatggtgcatatgtcgttgccatcacaaattttgaaggtagtaaacttacagattgtgcagatttagtacttttaacaacggatcaatcgcgtaataccgaccatcaatttatcaacacacaaattgcgacactctttttaatcgatatcgtgagttatcatttattagaaaatacgaatctgagtcaaacttatcaacatactaaatctattatcctagacaacaaa

SEQ ID NO: 1984 - protein, 266 aa, Staphylococcus aureus
  MISC_FEATURE (1)..(266): conserved hypothetical
MKFENRVQRYQHLFTKTDKRIVNYIRQNGYSDAFSTINSLAHAIGTSPATMTRFSHKLDYENFQDLKFNIQQEMTETVIENSPIIQRIHKYHQQIIQQTGEFIDNDIIQTFIDKLQSSRHILFAGLGSSGLSATEFYYRMIRMGLKGNVTTDSHLMKISASLLSHSDMFIAMSNSGNTSELISAAEVAKSHGAYVVAITNFEGSKLTDCADLVLLTTDQSRNTDHQFINTQIATLFLIDIVSYHLLENTNLSQTYQHTKSIILDNK

SEQ ID NO: 1985 - DNA, 900 bp, Staphylococcus aureus
atgaaaatgtttttcaaaatcaatagaaatggagtgagtaaggtgtattacatcgcaatcgatattggaggcactcaaattaaatcggcagttattgataagcaattgaatatgtttgactatcaacaaatatcaacgccggacaacaaaagtgagcttattactgacaaagtatatgagattgtaacaggatatatgaagcaatatcagttgatccaacctgtcataggtatttcatcagcaggcgttgttgatgaacaaaaaggcgaaattgtatacgcagggccaaccattccgaattataaaggtactaattttaagcgattattaaaatcactgtctccttatgtcaaagtaaaaaatgatgtaaacgctgcattactaggcgaattgaaattacatcaatatcaagcagaacggatcttttgtatgacgcttggtacaggcattgggggtgcgtacaagaataatcaaggtcatattgataatggtgagcttcataaggcaaatgaagttgggtatttattgtatcgtccaactgaaaatacaacgtttgagcaacgtgctgcaacgagtgcattgaaaaagcgcatgattgccggaggatttacgagaagcacacatgtgccagtattgtttgaagcagctgaagaaggtgatgatattgcaaaacaaatattgaatgagtgggcagaagatgtagcagaagggattgcccaaatacaggtcatgtatgatccagggcttatattaattgggggcggtatatctgaacaaggagataatctcattaaatatatcgagccgaaagttgcacactatttaccaaaagactatgtttatgcaccaatacaaacgactaagagtaaaaatgatgcagcattatatggctgtttgcaa

SEQ ID NO: 1986 - protein, 300 aa, Staphylococcus aureus
  MISC_FEATURE (1)..(300): hypothetical protein
MKMFFKINRNGVSKVYYIAIDIGGTQIKSAVIDKQLNMFDYQQISTPDNKSELITDKVYEIVTGYMKQYQLIQPVIGISSAGVVDEQKGEIVYAGPTIPNYKGTNFKRLLKSLSPYVKVKNDVNAALLGELKLHQYQAERIFCMTLGTGIGGAYKNNQGHIDNGELHKANEVGYLLYRPTENTTFEQRAATSALKKRMIAGGFTRSTHVPVLFEAAEEGDDIAKQILNEWAEDVAEGIAQIQVMYDPGLILIGGGISEQGDNLIKYIEPKVAHYLPKDYVYAPIQTTKSKNDAALYGCLQ

SEQ ID NO: 1987 - DNA, 249 bp, Staphylococcus aureus
atgcttacattaataaaattgaaagaagatgaacaggttataatatatgaatatatacctgaagatgatataagtaacggtaaaggttcagtaacttttaataaaaaagatgcagaggttatagatttctcattatctgaaatagaaaatgaagaatattttatgttatatcgtaataagtctttttctgtagtaagagactttatcgagaagcaagaatttcccgaaaattataaaatagcatggtat

SEQ ID NO: 1988 - protein, 83 aa, Staphylococcus aureus
  MISC_FEATURE (1)..(83): hypothetical protein
MLTLIKLKEDEQVIIYEYIPEDDISNGKGSVTFNKKDAEVIDFSLSEIENEEYFMLYRNKSFSVVRDFIEKQEFPENYKIAWY

SEQ ID NO: 1989 - DNA, 879 bp, Staphylococcus aureus
atgaacaaagatttaaaaggtttatatgcagcgttactcgttccttttgatgaaaatggtcaagtaaatgaacaaggacttaaacaaattgctcaaaatgccattgaaactgaagaattagacggtctttatgtaaatggtagctcaggcgaaaactttttattaaatacagagcagaagaagcaagttttcaaggttgccaaagaggcagttggggataaagtgaaattgattgctcaagtaggttcgttagatttaaatgaagccattgaacttggaaaatatgccacagaactcggttatgatgcactttctgccgtaacaccattctactatccatttacttttgaagaaattagagattactatttcgatattatcgaagcaactcagaacaatatgattatttatgcaataccagatttaacaggtgtgaatatttctattgaacaattcagcgagctatttaatcatgaaaaaattgttggtgttaaatatacagcgccaaacttcttcctactcgaacgtattagaaaagcattcccagacaaattaatcttatctggctttgatgaaatgttagttcaagctacgatttctggcgtagatggtgcaattggttctacatataacgttaatggtcgccgtgcaagaaaaatcttcgacttagcacgacaaggtcaaattcaagaagcttaccaactgcaacatgattcaaacgacattatcgaaacagtgttatcaatggggatttatccaacattgaaagaaatattacgtcatcgtggcattgatgcaggattaccgaaaagacctttcaaaccttttaacgaagcacatcgacaaacattagatcaactcattgcaaaatacgattta

SEQ ID NO: 1990 - protein, 293 aa, Staphylococcus aureus
  MISC_FEATURE (1)..(293): N-acetylneuraminate lyase
MNKDLKGLYAALLVPFDENGQVNEQGLKQIAQNAIETEELDGLYVNGSSGENFLLNTEQKKQVFKVAKEAVGDKVKLIAQVGSLDLNEAIELGKYATELGYDALSAVTPFYYPFTFEEIRDYYFDIIEATQNNMIIYAIPDLTGVNISIEQFSELFNHEKIVGVKYTAPNFFLLERIRKAFPDKLILSGFDEMLVQATISGVDGAIGSTYNVNGRRARKIFDLARQGQIQEAYQLQHDSNDIIETVLSMGIYPTLKEILRHRGIDAGLPKRPFKPFNEAHRQTLDQLIAKYDL

SEQ ID NO: 1991 - DNA, 1539 bp, Staphylococcus aureus
atgttgcccatgaaagaagttggatttggcacactaaactgggttgccgttatcatttatctactagctatgttgttcattggcgtttattttaccaagcgcgcgagccaaagtaccaatagtttctttaccgcaagtggtcgcttgccatcttgggtagttggcttttcaatttatgctactacgttaagtgcgattacatttatgtcgacaccagagaaagcatttttaacagattggtcatatatcgctggtaacattgctatcgtcgcaattattccattacttatttatttctatgtccctttctttaaaaagttaaaggtaacatctgcatatgaatatttagaagctagatttggccctagcatacgtgtcattggctcattattatttgtcgtttaccatttagggcgtgttgcaattgttatctacttaccaacattagcaatcacatctgtatcagacatgaacccttatatcgttgcatcactcgttggtttactatgtattttatatacatttttaggtggtttcgaaggtgtggtttggagtgatttcattcaaggcgtcattttattaggcggcgctttagttattattattctaggtgttgtgaacattaaaggcggtttcggcactgtctttgcagatgcgattgagcacaaaaaattaattagtgcagacaattggaaactaaatactgcggcagctgccattccaattattttcctaggaaatattttcaacaacttgtatcaatacacagcgagtcaagacgtcgtgcagcgttatcaagcttctgatagtttaaaagaaacaaataaatcgttatggacaaatggtatcctagctttaatttcagcacccttattttatggtatgggtacaatgctgtattcattttatacacatgaagctgttttaccaaaaggcttcaatacatcatctgtagtgccatatttcattttgactgagatgccaccatttgtagcaggattacttattgcagccattttcgccgctgcacagtctaccatttcatctagtttaaattctatatctgcttgtatttcaatcgacattaagcaacgcttcttcggaaaaggtagcgagcgacacgaagttaactttgcacgtttcattattatcattgcaggtattttcggttttggaatgtcactatacttaattgcttctaattcaaatgacttatgggatttattcttgtttgtgactggattattcggcgttccattggctggtgtatttgcagttggtattttcactaaacgtacgaatacattcggtgttatttgtggattaatattgggtatcatctttgcttatgtctataatggtgttggcaaaggtaactcacctttctatgtatctaccatttcatttacagttgcttttgtctttgcttatatacttagcttcattgtcccttcaaaacataaaaaagatataacgggattaacaatttttgaaaaagataaaccatcaacatacatttcaaaaacggctacgaaaaag

SEQ ID NO: 1992 - protein, 513 aa, Staphylococcus aureus
  MISC_FEATURE (1)..(513): hypothetical protein
MLPMKEVGFGTLNWVAVIIYLLAMLFIGVYFTKRASQSTNSFFTASGRLPSWVVGFSIYATTLSAITFMSTPEKAFLTDWSYIAGNIAIVAIIPLLIYFYVPFFKKLKVTSAYEYLEARFGPSIRVIGSLLFVVYHLGRVAIVIYLPTLAITSVSDMNPYIVASLVGLLCILYTFLGGFEGVVWSDFIQGVILLGGALVIIILGVVNIKGGFGTVFADAIEHKKLISADNWKLNTAAAAIPIIFLGNIFNNLYQYTASQDVVQRYQASDSLKETNKSLWTNGILALISAPLFYGMGTMLYSFYTHEAVLPKGFNTSSVVPYFILTEMPPFVAGLLIAAIFAAAQSTISSSLNSISACISIDIKQRFFGKGSERHEVNFARFIIIIAGIFGFGMSLYLIASNSNDLWDLFLFVTGLFGVPLAGVFAVGIFTKRTNTFGVICGLILGIIFAYVYNGVGKGNSPFYVSTISFTVAFVFAYILSFIVPSKHKKDITGLTIFEKDKPSTYISKTATKK

SEQ ID NO: 1993 - DNA, 1218 bp, Staphylococcus aureus
atgaatattttattcgctatcacagggatagcatttgcactatttgttgcgtttttattcagttttgatcgtaaaaaaatagacttcaaaaagacgttaataatgatatttattcaagtgttgatcgtgttatttatgatgaacacaacgattggtttgacaattttaactgcactaggttcattttttgaagggctaataaatattagtaaagcaggcataaattttgtttttggagatatacaaaataaaaatggctttacgttctttttaaacgtattactgccattagtttttatttctgtattaataggcatctttaattatattaaggtattaccatttattatcaaatatgtaggtatcgctattaataaaataactagaatggggcgcttagaaagttattttgctatttcaacagcaatgtttgggcaaccagaagtatatttaacaataaaagatattattccaagattatctagagcgaaattatatacaattgcgacgtctggtatgagtgctgttagtatggcaatgctaggttcatatatgcagatgattgaacccaagttcgtagttacagcagtaatgttaaatatttttagtgcgcttatcatcgccagtgtaatcaatccctataaatctgatgatactgatgttgaaattgataacttaacgaaatccacagaaactaaaacattgaatggaaaaacaggaaaacctaagaaagttgcctttttccaaatgattggtgatagtgcgatggatgggtttaaaatcgctgttgtagtagccgtaatgttgttagcatttatttcattaatggaagcaattaatatcatgtttggtagtgttggtttgaactttaaacagcttattggctatgtgtttgcaccaatcgcattcttaatggggattccatggagcgaagctgttccagctggctctttaatggcgactaaattaattacaaatgagtttgtagcaatgcttgattttaaaaatgtcctgggtgatgtatcagctcgaacacaaggtatcatttcagtttacttagtaagcttcgctaattttggtacggttggtatcatcgtaggttcaattaaaggcattagtgataaacaaggagaaaaagttgcatcctttgcaatgaggttgctacttggttcaactctagcttcaatcatttcaggatcaatcattggcttagtattg

SEQ ID NO: 1994 - protein, 406 aa, Staphylococcus aureus
  MISC_FEATURE (1)..(406): probable pyrimidine
MNILFAITGIAFALFVAFLFSFDRKKIDFKKTLIMIFIQVLIVLFMMNTTIGLTILTALGSFFEGLINISKAGINFVFGDIQNKNGFTFFLNVLLPLVFISVLIGIFNYIKVLPFIIKYVGIAINKITRMGRLESYFAISTAMFGQPEVYLTIKDIIPRLSRAKLYTIATSGMSAVSMAMLGSYMQMIEPKFVVTAVMLNIFSALIIASVINPYKSDDTDVEIDNLTKSTETKTLNGKTGKPKKVAFFQMIGDSAMDGFKIAVVVAVMLLAFISLMEAINIMFGSVGLNFKQLIGYVFAPIAFLMGIPWSEAVPAGSLMATKLITNEFVAMLDFKNVLGDVSARTQGIISVYLVSFANFGTVGIIVGSIKGISDKQGEKVASFAMRLLLGSTLASIISGSIIGLVL

SEQ ID NO: 1995 - DNA, 921 bp, Staphylococcus aureus
atggcaaatttacaaaagtatattgagtattctcgagaagttcagcaagcacgggagaacaatcaaccgattgtagcattagaatcaacaattatttcgcatggtatgccgtacccacaaaatgttgaaatggcaacaacagtagagcaaattatcaggaataatggtgccattccagcaaccatagccattatagatggcaaaattaaaattggtttagaaagcgaagatttagaaatactggcaactagtaaagacgttgctaaagtatctagaagggatttagcagaagttattgcgatgaagtgtgttggtgctactactgtagcgacgacgatgatatgtgctgcaatggctggtattcaattttttgttacaggaggtattgggggcgtccataaaggtgcagaacatacgatggacatttcagcagacttagaagaactgtctaaaacaaatgtcactgttatctgtgcaggtgccaaatcaattttagacttacctaagacgatggagtatttagaaacaaaaggcgttccagttattggatatcaaacgaatgaattgccagcattcttcactcgcgaaagcggtgttaagttaacaagttcggttgaaacgccagaacgacttgctgacattcatttaacaaaacagcagttaaatcttgaaggtggcattgttgttgctaatccaattccatatgagcatgccttatcaaaagcatatattgaggcaatcataaatgaagctgttgttgaagcggaaaatcaaggtattaaaggtaaggacgccacaccgttcttgttagggaaaattgtagaaaaaacgaatggtaaaagtttagcagcaaatataaaacttgttgaaaacaatgcggcgttgggtgctaaaattgctgtcgctgttaataaattattg

SEQ ID NO: 1996 - protein, 307 aa, Staphylococcus aureus
  MISC_FEATURE (1)..(307): conserved hypothetical
MANLQKYIEYSREVQQARENNQPIVALESTIISHGMPYPQNVEMATTVEQIIRNNGAIPATIAIIDGKIKIGLESEDLEILATSKDVAKVSRRDLAEVIAMKCVGATTVATTMICAAMAGIQFFVTGGIGGVHKGAEHTMDISADLEELSKTNVTVICAGAKSILDLPKTMEYLETKGVPVIGYQTNELPAFFTRESGVKLTSSVETPERLADIHLTKQQLNLEGGIVVANPIPYEHALSKAYIEAIINEAVVEAENQGIKGKDATPFLLGKIVEKTNGKSLAANIKLVENNAALGAKIAVAVNKLL

SEQ ID NO: 1997 - DNA, 1131 bp, Staphylococcus aureus
atgaggagggatgttatgagcgattctgagaaagaaattttaaaaagaattaaagataatccgtttatttcacaacgtgaacttgctgaggcaattggattatctagacccagcgtagcaaacattatttcaggattaatacaaaaggaatatgttatgggaaaggcatatgttttaaatgaagattatcctattgtttgtattggcgcagcgaatgtagatcgtaagttttatgtgcataaaaatttagttgcagaaacatcaaatcctgtaacgtcaacacgctctattggtggcgtagcaagaaatattgctgagaacttaggtaggcttggcgaaacggtcgcttttttatctgctagtggacaagatagtgaatgggaaatgattaaacgattgtccacaccatttatgaatttggatcatgttcaacaatttgaaaatgcgagtacaggttcatatacagctttaattagtaaagaaggcgacatgacatatggcttagcagatatggaagtgtttgactacattacgcctgaatttttaattaagcgttcacacttattgaaaaaggctaagtgcattattgtagatttgaatttaggcaaagaggcattaaacttcttatgtgcctataccacgaaacatcaaatcaaattagttatcaccacggtttcttccccaaaaatgaaaaatatgcctgattcattacatgctattgattggattatcacgaataaagatgaaacagaaacatacttaaatttaaaaatagaatctactgatgatttaaaaatagctgctaaacgctggaatgatttaggtgttaaaaatgttattgtgacaaatggcgtgaaagaactcatttatcgaagtggtgaggaagaaatcattaagtcagttatgccatcaaatagtgtgaaagatgttacaggtgcaggcgattcattctgtgctgcagtagtgtatagctggttaaatgggatgtctactgaagatatattaattgctggtatggttaacgcaaagaaaacgatagaaacgaaatatacagttaggcaaaacctagatcaacagcaactttatcacgatatggaggattataaaaatggcaaatttacaaaagtatat

SEQ ID NO: 1998 - protein, 377 aa, Staphylococcus aureus
  MISC_FEATURE (1)..(377): hypothetical protein
MRRDVMSDSEKEILKRIKDNPFISQRELAEAIGLSRPSVANIISGLIQKEYVMGKAYVLNEDYPIVCIGAANVDRKFYVHKNLVAETSNPVTSTRSIGGVARNIAENLGRLGETVAFLSASGQDSEWEMIKRLSTPFMNLDHVQQFENASTGSYTALISKEGDMTYGLADMEVFDYITPEFLIKRSHLLKKAKCIIVDLNLGKEALNFLCAYTTKHQIKLVITTVSSPKMKNMPDSLHAIDWIITNKDETETYLNLKIESTDDLKIAAKRWNDLGVKNVIVTNGVKELIYRSGEEEIIKSVMPSNSVKDVTGAGDSFCAAVVYSWLNGMSTEDILIAGMVNAKKTIETKYTVRQNLDQQQLYHDMEDYKNGKFTKVY

SEQ ID NO: 1999 - DNA, 987 bp, Staphylococcus aureus
gtgatttttacattatttacatataaagcgcctaatggtatgcgtgccatgggagcattagctaatgcagcaatcgcaacatttttagtggaagcatttaataaatatgttggtggcgaagtattcggtattaaatttttagaagagctaggagacgctgcgggaggtctaggtggtgtcgctgccgctggattaacagcattagctatcggtgtgtcaccagtatatgcattagttatagcagccgcgtgcggtggtatggatttattaccaggtttctttgcgggttatatgattggatatgtgatgaaatatacagagaaatatgtgccggatggtgtcgacttaattggatcgattgtcatcttagcgccattagctcgtcttattgcagtattattaacgccagtagtgaatagtacattgattcgaattggtgatattatccaaagtagtacgaatacgaatccaattatcatgggtatcattttaggtggtattattacggttgtcggcacagcgccattgagttcaatggcattgacagcattattaggtttaacgggtgtacctatggctattggtgccatggcagcatttagttcggcatttatgaatgggacgctattccatcgcttaaaattaggtgatcgtaagtctacgattgcagtaagtattgaacctttatcacaagcagatattgtatcagccaatccaattccaatctatattacaaatttctttggtggtgcgattgctggtttaattattgctatgtcaggtttaattaacgatgcgacaggtacagctacaccgattgcaggatttttagttatgtttggatttaatcatccgacgacaattgtgatttatggtgtagtaatggcgattgtaggtgcgcttgcaggttatcttggttcaattgtatttaaaaaatatccaattgttactaagcaagacatgattaatcgaggtgcagtagacgca

SEQ ID NO: 2000 - protein, 329 aa, Staphylococcus aureus
  MISC_FEATURE (1)..(329): hypothetical protein
VIFTLFTYKAPNGMRAMGALANAAIATFLVEAFNKYVGGEVFGIKFLEELGDAAGGLGGVAAAGLTALAIGVSPVYALVIAAACGGMDLLPGFFAGYMIGYVMKYTEKYVPDGVDLIGSIVILAPLARLIAVLLTPVVNSTLIRIGDIIQSSTNTNPIIMGIILGGIITVVGTAPLSSMALTALLGLTGVPMAIGAMAAFSSAFMNGTLFHRLKLGDRKSTIAVSIEPLSQADIVSANPIPIYITNFFGGAIAGLIIAMSGLINDATGTATPIAGFLVMFGFNHPTTIVIYGVVMAIVGALAGYLGSIVFKKYPIVTKQDMINRGAVDA

SEQ ID NO: 2001 - DNA, 108 bp, Staphylococcus aureus
atggggattgaatataaaattatcgtaatgggggtcaatggttatggatttattgataggtactttatttttatttttggtcttagtgatttttacattatttacata

SEQ ID NO: 2002 - protein, 36 aa, Staphylococcus aureus
MGIEYKIIVMGVNGYGFIDRYFIFIFGLSDFYIIYI

SEQ ID NO: 2003 - DNA, 675 bp, Staphylococcus aureus
atgttgaaatttgaaaatgtaacaaagtcatttaaagatgggaatcgtaacattgaagcggttaaagatacaaattttgagataaataaaggtgatattatagcattggttggaccttctggctctggtaaaagtacatttctaactatggcaggtgctttacaaacaccgacatctgggcacattttaatcaataaccaagatattacgacaatgaagcaaaaagcattggcaaaagttagaatgtctgaaataggttttattttacaagctacaaaccttgtaccatttttaacggtaaagcaacaatttacattattgaaaaagaaaaataagaatgttatgtctaatgaagactatcagcaacttatgtcacaattaggtctaacttcattgcttaataagttaccttcagaaatttcaggtggtcagaaacaacgtgtggcgatagccaaagcgttatatacgaatccgtcgattattttagcggatgaacctaccgcggcgttagatactgaaaatgcgattgaagtcattaaaattctacgtgatcaagccaaacaaagaaagaaagcatgtattattgttacacatgatgaacgacttaaagcatattgtgatcgttcatatcatatgaaagatggcgtccttaatcttgaaaatgaaacagtagaa

SEQ ID NO: 2004 - protein, 225 aa, Staphylococcus aureus
  MISC_FEATURE (1)..(225): hypothetical protein
MLKFENVTKSFKDGNRNIEAVKDTNFEINKGDIIALVGPSGSGKSTFLTMAGALQTPTSGHILINNQDITTMKQKALAKVRMSEIGFILQATNLVPFLTVKQQFTLLKKKNKNVMSNEDYQQLMSQLGLTSLLNKLPSEISGGQKQRVAIAKALYTNPSIILADEPTAALDTENAIEVIKILRDQAKQRKKACIIVTHDERLKAYCDRSYHMKDGVLNLENETVE

SEQ ID NO: 2005 - DNA, 1047 bp, Staphylococcus aureus
atgtttttagcttggaatgaaatacggcgcaacaaattgaagtttggactaattattggtgtgttaacgatgattagttacttgctatttttattatctggattggcgaatggtcttatcaatatgaataaagaaggcattgataagtggcaagcagatgccattgttctaaataaagatgccaatcaaactgtgcaacaatctgtttttaacaagaaagatattgaaaataaatacaagaagcaagctactttgaagcaaacaggggaaattgtgtctaatggccatcaaaaagacaatgttttagtgttcggtgttgaaaagtcatcatttttagttccgagtttaatagaagggcataaagcgactaaagataatgaagtgttagctgatgaaacgcttaaaaataaaggatttaaaattggtgacacattatcactatctcaatcagatgaaaaattgcatatcgtaggttttacagaaagtgcaaaatataatgcgtcatcagtcattttcacgaatgacgctaccattgccaagatcaatcctagattgactggagataaaattaatgcagttgttgtacgtgatacaaattggaaagacaaaaaattaaaccaagagcttgaagcggtaagtattaatgactttattgaaaatttaccaggttataaaccacagaacttaacattaaactttatgatttcattcttatttgtcatttcagctacagttataggcattttcctatatgtcatgacattacaaaagacgagtttatttggcatattaaaagctcaaggatttacgaatggctatttggcgaatgtggtaatttcgcagacggtcatattagcactatttggtacggcatttggcttactgttaacaggcgttacaggtgcatttttacctgatgcagtacctgtcaaattcgatgtactaacattgctcgtatttgcaattgtgttaatgattgtctctgtattaggaagtttattctccattttaacaattagaaaaatagatccgttaaaggcgattggg

SEQ ID NO: 2006 - protein, 349 aa, Staphylococcus aureus
  MISC_FEATURE (1)..(349): conserved hypothetical
MFLAWNEIRRNKLKFGLIIGVLTMISYLLFLLSGLANGLINMNKEGIDKWQADAIVLNKDANQTVQQSVFNKKDIENKYKKQATLKQTGEIVSNGHQKDNVLVFGVEKSSFLVPSLIEGHKATKDNEVLADETLKNKGFKIGDTLSLSQSDEKLHIVGFTESAKYNASSVIFTNDATIAKINPRLTGDKINAVVVRDTNWKDKKLNQELEAVSINDFIENLPGYKPQNLTLNFMISFLFVISATVIGIFLYVMTLQKTSLFGILKAQGFTNGYLANVVISQTVILALFGTAFGLLLTGVTGAFLPDAVPVKFDVLTLLVFAIVLMIVSVLGSLFSILTIRKIDPLKAIG

SEQ ID NO: 2007 - DNA, 171 bp, Staphylococcus aureus
ttggcaacgtttaagagaaggaaaaacaataaaaaacaagatttaatactgctgcgtcatgaggcgcttgaacattatttgatgaataagtataatttcaactatgattatgcacataaaattgtatcaaaaaaatacgattattcaatttttataaaaaagaaggtggat

SEQ ID NO: 2008 - protein, 57 aa, Staphylococcus aureus
LATFKRRKNNKKQDLILLRHEALEHYLMNKYNFNYDYAHKIVSKKYDYSIFIKKKVD

SEQ ID NO: 2009 - DNA, 888 bp, Staphylococcus aureus
atgaataaaatttcaaagtatattgcaatagcatcattatcggtagcggttacagtttcagcaccacaaacgacaaattctacagcgtttgccaaaagttctgctgaagttcaacaaacgcaacaagcttctataccagcatcacaaaaggcgaatcttggtaatcaaaatattatggcagtggcttggtatcaaaattcagctgaagcaaaagcattatatttacaaggttataacagtgcaaagacacagttagataaagagattaaaaagaataaaggtaaacataagttagctattgctttggatttagatgaaacagttttagataattctccatatcaaggctatgcatcaatacataataaacctttcccagaaggttggcatgaatgggtacaagctgctaaagctaaacctgtctatggcgcaaaagaattcttgaaatatgctgacaaaaaaggtgtcgatatctactatatttctgatagagataaagaaaaagatttaaaggcaacacaaaagaacttaaaacaacaaggtatccctcaagctaagaagagtcatattttactaaaaggtaaagatgataagagtaaagaatcacgcagacaaatggttcaaaaggatcataaacttgtcatgctatttggagataatttattagactttacagatccaaaagaagctacagctgaatctcgtgaagcattaattgaaaaacataaagacgatttcggtaagaaatatatcattttccctaacccaatgtatggtagttgggaagctacgatttacaacaataactataaagcaagtgacaaagcaaaagataaattacgtaaaaatgctattaagcaattcgatcctaaaacaggcgaagttaaa

SEQ ID NO: 2010 - protein, 296 aa, Staphylococcus aureus
  MISC_FEATURE (1)..(296): hypothetical protein
MNKISKYIAIASLSVAVTVSAPQTTNSTAFAKSSAEVQQTQQASIPASQKANLGNQNIMAVAWYQNSAEAKALYLQGYNSAKTQLDKEIKKNKGKHKLAIALDLDETVLDNSPYQGYASIHNKPFPEGWHEWVQAAKAKPVYGAKEFLKYADKKGVDIYYISDRDKEKDLKATQKNLKQQGIPQAKKSHILLKGKDDKSKESRRQMVQKDHKLVMLFGDNLLDFTDPKEATAESREALIEKHKDDFGKKYIIFPNPMYGSWEATIYNNNYKASDKAKDKLRKNAIKQFDPKTGEVK

SEQ ID NO: 2011 - DNA, 1305 bp, Staphylococcus aureus
ttgaaaaaacaagttattatttcgggcctcatgttattttcactattttttggagccggaaatttaatattcccgcccatgcttggccatacagcgggtcaaaatatgtggattggtatgctaggctttgcccttacaggcatattactcccctttattactgttattgttgttgcattttatgatgaaggtgttgaaagtgtaggcaatcgtatacatccatggttcgggtttatttttgctgtcgtgatttacatgtctatcggagcattttacggtattccacgtgctgcaaatgtcgcgtacgaaattggtacaagacacattttacctgtgcataaccaatggactttaattatattcgcagcaatcttttttgccatcgtttactggattagtttaaatccatcgaaaatcgttgataatttaggtaaattattaacaccgttattactattaatggtcgctctattaagtattgctgtcattttcaaccctgaatctgcactaagtgcacctaaggataaatatataacacatcctttcatttcaggaagtttggaaggctattttacaatggatcttgttgctgcgttagctttttccgtagtcattgtcaatggctataagtttaaaggcctcacagatcgcatgaaaattttaaaatatgtctgcttttcaggtcttattgcagccatattacttggaatgatttactttgcacttgcatacgttggggcatcaacagctccaggaaactttaaagatggtacagatatattgacgtacaactcattacgattatttggttcgttcggtaacctcgtatttggaatgacggttatccttgcatgcctaacaacatgtataggactcgtcaatgcttgcgccacatttactaagaaacacgtacctaagttttcttataaaatattcgcacttattttctctatcatagggttcttatttacaacacttggtttagaaatgattttaaaaattgctgtcccattattgactttaatatatcccgtgtcgattgcacttgtactcatatcatttgctaacatgtttagcacattcagattcagttgggcctatcgactcgcaactgttattacattgattatttcaattttacaaatactaaatagtttcaacttattacacggtgttattttgaaatcgtttatgatgttacctttagcagatatcgatttagcttggcttgtaccattcatgctctttgctattatcggtttcataatcgatgtatttatacgccgtccgaaacaagcgacaact

SEQ ID NO: 2012 - protein, 435 aa, Staphylococcus aureus
  MISC_FEATURE (1)..(435): hypothetical protein
LKKQVIISGLMLFSLFFGAGNLIFPPMLGHTAGQNMWIGMLGFALTGILLPFITVIVVAFYDEGVESVGNRIHPWFGFIFAVVIYMSIGAFYGIPRAANVAYEIGTRHILPVHNQWTLIIFAAIFFAIVYWISLNPSKIVDNLGKLLTPLLLLMVALLSIAVIFNPESALSAPKDKYITHPFISGSLEGYFTMDLVAALAFSVVIVNGYKFKGLTDRMKILKYVCFSGLIAAILLGMIYFALAYVGASTAPGNFKDGTDILTYNSLRLFGSFGNLVFGMTVILACLTTCIGLVNACATFTKKHVPKFSYKIFALIFSIIGFLFTTLGLEMILKIAVPLLTLIYPVSIALVLISFANMFSTFRFSWAYRLATVITLIISILQILNSFNLLHGVILKSFMMLPLADIDLAWLVPFMLFAIIGFIIDVFIRRPKQATT

SEQ ID NO: 2013 - DNA, 843 bp, Staphylococcus aureus
atgaaaagtgaggatgtcattgtgaaggagaaacatattaaatgggataagattttttatggggacgactgggtaaataacgtagtcgaaacgataagaacaaaagatatattacaaagcgtttatttaaaacgttatttattacgcgcgatgatggcaggatttattatcgggattattacggtcttcgtattatcagttaaagcaacacacgaaccagatttaccgccaggcattgtgaatatggccagtgccattacattcagctttgcgttagtactcattttatttacaaactccgaactactaaccagtaacttcatgtactttactgtaggcctgtattataaagtaattaaaccaactagagtattgaaaatatttttattatgctttgcaggaaatattttaggtgctgctattttatttagtttcatgcgtttttcaaatgtaatgacgccagatatgttaaatcagttatcagcagttatagagcataaaacgttgtctactggttttgtaagtatattaatgaaagcgatcttcgccaatttctttatcaatatttcattagttattgccatgcaaattgacgatgtactcgcaaaaatgtttgtcatgatgttcggtgttaccatattcgcctttatgggttatgaacacgtcgtttacaacagttgcttatttatgggtggtttaatttatcaagttgatacattgcacttcataccagctatttcgaatatcgctgcggcttttatcggtaactatattggaggcggactcattataggtttattctatgcttacttgaatgatcatcatcaattttataaaaataat

SEQ ID NO: 2014 - protein, 281 aa, Staphylococcus aureus
  MISC_FEATURE (1)..(281): hypothetical protein
MKSEDVIVKEKHIKWDKIFYGDDWVNNVVETIRTKDILQSVYLKRYLLRAMMAGFIIGIITVFVLSVKATHEPDLPPGIVNMASAITFSFALVLILFTNSELLTSNFMYFTVGLYYKVIKPTRVLKIFLLCFAGNILGAAILFSFMRFSNVMTPDMLNQLSAVIEHKTLSTGFVSILMKAIFANFFINISLVIAMQIDDVLAKMFVMMFGVTIFAFMGYEHVVYNSCLFMGGLIYQVDTLHFIPAISNIAAAFIGNYIGGGLIIGLFYAYLNDHHQFYKNN

SEQ ID NO: 2015 - DNA, 396 bp, Staphylococcus aureus
atggaaaaatcgatcaaaataatgacaataataggaattgttgttcagggtttagcaacggtatttagtttactattgatggttttagcagcatcaggtgtaatgactacagatgtgtcaacaacagttaatggtgaggttgacccagttgatgcagaaacagcagcagcaattttcactgtattattcttatccctattcatatttggaatcatttcaattattttaggtgcaatcggtatgtttaaagcatctaaaaacaaaaaaatgagtggtatattgttgattattggagctgtaataagtggtaacataattacatttgctttatggttaatcagtggtattaaactacttactaataacaagcctaaagatgaaataagcgacttatca

SEQ ID NO: 2016 - protein, 132 aa, Staphylococcus aureus
  MISC_FEATURE (1)..(132): hypothetical protein
MEKSIKIMTIIGIVVQGLATVFSLLLMVLAASGVMTTDVSTTVNGEVDPVDAETAAAIFTVLFLSLFIFGIISIILGAIGMFKASKNKKMSGILLIIGAVISGNIITFALWLISGIKLLTNNKPKDEISDLS

SEQ ID NO: 2017 - DNA, 405 bp, Staphylococcus aureus
gtggaaaatgacagccatctaaggagaaaaatgatgaaaagaatattggtagtatttttaatgttagcaattatattggcaggttgttctaataaaggtgaaaagtatcaaaaagatattgataaagtgtacaaagaacagaatcaaatgaataaaattgcctcgaaagtacaaaacactattaaaacagacattaaacaagaagacagtaatacacatgtttataaagatggtaaagtcattgttattggtattcaattatataaagatcgtgaaaaaatgtattatttcgcatatgaaataaaagatggtaaggcagagattaatagagaaatagacccaattaagtatatgaaagaccataaagcagattatgaagatgaaaatgtagaagtggaaaaagat

SEQ ID NO: 2018 - protein, 135 aa, Staphylococcus aureus
  MISC_FEATURE (1)..(135): hypothetical protein
VENDSHLRRKMMKRILVVFLMLAIILAGCSNKGEKYQKDIDKVYKEQNQMNKIASKVQNTIKTDIKQEDSNTHVYKDGKVIVIGIQLYKDREKMYYFAYEIKDGKAEINREIDPIKYMKDHKADYEDENVEVEKD

SEQ ID NO: 2019 - DNA, 111 bp, Staphylococcus aureus
gtgcaaaatcaccctcgttttacatttgattcaaagaagaaggtaaaagataagattatttgcaacttaaaaagtcaattagcttatcggtatccatacatcatggataaa

SEQ ID NO: 2020 - protein, 37 aa, Staphylococcus aureus
VQNHPRFTFDSKKKVKDKIICNLKSQLAYRYPYIMDK

SEQ ID NO: 2021 - DNA, 513 bp, Staphylococcus aureus
atgaagctgaactataggggcgataacatgactttcgaagaaaagctaagtcaaatgtacaatgaaattgcaaatgaaatcagtggaatgataccagtagaatgggaaaaagtatatacaattgcctacgtagatgatgaaggtggagaggttgtttttaattatactaaaccaggaagtgaagatttgaattattattcagatattcctaaagattgcaatgtctcaaaagatatttttaagaattcatggtttaaagtttatcgaatgtttgatgagttaagagaaacttttaaaaaagaagatttagaaccgtggacatcatgtgaatttgactttacaagaaagggaaatttaaaagtatcatttgattatatagattggattaaattaggttttggcccatcaggaaaggaaaactactatatgtacaaaaaatttggtattttaccagatatggaatatgaaatggaagaaattcgagcagtagagaagtatgttaaagagcaagag

SEQ ID NO: 2022 - protein, 171 aa, Staphylococcus aureus
  MISC_FEATURE (1)..(171): conserved hypothetical
MKLNYRGDNMTFEEKLSQMYNEIANEISGMIPVEWEKVYTIAYVDDEGGEVVFNYTKPGSEDLNYYSDIPKDCNVSKDIFKNSWFKVYRMFDELRETFKKEDLEPWTSCEFDFTRKGNLKVSFDYIDWIKLGFGPSGKENYYMYKKFGILPDMEYEMEEIRAVEKYVKEQE

SEQ ID NO: 2023 - DNA, 540 bp, Staphylococcus aureus
atgttaaagagcaagatgaagctgaactataggggcgataatatgactttcgaagaaaaactaagtcaaatgtacaatgaaattgcaaatgaaatcagtggaatgataccagttgaatgggaaaatatatatacaattgcctatgtaactgatcaaggtggagaggtcatttttaattatactaaaccaggtagcgatgaattgaattattacacatatatccctagagagtataatgtctctgaaaaagtattttatgatttgtggacggatttatatagattgtttaagaagttaagagaaacttttaaagaagaagggcttgaaccatggacatcaagtgaatttgactttacaagcgaaggtaaattaaaagtttcatttgattatattgattggataaatacagagtttgatcaattaggccgtgaaaactattatatgtataaaaagtttggtgttttaccagaaatggaatacgaaatggaagaagttaaagaaatcgagcaatatattaaagagcaagatgaagctgaacta

SEQ ID NO: 2024 - protein, 180 aa, Staphylococcus aureus
  MISC_FEATURE (1)..(180): conserved hypothetical
MLKSKMKLNYRGDNMTFEEKLSQMYNEIANEISGMIPVEWENIYTIAYVTDQGGEVIFNYTKPGSDELNYYTYIPREYNVSEKVFYDLWTDLYRLFKKLRETFKEEGLEPWTSSEFDFTSEGKLKVSFDYIDWINTEFDQLGRENYYMYKKFGVLPEMEYEMEEVKEIEQYIKEQDEAEL

SEQ ID NO: 2025 - DNA, 525 bp, Staphylococcus aureus
atgaagctgaaatataggggagataacatgactttcgaagagaaaataagcaaattatataatgagattgcgaatgagattagcagtatgataccggtagagtgggaaaaagtatatacaatggcttatatagatgatggaggaggtgaagtattctttaattatactaaaccaggaagtgaagatttgaattattataccgatatacctaaggagtataatgtttctgtgcaagtatttgatgatttatggatggatttatatgatttgtttaagaatttaagaaatttatttaaagaagaaggacttgaaccatggacatcatgtgaatttgactttacaagagacggcaaattgaatgtttcatttgattatattgattgggcgaattcagagtttggacaaatgggaagagaacattattacatgtataaaaaatttggaatttggcctgaaaaagaatatgccataaattgggtaaaaaaaataaaagattatgttaaagagcaagatgaagctgaacta

SEQ ID NO: 2026 - protein, 175 aa, Staphylococcus aureus
  MISC_FEATURE (1)..(175): conserved hypothetical
MKLKYRGDNMTFEEKISKLYNEIANEISSMIPVEWEKVYTMAYIDDGGGEVFFNYTKPGSEDLNYYTDIPKEYNVSVQVFDDLWMDLYDLFKNLRNLFKEEGLEPWTSCEFDFTRDGKLNVSFDYIDWANSEFGQMGREHYYMYKKFGIWPEKEYAINWVKKIKDYVKEQDEAEL

SEQ ID NO: 2027 - DNA, 102 bp, Staphylococcus aureus
atgttcaaagtgaattattcgattttaagttattatccagaatataatatcgcagtaagttggcaacgtttaagagaaggaaaaacaataaaaaacaagatt

SEQ ID NO: 2028 - protein, 34 aa, Staphylococcus aureus
MFKVNYSILSYYPEYNIAVSWQRLREGKTIKNKI

SEQ ID NO: 2029 - DNA, 498 bp, Staphylococcus aureus
atgactttcgaagagaaaataagcaaattatataatgagattgcgaatgagattagcagtatgataccggtagagtgggaaaaagtatatacaatggcttatatagatgatggaggaggtgaagtattctttaattatactaaaccaggtagtgatgacttgaattattacaccgatatacctaaggagtataacatctctgtgcaagtatttgatgatttatggatggatttatatgatttgtttgaggaattaagagatttatttaaagaagaagggcttgaaccatggacatcatgtgaatttgactttacaagcgaaggtaaattaaaagtttcatttgattatatagattggataaatacagagtttgatcaattaggccgtgaaaattattatatgtataaaaaatttggggttttaccagaaatggaatatgaaatggaagaaattaaagaaatcgatcaatatattaaagagcaagatgaagctgaaata

SEQ ID NO: 2030 - protein, 166 aa, Staphylococcus aureus
  MISC_FEATURE (1)..(166): conserved hypothetical
MTFEEKISKLYNEIANEISSMIPVEWEKVYTMAYIDDGGGEVFFNYTKPGSDDLNYYTDIPKEYNISVQVFDDLWMDLYDLFEELRDLFKEEGLEPWTSCEFDFTSEGKLKVSFDYIDWINTEFDQLGRENYYMYKKFGVLPEMEYEMEEIKEIDQYIKEQDEAEI

SEQ ID NO: 2031 - DNA, 540 bp, Staphylococcus aureus
atgttaaagagcaagatgaagttgaactataggggagataatatgactttcgaagaaaaactaagtcaaatgtacaacgagattgcgaatgagattagtgggatgataccggtagaatgggagcaagtatttacaatagcttatgtaactgatcaagctggagaagtcatctttaattatactaaaccagatagtgatgaattaaattattattcagacatacctaaagattgcaatgtctcaaaagatatttttaagaattcatggtttaaagtttatcgaatgtttgatgagttaagagaaacttttaaagaagaagggcttgaaccatggacatcatgcgaatttgactttacaagagatggcaaattgaatgtatcttttgattatatagattggataaatacagagtttgatcaattgggccgtcaaaattattatatgtacaaaaaatttggggttataccagaaatggaatatgaaatggaagaagttaaagaaatcgaacaatatattaaagagcaagaagaagctgaacaa

SEQ ID NO: 2032 - protein, 180 aa, Staphylococcus aureus
  MISC_FEATURE (1)..(180): conserved hypothetical
MLKSKMKLNYRGDNMTFEEKLSQMYNEIANEISGMIPVEWEQVFTIAYVTDQAGEVIFNYTKPDSDELNYYSDIPKDCNVSKDIFKNSWFKVYRMFDELRETFKEEGLEPWTSCEFDFTRDGKLNVSFDYIDWINTEFDQLGRQNYYMYKKFGVIPEMEYEMEEVKEIEQYIKEQEEAEQ

SEQ ID NO: 2033 - DNA, 498 bp, Staphylococcus aureus
atgactttcgaagagaaactaagtcaaatgtacaataaaattgcaagtgagatcagtggaatgataccagtagaatgggagcaagtatttacaatagcttatgtaactgatcaagctggggaagtcatttttaattatactaaaccaggtagtgatgaattaaattattattcagacatacctaaagattgcaatgtctcaaaagatatttttaagaattcatggtttaaagtttatcgaatgtttgatgagttaagagaaacttttaaagaagaagagcttgaaccatggacatcatgcgaatttgactttacaagagatggcaaattgaatgtatcttttgattatattgattgggtgaattcagaatttggaccaatgggaagagaacattattatatgtataaaaaatttggaatttggcctgaaaaagaatatgccataaattgggttgaaaaaataaaagattatgttaaagagcaagatgaagttgaacta

SEQ ID NO: 2034 - protein, 166 aa, Staphylococcus aureus
  MISC_FEATURE (1)..(166): conserved hypothetical
MTFEEKLSQMYNKIASEISGMIPVEWEQVFTIAYVTDQAGEVIFNYTKPGSDELNYYSDIPKDCNVSKDIFKNSWFKVYRMFDELRETFKEEELEPWTSCEFDFTRDGKLNVSFDYIDWVNSEFGPMGREHYYMYKKFGIWPEKEYAINWVEKIKDYVKEQDEVEL

SEQ ID NO: 2035 - DNA, 498 bp, Staphylococcus aureus
atgactttcgaagaaaaactaagtgaaatatacaacaagattgcgaatgagattagtgggatgataccagtagaatgggaccaagtatttacgatagcttatgtaaatgatagaggtggagagatcgtttttaattatactaaaccaggtagcgatgaattgaattattacacatatatccctagagagtataatgtctctgaaaaagtattttatgatttgtggacggatttatatagattgtttaagaagttaagaaacgcatttaaagaagaagatttagaaccatggacatcatgtgaatttgactttacaagagatggtaaattgaatgttgtatttgattatgttgattggatgaattcagaatttggtccaatagcaaaagaaaattattatatgtacaaaaagtttggtgttttaccagaaacggaatatgaaattaataaagttaaagaaatcgatcaatatgttaaagagcaagatgaagctgaacta

SEQ ID NO: 2036 - protein, 166 aa, Staphylococcus aureus
  MISC_FEATURE (1)..(166): conserved hypothetical
MTFEEKLSEIYNKIANEISGMIPVEWDQVFTIAYVNDRGGEIVFNYTKPGSDELNYYTYIPREYNVSEKVFYDLWTDLYRLFKKLRNAFKEEDLEPWTSCEFDFTRDGKLNVVFDYVDWMNSEFGPIAKENYYMYKKFGVLPETEYEINKVKEIDQYVKEQDEAEL

SEQ ID NO: 2037 - DNA, 681 bp, Staphylococcus aureus
atgactactaaggaaaatatagacattcttcgaaagccaggtgcacaagccttaagtttagcatcattatttatgatacttttttcatgtctaactttcttttttggtttagattatgaaaggtttccaaattatttaaagataacgacaattatagaattaataattatcataattagtttacttcaatggattagatttatagatttcgaaaaggaaagcgcacagaaatataagaaaatatatgcccgatttttagttattataaatgtgctaactactatcaccgcagtatttgcaacatgtaacctttattattttgttgctgtacaaaatcattatgacctattcaattattggttgatgggtacgatttcaatcataattagttatttgttattagtaattggcggaatgttcacgttattaaaattacctaaagtaacaaaacgttggggtggtaaaactaaaacacatttcggtttattattaaccgcgttgagcgcatttatatatattgaaagaattatcgaatatatattggtgcccaatgtcgtagaatccaagtttgtcataatggtaagtatcattattattgcttgtacacaatttgtggcatttcaatttattatgcaatacagtagattctatatttttgaattaaacactgaagatgatgac

SEQ ID NO: 2038 - protein, 227 aa, Staphylococcus aureus
  MISC_FEATURE (1)..(227): hypothetical protein
MTTKENIDILRKPGAQALSLASLFMILFSCLTFFFGLDYERFPNYLKITTIIELIIIIISLLQWIRFIDFEKESAQKYKKIYARFLVIINVLTTITAVFATCNLYYFVAVQNHYDLFNYWLMGTISIIISYLLLVIGGMFTLLKLPKVTKRWGGKTKTHFGLLLTALSAFIYIERIIEYILVPNVVESKFVIMVSIIIIACTQFVAFQFIMQYSRFYIFELNTEDDD

SEQ ID NO: 2039 - DNA, 516 bp, Staphylococcus aureus
atgaagctgaactataggggcgataatatgactttcgaagaaaaattaagtgaaatgtatagcgagattgcgaataagattattagcatgataccggtagagtgggaaaaagtatatgcaatggcatatatcgatgaagaatgtggagaagtgttttacaattatactgaaccaagcagtgatgaattattttactatacaagtgtgataaagaagtataatttattgaaatcaagctttatggattcagtatatgagttgcatgatcaatttgaggaactaagagaagtatttatagaagaaggtcttgaaccatggacatcatgcgaatttgattttacaaaagaagataaattaaaagtttcatttgattatattgattggataaatacagagtttgatcaattaggccgtgaaaattattatatgtacaaaaaatttggtgttttaccagaaacggaatatgaaatggaggaggttaaagaaatcgagcaatatattaaagagcaagaagaa

SEQ ID NO: 2040 - protein, 172 aa, Staphylococcus aureus
  MISC_FEATURE (1)..(172): conserved hypothetical
MKLNYRGDNMTFEEKLSEMYSEIANKIISMIPVEWEKVYAMAYIDEECGEVFYNYTEPSSDELFYYTSVIKKYNLLKSSFMDSVYELHDQFEELREVFIEEGLEPWTSCEFDFTKEDKLKVSFDYIDWINTEFDQLGRENYYMYKKFGVLPETEYEMEEVKEIEQYIKEQEE

SEQ ID NO: 2041 - DNA, 339 bp, Staphylococcus aureus
ttgaattattacaccgatatacctaaggagtataacatttctgtgcaagtatttgatgatttatggatggatttatatgatttgtttgaggaattaagaaatttatttaaagaagaaggactagaaccatggacatcatgcgaatttgattttacaagagaaggtaaattaaaagtttcatttgattatattgattggataaattcagaatttggtcaagtaggtcgacaaaattactataagtatagaaaatttggaattttaccagaaacggaatatgaaattaataaagttaaagaaatcgagcaatatattaaagagcaagatgaagctgaacta

SEQ ID NO: 2042 - protein, 113 aa, Staphylococcus aureus
  MISC_FEATURE (1)..(113): conserved hypothetical
LNYYTDIPKEYNISVQVFDDLWMDLYDLFEELRNLFKEEGLEPWTSCEFDFTREGKLKVSFDYIDWINSEFGQVGRQNYYKYRKFGILPETEYEINKVKEIEQYIKEQDEAEL

SEQ ID NO: 2043 - DNA, 150 bp, Staphylococcus aureus
atgattttcgaagaaaaactaaatgaaatgtacaacgagattgcgaataaaattagtagcatgataccagtagaatgggaaaaggtatatacaatggcttatatagatgatggaggaggtgaagtattctttaattatactaaacagcga

SEQ ID NO: 2044 - protein, 50 aa, Staphylococcus aureus
  MISC_FEATURE (1)..(50): conserved hypothetical
MIFEEKLNEMYNEIANKISSMIPVEWEKVYTMAYIDDGGGEVFFNYTKQR

SEQ ID NO: 2045 - DNA, 540 bp, Staphylococcus aureus
atgttaaagagcaagaagaagctgaacaatagaggcgataacatgaatttcgaagaaaaattaagtgaaatgtacaataaaattgcaaatgagatcaatgaaatgataccagtagagtgggaaaaggtatatgtaattgcatatgtggacgatggaggtgggcaagttatattttattataccaagcccagaaatgatgagctgtattattattcgagtatcgttgaagattataatgttttagaagaaatctttgatgatttatggatggaactttatagatcatttaaaaaattaagaaatatatttaaagaagaaagtcttgaaccatggacatcatgtgaatttgactttacaaaagaagataaattaaaagtttcatttgattatattgattggaagaatacagaatttgatcaattaggccaagaaaactactataactatagaaaattcggaattataccagaaatggaatatgaaatggaagaggttaaacaaatcgagcaatatattaaagagcaagaagaagctgaacaa

SEQ ID NO: 2046 - protein, 180 aa, Staphylococcus aureus
  MISC_FEATURE (1)..(180): conserved hypothetical
MLKSKKKLNNRGDNMNFEEKLSEMYNKIANEINEMIPVEWEKVYVIAYVDDGGGQVIFYYTKPRNDELYYYSSIVEDYNVLEEIFDDLWMELYRSFKKLRNIFKEESLEPWTSCEFDFTKEDKLKVSFDYIDWKNTEFDQLGQENYYNYRKFGIIPEMEYEMEEVKQIEQYIKEQEEAEQ

SEQ ID NO: 2047 - DNA, 471 bp, Staphylococcus aureus
atgtatagcgagattgcgaataagattagcagcatgataccggtagagtgggaaaaggtatatgcaatggcatatatagatgacggaggaggagaagtgttctactattacacagaacctggaagtgatgaattatactactatactagtgtattaaataaatatgatatatcggaatcggaatttatggattcagtgtatgagttgtataaacaatttcaaaatttaaggaatttatttaaagaagaaggacatgaaccatggacatcatgcgaatttgactttacaagagaaggtgaattaaaagtttcatttgattatattgattggataaatccagaatttggtcaagtaggccgacaaaattactataagtatagaaaatttggaattttaccagaaacggaatatgaaattaataaagttaaagaaatcgagcaatatgttaaagagcaagaagaagctgaacaa

SEQ ID NO: 2048 - protein, 157 aa, Staphylococcus aureus
  MISC_FEATURE (1)..(157): conserved hypothetical
MYSEIANKISSMIPVEWEKVYAMAYIDDGGGEVFYYYTEPGSDELYYYTSVLNKYDISESEFMDSVYELYKQFQNLRNLFKEEGHEPWTSCEFDFTREGELKVSFDYIDWINPEFGQVGRQNYYKYRKFGILPETEYEINKVKEIEQYVKEQEEAEQ

SEQ ID NO: 2049 - DNA, 207 bp, Staphylococcus aureus
ttgtacagatatggagatgaaaaaatgtcagaatacaagaaaaaaataattgaattaattgaaagtaatttaacaggatatgaaatttctaaaaaaactggagtttctcaatacgtactttcacaattaagacagggcaaacgcgaagtagataatctaaccctgaatacaacagaaaaattatatgaatatgccaataaagttttg

SEQ ID NO: 2050 - protein, 69 aa, Staphylococcus aureus
  MISC_FEATURE (1)..(69): hypothetical protein
LYRYGDEKMSEYKKKIIELIESNLTGYEISKKTGVSQYVLSQLRQGKREVDNLTLNTTEKLYEYANKVL

SEQ ID NO: 2051 - DNA, 105 bp, Staphylococcus aureus
ttgacaaatatttttaaacataatataataaataacgttctgaaaaacgaagatgttttaaatgcctatatccgcggtcgtggcggaatggcagacgcgctaggt

SEQ ID NO: 2052 - protein, 35 aa, Staphylococcus aureus
LTNIFKHNIINNVLKNEDVLNAYIRGRGGMADALG

SEQ ID NO: 2053 - DNA, 147 bp, Staphylococcus aureus
ttggagcgcctagattttgtaacagcattgaaagctatcaacaacgggcaaattatgaatattattgcactaaatgtcatgcaaaatatatacgtatccgtaaagttgatacgaatcgtatgcgttgcggacattgcaatggaaaat

SEQ ID NO: 2054 - protein, 49 aa, Staphylococcus aureus
LERLDFVTALKAINNGQIMNIIALNVMQNIYVSVKLIRIVCVADIAMEN

SEQ ID NO: 2055 - DNA, 462 bp, Staphylococcus aureus
ttgatccacatgaataatgacaaacttcagcgaatggttgagaatctttcggaagaaaaatttggacgtacgtttcgacattgtgcatattttaataaaaggttacgtacaacaggcggacgttatcttttaaagtcccatgatattgaaattaatccaaaacaatatgagcattatggagaagatgctgttgtaaaaattatactgcacgaattgtgtcattatcacttgcatattgctggtaaaggttatcaacataaagatcaagattttaaacgattgagccaacaggttggagcgcctagattttgtaacagcattgaaagctatcaacaacgggcaaattatgaatattattgcactaaatgtcatgcaaaatatatacgtatccgtaaagttgatacgaatcgtatgcgttgcggacattgcaatggaaaattaagaatgaaaagacaattgaaa

SEQ ID NO: 2056 - protein, 154 aa, Staphylococcus aureus
  MISC_FEATURE (1)..(154): conserved hypothetical
LIHMNNDKLQRMVENLSEEKFGRTFRHCAYFNKRLRTTGGRYLLKSHDIEINPKQYEHYGEDAVVKIILHELCHYHLHIAGKGYQHKDQDFKRLSQQVGAPRFCNSIESYQQRANYEYYCTKCHAKYIRIRKVDTNRMRCGHCNGKLRMKRQLK

SEQ ID NO: 2057 - DNA, 2148 bp, Staphylococcus aureus
atggacaatcaattgattaattcaatcatagagaaatatcaatttagtaaaaaacaaattgaagcagtattaacactgctagaagaaaaaaatacagtaccatttattgcgaggtatcgaaaagagcaaactggtggactagatgaagttcaaataaagcaaattgatgacgaataccaatatatggtcaatttacaaaaacgtaaagaagaagttatcaaaaatatagaacagcaaggattacttactgaggaattaaagaaggatattttaaaacagaacaaattacaacgtgttgaagacctatataggccttttaaacaaaagaaaaagacaagggcaactgaggcgaaacgtaaagggttagagccattagcgatatggatgaaggcacgtaaacatgaagtctcaattgaagaaaaagcacaacaatttataaatgaagaagtgcaatcggttgaagatgctatcaaaggtgcacaagatattattgcggaacaaatttcagataatcctaaatatagaacaaaaattttaaaagatatgtatcatcaaggtgtgttaactacatctaaaaagaaaaatgctgaagatgaaaaaggtatttttgaaatgtactatgcatatagtgagccaattaaacgcattgctaatcatagagttttagctgttaatcgtggtgaaaaagagaaagtattatctgtaaagtttgaattcgatacgacatcagtagaggatttcattgcacgtcaagaaatcaatcataataatgtaaatcgcagttatattttagaggcgattaaagatagcttgaaacgcttaattgtcccttcgatagagcgtgaaatccatgctgatttaactgaaaaagctgaaaatcatgcaatagatgtttttagtgaaaacttaagaaatctattactgcaacctccaatgaaaggtaaacaaatattaggcgtagatccagcatttagaacaggttgtaaattagcagtcattaacccattcggtacttttatagcaaaaggtgtgatttatccgcatccaccagtttctaaaaaagaggcagcagagaaggattttgtacaaatggttaaagcgtatgatgtgcaattaattgcaattggcaatggtactgcaagtcgtgaaacagaacaatttgttgcagatttaattaaaaagcatcagttgccagtacaattcatcattgtcaatgaagcgggcgcttcagtatactcagcatcagaaattgctagagatgaatttcctgattttcaagtggaagaaagaagtgccgtatcaattggacgacgcgttcaagatccattaagtgaattagttaaaatcgatcctaaatctattggtgtcggacaataccagcatgatgttaatcaaaaagcactagaaaatgcattaactttcgttgttgaaacagcagttaaccaagtaggtgttgatgtcaatacagcatcatcatcattattacaatatgtgtctggtctaagttcgcaaattgctaaaaatataattgcatatagagaagaaaatggcgcaataaagcataataaagagttaagcaagattaagcgtttgggtgctaaaacttttgagcagagtataggatttttaagaatagtagacggttcagagccattggataatacatcgattcatcccgaaagctataaagtaacgtatcagttattagataaactcggatttggtggcaatgatttaggtagtgatgcattaaaagctaaattaaattcattggatatggatgaactggcgattgaattacaagtcggtgtacctacattagaggatattattaaatccttgaaagcacctaatcgagatccaagggacgagtttgaaacaccaatccttaaatccgatgtgctatcaattgaagatttacaagaaggaatgaaattgagtggtacagttagaaatgtagtagattttggagcatttgtagatataggtgttaaacaagatggacttgtccatgtttcgaaactttctaagaagttcgtaaaaaatccaatggatattgtcagtgttggtgatatcgttgacgtttggatttacagtattgacaaaaataaagacaaagtatcattaacgatgattgatccacatgaa

SEQ ID NO: 2058 - protein, 716 aa, Staphylococcus aureus
  MISC_FEATURE (1)..(716): conserved hypothetical
MDNQLINSIIEKYQFSKKQIEAVLTLLEEKNTVPFIARYRKEQTGGLDEVQIKQIDDEYQYMVNLQKRKEEVIKNIEQQGLLTEELKKDILKQNKLQRVEDLYRPFKQKKKTRATEAKRKGLEPLAIWMKARKHEVSIEEKAQQFINEEVQSVEDAIKGAQDIIAEQISDNPKYRTKILKDMYHQGVLTTSKKKNAEDEKGIFEMYYAYSEPIKRIANHRVLAVNRGEKEKVLSVKFEFDTTSVEDFIARQEINHNNVNRSYILEAIKDSLKRLIVPSIEREIHADLTEKAENHAIDVFSENLRNLLLQPPMKGKQILGVDPAFRTGCKLAVINPFGTFIAKGVIYPHPPVSKKEAAEKDFVQMVKAYDVQLIAIGNGTASRETEQFVADLIKKHQLPVQFIIVNEAGASVYSASEIARDEFPDFQVEERSAVSIGRRVQDPLSELVKIDPKSIGVGQYQHDVNQKALENALTFVVETAVNQVGVDVNTASSSLLQYVSGLSSQIAKNIIAYREENGAIKHNKELSKIKRLGAKTFEQSIGFLRIVDGSEPLDNTSIHPESYKVTYQLLDKLGFGGNDLGSDALKAKLNSLDMDELAIELQVGVPTLEDIIKSLKAPNRDPRDEFETPILKSDVLSIEDLQEGMKLSGTVRNVVDFGAFVDIGVKQDGLVHVSKLSKKFVKNPMDIVSVGDIVDVWIYSIDKNKDKVSLTMIDPHE

SEQ ID NO: 2059 - DNA, 768 bp, Staphylococcus aureus
atggcgaaagagtcgaaatcagctaatgaaatttcacctgagcaaattaaccaatggattaaagaacaccaagaaaataagaatacagatgcacaggataagttagttaaacattaccaaaaactaattgagtcattggcatataaatattctaaaggacaatcacatcacgaagatttagttcaagttggtatggttggtttaataggtgccataaatagattcgatatgtcctttgaacggaagtttgaagcctttttagtacctactgtaatcggtgaaatcaaaagatatctacgagataaaacttggagtgtacatgttccgagacgtattaaagaaattgggccaagaatcaaaaaagtgagcgatgaactaaccgctgaattagagcgttcaccttctatcagtgaaatagctgatcgattagaagtctcagaagaagaagtgttagaagcaatggaaatgggacaaagttataatgcgttaagtgttgatcattccattgaagctgataaagatggttcaactgttacgctattagatattatggggcaacaagatgaccattatgacttaactgaaaaacgtatgattttagaaaaaatattacctatattatctgatcgcgaacgagaaatcatacaatgtacgtttattgaaggattgagtcaaaaagagacaggtgagcgtatcggtttaagtcaaatgcatgtatcacgacttcagagaacggcaattaagaaattacaagaagcagcacatcaa

SEQ ID NO: 2060 - protein, 256 aa, Staphylococcus aureus
  MISC_FEATURE (1)..(256): sigma factor B
MAKESKSANEISPEQINQWIKEHQENKNTDAQDKLVKHYQKLIESLAYKYSKGQSHHEDLVQVGMVGLIGAINRFDMSFERKFEAFLVPTVIGEIKRYLRDKTWSVHVPRRIKEIGPRIKKVSDELTAELERSPSISEIADRLEVSEEEVLEAMEMGQSYNALSVDHSIEADKDGSTVTLLDIMGQQDDHYDLTEKRMILEKILPILSDREREIIQCTFIEGLSQKETGERIGLSQMHVSRLQRTAIKKLQEAAHQ

SEQ ID NO: 2061 - DNA, 507 bp, Staphylococcus aureus
atgttaatgaaggaacggaggtcgaataacatgcaatctaaagaagattttatcgaaatgcgcgtgccagcatcggcagagtatgtaagtttaattcgtttaacactttctggcgttttttcgagagctggtgctacatatgatgatattgaagatgccaagattgcagttagtgaagctgtgacaaatgcagttaaacatgcatacaaagaaaataacaatgtgggcattattaacatatattttgaaattttagaagataaaattaaaattgttatttctgataaaggtgacagttttgattatgaaacaactaaatcaaaaataggtccttacgataaagacgaaaatatagactttttacgcgaaggtggcctaggtttatttttaatcgaatctttaatggatgaagtcacagtatataaagaatctggtgtgacaatcagtatgactaagtatataaaaaaagagcaggtgcgaaataatggcgaaagagtcgaaatcagc

SEQ ID NO: 2062 - protein, 169 aa, Staphylococcus aureus
  MISC_FEATURE (1)..(169): anti-sigmaB factor
MLMKERRSNNMQSKEDFIEMRVPASAEYVSLIRLTLSGVFSRAGATYDDIEDAKIAVSEAVTNAVKHAYKENNNVGIINIYFEILEDKIKIVISDKGDSFDYETTKSKIGPYDKDENIDFLREGGLGLFLIESLMDEVTVYKESGVTISMTKYIKKEQVRNNGERVEIS

SEQ ID NO: 2063 - DNA, 324 bp, Staphylococcus aureus
atgaatcttaatatagaaacaaccactcaagataaattttacgaagttaaagtcggtggagaattagatgtttatactgtgcctgaattagaagaggttttaacacctatgagacaagatggaactcgtgatatttatgttaatttagaaaatgtgagttatatggattcgacaggtttaggtttattcgtaggtacattaaaagcattaaaccaaaatgataaagaactatacattttaggtgtgtcagatcgtatcggtagactatttgaaattactggtcttaaggatttaatgcatgttaatgaaggaacggaggtcgaa

SEQ ID NO: 2064 - protein, 108 aa, Staphylococcus aureus
  MISC_FEATURE (1)..(108): anti-sigmaB factor
MNLNIETTTQDKFYEVKVGGELDVYTVPELEEVLTPMRQDGTRDIYVNLENVSYMDSTGLGLFVGTLKALNQNDKELYILGVSDRIGRLFEITGLKDLMHVNEGTEVE

SEQ ID NO: 2065 - DNA, 786 bp, Staphylococcus aureus
atgtcttacaagaaatttggttatagttatcgagattatcaaagattggtagataaacttcaagttcacgataaagagatagacttagcttctagcttacaacaaacaatgcttaaaacagatattccacaatttgatagtattcaaattggcgttatttcagtggcggcacaaaaagtaagtggagattattttaatttaattgaccataacgatggcacaatgagctttgctgttgcagatgtcattggaaaaggtataccagctgctttagcaatgagtatgataaagtttggcatggattcttatggacactcacaattaccgagtgatggtttaaaacgtttaaatcgtgttgttgaaaagaatattaatcaaaatatgttcgtcacaatgttttatggtttatatgaagaaatgaaccatttattgtattgtagttcagctggtcatgagcctggatatatttatcgcgctgaaaaagaagaatttgaagaaatttcagttagaggtagagtgttaggaatcagttcacaaacacgatatcaacaacaagaaattccaatataccttgatgatttaattatcattttaacggatggtgtgactgaagctagaaatagtgaaggtacctttatagataaacaaaaacttttagaatatattaaaaaacataaacatatgcacccacaagatattgttcaaattatctatgaagcaattttaaagcttcaaaacccaaataaaaaagatgatatgactattttgattataaaaagagtaaat

SEQ ID NO: 2066 - protein, 262 aa, Staphylococcus aureus
  MISC_FEATURE (1)..(262): sigmaB regulation protein
MSYKKFGYSYRDYQRLVDKLQVHDKEIDLASSLQQTMLKTDIPQFDSIQIGVISVAAQKVSGDYFNLIDHNDGTMSFAVADVIGKGIPAALAMSMIKFGMDSYGHSQLPSDGLKRLNRVVEKNINQNMFVTMFYGLYEEMNHLLYCSSAGHEPGYIYRAEKEEFEEISVRGRVLGISSQTRYQQQEIPIYLDDLIIILTDGVTEARNSEGTFIDKQKLLEYIKKHKHMHPQDIVQIIYEAILKLQNPNKKDDMTILIIKRVN

SEQ ID NO: 2067 - DNA, 288 bp, Staphylococcus aureus
gtgaatcataattatccttgcttaagcatttgctttgtaagggaagtgaggaggcaactaatcgtggaagaatttaagcaacattataagggtttaattgatgaaagtttaacgtgccaagataaagtagaattgataaaaaagtgtgagaaatacactgacgaagtgattcgtaaggacgtcttgcctgaagacattgtcgatattcacaaaaactatatattgacgttaaacttaacgcgtgaagatgtgttcaagacattagatgtcttacaagaaatttggtta

SEQ ID NO: 2068 - protein, 96 aa, Staphylococcus aureus
  MISC_FEATURE (1)..(96): sigmaB regulation protein
VNHNYPCLSICFVREVRRQLIVEEFKQHYKGLIDESLTCQDKVELIKKCEKYTDEVIRKDVLPEDIVDIHKNYILTLNLTREDVFKTLDVLQEIWL

SEQ ID NO: 2069 - DNA, 360 bp, Staphylococcus aureus
atgattagacgaggagatgtttatttagcagatttatcaccagtacagggatctgaacaagggggagtcagacctgtagtcataattcaaaatgatactggtaataaatatagtcctacagttattgttgcggcaataactggtaggattaataaagcgaaaataccgacacatgtagagattgaaaagaaaaagtataagttggataaagactcagttatattattagaacaaattcgtacacttgataaaaaacgattgaaagaaaaactgacgtacttatccgatgataaaatgaaagaagtagataatgcactaatgattagtttagggctgaatgcagtagctcaccagaaaaat

SEQ ID NO: 2070 - protein, 120 aa, Staphylococcus aureus
  MISC_FEATURE (1)..(120): conserved hypothetical
MIRRGDVYLADLSPVQGSEQGGVRPVVIIQNDTGNKYSPTVIVAAITGRINKAKIPTHVEIEKKKYKLDKDSVILLEQIRTLDKKRLKEKLTYLSDDKMKEVDNALMISLGLNAVAHQKN

SEQ ID NO: 2071 - DNA, 108 bp, Staphylococcus aureus
atgaagatgactattaaagtgcgaaaaacaaataaaaaagagaaaatagaatttttaatagggacgtttataattattttagtaatattagggttcaaaattatgaaa

SEQ ID NO: 2072 - protein, 36 aa, Staphylococcus aureus
MKMTIKVRKTNKKEKIEFLIGTFIIILVILGFKIMK

SEQ ID NO: 2073 - DNA, 192 bp, Staphylococcus aureus
ttggaatcaattggaggttctcatatgttatcttttagtcaaaatagaagtcatagcttagaacaatctttaaaagaaggatattcacaaatggctgatttaaatctctccctagcgaacgaagcttttccgatagagtgtgaagcatgcgattgcaacgaaacatatttatcttctaattcaacgaatgaa

SEQ ID NO: 2074 - protein, 64 aa, Staphylococcus aureus
  MISC_FEATURE (1)..(64): hypothetical protein
LESIGGSHMLSFSQNRSHSLEQSLKEGYSQMADLNLSLANEAFPIECEACDCNETYLSSNSTNE

SEQ ID NO: 2075 - DNA, 1170 bp, Staphylococcus aureus
gtgggaattacaggaggaagtaatatgtcggataaatattatagatctgcgtatatgaatgtagatttaaacgctgttgcatcaaatttcaaagtattcagtacattgcatccaaataaaacagtgatggctgtcgttaaagccaatgcctatggactaggtagtgttaaagtagcacgtcatttaatggaaaatggcgccacattttttgctgtagcaacgttagatgaagcgatagaacttagaatgcatgggattactgctaaaattttagtcttaggtgtgttaccagctaaagatattgataaagcgatacaacaccgagttgccttaacggttccgtctaaacagtggttgaaagaagcaattaaaaacatttctggtgagcaagagaaaaagttatggttgcacattaaattagatacaggaatgggacgtttaggtattaaagatactaaaacgtatcaagaagtgattgaaatcattcaacaatatgagcaacttgtatttgaaggcgtgtttacacactttgcctgtgctgacgaaccaggagatatgacaactgaacaatatcaacgttttaaagatatggtcaatgaagcaattaaacctgaatatatacattgtcagaactcagcaggctctctattaatggattgccaattctgtaatgcaataagaccaggaatttccctttatggatattatccatcagagtatgtacagcaaaaagttaaagtacaccttaaaccaagtgtgcaattaattgctaatgtagttcaaacaaagacgctacaagcgggtgagtctgtaagttatggtgcaacttatacagctactgacccaactacaatagcattgttacctattggatatgcagatggctatttacgcataatgcaaggtagctttgtaaatgtaaatggtcatcaatgcgaagttattggtcgcgtatgtatggatcagacaattgttaaagtgccagatcaagttaaagctggagattcggtgattttaatagataatcatagagaaagtccacagtcggtagaggtggtagctgaaaagcaacatactattaattatgaagtgctttgtaacttgtcgagacgtttgccgcgaatctatcatgatggtgatcaacgttttgtaacaaatgaattgttaaaa

SEQ ID NO: 2076 - protein, 390 aa, Staphylococcus aureus
  MISC_FEATURE (1)..(390): alanine racemase
VGITGGSNMSDKYYRSAYMNVDLNAVASNFKVFSTLHPNKTVMAVVKANAYGLGSVKVARHLMENGATFFAVATLDEAIELRMHGITAKILVLGVLPAKDIDKAIQHRVALTVPSKQWLKEAIKNISGEQEKKLWLHIKLDTGMGRLGIKDTKTYQEVIEIIQQYEQLVFEGVFTHFACADEPGDMTTEQYQRFKDMVNEAIKPEYIHCQNSAGSLLMDCQFCNAIRPGISLYGYYPSEYVQQKVKVHLKPSVQLIANVVQTKTLQAGESVSYGATYTATDPTTIALLPIGYADGYLRIMQGSFVNVNGHQCEVIGRVCMDQTIVKVPDQVKAGDSVILIDNHRESPQSVEVVAEKQHTINYEVLCNLSRRLPRIYHDGDQRFVTNELLK

SEQ ID NO: 2077 - DNA, 357 bp, Staphylococcus aureus
atgatacatggaattggtgtagatttaatcgaaatcgatcgaatacaagcgttatatagtaagcaaccaaaattggttgagcggattttaactaaaaatgaacagcacaaattcaacaatttcacacatgagcaacgtaaaattgaatttttagctggcaggtttgctacaaaagaagcgttcagtaaagcattaggcacaggcttaggaaaacatgtagcttttaacgatatagactgttacaacgacgaacttggcaaaccaaagattgattacgaagggtttatcgtacatgttagtatctcacacactgagcattatgcgatgagccaagttgttttagaaaagtcagcattt

SEQ ID NO: 2078 - protein, 119 aa, Staphylococcus aureus
  MISC_FEATURE (1)..(119): holo-ACP synthase
MIHGIGVDLIEIDRIQALYSKQPKLVERILTKNEQHKFNNFTHEQRKIEFLAGRFATKEAFSKALGTGLGKHVAFNDIDCYNDELGKPKIDYEGFIVHVSISHTEHYAMSQVVLEKSAF

SEQ ID NO: 2079 - DNA, 498 bp, Staphylococcus aureus
gtgaaaatgatgagggattataattttatgtcaccacacgctaaaaaagtgatgaggttaagtgctgtgctgttttggatacccatagcgcttgtacttttaatcgcatttaatattttgaactggctattttgggagattttagataaccatttatccattgttagtagtgtgattataatattacttgttgctgttttcacgcttgttatagcgccagtctatcgatataagcactgcagatatgcatttgaaaaacaccatttgcgtgtacgaaacggcattttatttttggatgaaaaggtaataccatattttcgtattcaaaatattgatatcgatgttggtcctataatgagacgctatcgattagcaactttgaccctttatacagcgggtggtcaagctgaaattgaattaatagatagaagtgaagcacgtagattgaaacgatggttaaataacgagagacatttagaaaacaataaaaatgaggaa

SEQ ID NO: 2080 - protein, 166 aa, Staphylococcus aureus
  MISC_FEATURE (1)..(166): conserved hypothetical
VKMMRDYNFMSPHAKKVMRLSAVLFWIPIALVLLIAFNILNWLFWEILDNHLSIVSSVIIILLVAVFTLVIAPVYRYKHCRYAFEKHHLRVRNGILFLDEKVIPYFRIQNIDIDVGPIMRRYRLATLTLYTAGGQAEIELIDRSEARRLKRWLNNERHLENNKNEE

SEQ ID NO: 2081 - DNA, 1590 bp, Staphylococcus aureus
ttgaaagtgatgtctgaacctcaaaaattacatccgatttcatattttaatggcataatcaatgctatcaaacaaaacatagtcgtcttttttattttcattatctttcaattgaaagattttgattatacgaatcccgaatcatatttatggataggtattgtatttgtattctttttaatatcatacatttctcaaattgtcggaattatgaacacgcgatattggattgaggataattatttcattttaacaacaggtatttttaataaaaagcgtaaagaattaaatataaaacgtattcagtccgttgatatgacacaaggggtcgtcaatcaaattattggtggtgtggatttacaaatcaaaacaccaagtgatggtattgtcttaagtgttatttcgaaaaaacaaggtgaatatcttgaacgatatattgatcaattgcaaacagagttgaagacagaagtggcgcaaaagtctagtgctgagaagaatgacaactgtaatcatgacattgaaggtaatgtggaagacatcgcagaaggtcgcttagatgaagtgcagaacactgatagtatgcttaatcagaaaaataaacgcattcctatatatcagatgaattttaaagaatcactatttatggcaatgaccagtggcgccattggtgtaacgttagcagctttagtaccgatttacggggctgtaagagagttgatcccatggtcgaagctaaatcatgaaattagtcaatgggttcaaattgtaagtatttcagtattaatcatcattttactagtattaatagtggcatatattattggaacgattataacaatgataagattttatggcttttcggtgatgcttgaaaatgagcaacttaaaattgaatatggtctctttaacaagaagaaagtaactgtaccaacgaaacgattgcaagctgttgttgaacgtcagtcatatatacgaagattatttggctacacagcaatacattttatcatcacaagtgattttgaaaataaaaaaatcgaagatgatgacaatgattcaggtagtgtgccgatattgccgtttattaaacgagacaaagcatatcaaattatccagaatttagtaccagatttatcttatcaacaagttaatgaaggtatgcctttgtcaggtttccacagacactttttaatacctagtattattgtcatagctatggcaggtataggctgttatttttggaatcaattattattgttatttacgattataacaatagtcattattggtttatttgtgatcaaaggatatctttatgtcaaacatgcgggttttaaaatgacagaagaacaaattactatccagaatttcgagctattgaaacgaaatatttattattttaaagcgcatcacattataggatttgacacttggcaacatacattacttaaacgcaacaatttaaataattttagctttattgttgctaaaggtgtgggagcccaatcgattaacttaaaatacgcaagaagtgaagatgcaaataaattgaaatcatggtatttaagaggtgaaaatgatgagggatta

SEQ ID NO: 2082 - protein, 530 aa, Staphylococcus aureus
  MISC_FEATURE (1)..(530): conserved hypothetical
LKVMSEPQKLHPISYFNGIINAIKQNIVVFFIFIIFQLKDFDYTNPESYLWIGIVFVFFLISYISQIVGIMNTRYWIEDNYFILTTGIFNKKRKELNIKRIQSVDMTQGVVNQIIGGVDLQIKTPSDGIVLSVISKKQGEYLERYIDQLQTELKTEVAQKSSAEKNDNCNHDIEGNVEDIAEGRLDEVQNTDSMLNQKNKRIPIYQMNFKESLFMAMTSGAIGVTLAALVPIYGAVRELIPWSKLNHEISQWVQIVSISVLIIILLVLIVAYIIGTIITMIRFYGFSVMLENEQLKIEYGLFNKKKVTVPTKRLQAVVERQSYIRRLFGYTAIHFIITSDFENKKIEDDDNDSGSVPILPFIKRDKAYQIIQNLVPDLSYQQVNEGMPLSGFHRHFLIPSIIVIAMAGIGCYFWNQLLLLFTIITIVIIGLFVIKGYLYVKHAGFKMTEEQITIQNFELLKRNIYYFKAHHIIGFDTWQHTLLKRNNLNNFSFIVAKGVGAQSINLKYARSEDANKLKSWYLRGENDEGL

SEQ ID NO: 2083 - DNA, 477 bp, Staphylococcus aureus
atgtcagattatactaagttgactaagagtcctaagtcagcattgttgtattactacattacgaatggcttagaatttatattgagtgtagctgtgtatgtcattttttattttatatggttaagatttgaatggccacattacttactttatattttgttggttttaggtgctctgagtacattaaaattatttattaagcctttatggcaatatcattgtcgcttttataaagttgatcaactaagtgtacaatatcgtacatcattttttatatataaagaagaaacgagtcgaattgaacgtttacaatacttgtcgattaaatctaatccaattagtaaagtgcttaatttgtataaagttggatttatgactgcaggtcatactatttatttaccgatgatgtctcatgacgatgttaaaataatcgaagagagaactatgtcgaatttgagaggggttgaaagtgatgtc

SEQ ID NO: 2084 - protein, 159 aa, Staphylococcus aureus
  MISC_FEATURE (1)..(159): hypothetical protein
MSDYTKLTKSPKSALLYYYITNGLEFILSVAVYVIFYFIWLRFEWPHYLLYILLVLGALSTLKLFIKPLWQYHCRFYKVDQLSVQYRTSFFIYKEETSRIERLQYLSIKSNPISKVLNLYKVGFMTAGHTIYLPMMSHDDVKIIEERTMSNLRGVESDV

SEQ ID NO: 2085 - DNA, 597 bp, Staphylococcus aureus
ttgtacaattttttgtgtaaagaggaaggagcctgtaccatgaatacgataagaaatagtatttgtttaacgataataactatggtattatgtggatttttattcccgttagctatcacgttaattggtcaaatatttttttatcaacaagcaaatggcagtttaattacgtatgacaatcgtatagttggatcaaaattgattggacagcactggacagagacacgatattttcacgggagaccgagtgcagttgattataatatgaatcctgaaaaattatataaaaacggcgtatcttcaggtggaagtaatgaatcgaatggaaacaccgaattaatagcacgcatgaaacatcatgttaaatttgggaattcaaatgtaacaatagatgctgcaacaagttctgggtcgggcttagatccgcatattacggtcgaaaatgcattgaagcaagcacctcgtattgctgatgctcgtcatgtatctacttcaagagtggccgacttgattcaacatcgtaagcagcgtggtgtgttaacaaatgattatgtgaatgtgcttgaactaaatatcgctcttgataagatgaaagat

SEQ ID NO: 2086 - protein, 199 aa, Staphylococcus aureus
  MISC_FEATURE (1)..(199): probable
LYNFLCKEEGACTMNTIRNSICLTIITMVLCGFLFPLAITLIGQIFFYQQANGSLITYDNRIVGSKLIGQHWTETRYFHGRPSAVDYNMNPEKLYKNGVSSGGSNESNGNTELIARMKHHVKFGNSNVTIDAATSSGSGLDPHITVENALKQAPRIADARHVSTSRVADLIQHRKQRGVLTNDYVNVLELNIALDKMKD

SEQ ID NO: 2087 - DNA, 2034 bp, Staphylococcus aureus
atggaaaaaatgcatcatgtaaataaatatttcaatcaaacaatggtgatagaagctttgaaaatgagtttttataagctgaatcttaaacaattaataaaaaatccgataatgtttgtcgttgaggttggaatgattttaacgttgatattaatatgttttcctgacatatttggaactagctatctatcgcgaggttatttgattacaatttttatcatattattaataactatattgtttgctaatttttcagaagcctttgctgaaggtcgtggaaaagcgcaagctgatagtttaagacaagcacaatcaaatttaactgctcgattgatagaagaaaatggtgcgtatcggatagtgaacgccacagagttaaaagccggacaaaatattcgggtagaaaatggagaaacaatccctgctgatggcgttgtaataaatggattagcaaccgttgatgaatctgcaattactggtgagtctgcacctgtgataaaagaatcaggtggcgattttgatggagtcattggcggtacacttgtaacatctgattggttagaaatacgtgttgagagtgaagcgggtacatcttttttagataaaatgattgccttagttgaaggggcggaaagaaataaaacaccaaatgaaattgcactttttacattattaacaacgttaacaattatatttttagtcgttattgtaacgttatatccaatagcatcttacctgcatttaattttacctattgcgatgctcattgcgttaacagtatgtttaataccaacgacaatcggtggtttgttatcggcgattggtattgcaggcatggatcgtgttactcaattcaatgtattagcgaaaagtgggcgtgctgtagaagtatgtggagatgtcgatgtaatgattttagacaagacaggcacaatcacttatggcaatcgaatcgctagtgaatttttaccagtgaatcaacaaatgcttgaaaaattgatagtcgctgcttatatgtcatcaatctacgatgatacgccagaaggaaaaagtattgtacgattagcgaagcagatgtatataaatgagctgcctaaagacattgatggcacatataagccttttacagctgaaactagaatgagcggaatcattacaaatgaaatatcggtattcaaaggtgcacctaatagtatgataaatcttgtcaaacaacaacaaggcaatattcctcttaatattgagtctctctgtatggatgtatcgagtaaaggtggcacaccattaatagtcattgaaaacaatgtcatgcttggcgtgatttatttaaaagatgtgattaaagatggtcttgtagaacgatttactgaattgagaaaaatggggattgaaacagttatgtgtacaggtgataatgctttaacagcagctacaattgcaaaagaagccggggttgatagatttgttgcagagtgtaaacccgaagataaaattaaagtcatcaaagatgaacaagcgaaaggccatattgttgcgatgacaggagatggtacaaatgatgcacctgcgctagcacaagcgaatataggattagctatgaactcagggacaattagtgctaaagaggcagctaatctaattgatttagattcgaatcctacaaagttaatagaggttgtaaaaataggcaaacaattattaatgacgagaggtgcattaacgacatttagtttggctaatgacgtagcaaaatactttgcaattttacctgcactaatgatgtcaacaattccagaaatgacttcactaaatattatgcatttatcgtcacctaaatctgcaattatatcagctttgatattcaatgcattaatcattgttgccttaattccaattgccatgaaaggtgtaaaagtaaagggttacagcattgatagaatctttataaataatatgttgatttatggattaggtggattaatcgtcccgtttttaggcattaaattaatagatatgattgtacaattttttgtg

SEQ ID NO: 2088 - protein, 678 aa, Staphylococcus aureus
  MISC_FEATURE (1)..(678): probable
MEKMHHVNKYFNQTMVIEALKMSFYKLNLKQLIKNPIMFVVEVGMILTLILICFPDIFGTSYLSRGYLITIFIILLITILFANFSEAFAEGRGKAQADSLRQAQSNLTARLIEENGAYRIVNATELKAGQNIRVENGETIPADGVVINGLATVDESAITGESAPVIKESGGDFDGVIGGTLVTSDWLEIRVESEAGTSFLDKMIALVEGAERNKTPNEIALFTLLTTLTIIFLVVIVTLYPIASYLHLILPIAMLIALTVCLIPTTIGGLLSAIGIAGMDRVTQFNVLAKSGRAVEVCGDVDVMILDKTGTITYGNRIASEFLPVNQQMLEKLIVAAYMSSIYDDTPEGKSIVRLAKQMYINELPKDIDGTYKPFTAETRMSGIITNEISVFKGAPNSMINLVKQQQGNIPLNIESLCMDVSSKGGTPLIVIENNVMLGVIYLKDVIKDGLVERFTELRKMGIETVMCTGDNALTAATIAKEAGVDRFVAECKPEDKIKVIKDEQAKGHIVAMTGDGTNDAPALAQANIGLAMNSGTISAKEAANLIDLDSNPTKLIEVVKIGKQLLMTRGALTTFSLANDVAKYFAILPALMMSTIPEMTSLNIMHLSSPKSAIISALIFNALIIVALIPIAMKGVKVKGYSIDRIFINNMLIYGLGGLIVPFLGIKLIDMIVQFFV

SEQ ID NO: 2089 - DNA, 1686 bp, Staphylococcus aureus
gtgagggttatcatggaaataattttgtttctaacaatgatggttatgattacgtatgtttttagtggatatctatatcgcgtagcattggtgcaatcgtcaagagtagatttaatatttactagatttgaaaatatgtgttttaaaattatcggcacagatttagaacacatgtcagctaaaacatatgtcaaacattttctggcatttaatggatttatggggtttataacatttgtattgctaatagttcagcaatggctttttttaaatccaaatcataatttaaaccaatcgatagatttagcgtttaatacagcaatatcttttttaacaaatagtaatttacaacactataacggtgaatcagatgtgacatatttaacgcaaatgattgtaatgacatatttaatgtttacatctagtgcatcaggttacgccgtttgtatagcgatgttgagacgtttaactggattaactaatatcattggtaatttttatcaagatattgttcggtttattgtccgagtacttttaccattatcatgtttaattagtattttattgatgactcaaggtgtaccacaaacgttgcatgctaatttaatgattcggactttaagcggacatattcaacatattgcatttggacctattgcatcacttgaatcaataaaacatcttggtacgaatggtggaggatttttagcaggaaattctgcaacaccttttgaaaatccaaatatttggagcaattttatagaaatgggcagtatgatgttacttcctatgtcaatgttgttcttatttggtcgcatgttaagtagacatggtaaacgagtacatcgtcatgcgttgatattatttgtcgcaatgtttttcatttttatagcaattcttacattaactatgtggagtgagtatcgtggtaatccaatactagcgaatttaggcatttatggaccgaatatggaaggtaaagaggtacggtttggagcaggtttgtcagcactatttacagttattacgacggcatttacaacgggttctgttaataacatgcatgatagcttaacgcctataggtggattaggaccaatggtattaatgatgctaaatgttgtatttggtggcgaaggcgtaggactcatgaatttattgatatttgtcttactgacggtgtttatatgcagtttgatggttggtaaaacaccagaatatttaaatatgccaattggcgcccgtgaaatgaaatgtattgtcttagtctttctcatacacccaattttaattttagtattttcagcacttgcttttatgattcctggagcaagtgaaagtataacgaatccgtcttttcatggtatttcacaagttatgtatgaaatgacatcagctgctgcgaacaatggatcagggtttgaaggactgaaagatgatacaacattctggaatatctctacaggaatcattatgttgctttctcgttatataccaattattttgcaattaatgattgcatcaagtttagtgaataaaaaatcataccatcaagataaatatacaatagcgattgataaaccttattttggcgtatcactaatcgtatttatcgttttactaagtggtttgacatttattccagtactattacttggtcctattggtgaatttttaactttaaaa

SEQ ID NO: 2090 - protein, 562 aa, Staphylococcus aureus
  MISC_FEATURE (1)..(562): probable
VRVIMEIILFLTMMVMITYVFSGYLYRVALVQSSRVDLIFTRFENMCFKIIGTDLEHMSAKTYVKHFLAFNGFMGFITFVLLIVQQWLFLNPNHNLNQSIDLAFNTAISFLTNSNLQHYNGESDVTYLTQMIVMTYLMFTSSASGYAVCIAMLRRLTGLTNIIGNFYQDIVRFIVRVLLPLSCLISILLMTQGVPQTLHANLMIRTLSGHIQHIAFGPIASLESIKHLGTNGGGFLAGNSATPFENPNIWSNFIEMGSMMLLPMSMLFLFGRMLSRHGKRVHRHALILFVAMFFIFIAILTLTMWSEYRGNPILANLGIYGPNMEGKEVRFGAGLSALFTVITTAFTTGSVNNMHDSLTPIGGLGPMVLMMLNVVFGGEGVGLMNLLIFVLLTVFICSLMVGKTPEYLNMPIGAREMKCIVLVFLIHPILILVFSALAFMIPGASESITNPSFHGISQVMYEMTSAAANNGSGFEGLKDDTTFWNISTGIIMLLSRYIPIILQLMIASSLVNKKSYHQDKYTIAIDKPYFGVSLIVFIVLLSGLTFIPVLLLGPIGEFLTLK

SEQ ID NO: 2091 - DNA, 2727 bp, Staphylococcus aureus
gtgtatgcagaaataaattttatagcatttaattgtgaagaatattatgatattgctatcgaggtgaaggttatgtcaaacactgaatcgctaaacataggaaaaaagcgtggatctttaacaatttacatcggttacagtccaggtgttggtaaaacatttgagatgctttcaaatgccattgaactatttcaaagtaacgttgatattaaaataggatatattgaaccgcatcagcgtgatgaaacaaatgcattagctgaacaattacctaaaatcacaaccaattttactaaacatggtagtcatcattttcaatatttagatgtcgaccgcataatcgaagaatcgccgacaatagtacttatcgatgagttagcacatacgaatatttctagagatcgtcatgagaaacgatatatggatattgaagaaattttaaatcatggtatcgatgttcataccactttgaacattcaacatattgaaagtttaagtagtcaaattgaactgatgaccggtgtacatgttaaagaacgtgtacccgactatttcataatgagcgccgatgtattagaagtcgtagatatctcacctgaacaattaattaaacgcttaaaagctggcaaggtatataaaaaggataggctagatgtagcatttagtaatttctttacgtatgcccacctaagcgaactgcgtacattgacgttaagaacagttgccgacttgatgagtgataaagaaaaagtccgacacaaccataaaacgtcactcaaacctcatattgctgtggcaattagtgggagcatttataatgaagcagtaattaaagaggcattccatattgctcaaaaagaacatgcgaagttcactgctatttatatagatgtattcgaaaaaaacaggcaatataaagatagtcaaaagcaagtgcatcaacatctcatgcttgcaaaatcattaggagcaaaagtaaaagtagtttatagccaaaccgttgcattaggattagacgaatggtgtaaaaatcaagatgtaaccaaattaattatcggacaacatattagaaataagtggcgagactttttcaatacacctttaattgaccatttaatgtcctttgaacatagctataaaatcgaaatcgttccaatcaaacaaatacctgttgaattgaaaatgaacaaatcaccctatcgtcctaaaggcaaacgtttcgccatagatatgttaaaaatgattttgattcaaataatttgtgtaatgatgggactgtggatttatcaacttgataagcatgagtctagtacgattattttaatgatttttctcatcggcatcattttattatccatttggacgcggtccttcatcattggctttttagcagcaattattaacgtatttgtttttaattatttttttacggaacctagatatacatttgaagtatatcgctttgactatcctattacatttatcgttagcattttaacaagtattttaacgagtgctttattaaaacaaattaaattccaatactccattactaaaaagcaactttatcgtacagatttattatttcaatttaatgattcgattaaacaaacttatacagttgaaaacttactaataaatgctggataccaaattaatcaattattgcaacaatcaattactatatacgttatcaatcaatcgaaagtaattaaaacaataccattgcaaaaccatatcgataatacgactcaacagcatgaacaagcattaagctgggtaattaaaaatgaaagacaagctggtgcaacaacagatacatttccaggcattaataaatggttgataccaattggcacatctccgattaaaggcattctagccattgattaccaaagttctcaagtgattaatccatatgatgcatcaatattagaatcaatgttaaatgaactttctctcgccgttgaaaatgtgacgttacttaaacaaacgagagaatccatgttacaggctgaacgtcaactgacacattcaaattttttaagatcaatttcgcatgacatacgtacaccgttaacaacaattatgggaaatttagatattttagtatcacatagtaaagatatgtctatcatagaaaaggaacaattacttgtacatagttttcaagaaagtcagtatttatatctattagtgacaaatattttatcattaacaaaattacagtcatcaaatgttcagataaaattgcaaccttatctcgttagtgaattagtagaagaaatcgatatgattttagaacgtcgccatttaaaaaagcgtataactgtatcatcctcagtaaatttacagtttatacacattgacagtaagttgattttacaagctttattcaatttgattgaaaatgcagttaaacacacttctactgacaccaaaatcaatttatctattcgttatgctagctatgaacaaatcgaatttgccgttatagacgaaggacctggaattagtttagaagaacaacaaaagatattcgagcctttttacacaggatcaaataaatattttaaagataaccaaaaagaaagcatgggactaggcttatatttagtacagactatcctacacaaacatcaatcaaacttacaatataaaccgaaccaaccacacggcagtatattctatttcaatatatatacagactttaacgaaggagacgta

SEQ ID NO: 2092 - protein, 909 aa, Staphylococcus aureus
  MISC_FEATURE (1)..(909): sensor protein
VYAEINFIAFNCEEYYDIAIEVKVMSNTESLNIGKKRGSLTIYIGYSPGVGKTFEMLSNAIELFQSNVDIKIGYIEPHQRDETNALAEQLPKITTNFTKHGSHHFQYLDVDRIIEESPTIVLIDELAHTNISRDRHEKRYMDIEEILNHGIDVHTTLNIQHIESLSSQIELMTGVHVKERVPDYFIMSADVLEVVDISPEQLIKRLKAGKVYKKDRLDVAFSNFFTYAHLSELRTLTLRTVADLMSDKEKVRHNHKTSLKPHIAVAISGSIYNEAVIKEAFHIAQKEHAKFTAIYIDVFEKNRQYKDSQKQVHQHLMLAKSLGAKVKVVYSQTVALGLDEWCKNQDVTKLIIGQHIRNKWRDFFNTPLIDHLMSFEHSYKIEIVPIKQIPVELKMNKSPYRPKGKRFAIDMLKMILIQIICVMMGLWIYQLDKHESSTIILMIFLIGIILLSIWTRSFIIGFLAAIINVFVFNYFFTEPRYTFEVYRFDYPITFIVSILTSILTSALLKQIKFQYSITKKQLYRTDLLFQFNDSIKQTYTVENLLINAGYQINQLLQQSITIYVINQSKVIKTIPLQNHIDNTTQQHEQALSWVIKNERQAGATTDTFPGINKWLIPIGTSPIKGILAIDYQSSQVINPYDASILESMLNELSLAVENVTLLKQTRESMLQAERQLTHSNFLRSISHDIRTPLTTIMGNLDILVSHSKDMSIIEKEQLLVHSFQESQYLYLLVTNILSLTKLQSSNVQIKLQPYLVSELVEEIDMILERRHLKKRITVSSSVNLQFIHIDSKLILQALFNLIENAVKHTSTDTKINLSIRYASYEQIEFAVIDEGPGISLEEQQKIFEPFYTGSNKYFKDNQKESMGLGLYLVQTILHKHQSNLQYKPNQPHGSIFYFNIYTDFNEGDV

SEQ ID NO: 2093 - DNA, 204 bp, Staphylococcus aureus
atgaatgagattgaaactattataagtgaaatagaaaagttattaactaacaatacaccatatagtatttcaaaaaactcaggtgtaccacgtcaaacagttactgatttaaaggtaggtaaaactaaaataaaagaagctaaatttaaaacgataatcaagttatatgaatatcaaagaacattagaaaataaaacagaatgt

SEQ ID NO: 2094 - protein, 68 aa, Staphylococcus aureus
  MISC_FEATURE (1)..(68): hypothetical protein
MNEIETIISEIEKLLTNNTPYSISKNSGVPRQTVTDLKVGKTKIKEAKFKTIIKLYEYQRTLENKTEC

SEQ ID NO: 2095 - DNA, 693 bp, Staphylococcus aureus
atgcaatctaaaatattgataattgaagatgatcacgcaatcacacatttacttgatgttgcattaactttagattattacaatgtaactacagccgacaatgccacacaagcacactttaaaattcaaattgataaaccagatgtcattttattagatttaggtttaccagataaagatggattatgtttgatttcagaaatcaggcaacatactgacattcctatcattgtaataagtgcaagacaagaagaacaaacaattattcaagctttagataacggtgcgaatgactatatgactaaaccttttaatgttgatgagcttcgggcacgaatacgagtcatcgagagaatcgctaagtcacatcaagaaactaacattgtatttactaacggtttgctaagcatcgactttggctccaaatctgttgttattaataatcaggaggtacatttgacgccaaatgaatttagcttgttagaactattgtcaaatcataaaggaaaagtactcacttatgagatgatattaaaacgaatatatggctatgttaataagactgaaatgcctagtttaagagtgcatatgacatcattaagacaaaaactttcacaatgtcatgaggacgcaaaagatattattaaaacacatccacgcattggttatcaaatgttgcagtggaaagagaaa

SEQ ID NO: 2096 - protein, 231 aa, Staphylococcus aureus
  MISC_FEATURE (1)..(231): KDP operon transcriptional
MQSKILIIEDDHAITHLLDVALTLDYYNVTTADNATQAHFKIQIDKPDVILLDLGLPDKDGLCLISEIRQHTDIPIIVISARQEEQTIIQALDNGANDYMTKPFNVDELRARIRVIERIAKSHQETNIVFTNGLLSIDFGSKSVVINNQEVHLTPNEFSLLELLSNHKGKVLTYEMILKRIYGYVNKTEMPSLRVHMTSLRQKLSQCHEDAKDIIKTHPRIGYQMLQWKEK

SEQ ID NO: 2097 - DNA, 1551 bp, Staphylococcus aureus
ttgagaaataaacaggtaaaaaggagaattattttgcaaaattttaaagaactagggatttcggataatacggttcagtcacttgaatcaatgggatttaaagagccgacacctatccaaaaagacagtatcccttatgcgttacaaggaattgatatccttgggcaagctcaaaccggtacaggtaaaacaggagcattcggtattcctttaattgagaaagtagtagggaaacaaggggttcaatcgttgattttagcacctacaagagaattggcaatgcaggtagctgaacaattaagagaatttagccgtggacaaggtgtccaagttgttactgtattcggtggtatgcctatcgaacgccaaattaaagccttgaaaaaaggcccacaaatcgtagtcggaacacctgggcgtgttatcgaccatttaaatcgtcgcacattaaaaacggacggaattcatactttgattttagatgaagctgatgaaatgatgaatatgggattcatcgatgatatgagatttattatggataaaattccagcagtacaacgtcaaacaatgttgttctcagctacaatgcctaaagcaatccaagctttagtacaacaatttatgaaatcaccaaaaatcattaagacaatgaataatgaaatgtctgatccacaaatcgaagaattctatacaattgttaaagaattagagaaatttgatacatttacaaatttcctagatgttcatcaacctgaattagcaatcgtattcggacgtacaaaacgtcgtgttgatgaattaacaagtgctttgatttctaaaggatataaagctgaaggtttacatggtgatattacacaagcgaaacgtttagaagtattaaagaaatttaaaaatgaccaaattaatattttagtcgctactgatgtagcagcaagaggactagatatttctggtgtgagtcatgtttataactttgatatacctcaagatactgaaagctatacacaccgtattggtcgtacgggtcgtgctggtaaagaaggtatcgctgtaacgtttgttaatccaatcgaaatggattatatcagacaaattgaagatgcaaacggtagaaaaatgagtgcacttcgtccaccacatcgtaaagaagtacttcaagcacgtgaagatgacatcaaagaaaaagttgaaaactggatgtctaaagagtcagaatcacgcttgaaacgcatttctacagagttgttaaatgaatataacgatgttgatttagttgctgcacttttacaagagttagtagaagcaaacgatgaagttgaagttcaattaacttttgaaaaaccattatctcgcaaaggccgtaacggtaaaccaagtggttctcgtaacagaaatagtaagcgtggtaatcctaaatttgacagtaagagtaaacgttcaaaaggatactcaagtaagaagaaaagtacaaaaaaattcgaccgtaaagagaagagcagcggtggaagcagacctatgaaaggtcgcacatttgctgaccatcaaaaa

SEQ ID NO: 2098 - protein, 517 aa, Staphylococcus aureus
  MISC_FEATURE (1)..(517): hypothetical protein
LRNKQVKRRIILQNFKELGISDNTVQSLESMGFKEPTPIQKDSIPYALQGIDILGQAQTGTGKTGAFGIPLIEKVVGKQGVQSLILAPTRELAMQVAEQLREFSRGQGVQVVTVFGGMPIERQIKALKKGPQIVVGTPGRVIDHLNRRTLKTDGIHTLILDEADEMMNMGFIDDMRFIMDKIPAVQRQTMLFSATMPKAIQALVQQFMKSPKIIKTMNNEMSDPQIEEFYTIVKELEKFDTFTNFLDVHQPELAIVFGRTKRRVDELTSALISKGYKAEGLHGDITQAKRLEVLKKFKNDQINILVATDVAARGLDISGVSHVYNFDIPQDTESYTHRIGRTGRAGKEGIAVTFVNPIEMDYIRQIEDANGRKMSALRPPHRKEVLQAREDDIKEKVENWMSKESESRLKRISTELLNEYNDVDLVAALLQELVEANDEVEVQLTFEKPLSRKGRNGKPSGSRNRNSKRGNPKFDSKSKRSKGYSSKKKSTKKFDRKEKSSGGSRPMKGRTFADHQK

SEQ ID NO: 2099 - DNA, 1356 bp, Staphylococcus aureus
atgattaatgttacattaaagcaaattcaatcatggattccttgtgaaattgaagatcaatttttaaatcaagagataaatggagtcacaattgattcacgagcaatttctaaaaatatgttatttataccatttaaaggtgaaaatgttgacggtcatcgctttgtctctaaagcattacaagatggtgctggggctgctttttatcaaagagggacacctatagatgaaaatgtaagcgggcctattatatgggttgaagacacattaacggcattacaacaattggcacaagcttacttgagacatgtaaaccctaaagtaattgccgtcacagggtctaatggtaaaacaacgactaaagatatgattgaaagtgtattgcataccgaatttaaagttaagaaaacgcaaggtaattacaataatgaaattggtttacctttaactattttggaattagataatgatactgaaatatcaatattggagatggggatgtcaggtttccatgaaattgaatttctgtcaaacctcgctcaaccagatattgcagttataactaatattggtgagtcacatatgcaagatttaggttcgcgcgaggggattgctaaagctaaatctgaaattacaataggtctaaaagataatggtacgtttatatatgatggcgatgaaccattattgaaaccacatgttaaagaagttgaaaatgcaaaatgtattagtattggtgttgctactgataatgcattagtttgttctgttgatgatagagatactacaggtatttcatttacgattaataataaagaacattacgatctgccaatattaggaaagcataatatgaaaaatgcgacgattgccattgcggttggtcatgaattaggtttgacatataacacaatctatcaaaatttaaaaaatgtcagcttaactggtatgcgtatggaacaacatacattagaaaatgatattactgtgataaatgatgcctataatgcaagtcctacaagtatgagagcagctattgatacactgagtactttgacagggcgtcgcattctaattttaggagatgttttagaattaggtgaaaatagcaaagaaatgcatatcggtgtaggtaattatttagaagaaaagcatatagatgtgttgtatacgtttggtaatgaagcgaagtatatttatgattcgggccagcaacatgtcgaaaaagcacaacacttcaattctaaagacgatatgatagaagttttaataaacgatttaaaagcgcatgaccgtgtattagttaaaggatcacgtggtatgaaattagaagaagtggtaaatgctttaatttca

SEQ ID NO: 2100 - protein, 452 aa, Staphylococcus aureus
MINVTLKQIQSWIPCEIEDQFLNQEINGVTIDSRAISKNMLFIPFKGENVDGHRFVSKALQDGAGAAFYQRGTPIDENVSGPIIWVEDTLTALQQLAQAYLRHVNPKVIAVTGSNGKTTTKDMIESVLHTEFKVKKTQGNYNNEIGLPLTILELDNDTEISILEMGMSGFHEIEFLSNLAQPDIAVITNIGESHMQDLGSREGIAKAKSEITIGLKDNGTFIYDGDEPLLKPHVKEVENAKCISIGVATDNALVCSVDDRDTTGISFTINNKEHYDLPILGKHNMKNATIAIAVGHELGLTYNTIYQNLKNVSLTGMRMEQHTLENDITVINDAYNASPTSMRAAIDTLSTLTGRRILILGDVLELGENSKEMHIGVGNYLEEKHIDVLYTFGNEAKYIYDSGQQHVEKAQHFNSKDDMIEVLINDLKAHDRVLVKGSRGMKLEEVVNALIS

SEQ ID NO: 2101 - DNA, 1179 bp, Staphylococcus aureus
gtgatactattaagattcaaagatgcgaataaatcaattaacaataggactaaatcaatattaatttatattaaggtagcaaaccctgatatatcattggaggaaaacgaaatgacaaaagaaaatatttgtatcgtttttggagggaaaagtgcagaacacgaagtatcgattctgacagcacaaaatgtattaaatgcaatagataaagacaaatatcatgttgatatcatttatattaccaatgatggtgattggagaaagcaaaataatattacagctgaaattaaatctactgatgagcttcatttagaaaatggagaggcgcttgagatttcacagctattgaaagaaagtagttcaggacaaccatacgatgcagtattcccattattacatggtcctaatggtgaagatggcacgattcaagggctttttgaagttttggatgtaccatatgtaggaaatggtgtattgtcagctgcaagttctatggacaaacttgtaatgaaacaattatttgaacatcgagggttaccacagttaccttatattagtttcttacgttctgaatatgaaaaatatgaacataacattttaaaattagtaaatgataaattaaattacccagtctttgttaaacctgctaacttagggtcaagtgtaggtatcagtaaatgtaataatgaagcggaacttaaagaaggtattaaagaagcattccaatttgaccgtaagcttgttatagaacaaggcgttaacgcacgtgaaattgaagtagcagttttaggaaatgactatcctgaagcgacatggccaggtgaagtcgtaaaagatgtcgcgttttacgattacaaatcaaaatataaagatggtaaggttcaattacaaattccagctgacttagacgaagatgttcaattaacgcttagaaatatggcattagaggcattcaaagcgacagattgttctggtttagtccgtgctgatttctttgtaacagaagacaaccaaatatatattaatgaaacaaatgcaatgcctggatttacggctttcagtatgtatccaaagttatgggaaaatatgggcttatcttatccagaattgattacaaaacttatcgagcttgctaaagaacgtcaccaggataaacagaaaaataaatacaaaattgac

SEQ ID NO: 2102 - protein, 393 aa, Staphylococcus aureus
  MISC_FEATURE (1)..(393): D-alanine-D-alanine ligase
VILLRFKDANKSINNRTKSILIYIKVANPDISLEENEMTKENICIVFGGKSAEHEVSILTAQNVLNAIDKDKYHVDIIYITNDGDWRKQNNITAEIKSTDELHLENGEALEISQLLKESSSGQPYDAVFPLLHGPNGEDGTIQGLFEVLDVPYVGNGVLSAASSMDKLVMKQLFEHRGLPQLPYISFLRSEYEKYEHNILKLVNDKLNYPVFVKPANLGSSVGISKCNNEAELKEGIKEAFQFDRKLVIEQGVNAREIEVAVLGNDYPEATWPGEVVKDVAFYDYKSKYKDGKVQLQIPADLDEDVQLTLRNMALEAFKATDCSGLVRADFFVTEDNQIYINETNAMPGFTAFSMYPKLWENMGLSYPELITKLIELAKERHQDKQKNKYKID

SEQ ID NO: 2103 - DNA, 1200 bp, Staphylococcus aureus
atgaattattcatctcgtcaacagccggataagcattggcttcgcaaagtagactgggtattagtagccactatagctgttttagcaattttcagtgttctgcttattaactcggcaatgggcggtggtcaatacagtgctaatttcggtatcagacaaattttttattacattttaggtgcaatttttgcaggtatcatcatgtttatttcacctaaaaagattaaacattatacatatttattgtatttcttaatctgtctattattaataggcttgctcgttattcctgagtcacctattacacctattatcaatggtgccaaaagttggtacacgtttggccctatcagtattcagccatctgaattcatgaaaattattttaattttagcattagcgcgtgtcgtttctagacataatcaattcacattcaataaatcattccaaagtgatttgttattatttttcaaaattattggtgtctcgttagtaccaagtattttaatattactgcaaaatgacctaggaactacattagtattagctgctattattgcaggtgtgatgttagtaagtggtataacatggcgtatcttagcacctatctttattacaggtattgttggtgcaatgacagtcattttaggtattctatatgcacccgcattaattgaaaatttattaggtgtccaactgtatcaaatgggacgaatcaattcatggcttgacccctatacatatagtagtggtgatggctatcatttaactgaatcacttaaagctatcggttctggacagttactaggtaaaggatacaatcacggtgaagtttatatacctgaaaatcatactgactttatcttttcagtgattggagaggaacttggctttatcggttctgtcatattgatcttaatatttttatttttaatcttccatctaataagattagctgcgaaaattgaagatcaatttaacaaaatctttatcgttggtttcgtcactttacttgtgttccatattttacaaaatattggtatgacaattcagttgttaccaatcactggtattccattaccatttattagttatggtggtagtgcgctatggagtatgatgactggaataggtatagtcttatcaatttattatcatgaaccaaaacgatatgtcgatttataccatccaaaaagtaat

SEQ ID NO: 2104 - protein, 400 aa, Staphylococcus aureus
  MISC_FEATURE (1)..(400): hypothetical protein
MNYSSRQQPDKHWLRKVDWVLVATIAVLAIFSVLLINSAMGGGQYSANFGIRQIFYYILGAIFAGIIMFISPKKIKHYTYLLYFLICLLLIGLLVIPESPITPIINGAKSWYTFGPISIQPSEFMKIILILALARVVSRHNQFTFNKSFQSDLLLFFKIIGVSLVPSILILLQNDLGTTLVLAAIIAGVMLVSGITWRILAPIFITGIVGAMTVILGILYAPALIENLLGVQLYQMGRINSWLDPYTYSSGDGYHLTESLKAIGSGQLLGKGYNHGEVYIPENHTDFIFSVIGEELGFIGSVILILIFLFLIFHLIRLAAKIEDQFNKIFIVGFVTLLVFHILQNIGMTIQLLPITGIPLPFISYGGSALWSMMTGIGIVLSIYYHEPKRYVDLYHPKSN

SEQ ID NO: 2105 - DNA, 144 bp, Staphylococcus aureus
gtgataataatgaaacgtcctgaaaagattcaaaatgtagtcaaactattgtcatcattaggtgtgaatattaaaaaaactaaatctcgtttagacattattaatactttgccagcatctaataaagtaagtcacgaattaaaa

SEQ ID NO: 2106 - protein, 48 aa, Staphylococcus aureus
  MISC_FEATURE (1)..(48): hypothetical protein
VIIMKRPEKIQNVVKLLSSLGVNIKKTKSRLDIINTLPASNKVSHELK

SEQ ID NO: 2107 - DNA, 207 bp, Staphylococcus aureus
atgatacatcaaaatacgatttacacagcgggaattgaaacagaagaacaagtaagtcaattgacagaacgcatttcaaatatgataggtgttcatcaagtgaatattaatataatagatggtcaagtaactgtatcgtatgagacaccagcaaatttgaatagtattgaaaaagaaatctatgatgaaggatacaaaattgtattt

SEQ ID NO: 2108 - protein, 69 aa, Staphylococcus aureus
  MISC_FEATURE (1)..(69): hypothetical protein
MIHQNTIYTAGIETEEQVSQLTERISNMIGVHQVNINIIDGQVTVSYETPANLNSIEKEIYDEGYKIVF

SEQ ID NO: 2109 - DNA, 354 bp, Staphylococcus aureus
gtgttgacgttgtgttttatgggatatagtatagtaaggaatgtaaatgaaggagtgaatgctatgactgaacaagataatgcacatcattctgaacaaataaaaacgaatcttaaatcacgtttaaatcgaattgaaggacaagtgagagcgattaatcgcatgattgaagaagatgtctattgtgatgatgtccttacgcaaataagagcgacacgttcggcgttaaacagtgttgcgataaagttattagaacaacatatgaaaagttgtattatgaataaagttaatcaaggtgctcaggaagaggcaatggaagagttattagtgacttttcaaaaattgattaaagac

SEQ ID NO: 2110 - protein, 118 aa, Staphylococcus aureus
  MISC_FEATURE (1)..(118): conserved hypothetical
VLTLCFMGYSIVRNVNEGVNAMTEQDNAHHSEQIKTNLKSRLNRIEGQVRAINRMIEEDVYCDDVLTQIRATRSALNSVAIKLLEQHMKSCIMNKVNQGAQEEAMEELLVTFQKLIKD

SEQ ID NO: 2111 - DNA, 1539 bp, Staphylococcus aureus
atgatacaattaataagatatactactcgtttaaagattttcgatgggaggtttcaaatgatagagttattatccattgcactcaagcattctaatattattttaaattcaatatttattggtgcatttattttaaacttattattcgcctttaccattattttcatggaaagacgttctgccaattctatctgggcttggttactagtcttagttttcttgcctttattcggcttcattttatacttactattaggacgacaaattcaacgtgaccaaattttcaaaattgataaggaagataaaaaaggattagagttaatcgttgatgagcaattagctgctttaaaaaatgaaaacttttcaaattccaattatcaaattgtaaaatttaaagaaatgattcaaatgttgttatataataacgcagcatttttaacaacagacaacgatttaaaaatatacacagacggccaagaaaaatttgatgacctaatacaagacatccgtaatgctactgattatattcattttcagtactatattattcaaaatgatgaattaggtcgtaccattttaaatgaacttggtaaaaaagcggaacaaggtgtagaagttaaaattctttatgatgacatgggttctcgtggactgcgtaaaaaaggcttacgcccgtttcgcaataaaggtggacatgctgaagcatttttcccatcaaaattacctttaattaacttgcgtatgaacaatcgaaaccatcgaaaaattgttgtaatagatgggcaaattggatatgttggtggttttaatgttggtgatgagtacttaggtaaatcaaaaaaattcggctattggcgagatacgcatttacgaattgtcggggatgcagtgaatgcattgcaattacgatttattctagattggaattcacaagccacacgtgaccacatctcctatgatgatcgttatttcccagatgtaaattctggtggaacaattggcgttcaaatagcttctagtggtcctgacgaagaatgggaacagattaaatacggctatttgaaaatgatttcatctgctaaaaaatcgatttatattcaatctccctatttcatacctgatcaagcctttttagattctattaaaattgcggcattaggtggtgttgatgtcaatatcatgattcctaataaacctgaccatccgtttgttttttgggctactttaaaaaatgcagcatccttattagatgccggtgttaaagtatttcactacgacaatggctttttacactcaaaaacacttgttatagatgatgaaattgcaagtgtgggaacagctaatatggaccatcgcagtttcacattgaatttcgaagtcaacgcttttatttatgaccaacaaattgccaaaaaattaaaacaagcttttatagatgatttagcagtatcttctgaattaacaaaagcacgttatgctaagcgaagtctttggattaaatttaaagaaggtatttcacaattattgtcacctatctta

SEQ ID NO: 2112 - protein, 513 aa, Staphylococcus aureus
  MISC_FEATURE (1)..(513): hypothetical protein
MIQLIRYTTRLKIFDGRFQMIELLSIALKHSNIILNSIFIGAFILNLLFAFTIIFMERRSANSIWAWLLVLVFLPLFGFILYLLLGRQIQRDQIFKIDKEDKKGLELIVDEQLAALKNENFSNSNYQIVKFKEMIQMLLYNNAAFLTTDNDLKIYTDGQEKFDDLIQDIRNATDYIHFQYYIIQNDELGRTILNELGKKAEQGVEVKILYDDMGSRGLRKKGLRPFRNKGGHAEAFFPSKLPLINLRMNNRNHRKIVVIDGQIGYVGGFNVGDEYLGKSKKFGYWRDTHLRIVGDAVNALQLRFILDWNSQATRDHISYDDRYFPDVNSGGTIGVQIASSGPDEEWEQIKYGYLKMISSAKKSIYIQSPYFIPDQAFLDSIKIAALGGVDVNIMIPNKPDHPFVFWATLKNAASLLDAGVKVFHYDNGFLHSKTLVIDDEIASVGTANMDHRSFTLNFEVNAFIYDQQIAKKLKQAFIDDLAVSSELTKARYAKRSLWIKFKEGISQLLSPIL

SEQ ID NO: 2113 - DNA, 663 bp, Staphylococcus aureus
atgaggagtgtaactttaatgcaacaatcagacgtcattagtgctgccaaaaaatatatggaatctattcatcaaaatgattatacaggccatgatattgcgcatgtatatcgtgtcactgctttagctaaatcaatcgctgaaaatgaaggtgttaatgatactttagtcattgaactcgcatgtttgcttcatgataccgttgacgaaaaagttgtagatgctaacaaacaatatgttgaattgaagtcatttttatcttctttatcactatcaaccgaagatcaagagcacattttatttattattaataatatgagctatcgcaatggcaaaaatgatcatgtcactttatctttagaaggtcaaattgtcagggatgcagatcgtcttgatgctataggcgctataggtgttgcacgaacatttcaatttgcaggacactttggtgaacctatgtggacagaacatatgtcactagataagattaatgatgatttagttgaacagttgccaccatctgcaattaaacatttctttgaaaaattacttaagttagaatctttaatgcatacagatacggcgaagatgattgctaaagaacgtcacgactttatgatgatgtacttgaaacagttttttacggaatggaattgtcacgac

SEQ ID NO: 2114 - protein, 221 aa, Staphylococcus aureus
  MISC_FEATURE (1)..(221): conserved hypothetical
MRSVTLMQQSDVISAAKKYMESIHQNDYTGHDIAHVYRVTALAKSIAENEGVNDTLVIELACLLHDTVDEKVVDANKQYVELKSFLSSLSLSTEDQEHILFIINNMSYRNGKNDHVTLSLEGQIVRDADRLDAIGAIGVARTFQFAGHFGEPMWTEHMSLDKINDDLVEQLPPSAIKHFFEKLLKLESLMHTDTAKMIAKERHDFMMMYLKQFFTEWNCHD

SEQ ID NO: 2115 - DNA, 222 bp, Staphylococcus aureus
ttgacaaaaattatgaaccagtttaaagaaatttataatacaatagaaaaattactaaatgataaatcaatatctaattatagaattaatcaagacactgatgtttcttatggtggtataagtgaattaagaagcgggaaaagaaaagtgaataatttaactttagaaacagcggaaaaactctataattaccaaaaacaattagaaataatgattgaagat

SEQ ID NO: 2116 - protein, 74 aa, Staphylococcus aureus
LTKIMNQFKEIYNTIEKLLNDKSISNYRINQDTDVSYGGISELRSGKRKVNNLTLETAEKLYNYQKQLEIMIED

SEQ ID NO: 2117 - DNA, 621 bp, Staphylococcus aureus
atggctaattatgatgttttaaaattagacggaactaaatcaggttcaatcgaattaagcgatgcagtattcggtattgagccaaataatagcgttttattcgaagctattaatttacaacgtgcttcattacgtcaaggtacgcatgctgttaagaatcgttcagcagtaagcggtggcggacgtaaaccatggaagcaaaaaggaacaggtcgtgctcgtcaaggtacaatccgtgctccacaatggcgtggcggtggtatcgtattcggaccaactccaagaagttatgcatacaaaatgcctaagaaaatgcgtcgtttagctttacgctcagcattatctttcaaagctcaagagaatggcttaactgtagttgacgcattcaacttcgaagctccaaaaactaaagaattcaaaaatgtattatctacattagaacaacctaaaaaagtattagtagttactgaaaacgaagatgtaaatgttgaattatcagcacgcaacatccctggcgttcaagtgacaactgctcaaggtttaaatgttttagatatcactaatgctgacagcttagtaattactgaagctgctgctaaaaaagttgaggaggtgctcgga

SEQ ID NO: 2118 - protein, 207 aa, Staphylococcus aureus
  MISC_FEATURE (1)..(207): 50S ribosomal protein L4
MANYDVLKLDGTKSGSIELSDAVFGIEPNNSVLFEAINLQRASLRQGTHAVKNRSAVSGGGRKPWKQKGTGRARQGTIRAPQWRGGGIVFGPTPRSYAYKMPKKMRRLALRSALSFKAQENGLTVVDAFNFEAPKTKEFKNVLSTLEQPKKVLVVTENEDVNVELSARNIPGVQVTTAQGLNVLDITNADSLVITEAAAKKVEEVLG

SEQ ID NO: 2119 - DNA, 420 bp, Staphylococcus aureus
atgagtaactcacaagcaattcaagcaattgaaaacgtgttagtaacgtcaaaagttggtgtattatcaactgcatataataataaacctaatagtagatatatggtcttttataatgatggtcttactttatatactaaaacgaatatccattctgctaaggtcaaagaaattaaagataatccagcagcatatgttttgttaggctataacgacacaactaatcgtagtttcgttgagatggaagcgacaatcgaaatcgttacagaacaagaagtgattgattggctatgggaaacacaagacaaaagctttttcagttcaaaagaagacccagagttatgtgttttaagagtagttccgcaatccattaagctaatgaatgataaatcattagatacacctatcaaaatcgattta

SEQ ID NO: 2120 - protein, 140 aa, Staphylococcus aureus
  MISC_FEATURE (1)..(140): hypothetical protein
MSNSQAIQAIENVLVTSKVGVLSTAYNNKPNSRYMVFYNDGLTLYTKTNIHSAKVKEIKDNPAAYVLLGYNDTTNRSFVEMEATIEIVTEQEVIDWLWETQDKSFFSSKEDPELCVLRVVPQSIKLMNDKSLDTPIKIDL

SEQ ID NO: 2121 - DNA, 105 bp, Staphylococcus aureus
atgccacatcatagcactacatcaagacgcatcgtggtaccagcacatcaaagtagcatgacatgtcaccaagctcccacaacaacacatcaaagtaacatggca

SEQ ID NO: 2122 - protein, 35 aa, Staphylococcus aureus
MPHHSTTSRRIVVPAHQSSMTCHQAPTTTHQSNMA

SEQ ID NO: 2123 - DNA, 90 bp, Staphylococcus aureus
atgccacatcatagcactacatcaagtcgcatcgtggtaccagcacatcaaagtaacatggcatcaacgccaaacctgtctataacacca

SEQ ID NO: 2124 - protein, 30 aa, Staphylococcus aureus
MPHHSTTSSRIVVPAHQSNMASTPNLSITP

SEQ ID NO: 2125 - DNA, 870 bp, Staphylococcus aureus
atgaagaaaaaagcgttactaccattatttttaggtattatggtctttttggctggttgtgactattctaaacctgaaaaacgtagtgggtttttctacaatacattcgtagatccaatgaaaaatgtattggattggttgggaaataacttattaaacgacaattatggtttagctattattatccttgtattggtaattcgtattattttattaccattcatgttgtcaaactataaaaatagtcatatgatgcgtcaaaaaatgaaagttgcaaagccagaagttgaaaaaattcaagaaaaagtgaaacgtgcgcgtacacaagaagaaaaaatggctgcaaaccaagaattaatgcaagtatataaaaagtatgacatgaacccgattaagagtatgttgggttgtttaccaatgctaatccaattaccaatcatcatgggattatactttgtacttaaagaccaacttgtagatggtttgtttaaatatccacacttcttatggttcgatttaggacgtcctgatatttggattacaattattgccggtgttttatactttatccaagcatatgtatcaagtaaaacgatgccagacgaacaacgtcaaatgggttacatgatgatggtcatttcaccaattatgattatctggatttcattaagctcagcatcagcacttggtttgtactggtcagtcagtgcggcgttccttgtagttcaaacacactttgcgaacatttattatgaaaaagtcgctaaaaaagaagtacaacctttcattgaagcgtatgaaagagagcacaacggcggcagcaataaaaaaggcaaaaacacacaagttgtgtctaaaaagaaaaagaaa

SEQ ID NO: 2126 - protein, 290 aa, Staphylococcus aureus
  MISC_FEATURE (1)..(290): lipoprotein precursor
MKKKALLPLFLGIMVFLAGCDYSKPEKRSGFFYNTFVDPMKNVLDWLGNNLLNDNYGLAIIILVLVIRIILLPFMLSNYKNSHMMRQKMKVAKPEVEKIQEKVKRARTQEEKMAANQELMQVYKKYDMNPIKSMLGCLPMLIQLPIIMGLYFVLKDQLVDGLFKYPHFLWFDLGRPDIWITIIAGVLYFIQAYVSSKTMPDEQRQMGYMMMVISPIMIIWISLSSASALGLYWSVSAAFLVVQTHFANIYYEKVAKKEVQPFIEAYEREHNGGSNKKGKNTQVVSKKKKK

SEQ ID NO: 2127 - DNA, 687 bp, Staphylococcus aureus
atgaaacaacctatcaacaacggattcgtattcaagaggtggaataatatgtttaaccaatcgtatctaaatgtgtattttatttgtgggacctccgatgttccgagtcatcgaactattcatgaagtattagaagcagcattaaaggcagggattacacttttccaatttcgagaaaagggtgaatcagctttaaaaggaaacgataaacttgtattagctaaagaattacagcatctctgtcatcaatatgatgtgccttttatcgttaatgatgatgtatccttggcaaaagaaattaacgcggatggtatacatgtcggtcaagatgatgcgaaagtcaaagagatagcacaatatttcactgataaaattattggacttagtattagtgatttagatgagtatgcaaaatctgatttaactcatgttgattatataggtgttggaccaatctatcctacgccgtcgaagcatgacgcgcatataccagtaggtccagaaatgattgcaacgtttaaagaaatgaatccgcaactaccgattgtagctattggcggtatcaatactaataatgtggcgccgattgtagaagcaggtgccaatggaatttcagtcatttcagccatttctaaaagtgaaaatattgaaaagactgttaatcgattcaaagatttttttaataat

SEQ ID NO: 2128 - protein, 229 aa, Staphylococcus aureus
  MISC_FEATURE (1)..(229): thiamin phosphate synthase
MKQPINNGFVFKRWNNMFNQSYLNVYFICGTSDVPSHRTIHEVLEAALKAGITLFQFREKGESALKGNDKLVLAKELQHLCHQYDVPFIVNDDVSLAKEINADGIHVGQDDAKVKEIAQYFTDKIIGLSISDLDEYAKSDLTHVDYIGVGPIYPTPSKHDAHIPVGPEMIATFKEMNPQLPIVAIGGINTNNVAPIVEAGANGISVISAISKSENIEKTVNRFKDFFNN

SEQ ID NO: 2129 - DNA, 789 bp, Staphylococcus aureus
atgaattatctaaataaaatacgtattgaaaacccattaacaatttgttatacaaacgatgtagttaaaaattttacagcgaatggtttattaagtattggtgctagccctgcaatgagtgaagctcccgaagaagctgaagaattttacaaagttgcacaagcgctattaatcaatatcggtactttaacagcagaaaatgaacaagatattattgcgattgctcaaacggcaaatgaggcaggcttacctattgtatttgaccctgtagctgttggtgcttctacatatcgaaagcaattttgtaaattattattgaaatcagcgaaagtatcagtaattaaaggcaatgcatctgaaatattagcgttgattgatgatacagcaactatgaaaggtacagatagtgatgctaatcttgatgcggttgcaatagcgaaaaaggcttacgcaacatataaaactgcaatagtaatcacaggtaaagaggacgttattgttcaagataataaagccttcgtattagctaatggatctccattattagcacgagtaactggagctggttgtttattaggaggcgttattgctggatttttatttagagaaacagaaccagacatagaagcgttaattgaagcggtaagcgtatttaatattgctgctgaggtagctgctgaaaatgaaaattgtggtggtcctggtacgttttcaccattgttgcttgatacgttatatcatttaaatgaaacaacctatcaacaacggattcgtattcaagaggtggaa

SEQ ID NO: 2130 - protein, 263 aa, Staphylococcus aureus
  MISC_FEATURE (1)..(263): hydroxyethyl thiazole
MNYLNKIRIENPLTICYTNDVVKNFTANGLLSIGASPAMSEAPEEAEEFYKVAQALLINIGTLTAENEQDIIAIAQTANEAGLPIVFDPVAVGASTYRKQFCKLLLKSAKVSVIKGNASEILALIDDTATMKGTDSDANLDAVAIAKKAYATYKTAIVITGKEDVIVQDNKAFVLANGSPLLARVTGAGCLLGGVIAGFLFRETEPDIEALIEAVSVFNIAAEVAAENENCGGPGTFSPLLLDTLYHLNETTYQQRIRIQEVE

SEQ ID NO: 2131 - DNA, 828 bp, Staphylococcus aureus
atgattaaacctaaaatagcattaaccattgcaggtactgatccaacaggtggtgccggcgtaatggctgatttaaaatcatttcattcatgtggtgtatatggtatgggcgtcgttacaagtattgttgctcaaaatacattgggcgtacaacatattcataatttaaatcatcaatgggtagatgaacaacttgatagtgtcttcaatgataccttacctcatgctattaaaacggggatgattgctacagcagatactatggaaacgattcgtcattatttaatgcaacatgaatctattccatatgtaattgatcctgttatgttggcgaaaagcggtgattcattaatggataatgacacaaagcaaaacttgcagcatacgttattgccattagctgacgtagtaacaccgaatttaccagaagctgaagaaataacgggactaaccattgatagtgaagaaaaaattatgcaggctggccgcatctttattaatgagattggtagtaaaggtgtcatcattaaaggcggtcattcaaatgatactgatatagcaaaagattatttatttactaacgaaggtgttcaaacatttgaaaatgaacgatttaaaacaaaacatacgcatggaacagggtgtacattttcagcagttataacggcagaacttgcaaaaggtagaccattatttgaggctgtacacaaggctaaaaagtttatttcaatgagtatacaatatacgcctgaaatcggccgtggtagaggtccagtgaatcattttgcatatttaaagaaagagggattagacgatgaattatctaaa

SEQ ID NO: 2132 - protein, 276 aa, Staphylococcus aureus
  MISC_FEATURE (1)..(276): phosphomethylpyrimidine
MIKPKIALTIAGTDPTGGAGVMADLKSFHSCGVYGMGVVTSIVAQNTLGVQHIHNLNHQWVDEQLDSVFNDTLPHAIKTGMIATADTMETIRHYLMQHESIPYVIDPVMLAKSGDSLMDNDTKQNLQHTLLPLADVVTPNLPEAEEITGLTIDSEEKIMQAGRIFINEIGSKGVIIKGGHSNDTDIAKDYLFTNEGVQTFENERFKTKHTHGTGCTFSAVITAELAKGRPLFEAVHKAKKFISMSIQYTPEIGRGRGPVNHFAYLKKEGLDDELSK

SEQ ID NO: 2133 - DNA, 687 bp, Staphylococcus aureus
atggaattttcacaaaaattgtaccaagctgcaaagccaatcattaatgatatttatgaggatgactttattcagaagatgttatccggagatataggagctgacgcattacgccattacttaaaagctgatgctgcgtatttaaaagaatttacaaacttatatgctttgttaattccaaaaatgaatagcatgaatgacgtaaaatttttagtagagcaaatagaatttatggttgaaggtgaagtacttgcgcatgatattttagcgcaaattgttggtgaatcatacgaagaaatcattaaaacaaaagtttggcctccaagtggcgaccattacataaaacatatgtatttccaagcgcatagtcgtgaaaatgctatttatacaattgctgcaatggcaccttgtccatatatttatgcagaattagctaagcgctctcaaagtgatcataagcttaatagagaaaaagatacggcaaaatggtttgatttttatagtactgaaatggatgacataattaacgtatttgaggcaataatgaataaattagccgaatcaatgtctgacaaggaattggaacaagtaaagcaagtatttttagaaagttgcatacatgagcgtcgatttttcaatatggctatgacactagaacaatgggaatttggaggaaaagtaaatgat

SEQ ID NO: 2134 - protein, 229 aa, Staphylococcus aureus
  MISC_FEATURE (1)..(229): hypothetical protein
MEFSQKLYQAAKPIINDIYEDDFIQKMLSGDIGADALRHYLKADAAYLKEFTNLYALLIPKMNSMNDVKFLVEQIEFMVEGEVLAHDILAQIVGESYEEIIKTKVWPPSGDHYIKHMYFQAHSRENAIYTIAAMAPCPYIYAELAKRSQSDHKLNREKDTAKWFDFYSTEMDDIINVFEAIMNKLAESMSDKELEQVKQVFLESCIHERRFFNMAMTLEQWEFGGKVND

SEQ ID NO: 2135 - DNA, 129 bp, Staphylococcus aureus
ttgaaaatgttgaaaccgtttgctaagattaatttgcaattgaatactaaggaactactaggggagcctaatgatatggctgagatgaattgttcagacccttatgacctgatttggttagtaccaacg

SEQ ID NO: 2136 - protein, 43 aa, Staphylococcus aureus
LKMLKPFAKINLQLNTKELLGEPNDMAEMNCSDPYDLIWLVPT

SEQ ID NO: 2137 - DNA, 693 bp, Staphylococcus aureus
atgaagaaaacattactcgcatcatcattagcagtaggtttaggaatcgtagcaggaaatgcaggtcacgaagcccatgcaagtgaagcggacttaaataaagcatctttagcgcaaatggcgcaatcaaatgatcaaacattaaatcaaaaaccaattgaagctggggcttataattatacatttgactatgaagggtttacttatcactttgaatcagatggtacacactttgcttggaattaccatgcaacaggtactaatggagcagacatgagtgcacaagcacctgcaactaataatgttgcaccatcagctgttcaagctaatcaagtacaatcacaagaagttgaagcaccacaaaatgctcaaactcaacaaccacaagcatcaacatcaaacaattcacaagttactgcaacaccaactgaatcaaaatcatcagaaggttcatcagtaaatgtgaatgctcatctaaaacaaattgctcaacgtgaatcaggtggcaatattcatgctgtaaatccaacatcaggtgcagctggtaagtatcaattcttacaatcaacttgggattcagtagcacctgctaaatataaaggtgtatcaccagcaaatgctcctgaaagtgttcaagatgccgcagcagtaaaattatataacactggtggcgctggacattgggttactgca

SEQ ID NO: 2138 - protein, 231 aa, Staphylococcus aureus
  MISC_FEATURE (1)..(231): hypothetical protein
MKKTLLASSLAVGLGIVAGNAGHEAHASEADLNKASLAQMAQSNDQTLNQKPIEAGAYNYTFDYEGFTYHFESDGTHFAWNYHATGTNGADMSAQAPATNNVAPSAVQANQVQSQEVEAPQNAQTQQPQASTSNNSQVTATPTESKSSEGSSVNVNAHLKQIAQRESGGNIHAVNPTSGAAGKYQFLQSTWDSVAPAKYKGVSPANAPESVQDAAAVKLYNTGGAGHWVTA

SEQ ID NO: 2139 - DNA, 393 bp, Staphylococcus aureus
atgctaaataaaatcgtaattgtcgggagactgacgaaagacgcacaaatatttgaaaaggaggatagaaaaattgcaacgttttgtgttgcaacgcaccgaaattataaagatgaaaatggagaaatcgtctgtgattacttattctgtaaagcatttggcaagttagcttctaatatagaaaaatatactaatcaaggtacattggttggtataactggtcaaatgagatcaagaaagtatgataaagacggacaaacacactttgtcactgaattatatgttgaaacaataaaatttatgtcccctaaatcccaaaataatgaaattctctcagatagtattttagatattgactctcaaaatatagataatcatgacttattagaaatt

SEQ ID NO: 2140 - protein, 131 aa, Staphylococcus aureus
  MISC_FEATURE (1)..(131): hypothetical protein
MLNKIVIVGRLTKDAQIFEKEDRKIATFCVATHRNYKDENGEIVCDYLFCKAFGKLASNIEKYTNQGTLVGITGQMRSRKYDKDGQTHFVTELYVETIKFMSPKSQNNEILSDSILDIDSQNIDNHDLLEI

SEQ ID NO: 2141 - DNA, 195 bp, Staphylococcus aureus
atgaattgctatgatgaaatattcaatacaatcaaagaattgatagaaaacaaagagatatcgagttatcaaattaataaagatactgggataagttacggtaatattaatgctatgcgccgtagagaaagaagaatagaaaatttaagcttaaagaatgcaaagatcttatatgaatatgcgaaaaaggtattg

SEQ ID NO: 2142 - protein, 65 aa, Staphylococcus aureus
MNCYDEIFNTIKELIENKEISSYQINKDTGISYGNINAMRRRERRIENLSLKNAKILYEYAKKVL

SEQ ID NO: 2143 - DNA, 501 bp, Staphylococcus aureus
atgaccttaaatcttctaaataattcaaaaatcataaatattaaactaatgggatgtgggaatatgaaaacttttaaagcagtaaggtttcaaattgtgaatgaacacggcagaattatagaatatgaattagaagatggcgtaataattaataaagaggaaagtggcacgggttggttgcttgaaattgtcatttctaatgagcattatgaaacatttaaggaatatcaagacaatgaacagttattggatattcgtgtcgtcatcacgcgtccagccaatgatccagctttatttgaatctactgtgaaaagtattaaaaattttaaaacaacaatgtctatcgtatttgaatgtcatatttacactttacgtcaacagtatgctgaaagtttattagaacaacttattgatgatggattatctggtgaagaattaaaaaaatcatttaatcgaatgatgcagtctaaaccaaagttaaaggatgaaaaattagaagag

SEQ ID NO: 2144 - protein, 167 aa, Staphylococcus aureus
  MISC_FEATURE (1)..(167): conserved hypothetical
MTLNLLNNSKIINIKLMGCGNMKTFKAVRFQIVNEHGRIIEYELEDGVIINKEESGTGWLLEIVISNEHYETFKEYQDNEQLLDIRVVITRPANDPALFESTVKSIKNFKTTMSIVFECHIYTLRQQYAESLLEQLIDDGLSGEELKKSFNRMMQSKPKLKDEKLEE

SEQ ID NO: 2145 - DNA, 438 bp, Staphylococcus aureus
atggaaacaatttttgattataaccaaattaaacaaattatacctcacagacagccatttttattaattgataaagtagttgaatatgaagaaggtcaacgttgtgtggctattaaacaagtatcaggaaacgaaccattctttcaagggcattttcctgagtatgcggtaatgccaggcgtattaattactgaagcgttagctcaaacaggtgcggtagctattttaaatagtgaagaaaataaaggtaaaatcgctttatttgctggtattgataaatgtcgttttaaacgtcaagtagtacctggtgatactttaacgttggaagtagaaatcactaaaattaaaggaccaataggtaaaggtaatgctaaagctactgtcgatggtcaacttgcttgtagttgtgaacttacatttgcaattcaagatgtaaaa

SEQ ID NO: 2146 - protein, 146 aa, Staphylococcus aureus
  MISC_FEATURE (1)..(146): (3R)-hydroxymyristoyl-[acyl
METIFDYNQIKQIIPHRQPFLLIDKVVEYEEGQRCVAIKQVSGNEPFFQGHFPEYAVMPGVLITEALAQTGAVAILNSEENKGKIALFAGIDKCRFKRQVVPGDTLTLEVEITKIKGPIGKGNAKATVDGQLACSCELTFAIQDVK

SEQ ID NO: 2147 - DNA, 1263 bp, Staphylococcus aureus
atggataaaatagtaatcaaaggtggaaataaattaacgggtgaagttaaagtagaaggtgctaaaaatgcagtattaccaatattgacagcatctttattagcttctgataaaccgagcaaattagttaatgttccagctttaagtgatgtagaaacaataaataatgtattaacaactttaaatgctgacgttacatacaaaaaggacgaaaatgctgttgtcgttgatgcaacaaagactctaaatgaagaggcaccatatgaatatgttagtaaaatgcgtgcaagtattttagttatgggacctcttttagcaagactaggacatgctattgttgcattgcctgggggttgtgcaattggaagtacaccgattgagcaacacattaaaggttttgaagctttaggcgcagaaattcatcttgaaaatggtaatatttatgctaatgctaaagatggattaaaaggtacatcaattcatttagattttccaagtgtaggagcaacacaaaatattattatggcagcatcattagctaagggtaagactttaattgaaaatgcagctaaagaacctgaaattgtcgatttagcaaactacattaatgaaatgggtggtagaattactggtgctggtacagacacaattacaatcaatggtgtagaatcattacatggtgtagaacatgctatcattccagatagaattgaagcaggcacattactaatcgctggtgctataacgcgtggtgatatttttgtacgtggtgcaatcaaagaacatatggcgagtttagtctataaactagaagaaatgggcgttgaattggactatcaagaagatggtattcgtgtacgtgctgaaggggaattacaacctgtagacatcaaaactctaccacatcctggattcccgactgatatgcaatcacaaatgatggcattgttattaacggcaaatggtcataaagtcgtaaccgaaactgtttttgaaaaccgttttatgcatgttgcagagttcaaacgtatgaatgctaatatcaatgtagaaggtcgtagtgctaaacttgaaggtaaaagtcaattgcaaggtgcacaagttaaagcgactgatttaagagcagcagccgccttaattttagctggattagttgctgatggtaaaacaagcgttactgaattaacgcacctagatagaggctatgttgacttacacggtaaattgaagcaattaggtgcagacattgaacgtattaacgat

SEQ ID NO: 2148 - protein, 421 aa, Staphylococcus aureus
  MISC_FEATURE (1)..(421): UDP-N-acetylglucosamine
MDKIVIKGGNKLTGEVKVEGAKNAVLPILTASLLASDKPSKLVNVPALSDVETINNVLTTLNADVTYKKDENAVVVDATKTLNEEAPYEYVSKMRASILVMGPLLARLGHAIVALPGGCAIGSTPIEQHIKGFEALGAEIHLENGNIYANAKDGLKGTSIHLDFPSVGATQNIIMAASLAKGKTLIENAAKEPEIVDLANYINEMGGRITGAGTDTITINGVESLHGVEHAIIPDRIEAGTLLIAGAITRGDIFVRGAIKEHMASLVYKLEEMGVELDYQEDGIRVRAEGELQPVDIKTLPHPGFPTDMQSQMMALLLTANGHKVVTETVFENRFMHVAEFKRMNANINVEGRSAKLEGKSQLQGAQVKATDLRAAAALILAGLVADGKTSVTELTHLDRGYVDLHGKLKQLGADIERIND

SEQ ID NO: 2149 - DNA, 231 bp, Staphylococcus aureus
atggattatatcggacaatatgcagttatccatttagtgttacatgttgtatgtatttgtattgcctattgggctttacaatcaattagattagatcaattttttaaaaaaggatacgccactcaattacaagtgtgtatgatatttgttgctattttattaggcactgcagtaagcaattttattgtagatttgttacaatactcgacgcaggtaaaatatttaataaaa

SEQ ID NO: 2150 - protein, 77 aa, Staphylococcus aureus
  MISC_FEATURE (1)..(77): conserved hypothetical
MDYIGQYAVIHLVLHVVCICIAYWALQSIRLDQFFKKGYATQLQVCMIFVAILLGTAVSNFIVDLLQYSTQVKYLIK

SEQ ID NO: 2151 - DNA, 402 bp, Staphylococcus aureus
atgaatacattaaacctagatattgtcactcctaatggttctgtttacaatcgtgataatgttgaactcgttgttatgcaaacaacagctggtgagataggtgtcatgagtggacatattccaactgtagctgctttaaaaacaggctttgtaaaagtgaaatttcacgatggaactgaatatattgctgtaagcgatggctttgttgaagttagaaaagataaagtttcaatcattgttcagactgcagaaactgcaagagaaattgatgttgaaagagctaaattagccaaagcaagagcagagtctcacttggaaaatgatgacgacaatactgatattcatagagccgaaagagctttagagagagcaaataaccgtttgcgtgtggctgaattaaaa

SEQ ID NO: 2152 - protein, 134 aa, Staphylococcus aureus
  MISC_FEATURE (1)..(134): FoF1-ATP synthase epsilon
MNTLNLDIVTPNGSVYNRDNVELVVMQTTAGEIGVMSGHIPTVAALKTGFVKVKFHDGTEYIAVSDGFVEVRKDKVSIIVQTAETAREIDVERAKLAKARAESHLENDDDNTDIHRAERALERANNRLRVAELK

SEQ ID NO: 2153 - DNA, 1410 bp, Staphylococcus aureus
atgggaattggccgtgtaactcaagttatgggtcctgtaattgatgttcgatttgaacataacgaagttcctaaaattaataacgccttggttattgatgtgcctaaagaagaaggtacaatacaactaacattagaagttgcgctgcaattaggtgacgacgttgttcgtacaattgcgatggattcaactgatggtgtccaaagaggcatggatgtaaaagatacaggcaaagaaattagtgtacctgttggtgacgaaacattaggtcgtgtatttaatgtactaggtgaaacaattgaccttaaagaagaaattagtgattctgttcgccgcgatcctatccatcgtcaagcaccagcattcgatgaactttcaacagaagttcaaattttagaaacaggtattaaagtagtagatttactagcaccttatattaaaggtggtaaaatcggattgttcggtggtgccggtgtaggtaaaacagtattaatccaagaattaattaacaacatcgctcaagagcacggtggtatttctgtattcgccggtgtaggtgaacgtactcgtgaaggtaacgatttatacttcgaaatgagtgacagtggtgtaattaagaaaacagccatggtattcgggcaaatgaatgagccacctggtgcacgtatgcgtgttgcattatctggtttaacaatggctgaatatttccgtgacgaacaaggtcaagacgtattattattcatcgataacattttcagatttacacaagctggttctgaggtatctgcattattaggtcgtatgccttctgcagtaggttaccaaccaacacttgctactgaaatgggacaattacaagaacgtattacgtctacaacaaaaggatcagttacttctattcaagcggtattcgtacctgccgatgactatactgacccagcgcctgcgacagcgtttgcccatttagatgcaactacaaacttagaacgtaaattaactgaaatgggtatttatccagccgtggatccattagcgtctacatcaagagcattggaaccatcaattgtaggtcaagaacattatgaagtagctcgtgatgtacaatcaacacttcaaaaataccgtgaattacaagatatcattgctatcttaggtatggacgaattatctgatgaagataaacaaacagttgaacgcgcacgtagaattcaattcttcttatctcaaaacttccacgtagcggaacaatttactggtcaaaaaggttcttatgtacctgttaagacaacagttgcaaactttaaagatatcttagatggtaaatatgaccatattccagaagatgcattccgtttagttggtagcatggatgatgttattgcaaaagctaaagatatgggtgttgaagta

SEQ ID NO: 2154 - protein, 470 aa, Staphylococcus aureus
  MISC_FEATURE (1)..(470): ATP synthase beta chain
MGIGRVTQVMGPVIDVRFEHNEVPKINNALVIDVPKEEGTIQLTLEVALQLGDDVVRTIAMDSTDGVQRGMDVKDTGKEISVPVGDETLGRVFNVLGETIDLKEEISDSVRRDPIHRQAPAFDELSTEVQILETGIKVVDLLAPYIKGGKIGLFGGAGVGKTVLIQELINNIAQEHGGISVFAGVGERTREGNDLYFEMSDSGVIKKTAMVFGQMNEPPGARMRVALSGLTMAEYFRDEQGQDVLLFIDNIFRFTQAGSEVSALLGRMPSAVGYQPTLATEMGQLQERITSTTKGSVTSIQAVFVPADDYTDPAPATAFAHLDATTNLERKLTEMGIYPAVDPLASTSRALEPSIVGQEHYEVARDVQSTLQKYRELQDIIAILGMDELSDEDKQTVERARRIQFFLSQNFHVAEQFTGQKGSYVPVKTTVANFKDILDGKYDHIPEDAFRLVGSMDDVIAKAKDMGVEV

SEQ ID NO: 2155 - DNA, 864 bp, Staphylococcus aureus
gtggcttctcttaaagaaatagatactcgaataaaatcaaccaaaaaaatgaagcagattacgaaagcgatgaacatggtatcaagttcaaaacttcgtagagctgaaaaaaatacaaaacaattcacaccatatatggataaaatgcaagatgcaattactgcagttgcaggggcaagtagcaatacaaaccatccaatgctaagacctcgtaaaattactagaagtggatatttagttatcacgagtgataaaggtttagcaggtgcatatagtgcaaacgtgcttaaaaaattgattactgatattgaagcgaaacatcaagatagtagcgaatacagtattgtagttttagggcaacaaggtgttgatttcctaaaaaatagaggttatgacattgagtattctcaagtagacgtacctgatcaaccttctttcaaatctgttcaagcactagctaaccatgctatagacttatacagtgaagaagaaattgatgaattaaatatatactatagtcattatgtcagcgttcttgaaaacaagcctacatctagacaagtattaccattatctcaagaggattctagtaaggggcatggtcatttgtcttcttatgaatttgagccagataaagaatctatcttaagtgtaatcttgcctcaatatgttgagagtttgatttacggaacaatattagacgcaaaagcaagtgagcatgcaacacgtatgactgcgatgaaaaatgccactgataatgcaactgaacttattgatgacttatcattagaatataacagagcgagacaagcagaaattacgcaacaaattactgaaattgttggtggttccgcagcgcttgaa

SEQ ID NO: 2156 - protein, 288 aa, Staphylococcus aureus
  MISC_FEATURE (1)..(288): ATP synthase gamma chain
VASLKEIDTRIKSTKKMKQITKAMNMVSSSKLRRAEKNTKQFTPYMDKMQDAITAVAGASSNTNHPMLRPRKITRSGYLVITSDKGLAGAYSANVLKKLITDIEAKHQDSSEYSIVVLGQQGVDFLKNRGYDIEYSQVDVPDQPSFKSVQALANHAIDLYSEEEIDELNIYYSHYVSVLENKPTSRQVLPLSQEDSSKGHGHLSSYEFEPDKESILSVILPQYVESLIYGTILDAKASEHATRMTAMKNATDNATELIDDLSLEYNRARQAEITQQITEIVGGSAALE

SEQ ID NO: 2157 - DNA, 1506 bp, Staphylococcus aureus
atggccataaaagctgaagaaatcagtgcattacttcgctcacaaattgaaaattatgagtcagaaatgtccgtaactgatgtaggtactgtattacaaattggtgatggtattgcattaattcacggattaaatgacgttatggctggtgagctagtagaattccataacggcgtacttggtttagcccaaaaccttgaagagtcaaacgtgggtgtggttattttaggaccatacacaggtattactgaaggtgacgaagttaaacgtactggtcgtatcatggaagtaccagtaggtgaagaactaatcggaagagttgttaatccattaggacaacctattgatggacaaggaccgattaacacaactaaaacacgtccagtagagaaaaaagctactggtgtaatggatcgtaaatcagtagatgagccattacaaacaggtatcaaagcaattgatgctttagtaccaattggtagaggtcaacgtgagttaatcatcggtgaccgtcaaacaggtaaaacaacaattgcaattgacacaattttgaaccaaaaagatcaaggtacgatttgtatctatgttgctattggtcaaaaagattcaacagtaagagcaaatgttgaaaagttaagacaagcaggcgctttagactacactattgttgtagcagcatcagcttctgaaccttctccattattatatattgcaccatattcaggtgtaacaatgggtgaagaattcatgtttaacggtaaacatgttttaatcgtttatgatgatttaactaaacaagcagcagcttatcgtgagttatcattattattacgtagacctccaggtcgtgaagcatacccaggtgacgtattctacttacatagtagattattagaaagagcagcaaaattaaacgatgacttaggtggcggttcaattactgcattaccaattatcgaaacacaagctggtgatatttcagcttatgtaccaacaaacgttatttcaattacagatggacaaatcttcttacaatctgatttattcttctcaggtgtaagaccagcgattaatgccggacaatctgtatctcgtgttggtggatctgcacaaattaaagcaatgaagaaagttgctggtacgttacgtcttgacttagcgtcatacagagaacttgaatcatttgcacaattcggttcagaccttgatgaatttactgcaagtaaattagaacgtggtaaacgtactgttgaagtcttaaaacaagatcaaaacaaaccattaccagtcgaacaccaagtgttgattatttatgcattaacaaaaggatatttagatgatattccagttgtagatatcacacgttttgaagacgagttaaaccactgggcagaatcaaatgctactgaactgttaaatgaaatcagagaaactggtggcttaccagatgctgagaagtttgacacagcaattaacgaattcaaaaaaagctttagcaaatctgaa

SEQ ID NO: 2158 - protein, 502 aa, Staphylococcus aureus
  MISC_FEATURE (1)..(502): ATP synthase alpha chain
MAIKAEEISALLRSQIENYESEMSVTDVGTVLQIGDGIALIHGLNDVMAGELVEFHNGVLGLAQNLEESNVGVVILGPYTGITEGDEVKRTGRIMEVPVGEELIGRVVNPLGQPIDGQGPINTTKTRPVEKKATGVMDRKSVDEPLQTGIKAIDALVPIGRGQRELIIGDRQTGKTTIAIDTILNQKDQGTICIYVAIGQKDSTVRANVEKLRQAGALDYTIVVAASASEPSPLLYIAPYSGVTMGEEFMFNGKHVLIVYDDLTKQAAAYRELSLLLRRPPGREAYPGDVFYLHSRLLERAAKLNDDLGGGSITALPIIETQAGDISAYVPTNVISITDGQIFLQSDLFFSGVRPAINAGQSVSRVGGSAQIKAMKKVAGTLRLDLASYRELESFAQFGSDLDEFTASKLERGKRTVEVLKQDQNKPLPVEHQVLIIYALTKGYLDDIPVVDITRFEDELNHWAESNATELLNEIRETGGLPDAEKFDTAINEFKKSFSKSE

SEQ ID NO: 2159 - DNA, 537 bp, Staphylococcus aureus
atggtaaaagtagctaacaagtatgctaaagcattatttgacgtgtcattagatacaaataatttagagactattaatgaagaattaacagttataaatgaagcagtaaaagataaaattgagcaattgagaatggttgacagtaatccaactcaaacagcagaacaacgtcgtgagttgattaatggtgtatttactgacattaatccatacattaaaaatatgatgtacgtgttagcagataatagacatatctcattaatagctgacgtattcaaggcgttccaaagcttatataacggacactacaatcaagattttgcaacaattgagtcaacatatgaattgagtcaagaagagttagataagattgtcaaactagtaactcaacaaacgaagttatctaaagttattgtagatacaaaaattaatccagatttaattggtggatttagagttaaagtcggcacaactgtattagatggtagtgttagaaatgatcttgtccaattacaaagaaaatttagaagagttaat

SEQ ID NO: 2160 - protein, 179 aa, Staphylococcus aureus
  MISC_FEATURE (1)..(179): ATP synthase delta chain
MVKVANKYAKALFDVSLDTNNLETINEELTVINEAVKDKIEQLRMVDSNPTQTAEQRRELINGVFTDINPYIKNMMYVLADNRHISLIADVFKAFQSLYNGHYNQDFATIESTYELSQEELDKIVKLVTQQTKLSKVIVDTKINPDLIGGFRVKVGTTVLDGSVRNDLVQLQRKFRRVN

SEQ ID NO: 2161 - DNA, 1353 bp, Staphylococcus aureus
ttggaggattttaaaatgccaaaacgtactttcactaaagacgacattcgtaaatttgcagaagaggaaaatgtaagatatttaagattacaattcactgatattttaggaacaattaaaaatgttgaagtgcctgtaagccaattagaaaaagtacttgataacgaaatgatgtttgacggttcttctatcgaaggtttcgtacgtatcgaagaatcagatatgtacttacatccagatttagatacttgggtaatcttcccatggactgctggacaaggtaaagttgcacgtttaatttgtgatgtatataaaacagatggaacaccatttgaaggggatcctcgtgcaaacttaaaacgtgtattaaaagaaatggaagatttaggcttcacagactttaacctaggacctgaaccagaattcttcttgtttaagttggatgaaaaaggggaaccaactttagaacttaatgatgatggtggatatttcgatttagcacctacagatttaggtgaaaactgtcgtcgtgatattgttttagaattagaggatatgggcttcgatattgaagctagtcaccatgaagttgcccctggtcaacatgaaattgactttaaatatgcagatgctgttacagcatgtgataatatccaaacatttaaattggttgttaaaacaatcgcacgtaaacataatttacacgcaacatttatgcctaaaccattattcggtgtgaatggtagcggtatgcactttaacgtttcattattcaaaggtaaagaaaatgcattctttgatccaaatactgaaatgggcttaacggaaactgcatatcaatttacagcaggtgtgcttaaaaatgcacgcggatttactgctgtatgtaacccgttagtaaactcatataaacgtttagtacctggttatgaagcaccatgttatattgcatggagtggtaaaaaccgttcaccattaatccgtgtaccatcttcaagaggattatctactcgtatcgaagtacgttcagtagatccagctgcaaacccatacatggcgttagctgcaatcttagaagctggactagatggtattaaaaataaattaaaagttccagaaccagttaaccaaaatatttacgaaatgaaccgtgaagaacgtgaagcagtaggcattcaagacttaccttcaacactttatactgcattaaaagcaatgcgtgaaaatgaagttattaaaaaagctttaggaaatcatatctataatcaatttattaattcaaaatcaattgaatgggattactacagaactcaagtctctgaatgggaaagagatcagtacatgaagcaatat

SEQ ID NO: 2162 - protein, 451 aa, Staphylococcus aureus
  MISC_FEATURE (1)..(451): glutamine-ammonia ligase
LEDFKMPKRTFTKDDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILEAGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 2163 - DNA, 519 bp, Staphylococcus aureus
gtgactgaaacagctaacttattcgttcttggtgcagctggaggcgttgagtggggtactgtgattgtacaggtcctaactttcatcgtgttacttgcgttacttaaaaagttcgcatggggtccattgaaagatgtaatggataaacgtgaaagagatattaacagagatatcgatgacgcagaacaagctaagttaaatgcacagaaacttgaagaagaaaataaacaaaaacttaaagaaacacaagaagaagttcaaaagattttagaagatgctaaggttcaagcacgtcaacagcaagaacaaattattcatgaagcaaacgtacgtgcaaacggtatgattgaaacagcacaaagtgaaatcaatagccaaaaagaacgtgccattgcagatattaataatcaagtatctgaactatcagtgttaattgcttctaaagttcttagaaaagaaatttctgaacaagaccaaaaagcattggttgacaagtatctaaaagaggcaggcgataaa

SEQ ID NO: 2164 - protein, 173 aa, Staphylococcus aureus
  MISC_FEATURE (1)..(173): ATP synthase B chain
VTETANLFVLGAAGGVEWGTVIVQVLTFIVLLALLKKFAWGPLKDVMDKRERDINRDIDDAEQAKLNAQKLEEENKQKLKETQEEVQKILEDAKVQARQQQEQIIHEANVRANGMIETAQSEINSQKERAIADINNQVSELSVLIASKVLRKEISEQDQKALVDKYLKEAGDK

SEQ ID NO: 2165 - DNA, 210 bp, Staphylococcus aureus
atgaatttaatcgcagcagcaatcgcaattggtttatcagcattaggagcaggtatcggtaacggtttaatcgtttcaagaacagttgaaggtgtagcacgtcaaccagaagcacgtggtcaattaatgggtatcatgttcattggtgtaggtttagttgaggcattacctatcatcggtgtagtaattgcattcatgacatttgctgga

SEQ ID NO: 2166 - protein, 70 aa, Staphylococcus aureus
  MISC_FEATURE (1)..(70): ATP synthase C chain
MNLIAAAIAIGLSALGAGIGNGLIVSRTVEGVARQPEARGQLMGIMFIGVGLVEALPIIGVVIAFMTFAG

SEQ ID NO: 2167 - DNA, 726 bp, Staphylococcus aureus
atggatcacaaatccccgctcgtgagttggaatttattcggttttgatatcgttttcaatttatcaagtatattgatgatacttgttacggcgtttcttgtttttctacttgctatcatttgtacgcgtaatttgaaaaaaagaccaactggcaaacaaaatttcgttgaatggatttttgatttcgtgaggggaatcattgaaggtaacatggcttggaaaaaaggtggtcaattccacttcttagcagtaacgctgattctgtacatttttatagctaatatgttaggtcttccgttttctatagtaacgaaagatcacacattgtggtggaaatcaccgacagctgatgcaacagtgactttaacgttgtctacaacgataatactgttaactcacttttatggaattaaaatgcgtggtacgaaacaatatcttaaaggttatgtacagccgttttggccattggcaattattaatgtttttgaagagttcacttcaacattaacgcttggtctgcgtttgtacggtaacatatttgcaggtgagatactattaacattacttgctggcttattctttaacgaaccagcatggggttggattattagtatcccaggattaattgtttggcaagcattttcaatatttgtaggaacaatccaagcatatatctttattatgctttcgatggtttatatgtcacataaagtggcagatgaacac

SEQ ID NO: 2168 - protein, 242 aa, Staphylococcus aureus
  MISC_FEATURE (1)..(242): ATP synthase A chain
MDHKSPLVSWNLFGFDIVFNLSSILMILVTAFLVFLLAIICTRNLKKRPTGKQNFVEWIFDFVRGIIEGNMAWKKGGQFHFLAVTLILYIFIANMLGLPFSIVTKDHTLWWKSPTADATVTLTLSTTIILLTHFYGIKMRGTKQYLKGYVQPFWPLAIINVFEEFTSTLTLGLRLYGNIFAGEILLTLLAGLFFNEPAWGWIISIPGLIVWQAFSIFVGTIQAYIFIMLSMVYMSHKVADEH

SEQ ID NO: 2169 - DNA, 351 bp, Staphylococcus aureus
atgagtcgtttctacaacatttttaaacagttcattcaatattatttttatctaataataatattgggaggattatacctttatacacaccatgcatttatcttaggattaatcattggtgttactggttctgcaatcaacacatgtatttttgaatgctatttagctaaagctaaaagaccagacactatgcatatttcaactggaaatatgtggcgatacttagttgcaattattgcctgtatgatttggtaccttaataaagcgcatgtaagtatcatcggtataattattggtttaatgatttcatatgttgtagttatcatacgtcctttactaaaggtgagcaaa

SEQ ID NO: 2170 - protein, 117 aa, Staphylococcus aureus
  MISC_FEATURE (1)..(117): hypothetical protein
MSRFYNIFKQFIQYYFYLIIILGGLYLYTHHAFILGLIIGVTGSAINTCIFECYLAKAKRPDTMHISTGNMWRYLVAIIACMIWYLNKAHVSIIGIIIGLMISYVVVIIRPLLKVSK

SEQ ID NO: 2171 - DNA, 1128 bp, Staphylococcus aureus
ttgatgaaaaagattatgaccatatttggaacaagacccgaagccataaagatggctcctttagttaaagctttggaacaagaaaaaatgctcgagccaattgttgttgttacagcacagcatagagaaatgcttgattcagtattaagtacctttgaaatcaaaccaaaatacgatttgaatattatgaaatcaggacagacactttctgagataacttctaaatcaatcactcaattagaacaagtgattcaattagaaaaaccagacatggtacttgtacatggtgatacgatgacgacatttgcaggtggtttagcggcattttataaccaagtgccgattggacacgttgaagcagggcttagaagttatgataaatattcaccttttccagaagaggtgaatagacaattagttggtgtattagctgacttacattttgcacctactaaaaatgctgcatcgcatttgttaagtgaagggaaatattcagaaagtgttgttgtcactggtaatactgcgattgatgctatgaaatatacagttgatgacaattataaatctaacatcatggataaataccatgacaaaaaattcattcttatgacagcacaccgacgagaaaatatcgggaaacccatggaaaatatatttaaagcggttagacgcttaatagatgagtatactgatttagcactggtatatccaatgcataaaaacccgaaagttcgagaggtggctcaaaagattttaggtagtcatgacagaattgaattgattgaacctttggacgtagtagatttccataattttgctaaaaaatcttattttattttgacagattcaggtggaattcaggaagaagcgccatcatttaataagccagttttagttttgcgaagtgttacagaacgtcctgaaggtgttgaagctggcacattaaaagtcattggaacaaataagcaaaatgtgtatcaagctgcaaaagaattaatcgatgatgagagattatatcatcaaatgtctgaagcatctaatccttacggtgatggatttgcttcagaaagaatagttaatcatattaagtattatttgaatttaatcactgaaaaaccaagcgatttc

SEQ ID NO: 2172 - protein, 376 aa, Staphylococcus aureus
  MISC_FEATURE (1)..(376): UDP-GlcNAc 2-epimerase
LMKKIMTIFGTRPEAIKMAPLVKALEQEKMLEPIVVVTAQHREMLDSVLSTFEIKPKYDLNIMKSGQTLSEITSKSITQLEQVIQLEKPDMVLVHGDTMTTFAGGLAAFYNQVPIGHVEAGLRSYDKYSPFPEEVNRQLVGVLADLHFAPTKNAASHLLSEGKYSESVVVTGNTAIDAMKYTVDDNYKSNIMDKYHDKKFILMTAHRRENIGKPMENIFKAVRRLIDEYTDLALVYPMHKNPKVREVAQKILGSHDRIELIEPLDVVDFHNFAKKSYFILTDSGGIQEEAPSFNKPVLVLRSVTERPEGVEAGTLKVIGTNKQNVYQAAKELIDDERLYHQMSEASNPYGDGFASERIVNHIKYYLNLITEKPSDF

SEQ ID NO: 2173 - DNA, 627 bp, Staphylococcus aureus
atgagtaaagtacacgttttcgatcatccattaattcaacacaaactaagctatattagagatgtaaatacaggtactaaagaatttagagaacttgtagacgaagttggtatgttgatggcatatgaagtaactagagacttagagcttcaggatgttgatattgaaacgcctgtaactaaaatgacggctaaacgattagctggtaaaaaattagctatcgttccaattttaagagctggtttaggtatgactgatggtattttaagtttagtacctgcagccagagttggacatatcggtttatatcgagatcccgaaacattaaaggctgtagagtattttgctaagttacctcaagatattactgaaagacaaatcattgttgttgatcctatgttagcaacaggcgcatcagcaattgaagctattacttcattgaagaaacgtggcgctaaaaatattcgcttcatgtgtttaattgcagcaccagaaggcgtagaaaagatgcatgaagcacatccagatgtagatatttatattgctgcacttgatgaaaagctaaatgacaaagcatatatcacaccagggttaggcgacgctggagatagattgtttggtactaaa

SEQ ID NO: 2174 - protein, 209 aa, Staphylococcus aureus
  MISC_FEATURE (1)..(209): uracil phosphoribosyl
MSKVHVFDHPLIQHKLSYIRDVNTGTKEFRELVDEVGMLMAYEVTRDLELQDVDIETPVTKMTAKRLAGKKLAIVPILRAGLGMTDGILSLVPAARVGHIGLYRDPETLKAVEYFAKLPQDITERQIIVVDPMLATGASAIEAITSLKKRGAKNIRFMCLIAAPEGVEKMHEAHPDVDIYIAALDEKLNDKAYITPGLGDAGDRLFGTK

SEQ ID NO: 2175 - DNA, 1236 bp, Staphylococcus aureus
atgtcttatatcaccaagcaagataaagttatcgcagaagcaatcgagagagaatttcagagacaaaatagcaacatagagttaatcgcatcggaaaattttgtatcggaagcggttatggaagcacaaggttcagtgttgactaataagtatgctgaaggctatccaggacgccgatattatggtggctgtgagtttgtagatgttactgaaagcatcgcaattgatcgtgctaaagcattgtttggagctgaacatgtcaatgttcaaccacattcaggttcacaagcgaacatggctgtttacttagttgcattagaaatgggcgacacagttttaggtatgaatttgagtcatggtggtcacttgacacatggagcgcctgttaattttagtggtaaattctacaatttcgttgaatatggagtagataaagacacagaacgaatcaattatgatgaagttcgtaaattagcgttagagcataagcctaagcttattgtggcaggagcatcagcatattcaagaacaattgacttcaaaaagtttaaagaaatcgcagatgaagtaaacgctaagttaatggtagacatggcacatattgcaggattagtagcggcaggtttacatccaaatccagtagaatatgctgattttgtaacaactacaacacacaaaacattacgcggaccacgtggtggtatgattttatgtaaggaagaatataaaaaagacatagataaaacaattttccctggtattcaaggtggacctcttgagcatgttattgcagcaaaagcagttgcttttggagaagcgttagaaaataatttcaaaacgtatcaacaacaagtggttaaaaacgcaaaagttcttgcagaagcattaattaatgaaggatttagaattgtttctggcggtacagataatcacttagtagctgttgatgtaaaagggtctataggacttactggtaaagaagctgaagagactttagattcagttggtatcacatgtaacaaaaataccattccgttcgatcaagaaaaaccttttgtaacgagtggtatacgtttaggtacacctgctgcaacaacgcgtggatttgatgaaaaagcttttgaggaagttgcaaaaatcatcagtttagcattgaaaaatagtaaagatgaagaaaaattacaacaagctaaagaacgcgttgcgaaattaacagctgaatatcctctatatcaa

SEQ ID NO: 2176 - protein, 412 aa, Staphylococcus aureus
  MISC_FEATURE (1)..(412): serine hydroxymethyl
MSYITKQDKVIAEAIEREFQRQNSNIELIASENFVSEAVMEAQGSVLTNKYAEGYPGRRYYGGCEFVDVTESIAIDRAKALFGAEHVNVQPHSGSQANMAVYLVALEMGDTVLGMNLSHGGHLTHGAPVNFSGKFYNFVEYGVDKDTERINYDEVRKLALEHKPKLIVAGASAYSRTIDFKKFKEIADEVNAKLMVDMAHIAGLVAAGLHPNPVEYADFVTTTTHKTLRGPRGGMILCKEEYKKDIDKTIFPGIQGGPLEHVIAAKAVAFGEALENNFKTYQQQVVKNAKVLAEALINEGFRIVSGGTDNHLVAVDVKGSIGLTGKEAEETLDSVGITCNKNTIPFDQEKPFVTSGIRLGTPAATTRGFDEKAFEEVAKIISLALKNSKDEEKLQQAKERVAKLTAEYPLYQ

SEQ ID NO: 2177 - DNA, 522 bp, Staphylococcus aureus
atgaaagatttgacaatgttattagacgaattaaaagatatgtccttttttaataaaggagatatatgtttaattggatgttcaacatcggaagtcattggcgaaaaaatagggactgtcggttcgatggaagttgcagaaactatttttaatgcattagatgttgtgagtaaagagacaggcgttacttttgcttttcaaggatgtgaacatatcaacagagcgataacaatagaaaaatctcagtataatccattaacaatggaagaagtttccgtcgttccagatgtacatgctggagggagtttggcaacatacgcttttcagcatatgaaggatccgatcgtggtcgaacatattactgttccttgtggaattgatattggtcaaacgttaataggcatgcatattaaacatgtatgtgtacctgtaaggacctcagtaaagcaagtaggacaggcaattgtaactattgccacatctaggccgaaaaagattggtggcgaacgtgctaaataccaa

SEQ ID NO: 2178 - protein, 174 aa, Staphylococcus aureus
  MISC_FEATURE (1)..(174): conserved hypothetical
MKDLTMLLDELKDMSFFNKGDICLIGCSTSEVIGEKIGTVGSMEVAETIFNALDVVSKETGVTFAFQGCEHINRAITIEKSQYNPLTMEEVSVVPDVHAGGSLATYAFQHMKDPIVVEHITVPCGIDIGQTLIGMHIKHVCVPVRTSVKQVGQAIVTIATSRPKKIGGERAKYQ

SEQ ID NO: 2179 - DNA, 417 bp, Staphylococcus aureus
atgaagattttattcgtttgtacaggtaacacatgtcgtagcccattagcggaaagtattgcaaaagaggttatgccaaatcatcaatttgaatcaagaggtatattcgctgtgaacaatcaaggtgtttcgaattatgttgaagacttagttgaagaacatcatttagctgaaacgaccttatcgcaacaatttactgaagcagatttgaaagcagatattattttgacgatgtcgtattcgcacaaagaattaatagaggcacactttggtttgcaaaatcatgttttcacattgcatgaatatgtaaaagaagcaggagaagttatagatccatacggtggaacaaaagaaatgtatgtacatacctatgaagaacttgtaagtttaattttaaaattaaaagatattatttgc

SEQ ID NO: 2180 - protein, 139 aa, Staphylococcus aureus
  MISC_FEATURE (1)..(139): hypothetical protein
MKILFVCTGNTCRSPLAESIAKEVMPNHQFESRGIFAVNNQGVSNYVEDLVEEHHLAETTLSQQFTEADLKADIILTMSYSHKELIEAHFGLQNHVFTLHEYVKEAGEVIDPYGGTKEMYVHTYEELVSLILKLKDIIC

SEQ ID NO: 2181 - DNA, 1095 bp, Staphylococcus aureus
gtgcatagctttttgctttatattatgataaataagaaaggcgtgattaagttggatactaaaatttgggatgttagagaatataatgaagatttacagcaatatcctaaaattaatgaaataaaagacattgttttaaacggtggtttaataggtttaccaactgaaacagtttatggacttgcagcaaatgcgacagatgaagaagctgtagctaaaatatatgaagctaaaggccgtccatctgacaatccgcttattgttcatatacacagtaaaggtcaattaaaagattttacatatactttggatccacgcgtagaaaagttaatgcaggcattctggccgggccctatttcgtttatattgccgttaaagctaggctatctatgtcgaaaagtttctggaggtttatcatcagttgctgttagaatgccaagccattctgtaggtagacaattattacaaatcataaatgaacctctagctgctccaagtgctaatttaagtggtagaccttcaccaacaactttcaatcatgtatatcaagatttgaatggccgtatcgatggtattgttcaagctgaacaaagtgaagaaggattagaaagtacggttttagattgcacatcttttccttataaaattgcaagacctggttctataacagcagcaatgattacagaaatacttccgaatagtatcgcccatgctgattataatgatactgaacagccaattgcaccaggtatgaagtataagcattactcacccaatacaccacttacaattattacagatattgagagcaaaattggaaatgacggtaaagattggtcttctatagcttttattgtgccgagtaataaggtggcgtttataccaagtgaagcgcaattcattcaattatgtcaggatgacaatgatgttaaacaagcaagtcataatctttatgatgtgttacattcacttgatgaaaatgaaaatatttcagcggcgtatatatacggctttgagctgaatgataatacagaagcaattatgaatcgcatgttaaaagctgcaggtaatcacattattaaaggatgtgaacta

SEQ ID NO: 2182 - protein, 365 aa, Staphylococcus aureus
  MISC_FEATURE (1)..(365): conserved hypothetical
VHSFLLYIMINKKGVIKLDTKIWDVREYNEDLQQYPKINEIKDIVLNGGLIGLPTETVYGLAANATDEEAVAKIYEAKGRPSDNPLIVHIHSKGQLKDFTYTLDPRVEKLMQAFWPGPISFILPLKLGYLCRKVSGGLSSVAVRMPSHSVGRQLLQIINEPLAAPSANLSGRPSPTTFNHVYQDLNGRIDGIVQAEQSEEGLESTVLDCTSFPYKIARPGSITAAMITEILPNSIAHADYNDTEQPIAPGMKYKHYSPNTPLTIITDIESKIGNDGKDWSSIAFIVPSNKVAFIPSEAQFIQLCQDDNDVKQASHNLYDVLHSLDENENISAAYIYGFELNDNTEAIMNRMLKAAGNHIIKGCEL

SEQ ID NO: 2183 - DNA, 834 bp, Staphylococcus aureus
atggtgaattataaagaaaagttagatgaagcaattcatttaacacaacaaaaagggtttgaacaaacacgagctgaatggttaatgttagatgtatttcaatggacgcgtacggactttgtagtccacatgcatgatgatatgccgaaagcgatgattatgaagttcgacttagcattacaacgtatgttattaggagagcctatacagtatatagttggctttgcctcattttatggtagaacgtttgatgtaaactcaaattgtttgataccaagacctgaaactgaagaagtaatgttgcatttcttacaacagttagaagatgatgcaacaatcgtagatatcggaacgggtagtggtgtacttgcaattactttgaaatgtgaaaagccggatttaaatgttattgctactgatatttcacttgaagcaatgaatatggctcgtaataatgctgagaagcatcaatcacaaatacaatttttaacaggggatgcattaaagcccttaattaatgaaggtatcaagttgaacggcttgatatctaatccaccatatatagatgaaaaagatatggttacgatgtctccaacggttacgagattcgaaccacatcaggcattgtttgcagataaccatggatatgctatttatgaatcaatcattgaagatttacctcacgttatggaaaaaggcagcccagttgtttttgaaattggttacaatcaaggtgaggcacttaaatcaataattttaaataaatttcctgacaaaaaaatcgacattattaaagatataaatggccacgatcgaatcgtctcatttaaatgg

SEQ ID NO: 2184 - protein, 278 aa, Staphylococcus aureus
  MISC_FEATURE (1)..(278): hypothetical protein
MVNYKEKLDEAIHLTQQKGFEQTRAEWLMLDVFQWTRTDFVVHMHDDMPKAMIMKFDLALQRMLLGEPIQYIVGFASFYGRTFDVNSNCLIPRPETEEVMLHFLQQLEDDATIVDIGTGSGVLAITLKCEKPDLNVIATDISLEAMNMARNNAEKHQSQIQFLTGDALKPLINEGIKLNGLISNPPYIDEKDMVTMSPTVTRFEPHQALFADNHGYAIYESIIEDLPHVMEKGSPVVFEIGYNQGEALKSIILNKFPDKKIDIIKDINGHDRIVSFKW

SEQ ID NO: 2185 - DNA, 1074 bp, Staphylococcus aureus
gtgtttgatcaattagatattgtagaagaaagatacgaacagttaaatgaactgttaagtgacccagatgttgtaaatgattcagataaattacgtaaatattctaaagagcaagctgatttacaaaaaactgtagatgtttatcgtaactataaagctaaaaaagaagaattagctgatattgaagaaatgttaagtgagactgatgataaagaagaagtagaaatgttaaaagaggagagtaatggtattaaagctgaacttccaaatcttgaagaagagcttaaaatattattgattcctaaagatcctaatgatgacaaagacgttattgtagaaataagagcagcagcaggtggtgatgaggctgcgatttttgctggtgatttaatgcgtatgtattcaaagtatgctgaatcacaaggattcaaaactgaaatagtagaagcgtctgaaagtgaccatggtggttacaaagaaattagtttctcagtttctggtaatggcgcgtatagtaaattgaaatttgaaaatggtgcgcaccgcgttcaacgtgtgcctgaaacagaatcaggtggacgtattcatacttcaacagctacagtggcagttttaccagaagttgaagatgtagaaattgaaattagaaatgaagatttaaaaatcgacacgtatcgttcaagtggtgcaggtggtcagcacgtaaacacaactgactctgcagtacgtattacccatttaccaactggtgtcattgcaacatcttctgagaagtctcaaattcaaaaccgtgaaaaagcaatgaaagtgttaaaagcacgtttatacgatatgaaagttcaagaagaacaacaaaagtatgcgtcacaacgtaaatcagcagtcggtactggtgatcgttcagaacgtattcgaacttataattatccacaaagccgtgtaacagaccatcgtataggtctaacgcttcaaaaattagggcaaattatggaaggccatttagaagaaattatagatgcactgactttatcagagcagacagataaattgaaagaacttaataatggtgaatta

SEQ ID NO: 2186 - protein, 358 aa, Staphylococcus aureus
  MISC_FEATURE (1)..(358): peptide chain release
VFDQLDIVEERYEQLNELLSDPDVVNDSDKLRKYSKEQADLQKTVDVYRNYKAKKEELADIEEMLSETDDKEEVEMLKEESNGIKAELPNLEEELKILLIPKDPNDDKDVIVEIRAAAGGDEAAIFAGDLMRMYSKYAESQGFKTEIVEASESDHGGYKEISFSVSGNGAYSKLKFENGAHRVQRVPETESGGRIHTSTATVAVLPEVEDVEIEIRNEDLKIDTYRSSGAGGQHVNTTDSAVRITHLPTGVIATSSEKSQIQNREKAMKVLKARLYDMKVQEEQQKYASQRKSAVGTGDRSERIRTYNYPQSRVTDHRIGLTLQKLGQIMEGHLEEIIDALTLSEQTDKLKELNNGEL

SEQ ID NO: 2187 - DNA, 618 bp, Staphylococcus aureus
ttgaaaaaggtggaactctcaatgtatgaaacttaccattccggttggatagaatgtattacaggtagtatgtttagcggtaaatccgaagaactaataagacgtctaagaaggggtatatacgctaaacaaaaagtcgttgtatttaaaccggcgattgatgatcgatatcataaagaaaaagtggtctctcataatggtaatgccattgaagcgattaatatttctaaagcaagtgaaattatgacgcacgacttaactaatgttgatgttataggaatagacgaagtgcaattttttgacgatgaaattgtaagtatagtagaaaaactatcagcagatggacaccgtgttattgttgctggattagatatggattttaggggcgaaccgttcgaaccaatgcctaaattgatggctgtcagtgaacaagtaacgaaacttcaagcagtttgtgctgtttgtggttcttcatctagtagaacgcaacgattaataaatggtaaaccagctaaaatcgatgatccgattatcttagtaggtgccaatgaaagttatgagccacgttgtcgcgcgcaccatatcgtagcacctagtgataataataaggaggaatta

SEQ ID NO: 2188 - protein, 206 aa, Staphylococcus aureus
  MISC_FEATURE (1)..(206): thymidine kinase
LKKVELSMYETYHSGWIECITGSMFSGKSEELIRRLRRGIYAKQKVVVFKPAIDDRYHKEKVVSHNGNAIEAINISKASEIMTHDLTNVDVIGIDEVQFFDDEIVSIVEKLSADGHRVIVAGLDMDFRGEPFEPMPKLMAVSEQVTKLQAVCAVCGSSSSRTQRLINGKPAKIDDPIILVGANESYEPRCRAHHIVAPSDNNKEEL

SEQ ID NO: 2189 - DNA, 252 bp, Staphylococcus aureus
atgaaacaaggaattcatcctgagtatcaccaagtaatctttttagatactactacaaacttcaaattcttaagcggttctacaaaaacatcttcagaaatgatggagtgggaagatggaaaagaatacccagttattcgtttagatatttcatctgattcacatccattctacactggacgtcaaaaattcgctgctgcggatggacgtgtggaacgtttcaacaaaaagtttggtcttaaatcaaacaac

SEQ ID NO: 2190 - protein, 84 aa, Staphylococcus aureus
  MISC_FEATURE (1)..(84): ribosomal protein L31
MKQGIHPEYHQVIFLDTTTNFKFLSGSTKTSSEMMEWEDGKEYPVIRLDISSDSHPFYTGRQKFAAADGRVERFNKKFGLKSNN

SEQ ID NO: 2191 - DNA, 1329 bp, Staphylococcus aureus
atgggtgtaaactatatgcctgaaagagaacgtacatctcctcagtatgaatcattccacgaattgtacaagaactatactaccaaggaactcactcaaaaagctaaaactcttaagttgacgaactatagtaaattaaataaaaaagaacttgttctagctattatggaagcacaaatggaaaaagatggtaactattatatggaaggtatcttagatgatatacaaccagatggttatggttttttaagaacagtgaactattctaaaggggaaaaagatatttatatatctgctagccaaattcgtcgttttgaaattaaacgtggggataaagtaactgggaaagttagaaaacctaaagataacgaaaaatattatggcttattacaagttgactttgtcaatgaccataacgcagaagaagtgaagaaacgtccgcatttccaagctttgacaccactttatccagatgagcgtattaaattagagacagaaatacaaaattattcaacgcgcatcatggatttagtaacaccgattggtttaggtcaacgtggtttaatagtggcgccacctaaagcaggtaaaacatcgttattaaaagaaatagcgaatgcaatcagtacgaacaaaccagatgcaaagctatttattttgttagttggcgagcgtcctgaagaggtaacagatttagaacgctcagtagaagctgctgaagtcgttcattcaacgtttgacgaaccaccagaacaccatgttaaagtagctgaattattacttgaacgtgcaaagcgtttagtagaaattggggaagatgtcattattttaatggattctataacgagattagcacgcgcttataacttagttattccaccaagtggtcgtacattatcaggtggtttagatcctgcatctttacacaaaccaaaagcattcttcggtgcagcgagaaatattgaagcgggtggaagtttaacaatacttgcaactgcattagttgatacgggttcacgtatggacgatatgatttacgaagaatttaaaggaacaggtaacatggagttacatttagatcgtaaattgtctgaacgtcgtatcttccctgcaattgatattggcagaagttcaacgcgtaaagaagaattgttgataagtaaatctgaattagacacattatggcaattaagaaatctattcactgactcaactgactttactgaaagatttattcgcaaacttaaaaggtctaagaataatgaagatttcttcaagcagctacaaaagtctgcagaagaaagtactaaaacgggtcgacctataatt

SEQ ID NO: 2192 - protein, 443 aa, Staphylococcus aureus
  MISC_FEATURE (1)..(443): transcription termination
MGVNYMPERERTSPQYESFHELYKNYTTKELTQKAKTLKLTNYSKLNKKELVLAIMEAQMEKDGNYYMEGILDDIQPDGYGFLRTVNYSKGEKDIYISASQIRRFEIKRGDKVTGKVRKPKDNEKYYGLLQVDFVNDHNAEEVKKRPHFQALTPLYPDERIKLETEIQNYSTRIMDLVTPIGLGQRGLIVAPPKAGKTSLLKEIANAISTNKPDAKLFILLVGERPEEVTDLERSVEAAEVVHSTFDEPPEHHVKVAELLLERAKRLVEIGEDVIILMDSITRLARAYNLVIPPSGRTLSGGLDPASLHKPKAFFGAARNIEAGGSLTILATALVDTGSRMDDMIYEEFKGTGNMELHLDRKLSERRIFPAIDIGRSSTRKEELLISKSELDTLWQLRNLFTDSTDFTERFIRKLKRSKNNEDFFKQLQKSAEESTKTGRPII

SEQ ID NO: 2193 - DNA, 1443 bp, Staphylococcus aureus
ttgaggagtgaaagaataatgagagactacacaaagcaatacattaatggcgaatgggtagaaagtaatagtaatgaaacgatagaagttataaatccagcaaccgaagaagtaatcgggaaagttgctaaaggtaataaagctgatgttgataaagccgtcgaggcggcagacgatgtttatttagagttccgtcatacatctgtgaaagaaagacaagcgttattagataaaattgtaaaagaatatgaaaacagaaaagacgatattgtacaagctattacggatgaattaggtgctcctttatcattatctgagcgtgtccattatcaaatgggactaaaccattttgttgcagcgagagacgcattagataactacgaatttgaagaacgccgcggagatgatttagttgttaaagaagcaatcggtgtatctggattaattacaccgtggaacttccctacaaaccaaacatcattaaaattagcagcagcatttgcggctggtagtccagttgtacttaaaccatctgaagaaacaccatttgcagctgttattttagctgagatttttgataaagtcggtgttcctaaaggtgtatttaaccttgttaatggtgatggtgctggtgttgggaatcctttatctgaacatcctaaagtacgcatgatgtcatttacaggatcaggccctactggttctaaaattatggaaaaagccgctaaagattttaaaaaggtatcattagagcttggtggcaaatcaccatatatcgtcctagatgacgtagatattaaagaagcggctaaagcaacaacaggcaaagttgttaataatactggtcaagtatgtacagctggtacacgtgttttagtgcctaacaaaattaaagatgcattcttagctgaattaaaagaacaatttagccaagtgcgtgtcggtaatccaagagaagatggtacacaagtaggccctatcattagtaaaaaacaatttgatcaagtacaaaattatattaataaaggtattgaagaaggtgctgaattattttatggtggtcctggtaaaccagaaggacttgaaaaaggatactttgcacgtccgacaatttttattaatgtagataatcaaatgacgatagcacaagaagaaatttttgggccagtaatgtcagttatcacttataacgatttagatgaagcgattcaaattgcaaatgatacaaaatatggtttggcaggatatgttattggtaaggacaaagaaacattgcataaagtagctcgttctattgaagcaggtacagtagaaataaacgaagcaggtagaaagccagatttaccatttggtggctataaacaatctggtttaggtcgtgaatggggcgattatggtattgaagagttcttagaagtgaaatctatagctggatattttaaa

SEQ ID NO: 2194 - protein, 481 aa, Staphylococcus aureus
  MISC_FEATURE (1)..(481): hypothetical protein
LRSERIMRDYTKQYINGEWVESNSNETIEVINPATEEVIGKVAKGNKADVDKAVEAADDVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPNKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 2195 - DNA, 342 bp, Staphylococcus aureus
gtgaagatgatggaagtatgtccgtatctcgaagaaacttttaaaatacttggtagaagttggaatggattaatcattaattatctctcaagatgtaatgactgttcagcacacttttccgatatgaaaagagatttgaaaacaataacaccacgtgctttaagtcttaagttgtcagagcttgcacaatgggagttagttgagaagcaaatcatttctacgagtccagtacaaattatttatgtgctaactgaaaaaggtaaagcgttagcagaggctttacatccaattgaagcatgggcgcaatcatatgtcgatttaacagatcaacgtactgctaaa

SEQ ID NO: 2196 - protein, 114 aa, Staphylococcus aureus
  MISC_FEATURE (1)..(114): conserved hypothetical
VKMMEVCPYLEETFKILGRSWNGLIINYLSRCNDCSAHFSDMKRDLKTITPRALSLKLSELAQWELVEKQIISTSPVQIIYVLTEKGKALAEALHPIEAWAQSYVDLTDQRTAK

SEQ ID NO: 2197 - DNA, 1257 bp, Staphylococcus aureus
atggctcaagaggtaataaaaataagaggtggacgcacactaaatggggaagttaatatcagtggcgcgaaaaacagtgctgtagctatcattcctgcaacattattagctcaaggacatgtgaaattagaagggttaccgcaaatctctgatgttaaaactttagtgagtttattagaagatttaaatattaaggcatcactaaatggtacggaattagaagttgatacaactgaaatacaaaatgctgcattaccaaataataaagttgaatcattacgtgcttcatactatatgatgggtgccatgttaggtagatttaaaaaatgtgtgattggtttaccgggaggatgtccacttgggccacgtccaattgatcaacatattaaaggatttaaagctttaggtgctgaaattgatgaatcaagtacgacatcaatgaaaatcgaagctaaagagttaaaaggtgcacatatttttctagatatggttagcgtaggtgcaacaattaacattatgctagctgcagtttatgcaacaggacaaactgtaattgaaaatgctgctaaagaaccggaagtagttgatgttgctaacttcttaacaagtatgggagctaatattaagggagcgggtacatcaacaattaaaatcaatggcgtcaaagaattacatggttctgagtatcaagttatacctgatagaattgaagcaggcacatatatgtgtatcgctgcagcatgtggagaaaatgttatattaaataatattgttccgaaacatgtagaaacattaactgctaaatttagtgaattaggtgtgaatgttgatgtaagagacgaaagaattcgcatcaataataatgcgccatatcaatttgttgatattaaaacactagtatatccaggttttgctactgatttgcaacagcctattacaccattattatttatggcaaatggtccttcatttgtaactgatacgatttatccggagcgttttaaacatgttgaagaattaaagcgcatgggtgcaaatattgaagttgacgaaggcacagcaacgataaaaccatcaacattacatggtgctgaagtttatgctagcgatttaagagcaggagcttgtttaattattgctggtttaattgctgagggtgtaactacaatttacaatgttaaacatatttatagaggttatacagatattgtagaacacttaaaagctttaggtgcagatatttggacggaaactgta

SEQ ID NO: 2198 - protein, 419 aa, Staphylococcus aureus
  MISC_FEATURE (1)..(419): UDP-N-acetylglucosamine
MAQEVIKIRGGRTLNGEVNISGAKNSAVAIIPATLLAQGHVKLEGLPQISDVKTLVSLLEDLNIKASLNGTELEVDTTEIQNAALPNNKVESLRASYYMMGAMLGRFKKCVIGLPGGCPLGPRPIDQHIKGFKALGAEIDESSTTSMKIEAKELKGAHIFLDMVSVGATINIMLAAVYATGQTVIENAAKEPEVVDVANFLTSMGANIKGAGTSTIKINGVKELHGSEYQVIPDRIEAGTYMCIAAACGENVILNNIVPKHVETLTAKFSELGVNVDVRDERIRINNNAPYQFVDIKTLVYPGFATDLQQPITPLLFMANGPSFVTDTIYPERFKHVEELKRMGANIEVDEGTATIKPSTLHGAEVYASDLRAGACLIIAGLIAEGVTTIYNVKHIYRGYTDIVEHLKALGADIWTETV

SEQ ID NO: 2199 - DNA, 897 bp, Staphylococcus aureus
ttgaaaaatacgtgcgtaagcactcaaggaggaactttcatgcctttagtttcaatgaaagaaatgttaattgatgcaaaagaaaatggttatgcggtaggtcaatacaatattaataacctagaattcactcaagcaattttagaagcgtcacaagaagaaaatgcacctgtaattttaggtgtttctgaaggtgctgctcgttacatgagcggtttctacacaattgttaaaatggttgaagggttaatgcatgacttaaacatcactattcctgtagcaatccatttagaccatggttcaagctttgaaaaatgtaaagaagctatcgatgctggtttcacatcagtaatgatcgatgcttcacacagcccattcgaagaaaacgtagcaacaactaaaaaagttgttgaatacgctcatgaaaaaggtgtttctgtagaagctgaattaggtactgttggtggacaagaagatgatgttgtagcagacggcatcatttatgctgatcctaaagaatgtcaagaactagttgaaaaaactggtattgatgcattagcgccagcattaggttcagttcatggtccatacaaaggtgaaccaaaattaggatttaaagaaatggaagaaatcggtttatctacaggtttaccattagtattacacggtggtactggtatcccgactaaagatatccaaaaagcaattccatttggtacagctaaaattaacgtaaacactgaaaaccaaatcgcttcagcaaaagcagttcgtgacgttttaaataacgacaaagaagtttacgatcctcgtaaatacttaggacctgcacgtgaagccatcaaagaaacagttaaaggtaaaattaaagagttcggtacttctaaccgcgctaaa

SEQ ID NO: 2200 - protein, 299 aa, Staphylococcus aureus
  MISC_FEATURE (1)..(299): fructose-bisphosphate
LKNTCVSTQGGTFMPLVSMKEMLIDAKENGYAVGQYNINNLEFTQAILEASQEENAPVILGVSEGAARYMSGFYTIVKMVEGLMHDLNITIPVAIHLDHGSSFEKCKEAIDAGFTSVMIDASHSPFEENVATTKKVVEYAHEKGVSVEAELGTVGGQEDDVVADGIIYADPKECQELVEKTGIDALAPALGSVHGPYKGEPKLGFKEMEEIGLSTGLPLVLHGGTGIPTKDIQKAIPFGTAKINVNTENQIASAKAVRDVLNNDKEVYDPRKYLGPAREAIKETVKGKIKEFGTSNRAK

SEQ ID NO: 2201 - DNA, 519 bp, Staphylococcus aureus
atgtcaaaaatcttaaacacacaactaataggtatctttaataggctagaaaaacaatctttagaaattcaaatggccgcccaatgtttaattcaagcaattggtggcgaaggttatgtttatgtaaaaggttatgatgatttacagtttttcgaaagtttcattctacatagtgatgagcgtttaaaatctagccgaaaacttgacgctattaaagactttaaagaaattgactcaactgatcgtgtattattattcgcaccattttataatgatcaagttgcattagatattcaaaaacttatcgacttagatatcgatgtggtcttaataagcaacaaacctaaaacagatgatttccctgatcatctcgtacattttatcgatttatctacaccaagacctatagtctacactgaagattacgataagattgtccaaccacatgcgatggcattgaattatgtatactatgacatttatacacaaatgattgaaatgacaagagacttagaatta

SEQ ID NO: 2202 - protein, 173 aa, Staphylococcus aureus
  MISC_FEATURE (1)..(173): hypothetical protein
MSKILNTQLIGIFNRLEKQSLEIQMAAQCLIQAIGGEGYVYVKGYDDLQFFESFILHSDERLKSSRKLDAIKDFKEIDSTDRVLLFAPFYNDQVALDIQKLIDLDIDVVLISNKPKTDDFPDHLVHFIDLSTPRPIVYTEDYDKIVQPHAMALNYVYYDIYTQMIEMTRDLEL

SEQ ID NO: 2203 - DNA, 366 bp, Staphylococcus aureus
atgatatcgaatgatgcaatcagacgaaatatggctgtcttctctatgagtgtagtaagtaagttaacggatttaacgccaaggcaaatacgttactatgaaacacatgaactcatcaaacctgaaagaacagaaggtcaaaaacgtctgttctcactcaatgatttggaaagattactagaaattaaatcattattagaaaaaggatttaatatcaaagggattaaacaaatcatttatgactcacaagagcatttaacaacagatgaacaagagataagaaaaaagatgattgtagatgccacgcaaaagcctattggagaaactttgccaataaatcgtggtgatttatcccgatttattaaa

SEQ ID NO: 2204 - protein, 122 aa, Staphylococcus aureus
  MISC_FEATURE (1)..(122): glutamine synthetase
MISNDAIRRNMAVFSMSVVSKLTDLTPRQIRYYETHELIKPERTEGQKRLFSLNDLERLLEIKSLLEKGFNIKGIKQIIYDSQEHLTTDEQEIRKKMIVDATQKPIGETLPINRGDLSRFIK

SEQ ID NO: 2205 - DNA, 1608 bp, Staphylococcus aureus
atgacaaaatttatttttgtaacaggtggcgtagtttcatcattagggaagggtattacagcatcttctctaggtagattattaaaagatagaggtctaaatgtaacaattcaaaaattcgatccatacttaaatgttgacccaggtacaatgagtccttatcaacatggtgaagtattcgtaacggatgatggtgcagaaactgacctagacttaggacattacgaaagatttattgatattaatttaaacaagttttcaaatgtgacagccggtaaagtgtattcacacgtattgaaaaaagaacgtcgtggtgattacttaggcggaacagttcaagttattccgcatattacaaatgaaattaaagaacgtttattacttgcaggggaaagtacgaatgcagacgttgttatcactgaaattggcggtacaacaggtgatattgagtcattaccgtttattgaagcgattcgtcaaattcgtagcgatttaggtagagaaaatgttatgtatgttcactgtacattactgccttatattaaagctgctggagaaatgaaaacgaagccaacacaacatagtgttaaagaattacgaggcttaggtattcaaccagacttaatcgttgtaagaactgaatatgaaatgacacaagatttaaaagataaaattgcattattctgtgacattaataaagaaagtgttattgaatgtcgtgatgcagactctttatacgaaattccattacaattaagccaacaaaatatggatgatatcgttattaaacgtttacaattaaacgcgaaatatgaaacacagcttgatgaatggaaacagttgttagatatcgttaataatttagatggtaaaattacaattggtttagtaggtaaatatgttagcttacaagatgcatatttatcagttgttgaatcattgaaacatgctggatatccttttgccaaagatattgacattagatggattgattcaagtgaagtaacagatgaaaatgcagccgaataccttgcagatgtcgacggtattttagtaccaggtggatttggtttccgtgcaagtgaaggtaaaattagtgcaattaagtatgctagagaaaacaatgtaccattctttggtatttgtttaggaatgcaacttgcaacagttgaattttcaagaaacgtattaggccttgaaggcgcacattcagctgaattagacccagcaacaccatacccaattatagatttattaccagaacaaaaagatatcgaagatttaggtggtacattacgcttaggcttatattcatgttcaattaaagaaggcacattggcacaagatgtttatggtaaagcggaaattgaagaaagacatcgtcatcgttatgaatttaataatgactatagagaacaattagaagcaaatggtatggtgatttctggtacaagtccagatggacgtttagtagaaatggtagagattccgacaaatgatttctttattgcttgtcaattccacccagaattcttatctagaccaaatcgtccgcacccgatttttaaatcatttattgaagcttcattaaaatatcaacaaaataaa

SEQ ID NO: 2206 - protein, 536 aa, Staphylococcus aureus
  MISC_FEATURE (1)..(536): CTP synthase
MTKFIFVTGGVVSSLGKGITASSLGRLLKDRGLNVTIQKFDPYLNVDPGTMSPYQHGEVFVTDDGAETDLDLGHYERFIDINLNKFSNVTAGKVYSHVLKKERRGDYLGGTVQVIPHITNEIKERLLLAGESTNADVVITEIGGTTGDIESLPFIEAIRQIRSDLGRENVMYVHCTLLPYIKAAGEMKTKPTQHSVKELRGLGIQPDLIVVRTEYEMTQDLKDKIALFCDINKESVIECRDADSLYEIPLQLSQQNMDDIVIKRLQLNAKYETQLDEWKQLLDIVNNLDGKITIGLVGKYVSLQDAYLSVVESLKHAGYPFAKDIDIRWIDSSEVTDENAAEYLADVDGILVPGGFGFRASEGKISAIKYARENNVPFFGICLGMQLATVEFSRNVLGLEGAHSAELDPATPYPIIDLLPEQKDIEDLGGTLRLGLYSCSIKEGTLAQDVYGKAEIEERHRHRYEFNNDYREQLEANGMVISGTSPDGRLVEMVEIPTNDFFIACQFHPEFLSRPNRPHPIFKSFIEASLKYQQNK

SEQ ID NO: 2207 - DNA, 528 bp, Staphylococcus aureus
atgaaaattcaagattatacaaaacaaatggttgatgaaaaatcatttattgatatggcttatacattattgaatgataaaggcgaaacaatgaacttatatgatatcatcgatgaatttagagcgttaggtgattatgagtacgaagaaattgaaaatcgtgttgtacaattttacacggatttaaacacagatggtcgttttttaaatgttggagaaaatttatggggattacgtgattggtattcggtagatgatattgaagagaaaatcgcaccaactattcaaaaattcgatattctggatgcagatgatgaagaagatcaaaacttaaaattattgggcgaagatgaaatggatgacgacgatgatattccagctcaaacagatgatcaagaagaactaaatgatccagaagatgagcaggttgaagaagaaatcaatcattcggatatagtcattgaagaagatgaagatgaactagacgaagacgaagaagtgtttgaagacgaagaagacttcaacgat

SEQ ID NO: 2208 - protein, 176 aa, Staphylococcus aureus
  MISC_FEATURE (1)..(176): probable DNA-directed RNA
MKIQDYTKQMVDEKSFIDMAYTLLNDKGETMNLYDIIDEFRALGDYEYEEIENRVVQFYTDLNTDGRFLNVGENLWGLRDWYSVDDIEEKIAPTIQKFDILDADDEEDQNLKLLGEDEMDDDDDIPAQTDDQEELNDPEDEQVEEEINHSDIVIEEDEDELDEDEEVFEDEEDFND

SEQ ID NO: 2209 - DNA, 858 bp, Staphylococcus aureus
atggctaaagaactttgttttgaaggtatcactttaaaagcatttgatgaacaatatcgttcagcaattaatgattttgacttgaatgaaagacaacaaatatattcatctttacctaaagaagttattgatgatgcaattaatgatgctgataggattgctaacgtagcaataaacgataaaaatgaagtggtgggcttttttgtattacatcgttactatcagcatgaaggttatgatacacctgaaaatgtcgtttatattcgttcattatcgattaatgaaaaatatcaaggttttggatatggcacgaaaataatgatgtcattgccgcaatatgttcaaggtgtatttcctgattttaatcatctatatctagtagtagatgcggaaaatgacaatgcttggaacctatacgaacgtgctggattcatgcatacagcgactaaagaagaaggaccaattggcaaagaacgactatattacttggacttagattcaaaacatgtttcatcattaaagcttgaagaagaaagtcgttcagaagtgaccaatgtacatatcattaatttaatgattgatggccaaaaggttggctttatcgcattggagcagattggtgaacgcatgaacattgctgctattgaagtggataaatcatatcgctttaatggtattggttcaagtgctctgcgacaattgccaacttacttaagaaaaaactatgacaaccttaatgtgattacgatgattctgtttggagagaataatgattttaaaccattatgtttaaatagtaatttcgttgaaatcgaacaaactgatgattatgtcgttttcgaaaaatatttaaattac

SEQ ID NO: 2210 - protein, 286 aa, Staphylococcus aureus
  MISC_FEATURE (1)..(286): hypothetical protein
MAKELCFEGITLKAFDEQYRSAINDFDLNERQQIYSSLPKEVIDDAINDADRIANVAINDKNEVVGFFVLHRYYQHEGYDTPENVVYIRSLSINEKYQGFGYGTKIMMSLPQYVQGVFPDFNHLYLVVDAENDNAWNLYERAGFMHTATKEEGPIGKERLYYLDLDSKHVSSLKLEEESRSEVTNVHIINLMIDGQKVGFIALEQIGERMNIAAIEVDKSYRFNGIGSSALRQLPTYLRKNYDNLNVITMILFGENNDFKPLCLNSNFVEIEQTDDYVVFEKYLNY

SEQ ID NO: 2211 - DNA, 801 bp, Staphylococcus aureus
atgaaagttggcattgacgctggcggtacactaattaaaatcgttcaagagcaagataaccaacgtacttttaaaactgaattaactaaaaatattgatcaagttgtggaatggttaaaccaacagcaaattgaaaaattatgcttaactggaggtaatgcaggtgtcattgctgaaaacatcaacattcctgcacaaatttttgtagagtttgatgctgcatctcaaggactaggtattttgttaaaagagcaaggccatgacttagcagattatatttttgcaaatgttggtaccggtacgtcactacattatttcgacggccaatcacaacgtcgtgtaggcggtatcggtacaggtggaggcatgattcaaggactcggttatttactaagtcaaatcactgattataaacagttaactgacatggcacaacacggtgatcgtaacactatcgatttaaaggttagacatatttataaagataccgaaccacccattcccggtgatttaacagcagctaattttggtcatgtactacatcatttagatgctgattttacacctagcaataaattagcagccgttattggtgtcgttggcgaagttgttacgacaatggccattactgttgcacgtgaatttaaaactgaaaatatcgtttatatcggttcttcatttcataataacgctttattacgcaaagttgtggaagattatactgtgttacgcggttgcaaaccgtactatgttgaaaacggcgcattttcaggtgctattggtgcattatatttagaaaaa

SEQ ID NO: 2212 - protein, 267 aa, Staphylococcus aureus
  MISC_FEATURE (1)..(267): hypothetical protein
MKVGIDAGGTLIKIVQEQDNQRTFKTELTKNIDQVVEWLNQQQIEKLCLTGGNAGVIAENINIPAQIFVEFDAASQGLGILLKEQGHDLADYIFANVGTGTSLHYFDGQSQRRVGGIGTGGGMIQGLGYLLSQITDYKQLTDMAQHGDRNTIDLKVRHIYKDTEPPIPGDLTAANFGHVLHHLDADFTPSNKLAAVIGVVGEVVTTMAITVAREFKTENIVYIGSSFHNNALLRKVVEDYTVLRGCKPYYVENGAFSGAIGALYLEK

SEQ ID NO: 2213 - DNA, 669 bp, Staphylococcus aureus
atgtcttataaagcatatccattctttagagatatattaataaatgaatgtatttatttcgcctctaaaaataaaaaactagtacgcctaaattataaaagtgaagcgtatgtaggcgtttggacagaagaaagtgtggccgtatcatttttaacaagtcgtgatattccatttgataaagttgtaaaaatggacgttgatcgttttgctacttatgaattagatgaattgtttgatgaacaagaccatattattatgaatcaaacaatggaagaagaagggcatctactaaacgttgtagctgttacacaagaagtgatgacggaattagataaaattagaatcaaagaatttgtccaagatgtagcgaaatatgatgaagtatacggcttaactaaaaaaggtagtaagcagtttattctcattagtgaaaatgatagcgacgaaaaaaagccgcatattatgcctgtatggagtattaaaaacagagcgttaaaagttcgagatgaagattttgaagagtgtgatttaattacgattgaaggttctgttttcggagaatggctagatgaacttagagatgatcataaagccgttgcgatagatttaaaaactggcgtggttggtacaattgtttcagcgcaaaaattgtctaatgaacttacattt

SEQ ID NO: 2214 - protein, 223 aa, Staphylococcus aureus
  MISC_FEATURE (1)..(223): hypothetical protein
MSYKAYPFFRDILINECIYFASKNKKLVRLNYKSEAYVGVWTEESVAVSFLTSRDIPFDKVVKMDVDRFATYELDELFDEQDHIIMNQTMEEEGHLLNVVAVTQEVMTELDKIRIKEFVQDVAKYDEVYGLTKKGSKQFILISENDSDEKKPHIMPVWSIKNRALKVRDEDFEECDLITIEGSVFGEWLDELRDDHKAVAIDLKTGVVGTIVSAQKLSNELTF

SEQ ID NO: 2215 - DNA, 1191 bp, Staphylococcus aureus
atgacaaataatggtaatgagccgaacttaacgttaagtgatttatatgacaaagatgttgtctatacgtcaagaccttcgtatatatcgaatccatggttgaaaccggacgaacatcaatctaattttttaactggtagggagttattaatagcaaatcaattacctgttattgttcacgaagctagtgcgacagacaaattgcatcagctatttcaagttattggtaaggaagtaccgaactcaatttatacatttaacaatcagcaatcttacgaaaacttgatcaaacaattggcacataaggaaaataaaaagatttattttcaatatattcatgatgaaacaatcttgaatcagcaatattatgcattagataaaacgttatttgttgctttaaataataaagcaagaatacctgaatggacaaatgggaagtttttaccaaaaagaaaagttgtaaaaattgagcaattcgaaaacgagattaagaattgggaattcccgttagtaattaagccgggagatgatcttccgacagcaggtggctatggcgttatgatttgttatcatgatgcagatttacaaaaagcgataacgcgtattaaagaggcaactgctgaaacgaattcgcttattatcgaacagaagattgaagaaaaagcgaattattgcgttcagtttgcatactcggaatcgctaggcattcaatatcttggtgcggcaacgcaattaacggataagtacggattttataacggaaatgaaaatactactaatgtaccagagcacgttatagaagcaggtagacaaattatggaaaacggtgtgaatcaaggattctttggtgtagctggttttgacctactcgtcgatgaggatgataacgtttatgcgattgatttaaactttagacaaaatggttcaacgagcatgttattacttgctaacgagttgaattcaggatatcaaaagttttatagttatcattcaaaaggtgataacacacatttcttcaatacgattttgaaatatgtcaaagaaggtagtttatacccgttatcttattatgatggtgattggtacggtgaagataaagttaaatcaaggtttggctgtatttggcatggtgattcaaaagaaacagtactggagaatgaacgcgcatttttagctgaacttgaacactat

SEQ ID NO: 2216 - protein, 397 aa, Staphylococcus aureus
  MISC_FEATURE (1)..(397): hypothetical protein
MTNNGNEPNLTLSDLYDKDVVYTSRPSYISNPWLKPDEHQSNFLTGRELLIANQLPVIVHEASATDKLHQLFQVIGKEVPNSIYTFNNQQSYENLIKQLAHKENKKIYFQYIHDETILNQQYYALDKTLFVALNNKARIPEWTNGKFLPKRKVVKIEQFENEIKNWEFPLVIKPGDDLPTAGGYGVMICYHDADLQKAITRIKEATAETNSLIIEQKIEEKANYCVQFAYSESLGIQYLGAATQLTDKYGFYNGNENTTNVPEHVIEAGRQIMENGVNQGFFGVAGFDLLVDEDDNVYAIDLNFRQNGSTSMLLLANELNSGYQKFYSYHSKGDNTHFFNTILKYVKEGSLYPLSYYDGDWYGEDKVKSRFGCIWHGDSKETVLENERAFLAELEHY

SEQ ID NO: 2217 - DNA, 1182 bp, Staphylococcus aureus
atgagtgaaaaacaacaaattctcgattatatagaaacaaataaatatagttatatcgaaatcagtcatagaattcatgaacgtcctgaacttggtaatgaagaaatatttgcgtctcgaactttaatagatcgtttgaaagagcatgattttgaaattgaaaccgagattgctgggcatgcaactgggtttatagcgacatatgattcaggacttgacgggccagctataggttttttagcagaatacgatgctttgccaggattgggtcatgcttgtggtcataatatcattggaactgcaagtgttcttggtgcaattggtttgaagcaagtgattgaccaaattggtggtaaagtagtcgttcttggatgtccagctgaagaaggtggggaaaatggtagcgctaaagcttcttatgtcaaggctggtgtgattgatcaaatagacattgccttaatgattcatccgggaaatgaaacttataaaacgattgatactttggcagtggatgttttagatgttaaattttacggaaaaagtgctcatgcctctgaaaatgcagatgaagcgttaaatgcattagacgctatgattagttattttaatggtgtagcacaactacgacaacatattaaaaaagatcaacgtgtgcatggtgtgattttagatggcgggaaagcagctaatattattccagactatacacatgctcgtttttatactagagcaatgacgcgtaaagaattggatatattaacagaaaaagtaaatcaaatcgcacgtggagctgcgatacagactggttgtgattatgaatttggtcgaattcaaaacggtgtgaatgaattcattaaaacgccgaaattagatgatttatttgctaaatatgctgaagaagttggtgaagcagttattgatgatgattttggttatggctctacggatacagggaacgtaagtcatgttgtgccaacaatacatcctcatattaaaataggatcacgtaatttagtaggacatacgcatagatttagagaagcggctgcgagtgtacatggtgatgaagcattaattaaaggcgctaaaataatggcgttgatggggttagagttaattacaaatcaagacgtttatcaagacattattgaagagcatgcgcatttgaaagggaatgggaag

SEQ ID NO: 2218 - protein, 394 aa, Staphylococcus aureus
  MISC_FEATURE (1)..(394): HmrA [Staphylococcus aureus
MSEKQQILDYIETNKYSYIEISHRIHERPELGNEEIFASRTLIDRLKEHDFEIETEIAGHATGFIATYDSGLDGPAIGFLAEYDALPGLGHACGHNIIGTASVLGAIGLKQVIDQIGGKVVVLGCPAEEGGENGSAKASYVKAGVIDQIDIALMIHPGNETYKTIDTLAVDVLDVKFYGKSAHASENADEALNALDAMISYFNGVAQLRQHIKKDQRVHGVILDGGKAANIIPDYTHARFYTRAMTRKELDILTEKVNQIARGAAIQTGCDYEFGRIQNGVNEFIKTPKLDDLFAKYAEEVGEAVIDDDFGYGSTDTGNVSHVVPTIHPHIKIGSRNLVGHTHRFREAAASVHGDEALIKGAKIMALMGLELITNQDVYQDIIEEHAHLKGNGK

SEQ ID NO: 2219 - DNA, 468 bp, Staphylococcus aureus
atgacaaaaatgaatgttgaaagtttcaatttagatcatactaaggtggttgccccatttattagattagcgggaacgatggaaggattaaacggagatgtcattcacaaatacgacattcgtttcaaacaaccaaacaaagaacatatggatatgcccggactacattcattagaacatttaatggctgaaaatattagaaatcatagtgacaaagttgttgatttaagtcctatgggttgccaaactggtttctatgtatcatttattaatcatgataattatgatgatgtattaaatattgttgaagcaactttaaatgatgtgctaaatgctactgaagtgcctgcttgtaatgaagtacaatgtggctgggcagcaagtcattcattagaaggtgctaaaactatcgctcaagcatttctagacaaacgaaacgaatggcatgatgttttcggtacaggaaaa

SEQ ID NO: 2220 - protein, 156 aa, Staphylococcus aureus
  MISC_FEATURE (1)..(156): autoinducer-2 production
MTKMNVESFNLDHTKVVAPFIRLAGTMEGLNGDVIHKYDIRFKQPNKEHMDMPGLHSLEHLMAENIRNHSDKVVDLSPMGCQTGFYVSFINHDNYDDVLNIVEATLNDVLNATEVPACNEVQCGWAASHSLEGAKTIAQAFLDKRNEWHDVFGTGK

SEQ ID NO: 2221 - DNA, 348 bp, Staphylococcus aureus
ttgaacatactaagatatttattaggaataggttttagtgtaataggtgtattgcattttacacgagaacgacaatttagaaatatcataccgaaatgtttgccacttcgaaaaacagcggttcttgttacaggaatctttgagatattatttggacttgcacttttaattaaaagaccatctcaatgcttgaaaaatacaatcaatctattcttgctagctgtattcccagctaatatctatatggcagttaaaaagttacctttaggagataaacaattgccaacatggcaactatatttaaggttacctatgcagttcgtgttaatgggactaattaagaaatta

SEQ ID NO: 2222 - protein, 116 aa, Staphylococcus aureus
  MISC_FEATURE (1)..(116): conserved hypothetical
LNILRYLLGIGFSVIGVLHFTRERQFRNIIPKCLPLRKTAVLVTGIFEILFGLALLIKRPSQCLKNTINLFLLAVFPANIYMAVKKLPLGDKQLPTWQLYLRLPMQFVLMGLIKKL

SEQ ID NO: 2223 - DNA, 1338 bp, Staphylococcus aureus
atgctttgtcctaagctttttaagaaaaggatgataaaaatgagaatgatagacattattgagaaaaagcgtgacggtcatacactaacaacggaagaaattaatttctttattggcggctatgttaaaggggatattcctgattaccaagcatcaagtttagcaatggcgatttatttccaagatatgaatgatgatgagcgtgcagcattaacgatggctatggttaattctggtgatatgatagatttgagtgatattaaaggtgtcaaagtagataagcactcaacaggtggtgtaggagatacaactacattggttttagcaccattagtagcagctgtagatgttcctgttgcaaaaatgagtgggcgtggattaggtcatacaggtggtacgattgataaattagaagcaattgatggttttcatgttgaaatagatgaagcaacatttgtgaaattggttaatgaaaataaagtggcagttgtaggacaatcaggaaatttaactcctgcagacaaaaaattatatgccttaagggatgttactggtactgtcaattcaataccattaattgcctcttcaattatgagtaaaaagattgctgctggtgcagatgcaattgtattagatgtaaaaactggtagcggtgcatttatgaaaacattagaagatgctgaagcattagcgcacgcaatggtacgtattggtaataatgtgggacgtaatacgatggcgattatttctgatatgaatcagccacttggacgtgcgattggcaatgcgcttgagttacaagaagcaattgatacgttgaaaggacaaggtccgaaagatttaacagaacttgtattaacattaggttctcaaatggttgtacttgcaaacaaagctgaaacgcttgaagaagcgagagcgttgctaattgaggcaattaattcaggtgcagcattagaaaaattcaaaacatttattaaaaaccaaggtggcgacgaaactgttattgaccatccagagcgtttgccacaagctcaatatcaaattgaatataaagctaaaaaatcaggttatgtgactgaattagtctctaacgatataggtgtcgcttcgatgatgttaggagcgggacgtttaacaaaagaggatgatattgatttagcggttggtattgttttaaataaaaaaattggtgataaagtagaagaaggagaatcattattaacgattcacagtaatcgccaagatgtagacgatgttgttaaaaaattagattcaagcataacaattgctgatcatgttgtatcgcctacattaattcataaaatcattacagaa

SEQ ID NO: 2224 - protein, 446 aa, Staphylococcus aureus
  MISC_FEATURE (1)..(446): pyrimidine nucleoside
MLCPKLFKKRMIKMRMIDIIEKKRDGHTLTTEEINFFIGGYVKGDIPDYQASSLAMAIYFQDMNDDERAALTMAMVNSGDMIDLSDIKGVKVDKHSTGGVGDTTTLVLAPLVAAVDVPVAKMSGRGLGHTGGTIDKLEAIDGFHVEIDEATFVKLVNENKVAVVGQSGNLTPADKKLYALRDVTGTVNSIPLIASSIMSKKIAAGADAIVLDVKTGSGAFMKTLEDAEALAHAMVRIGNNVGRNTMAIISDMNQPLGRAIGNALELQEAIDTLKGQGPKDLTELVLTLGSQMVVLANKAETLEEARALLIEAINSGAALEKFKTFIKNQGGDETVIDHPERLPQAQYQIEYKAKKSGYVTELVSNDIGVASMMLGAGRLTKEDDIDLAVGIVLNKKIGDKVEEGESLLTIHSNRQDVDDVVKKLDSSITIADHVVSPTLIHKIITE

SEQ ID NO: 2225 - DNA, 1236 bp, Staphylococcus aureus
atgaaagatataagtaagatagtagctgacgtcgaatcaacgttagcaccatattttaaagaaattgaagaaacagcatatattaatcaagaaaaagtattaaatgcatttcatcatgtcaaagcaaccgaaagtgatctacaaggatcaacaggatacgggtatgatgactttggacgtgatcatttagaagaaatatatgcgcaggcatttaaagcagaagatgcaattgttcgtccgcaaattatttcaggtacgcatgcgattactattgcattacaaagtttattaaaacatggtgatgaattaatttatataacgggtagtccatatgacactttacttgaagtcattggcgtaaacggaaatggtattgaaagtttaatggagcatggcgtatcgtataaagatattgcacttaaagaaggtaagatcgatattgaaagtgtgttagatggggtttctgagcgcaccaaagtaatagcgattcaacgttcgaaaggctatgatcaaagaccttcaattccgctagatgaaattgaaaaggtaattactaggttgaaaaacgtgcatcctaatattttaatatttgtggataactgttatggggaatttgttgaaagacgtgaacctatagaatgtggtgccgatttaatagcaggatcattaattaaaaaccctggcggtggtttagctaagattggtggatacattgctggtagaaaagatttaattgaacgatgtggttatagattgacagcacctggtattggtaaagaagcgggtgcatcattaaatgcattgcttgaaatgtatcaaggtttctttttagcaccacacgttgtcagtcagagtcttaaaggtgcattgtttactagtttatttttagaaaaaatgaatatgaacacaacgccgaagtactacgaaaaacgaactgatttaattcaaacagttaaatttgaaacgaaagaacaaatgatttcattttgtcaaagtattcaacacgcatccccaattaatgcacattttagtccagaacctagttatatgcctggttacgaagatgatgttattatggcagctggtacgtttattcaaggttcatcgattgaattatctgcagatggacctattcgtcctccttatgaagcatatgttcaaggaggattaacatatgaacacgttaaaattgctgtgacaagagctgttaatcagttgaaagaacaaggacttata

SEQ ID NO: 2226 - protein, 412 aa, Staphylococcus aureus
  MISC_FEATURE (1)..(412): hypothetical protein
MKDISKIVADVESTLAPYFKEIEETAYINQEKVLNAFHHVKATESDLQGSTGYGYDDFGRDHLEEIYAQAFKAEDAIVRPQIISGTHAITIALQSLLKHGDELIYITGSPYDTLLEVIGVNGNGIESLMEHGVSYKDIALKEGKIDIESVLDGVSERTKVIAIQRSKGYDQRPSIPLDEIEKVITRLKNVHPNILIFVDNCYGEFVERREPIECGADLIAGSLIKNPGGGLAKIGGYIAGRKDLIERCGYRLTAPGIGKEAGASLNALLEMYQGFFLAPHVVSQSLKGALFTSLFLEKMNMNTTPKYYEKRTDLIQTVKFETKEQMISFCQSIQHASPINAHFSPEPSYMPGYEDDVIMAAGTFIQGSSIELSADGPIRPPYEAYVQGGLTYEHVKIAVTRAVNQLKEQGLI

SEQ ID NO: 2227 - DNA, 660 bp, Staphylococcus aureus
atgaatagtgcaaaattgattgatcacactttattgaagcctgagtcaacacgtacgcaaatcgatcaaatcatcgatgaagcgaaagcataccattttaaatctgtatgtgtgaatccaacgcatgttaaatatgcagcagagcgactagctgattcagaggtgttagtttgtacggtaataggattcccattaggtgcatcgacaactgcgacgaaagcatttgaaacagaagatgcgattcaaaatggtgcagatgaaattgacatggtcatcaacatcggcgcattaaaagatggacgttttgatgatgtacaacaagacattgaagcagtggtgaaagctgcgaaaggtcacacagtaaaagtgattattgagacggtattgttggaccatgacgaaattgtaaaagcgagtgaattaacaaaagcggctggtgcggacttcgttaaaacttcaacaggttttgcaggtggcggtgcgactgcagaagacgttaaattaatgaaagatacagtaggtgctgatatagaagtaaaagcatcaggtggcgtacgtaatttagaagatttcaataaaatggttgaagcaggtgcgacacgtattggtgcgagcgcaggcgttcaaattatgcaaggtttagaagcagattcagattac

SEQ ID NO: 2228 - protein, 220 aa, Staphylococcus aureus
  MISC_FEATURE (1)..(220): deoxyribose-phosphate
MNSAKLIDHTLLKPESTRTQIDQIIDEAKAYHFKSVCVNPTHVKYAAERLADSEVLVCTVIGFPLGASTTATKAFETEDAIQNGADEIDMVINIGALKDGRFDDVQQDIEAVVKAAKGHTVKVIIETVLLDHDEIVKASELTKAAGADFVKTSTGFAGGGATAEDVKLMKDTVGADIEVKASGGVRNLEDFNKMVEAGATRIGASAGVQIMQGLEADSDY

SEQ ID NO: 2229 - DNA, 708 bp, Staphylococcus aureus
atgacaaaaggtacaccacatattcaaccaaatggagtaaaaattgctaaaacagtattaatgcctggcgatccgctacgtgcaaaatatattgctgataattttttagaaaatgttgaacaatttaacgatgtacgtaacatgtttggttacactggtacatataaaggtaaagaagtttctgtaatgggttctggtatgggtattccaagtattggtatttactcatatgagttatacaacttctttgatgtagatacaatcattcgtatcggttcttgtggcgcattacaagaaaatgttaacttatacgatgttattattgcacaagctgcatcaactaattcaaattatgtagatcaatacaatattccaggtcatttcgcgcctatcgctgacttcgagttagtaactaaagctaaaaatgtcgctgaccaaatcggtgctactacacacgtaggtaacgtattatcttctgatacattttacaatgccgatccaacattcaatgatgcttggaaaaaaatgggtattttaggtatcgaaatggaatcagctggtttatatttaaatgcgattcatgctggtaaaaaagcacttggtattttcacagtaagtgatcatattttacgtgacgaagctactacacctgaagaacgtcaaaattcatttacacaaatgatggaaatcgctttagaaatcgcagag

SEQ ID NO: 2230 - protein, 236 aa, Staphylococcus aureus
  MISC_FEATURE (1)..(236): purine nucleoside
MTKGTPHIQPNGVKIAKTVLMPGDPLRAKYIADNFLENVEQFNDVRNMFGYTGTYKGKEVSVMGSGMGIPSIGIYSYELYNFFDVDTIIRIGSCGALQENVNLYDVIIAQAASTNSNYVDQYNIPGHFAPIADFELVTKAKNVADQIGATTHVGNVLSSDTFYNADPTFNDAWKKMGILGIEMESAGLYLNAIHAGKKALGIFTVSDHILRDEATTPEERQNSFTQMMEIALEIAE

SEQ ID NO: 2231 - DNA, 441 bp, Staphylococcus aureus
atgagtaatcaacaagatgttgtaaaagaattgaatcaacaagtagcaaactggacagtagcttacacaaagctacacaatttccactggtatgtgaaagggcctaacttcttctcattacacgttaaatttgaagaattatataatgaagcaagccaatatgtagacgaattagctgaaagaattttagcggtaggaggaaaccctgtaggtacattaactgaatgcttagagcaatcaattgttaaagaagctgcgaaaggttactctgcagaacaaatggttgaagaattatcacaagacttcacaaatatctcaaaacaattagaaaacgcaatcgaaattgctggtaatgctggcgatgatgtatcagaagatatgtttataggtatgcaaacatcagtagataaacataattggatgtttaaatcttacttaagc

SEQ ID NO: 2232 - protein, 147 aa, Staphylococcus aureus
  MISC_FEATURE (1)..(147): general stress protein 20U
MSNQQDVVKELNQQVANWTVAYTKLHNFHWYVKGPNFFSLHVKFEELYNEASQYVDELAERILAVGGNPVGTLTECLEQSIVKEAAKGYSAEQMVEELSQDFTNISKQLENAIEIAGNAGDDVSEDMFIGMQTSVDKHNWMFKSYLS

SEQ ID NO: 2233 - DNA, 411 bp, Staphylococcus aureus
atgccaatcgtatattatgatggaaactgtatatattgttataactatgtcatttggttaattcaacatgacctaccaagaaattatcaatttgccacgttaaaaggtgaagttggccaacaattttttaaacaacatccagaagcggcaaataaaaatagtgtgattttacagaaaggtgatcgtatatattttgaatcgcaggcgattattaaactaatcacagcactacctaatcgaactaaattattgggcgtaggtttatggcttgtacctaaaccagtccgtaatttcggttatcgaatgtttgctaataatagaaatagaatgtggaaaacaacatggcaccaaccaaatgattatgaaaaatcgttctttttagatgataatgcgaaagtaaaacttactgat

SEQ ID NO: 2234 - protein, 137 aa, Staphylococcus aureus
  MISC_FEATURE (1)..(137): conserved hypothetical
MPIVYYDGNCIYCYNYVIWLIQHDLPRNYQFATLKGEVGQQFFKQHPEAANKNSVILQKGDRIYFESQAIIKLITALPNRTKLLGVGLWLVPKPVRNFGYRMFANNRNRMWKTTWHQPNDYEKSFFLDDNAKVKLTD

SEQ ID NO: 2235 - DNA, 1371 bp, Staphylococcus aureus
atgacagcagaaacgaattatttttggttgaattgtggatataaccgttggaatcataatgaaccgttagtaggacaaacagctttatttgaatcaggcgcacattttaacccatctcaaggatttagagcgtttaaaaaggctaaagtaggagatcaagtcatcttttatcaagttcagacggatactggactacttggatgtggtgaaattattagtgttgaaacaggtgcacaaaataaaatacgtgtacagtttcgttttaatgaacaattgaaaccattaacagcagattatttaaagcgtagtgaagctttggaatttcgtataagtaatatgaaagagacattgttcaatcaaatcactgcagaagagtttgatttaataagtggtcttggtaaaggcgaaattaagataccgcgttatttctttttagctgaaactgaagaatttgaacctggaaaccaatatacgatttatacgcacacgtacaacggtattaaacgtaatggttatcatttttatactcagttagaagaaggcgacaatattattttttataatcgaacgaaaaatcaatctgtcgttggaattggagaagtatcaaagcatattcatgaaaaaccaccaattcctggtagaacaaatagtacagtgattgaagtgtcttatgagaaagacattacaccgattacattaagtacattaaataagcatcctaaattgaaaaacttatatttccttcaagaaaatgcaaaacaggctattgcaagtatgtcacaagcacagtatgatgcaattattgaaatgagcgataataatggattgaaatctccatttgaaatggttcaaaaaccagatatgcttgaaagtgaaaaagaagaagcgttaaagccatttattttacttgttgtagatcgaaaagaagaaggcttaaaagcggctaatgacttattgcaaaaagcgaatgcaaatcctgttataacaacaggtcatcctgatttttcagaagatatgctttatggcaagtatttaccaaatgaaacaggggcattatactatcgtgaagggtttattactcaattaatgcctaaaaaggataaaagttatttagttattgataattttaatcgtatagatacagacattttccaaacgtatattaatgtgttagaaggctatgaagtaacattaccacgttataataaagacggtaatatgattaaatggtcacgacaaaaagattctttctattatttcaatcctaattggcatattgtaggtattacatatgacagtttagaggaaattaaggagaaatattcagagcagtttttaaaatacacacgtatagtcaaagtcaaacatgac

SEQ ID NO: 2236 - protein, 457 aa, Staphylococcus aureus
  MISC_FEATURE (1)..(457): hypothetical protein
MTAETNYFWLNCGYNRWNHNEPLVGQTALFESGAHFNPSQGFRAFKKAKVGDQVIFYQVQTDTGLLGCGEIISVETGAQNKIRVQFRFNEQLKPLTADYLKRSEALEFRISNMKETLFNQITAEEFDLISGLGKGEIKIPRYFFLAETEEFEPGNQYTIYTHTYNGIKRNGYHFYTQLEEGDNIIFYNRTKNQSVVGIGEVSKHIHEKPPIPGRTNSTVIEVSYEKDITPITLSTLNKHPKLKNLYFLQENAKQAIASMSQAQYDAIIEMSDNNGLKSPFEMVQKPDMLESEKEEALKPFILLVVDRKEEGLKAANDLLQKANANPVITTGHPDFSEDMLYGKYLPNETGALYYREGFITQLMPKKDKSYLVIDNFNRIDTDIFQTYINVLEGYEVTLPRYNKDGNMIKWSRQKDSFYYFNPNWHIVGITYDSLEEIKEKYSEQFLKYTRIVKVKHD

SEQ ID NO: 2237 - DNA, 237 bp, Staphylococcus aureus
gtgaatgatttgaagcaatttctatatattgcgttagtatgtggtgtgatagcaggtcttggtgctttcttacatataccgcagtatccgagcatgacaattccacgtatagtagctattttaggaattatcagtgctatgttgacttttaaagacaagcaaatcagcgcctcattaaagtttagcgcattgttaattaatgtgctgccattatgcggtacctttgtagcttcaaat

SEQ ID NO: 2238 - protein, 79 aa, Staphylococcus aureus
  MISC_FEATURE (1)..(79): hypothetical protein
VNDLKQFLYIALVCGVIAGLGAFLHIPQYPSMTIPRIVAILGIISAMLTFKDKQISASLKFSALLINVLPLCGTFVASN

SEQ ID NO: 2239 - DNA, 738 bp, Staphylococcus aureus
ttgtttggtgatttcccaagcaaagattttccgcttctaactaaaatagtggatgcaagagaatcactttctattcatgtgcaccctgataattcttatgcttatgagcatgaaaacgggcaatatggcaaatctgaatgttggtatattatagatgcagaagaagatgcagaaatagttatagggacattagcagagtctagagaagaagttgcgaatcatgttcaacacggaacgatagagtcgatacttagatatattaaagtaaaacctggagaattctattttattccagcaggaacagtacatactatttcttcaggaatattagcatacgaaacgatgcaatcgtcagacattacatatagactttatgatttcaatcgtcaagataatcaatataatgatagaccgttaaatattgaaaaagctttagacgttattcagtacaatgcaccattacctaatattttgcctgaaagcgaaattattgaaaaccataagtgtacacacattgtatcgaatgatttctttacattggttaaatgggaaatttctggcacgttaaattatatgaagcctagagagttctgtttagttacagtgttggaaggcgaagggcaaatgattgtcgatggtgaaattttcaaactgactactggtacaaactttattttgacttctgaagatttggatagtgtctttgaaggtgatttcacattgatgattagctatgtg

SEQ ID NO: 2240 - protein, 246 aa, Staphylococcus aureus
  MISC_FEATURE (1)..(246): hypothetical protein
LFGDFPSKDFPLLTKIVDARESLSIHVHPDNSYAYEHENGQYGKSECWYIIDAEEDAEIVIGTLAESREEVANHVQHGTIESILRYIKVKPGEFYFIPAGTVHTISSGILAYETMQSSDITYRLYDFNRQDNQYNDRPLNIEKALDVIQYNAPLPNILPESEIIENHKCTHIVSNDFFTLVKWEISGTLNYMKPREFCLVTVLEGEGQMIVDGEIFKLTTGTNFILTSEDLDSVFEGDFTLMISYV

SEQ ID NO: 2241 - DNA, 222 bp, Staphylococcus aureus
atgagaacaaaatcaaaatataatggaacaacaacatcagagttctattgcttacttaatcacaatggaggtgcaacaatgccattatttttacaaccaattttaaaaacaaaattatggggcggtcaacgtctaagtgagtttggatatcaattagacaatgatacaactgggggaatgttggtgtgtgtcagcacatccaaatggtacgagcgagattat

SEQ ID NO: 2242 - protein, 74 aa, Staphylococcus aureus
  MISC_FEATURE (1)..(74): hypothetical protein
MRTKSKYNGTTTSEFYCLLNHNGGATMPLFLQPILKTKLWGGQRLSEFGYQLDNDTTGGMLVCVSTSKWYERDY

SEQ ID NO: 2243 - DNA, 663 bp, Staphylococcus aureus
atgaatattttggttataggtgctaatggcggtgtaggttcgttactagtgcaacaattagcaaaagaaaatgtaccatttactgctggtgttaggcaatcagatcaacttaatgcgttaaaatcacaaggtatgaaagcaattcttgttgatgttgaaaatgattcaatagagactttaactgagacgtttaaaccattcgataaagttatcttttcagtaggttctggagggaacacgggtgcagataaaacaattattgtcgatttagatggtgctgttaaatcaatgattgcgagtaaagaggccaatattaaacactatgtcatggtttcaacatatgattcgagacgtcaggcttttgatgatagcggtgatttaaagccatatacaatagctaaacattacgctgatgactatttaagacgttcaggtttgaattatacaattttacatccaggggcacttacaaatgcagcaggatctggaaagatagaagctgcacaatattttgatggtaaaggtgaaattcctagagaagatgttgcgacagtattaaaagaaattgtcacatccaatcattttaatcaccaagagtttcaaattattagtggtgatcaggacattaaagatgctttaactcaatttgaaaatgaaacggat

SEQ ID NO: 2244 - protein, 221 aa, Staphylococcus aureus
  MISC_FEATURE (1)..(221): conserved hypothetical
MNILVIGANGGVGSLLVQQLAKENVPFTAGVRQSDQLNALKSQGMKAILVDVENDSIETLTETFKPFDKVIFSVGSGGNTGADKTIIVDLDGAVKSMIASKEANIKHYVMVSTYDSRRQAFDDSGDLKPYTIAKHYADDYLRRSGLNYTILHPGALTNAAGSGKIEAAQYFDGKGEIPREDVATVLKEIVTSNHFNHQEFQIISGDQDIKDALTQFENETD

SEQ ID NO: 2245 - DNA, 318 bp, Staphylococcus aureus
atgtcagaacaatattcagaaataaatacagatacattagaacgcgtaactgaaattttcaaggcattaggcgattacaatcgaatacgtatcatggaattgttatcagtcagcgaagcaagtgttggtcacatttcacatcaattgaatttatctcaatcaaatgtctcgcaccaattaaaattacttaaaagtgtgcatcttgtgaaagcaaaacgacaaggccaatcaatgatttattcattagatgacatccacgtagcaactatgttaaagcaagccatacatcacgcgaatcatcctaaagaaagtgggtta

SEQ ID NO: 2246 - protein, 106 aa, Staphylococcus aureus
  MISC_FEATURE (1)..(106): repressor protein
MSEQYSEINTDTLERVTEIFKALGDYNRIRIMELLSVSEASVGHISHQLNLSQSNVSHQLKLLKSVHLVKAKRQGQSMIYSLDDIHVATMLKQAIHHANHPKESGL

SEQ ID NO: 2247 - DNA, 1245 bp, Staphylococcus aureus
atgtataacatggctcagcaacaaattcatgatactaaaaataaactagaaaaagctgtcttagtcggtgtacatgctcaagatgataagcaatttaattttgagtctacaatggaggaattatcatctttatcagagacttgccaacttgaagtgttgggtcaaattactcaaaacagagatcgtgtagatcgcaaatattatgttggtaaaggtaaaattgaagaaattcaagcatttattgagttcaaagatattgatgtagtcatcacaaatgatgaattaacgactgcacaatccaaatcactaaatgaagctttaggtgtaaaaattattgatagaactcagttgattcttgaaatatttgcattaagagcaagaagtaaagaaggtaaattgcaagtagagctagcacaacttgattatttattacctagattgcaaggccatggtaaaagcctttctcgtttaggtggcggtattggaactagaggccctggtgaaacgaagttagagatggatcgcagacatattcgaactcgtatgaatgaaattaaacatcaattgcggacggtagaagaacatcgcgaaagatatcgaaataaaagaaatcaaaatcaggtgtttcaagtagctttagttggttatacaaatgctggtaaatcatcatggtttaatgttttagcaaatgaagagacgtatgaaaaagatcaattatttgcaacgttagatcctaaaacacgacaaattcaaataaatgatggatttaatttaattatttcagatactgttggttttatacagaaactacctacgacgttaattgcagcttttaaatcaactttagaagaggctaaaggtgcagatttattagtacatgtcgtagatagtagccatcctgaataccgtacgcagtatgacacagttaatgatttaatcaaacaattagatatgagtcatatttctcaaatagttatttttaataaaaaggacttatgtgatcatgcatcaaatcgtccagcaagtgatttgcctaatgtttttgtttcttctaaaaatgatggtgataaattacttgttaagacgttatttattgatgaaatcaaaaggcaattaacttattatgatgagacaattgcgacgaataatgcagatcgattatattttctaaaacaacatacattagtgactgaacttaaatatgatgaaattgaaaatgtttatcgtataaaaggatttaaaaaa

SEQ ID NO: 2248 - protein, 415 aa, Staphylococcus aureus
  MISC_FEATURE (1)..(415): hypothetical protein
MYNMAQQQIHDTKNKLEKAVLVGVHAQDDKQFNFESTMEELSSLSETCQLEVLGQITQNRDRVDRKYYVGKGKIEEIQAFIEFKDIDVVITNDELTTAQSKSLNEALGVKIIDRTQLILEIFALRARSKEGKLQVELAQLDYLLPRLQGHGKSLSRLGGGIGTRGPGETKLEMDRRHIRTRMNEIKHQLRTVEEHRERYRNKRNQNQVFQVALVGYTNAGKSSWFNVLANEETYEKDQLFATLDPKTRQIQINDGFNLIISDTVGFIQKLPTTLIAAFKSTLEEAKGADLLVHVVDSSHPEYRTQYDTVNDLIKQLDMSHISQIVIFNKKDLCDHASNRPASDLPNVFVSSKNDGDKLLVKTLFIDEIKRQLTYYDETIATNNADRLYFLKQHTLVTELKYDEIENVYRIKGFKK

SEQ ID NO: 2249 - DNA, 474 bp, Staphylococcus aureus
atggagacaatttatgattttgtagtagaaacaaataaaggtgttacttacaaattagatgcatataagggtgacgttatgctaattgttaatacagctagcgaatgtggctttacttcacaatttgaaggtttgcaatcattatacgagaaatacaaagatcaagggtttgtaattctaggtttcccttgtaatcaatttggtggccaagaacctggttcaggcgaagaagcagctcaaaactgtaaattaaactatggtgttaccttccctatgcatcaaaaaatagacgtaaaaggggaacatcaattacctttatttagatatttgactgcggcacaacacggattctttaatgagaaaatcaaatggaatttcactaagtttttagtggatcgcgaaggtaacgttgttaaacgatttgcacctcaaaaaaaacctgttcaaatcgaaagagaaatagaaaaattatta

SEQ ID NO: 2250 - protein, 158 aa, Staphylococcus aureus
  MISC_FEATURE (1)..(158): glutathione peroxidase
METIYDFVVETNKGVTYKLDAYKGDVMLIVNTASECGFTSQFEGLQSLYEKYKDQGFVILGFPCNQFGGQEPGSGEEAAQNCKLNYGVTFPMHQKIDVKGEHQLPLFRYLTAAQHGFFNEKIKWNFTKFLVDREGNVVKRFAPQKKPVQIEREIEKLL

SEQ ID NO: 2251 - DNA, 990 bp, Staphylococcus aureus
gtgggttataatatgtctcattcacatcatcatcatgaccatatgcatagtcatgtaactacaaataataagaaagtattgtttatatcgtttttaataatcggtctatatatgtttatcgaaatcatcggcggtctccttgctaacagcttggcattactatctgacggtatccatatgtttagcgacacattctcattaggtgttgcacttgtcgcatttatttatgctgaaaagaatgccacaactacaaaaacatttggttataaacgtttcgaagtactcgcagcgttatttaacggtgtaacgctttttgtaataagtattttgattgtttttgaagcgattaaacgtttctttgttccttctgaagttcaatcaaaagaaatgttaatcattagtattatcggtttaattgtcaatatcgttgttgcattctttatgtttaaaggcggcgacacttcacacaatttaaatatgcgtggtgcttttctacatgttatcggagacttattaggttcagttggcgccattactgcagctattttaatttgggcatttggatggacaatcgccgatcctatcgcaagtattttagtttccgttattattttaaaaagtgcttggggtatcacaaaatcttcaattaacattttaatggaaggcacaccaagtgatgttgatatagatgaagttataactactattaaaaaggattcacgaatacaaagtgtgcatgattgccatgtttggacaatttcaaatgatatgaatgcattgagttgtcatgttgttgtagaccatacattgacaatgaaagaatgtgaattattattagaaaacattgagcatgatttattacatttaaatattcaccatatgactattcaattagaaacgcctaatcacaaacatgatgaatcgattatatgttcaggaacacatagtcattcacataaccatcatgctcatcatcacgcgcatgtacat

SEQ ID NO: 2252 - protein, 330 aa, Staphylococcus aureus
  MISC_FEATURE (1)..(330): cation-efflux system
VGYNMSHSHHHHDHMHSHVTTNNKKVLFISFLIIGLYMFIEIIGGLLANSLALLSDGIHMFSDTFSLGVALVAFIYAEKNATTTKTFGYKRFEVLAALFNGVTLFVISILIVFEAIKRFFVPSEVQSKEMLIISIIGLIVNIVVAFFMFKGGDTSHNLNMRGAFLHVIGDLLGSVGAITAAILIWAFGWTIADPIASILVSVIILKSAWGITKSSINILMEGTPSDVDIDEVITTIKKDSRIQSVHDCHVWTISNDMNALSCHVVVDHTLTMKECELLLENIEHDLLHLNIHHMTIQLETPNHKHDESIICSGTHSHSHNHHAHHHAHVH

SEQ ID NO: 2253 - DNA, 1089 bp, Staphylococcus aureus
ttgtttacttactttaaatcagcatttaaaaatgctaaaccacaattattaataacattgatatatgcacttatagcatttgctgtaattgcagttgtatatttacttgctaatttccagcttgctaagtatgcacaaactattgcaatttattcacaatttgggcaaaaaccaccagtagatgcatatttaaaagttatcgctgtattacttatagcagctgtagtttcactgtttgttttagttcaaatttttatcggaattacaaatgttatgaaacgagcaatgagtcatgaaaaagtaaaatttaccgatttatttattgcatttaaaaaaggtaattatttaaagagcgttctgatcggtcttgtatctatagcaatgattatcgttctttcacttctgacatcattactatacaaattattttctccagtatcagaaatgattatgaattcagtacaatcatcatatgcagatagtacacacctgattggtattgctattacaactcaaagcatcataatcattgttgttttattgattaaagcaattattacttggttattgttaatacctattttcaactttatgactagtttcgttgaatcaactaacgataaagtaaaaacacacttagctaatggatttaaagcaatgaaaaatggtcaaaaaacatttttcaaatttttcattggaatactattattaaacttaattattattttatttaaaacacctgttggttacttgatttcatttaatacgcaatcactctctcaaagtgttgcagaaaatatcataagagtttatacagtaatgacaattattttattcgttgttattcatgcaatcattttaatgggtatcgttcaatattacttaaaacgtggtcaaaaaattactaaagataaagtaaaaacagctgacaagaataaaaaagttgtcactgaaccaaaaaatacaaaagtagaaaatgataaagtgacaacatctgttgaaacaaaaacagaaaaagcacaagattcattaaatgataatacaacaaaaacaatgacttcagataaaccagaagacaatcaaccaaaa

SEQ ID NO: 2254 - protein, 363 aa, Staphylococcus aureus
  MISC_FEATURE (1)..(363): lytic regulatory protein
LFTYFKSAFKNAKPQLLITLIYALIAFAVIAVVYLLANFQLAKYAQTIAIYSQFGQKPPVDAYLKVIAVLLIAAVVSLFVLVQIFIGITNVMKRAMSHEKVKFTDLFIAFKKGNYLKSVLIGLVSIAMIIVLSLLTSLLYKLFSPVSEMIMNSVQSSYADSTHLIGIAITTQSIIIIVVLLIKAIITWLLLIPIFNFMTSFVESTNDKVKTHLANGFKAMKNGQKTFFKFFIGILLLNLIIILFKTPVGYLISFNTQSLSQSVAENIIRVYTVMTIILFVVIHAIILMGIVQYYLKRGQKITKDKVKTADKNKKVVTEPKNTKVENDKVTTSVETKTEKAQDSLNDNTTKTMTSDKPEDNQPK

SEQ ID NO: 2255 - DNA, 102 bp, Staphylococcus aureus
ttgttactcctagaaaggactagcatgtctgattttgaaatgcttatggttgtattaacaatcattggtttagtattgattagtactcaagaccataaaaaa

SEQ ID NO: 2256 - protein, 34 aa, Staphylococcus aureus
LLLLERTSMSDFEMLMVVLTIIGLVLISTQDHKK

SEQ ID NO: 2257 - DNA, 207 bp, Staphylococcus aureus
ttggttatgatcgtgtatcaacgaaagattaatatcgatacacttaaagaatttgggtgtgggtgtgtatatagtgaaagaataagtggtgtcaaacgtacagagcttgttaagtgtttagattatttacgagagagcgacacattagttgtctatcaacttgatcggttaggtagaacgacaaaactattaattgaattatcacaa

SEQ ID NO: 2258 - protein, 69 aa, Staphylococcus aureus
LVMIVYQRKINIDTLKEFGCGCVYSERISGVKRTELVKCLDYLRESDTLVVYQLDRLGRTTKLLIELSQ

SEQ ID NO: 2259 - DNA, 1134 bp, Staphylococcus aureus
gtgagcgtaaatgcacgtgatttattagtattacacactaatgtaaatagattggttggagaagagatatttgctaataagtgccttgctaataatgatgttcaaattatgaattcaataaaaaaattaattgaagctgagttattaacaacgactaatgattttgaagttagtatatataaaaagacaagacctgaattacaaagtattttaaaaagttttggtataaaaacaacaggtaataaacctgacttaattaaacgtattgacgacaattttcatattattaataacttagatttaccatatgtatatataccaattaagaaaggagaagaaattttaaagaaaacagagtacttaacctcttttatacaaagttatggtgaaatttctcttgagcgtgcttattatttggttgaaaactatatagatgaaaattgcgatgataaagttgcagaaatatacaagtttgaatttcaaagaaaatatgacaatggcgagtttgattttaatcatggatataatttcgaattgaatatgttgatagatcactataaaagagatgtaaaagactacgataatgccagaaagtattcaaatatttatctttactttggtttgagagatttcttaaaaaaattaatgagtaattattcatattacgatagtaaagggaatatagatttgaacgaaatacaaaacgatctgaatagatttatcaactctagcgcttctggtatgtacgagcgattaatatataatgaaaatttatccaataatattatgtttgaattatttaaaaaggacacacaagattatagtgatttggaagaacaattgattgaaaagttcataaactatgtagtgtctaatgtaaaaaaagaaagtaggagtaatactcttatagagttatcaaaaattttagagaacggatatacaattgataaagaagaatttaaaaaagaagatgattatctttctaagtacatatttactgacatagattatttgaaaaagttagaatcaaaaataaacgttgctattgatattcgaagtggagaaattcatttggtattagatgatgatagccttgatatattaatacaaaatcaaaaatacggcaatgagttt

SEQ ID NO: 2260 - protein, 378 aa, Staphylococcus aureus
VSVNARDLLVLHTNVNRLVGEEIFANKCLANNDVQIMNSIKKLIEAELLTTTNDFEVSIYKKTRPELQSILKSFGIKTTGNKPDLIKRIDDNFHIINNLDLPYVYIPIKKGEEILKKTEYLTSFIQSYGEISLERAYYLVENYIDENCDDKVAEIYKFEFQRKYDNGEFDFNHGYNFELNMLIDHYKRDVKDYDNARKYSNIYLYFGLRDFLKKLMSNYSYYDSKGNIDLNEIQNDLNRFINSSASGMYERLIYNENLSNNIMFELFKKDTQDYSDLEEQLIEKFINYVVSNVKKESRSNTLIELSKILENGYTIDKEEFKKEDDYLSKYIFTDIDYLKKLESKINVAIDIRSGEIHLVLDDDSLDILIQNQKYGNEF

SEQ ID NO: 2261 - DNA, 90 bp, Staphylococcus aureus
gtgtttatttttaaaacaacatctaaaagccattttcataataatgttaaatcattagaatgtataaagattccaattaataaaaataga

SEQ ID NO: 2262 - protein, 30 aa, Staphylococcus aureus
VFIFKTTSKSHFHNNVKSLECIKIPINKNR

SEQ ID NO: 2263 - DNA, 867 bp, Staphylococcus aureus
gtggagggcaatatggataacgtaaaagcaatatttttggacatggatggaacaattttacatgaaaataatcaagcatcaacgtatacgaaagatgtcattaatcaattgagagagaaaggatataaagtatttttggcaacaggacgttcgcattctgaaatacatcaacttgtacctcaagattttgcggttaatggcatcattagttcaaatggaacaattggagaagtagatggagaaattatcttcaagcatggtttatcattggctcaagtgcaacaaattactaatttagctaagcgccaacaaatttattatgaggtatttccttttgaaggtaatagagtttctttaaaagaagatgaaacatggatgcgagatatgattcgtagtcaagatcctattaatggcgtaagtcatagtgaatggtcttcaagacaagatgcgcttgctggtaagatagattgggtaactaagtttcctgaaggtgaatattcaaaaatttatctattcagttctaatttagaaaaaataacagcatttagagatgaattaaagcaaaatcatgtgcaactacagattagtgtttcaaattcatcaagatttaatgcggaaacaatggcttatcaaactgataaaggtacaggcattaaagaaatgattgcacattttggtattcatcaagaagaaacgttagttattggagatagcgacaatgatagagcaatgtttgaatttggtcattatacagttgctatgaaaaatgcacgccctgaaatccaagcattaacttcagatgtaacggcatacacgaatgaagaggatggcgcagcaaaatatttagcagagcattttttagctgaa

SEQ ID NO: 2264 - protein, 289 aa, Staphylococcus aureus
  MISC_FEATURE (1)..(289): conserved hypothetical
VEGNMDNVKAIFLDMDGTILHENNQASTYTKDVINQLREKGYKVFLATGRSHSEIHQLVPQDFAVNGIISSNGTIGEVDGEIIFKHGLSLAQVQQITNLAKRQQIYYEVFPFEGNRVSLKEDETWMRDMIRSQDPINGVSHSEWSSRQDALAGKIDWVTKFPEGEYSKIYLFSSNLEKITAFRDELKQNHVQLQISVSNSSRFNAETMAYQTDKGTGIKEMIAHFGIHQEETLVIGDSDNDRAMFEFGHYTVAMKNARPEIQALTSDVTAYTNEEDGAAKYLAEHFLAE

SEQ ID NO: 2265 - DNA, 780 bp, Staphylococcus aureus
atgttaattcaattagatcaaattgggcgaatgaagcaaggaaaaacaattttaaaaaagatttcttggcaaattgctaaaggtgataaatggatattatatgggttgaatggtgctggcaagacaacacttctaaatattttaaatgcgtatgagcctgcaacatctggaactgttaaccttttcggtaaaatgccaggcaaggtagggtattctgcagagactgtacgacaacatataggttttgtatctcatagtttactggaaaagtttcaagagggtgaaagagtaatcgatgtggtgataagcggtgcctttaaatcaattggtgtttatcaagatattgatgatgagatacgtaatgaagcacatcaattacttaaattagttggaatgtctgctaaagcgcaacaatatattggttatttatctaccggtgaaaaacaacgagtgatgattgcacgagctttaatggggcaaccccaggttttaattttagatgagccagcagctggtttagactttattgcacgagaatcgttgttaagtatacttgactcattgtcagattcatatccaacgcttgcgatgatttatgtgacgcactttattgaagaaataactgctaacttttccaaaattttactgctaaaagatggccaaagtattcaacaaggcgctgtagaagacatattaacttctgaaaacatgtcacgatttttccagaaaaatgtagcagttcaaagatggaataatcgattttctatggcaatgttagag

SEQ ID NO: 2266 - protein, 260 aa, Staphylococcus aureus
  MISC_FEATURE (1)..(260): hypothetical protein
MLIQLDQIGRMKQGKTILKKISWQIAKGDKWILYGLNGAGKTTLLNILNAYEPATSGTVNLFGKMPGKVGYSAETVRQHIGFVSHSLLEKFQEGERVIDVVISGAFKSIGVYQDIDDEIRNEAHQLLKLVGMSAKAQQYIGYLSTGEKQRVMIARALMGQPQVLILDEPAAGLDFIARESLLSILDSLSDSYPTLAMIYVTHFIEEITANFSKILLLKDGQSIQQGAVEDILTSENMSRFFQKNVAVQRWNNRFSMAMLE

SEQ ID NO: 2267 - DNA, 1803 bp, Staphylococcus aureus
atgtgtggaattgttggttatattggctatgataatgccaaagaattattattaaaaggtttagaaaaattagaatacagaggttatgactctgcaggtatcgcagtagtaaatgatgataatacaactgtatttaaagaaaaaggtcgtattgcagaattacgtaaagttgctgatagtagcgattttgatggacctgttggaatcggtcacacacgttgggcaacacacggtgtaccgaatcatgaaaactctcatccacatcaatcatcaaatggccgttttactctagttcataacggtgttattgaaaactatgaagagttaaaaggtgaatacttacaaggtgtatcattcatttcagaaacagatacagaagttatcgttcaattagttgaatacttttcaaatcaaggactttcaactgaagaagcatttacaaaagttgtgtcattattacatggttcatatgcattaggtttattagatgctgaagacaaagacacaatctatgttgctaaaaataaatcaccattattattaggtgttggtgaaggtttcaatgttatcgcatcagacgcacttgcaatgttacaagtgacaagcgaatataaagaaatccatgaccatgaaatcgttattgttaaaaaagatgaagttattattaaagatgcagatggaaacgttgtagaacgtgattcatatattgctgaaattgatgcatcagatgctgaaaaaggtgtttatgcacactacatgttaaaagaaattcatgaacaaccagcagtaatgcgtcgtattattcaagaatatcaagatgcagaaggtaacttgaaaattgatcaagacatcatcaatgatgttaaagaagcagaccgcatttacgttattgcagcaggtacaagctaccatgcaggtttagtaggtaaagaatttttagaaaaatgggctggcgtaccaactgaagtacacgttgcatcagagtttgtctacaacatgccattattatctgaaaaaccattgttcgtttatatttctcaatcaggtgaaactgcagatagccgcgccgtattagttgaaactaataaattaggtcataaatcattaacaatcactaatgttgcaggttcaactttatcacgtgaagcagaccacacattgttattacacgcgggtcctgaaatcgcagttgcatctacaaaagcatatactgcacaaattgcagtattatcaatcttgtctcaaatcgttgcaaaagagcatggtcgtgaagcagatattgatttattgagagaattagcaaaagtaacaacagcaatagaagcaattgttgacgatgcaccaattatggaacaaattgctacagatttcttagaaacaacacgcaatgcattctttatcggacgtactattgactataacgtaagtttagaaggtgcgttaaaacttaaagaaatttcttacattcaagcagaaggttttgctggtggagaacttaaacatggtacaattgccttaatcgaagaaggtacaccagttgtaggtttagcaacacaagagaaagttaatttatcaattcgtggtaacgttaaagaggtagtagcacgtggtgcacatccatgtattatttctatggagggtcttgaaaaagaaggcgacacttatgtcattcctcatgtacatgaattgttaacgccattagtatcagtggttgcattacaattaatttcatactatgcagcattacacagagatttagatgttgataaaccacgtaaccttgctaaatcagttactgtggaa

SEQ ID NO: 2268 - protein, 601 aa, Staphylococcus aureus
MCGIVGYIGYDNAKELLLKGLEKLEYRGYDSAGIAVVNDDNTTVFKEKGRIAELRKVADSSDFDGPVGIGHTRWATHGVPNHENSHPHQSSNGRFTLVHNGVIENYEELKGEYLQGVSFISETDTEVIVQLVEYFSNQGLSTEEAFTKVVSLLHGSYALGLLDAEDKDTIYVAKNKSPLLLGVGEGFNVIASDALAMLQVTSEYKEIHDHEIVIVKKDEVIIKDADGNVVERDSYIAEIDASDAEKGVYAHYMLKEIHEQPAVMRRIIQEYQDAEGNLKIDQDIINDVKEADRIYVIAAGTSYHAGLVGKEFLEKWAGVPTEVHVASEFVYNMPLLSEKPLFVYISQSGETADSRAVLVETNKLGHKSLTITNVAGSTLSREADHTLLLHAGPEIAVASTKAYTAQIAVLSILSQIVAKEHGREADIDLLRELAKVTTAIEAIVDDAPIMEQIATDFLETTRNAFFIGRTIDYNVSLEGALKLKEISYIQAEGFAGGELKHGTIALIEEGTPVVGLATQEKVNLSIRGNVKEVVARGAHPCIISMEGLEKEGDTYVIPHVHELLTPLVSVVALQLISYYAALHRDLDVDKPRNLAKSVTVE

SEQ ID NO: 2269 - DNA, 1536 bp, Staphylococcus aureus
atgtcacaaactgaagagaaaaaaggaattggtcgtcgtgttcaagcatttggatcattcttaagtagtatgatcatgccaaacattggcgctttcatcgcttggggttttatcgcggccatttttatagataatggatggttacctaacaaagatttagctactttagcaggaccaatgattacttatttaatcccattattgatcgcatttagtggtggtcgtttaatttatgatttacgtggtggtatcatcgcagcaacagcaactatgggggtcatcgttgcattacctgatacaccaatgttacttggtgcaatgattatgggtccacttgttggttggttaatgaagaagaccgaccaattgattcaacctagaacgccgcaaggttttgaaatgttatttaataacttttctgctggtattttaggatttatcatgacgattgcaggatttaaaattttagcaccacttatgaaatttattatgcatattttatcagtggcagttgaagcattagtacatgcacacctacttccacttgtaagtattttagtagagcctgcaaaaattgtatttttaaacaatgcgattaaccatggtgtattcacaccgcttggtgcagatcaagctgcaaaagctggtcaatcaattttatacacaattgaatctaaccctggaccaggtttaggtatcttacttgcttatatgatttttggaaaaggcactgcaaaagcaacgtcatatggtgctggaattatccacttcttaggtggtattcatgaaatttatttcccatatgtattaatgcgtcctttattatttatcgctgttattttaggtggaatgactggtgttgcaacttatcaagcaacaggatttggatttaaaagtcccgcgtcaccaggttcatttatagtttactgtttaaatgcacctagaggtgaattcttgcacatgttactcggtgtcttccttgctgcacttgtatcattcgttgtagctgctttaattatgaagttcactagagaaccaaagcaggatttagaagctgcgacagctcaaatggaaaatactaaagggaaaaaatcaagcgttgcttctaagttagtatcttctgataaaaatgttaatacagaagaaaatgctagtggtaatgttagtgaaacatcttcatcagatgatgatcctgaagcgctattggataattacaacactgaagatgttgatgcacacaattacaataatataaatcatgttatttttgcctgcgatgcgggtatgggttctagtgcaatgggtgcaagcatgttacgtaataaatttaaaaaggcgggcattaatgatattacagttacaaatactgcgattaatcaattgccaaaagatgctcaattagttatcactcagaaaaaactaactgatcgtgctattaaacaaacaccaaatgccatccatatttcagtggataatttccttaattcaccaagatatgaagaacttttaaataatctaaaaaaagatgatcaagca

SEQ ID NO: 2270 - protein, 512 aa, Staphylococcus aureus
  MISC_FEATURE (1)..(512): mannitol specific IIBC
MSQTEEKKGIGRRVQAFGSFLSSMIMPNIGAFIAWGFIAAIFIDNGWLPNKDLATLAGPMITYLIPLLIAFSGGRLIYDLRGGIIAATATMGVIVALPDTPMLLGAMIMGPLVGWLMKKTDQLIQPRTPQGFEMLFNNFSAGILGFIMTIAGFKILAPLMKFIMHILSVAVEALVHAHLLPLVSILVEPAKIVFLNNAINHGVFTPLGADQAAKAGQSILYTIESNPGPGLGILLAYMIFGKGTAKATSYGAGIIHFLGGIHEIYFPYVLMRPLLFIAVILGGMTGVATYQATGFGFKSPASPGSFIVYCLNAPRGEFLHMLLGVFLAALVSFVVAALIMKFTREPKQDLEAATAQMENTKGKKSSVASKLVSSDKNVNTEENASGNVSETSSSDDDPEALLDNYNTEDVDAHNYNNINHVIFACDAGMGSSAMGASMLRNKFKKAGINDITVTNTAINQLPKDAQLVITQKKLTDRAIKQTPNAIHISVDNFLNSPRYEELLNNLKKDDQA

SEQ ID NO: 2271 - DNA, 2145 bp, Staphylococcus aureus
atggaggataccgccatgttattgagtacacgtgaaaaagaaatgatagccctattgattaagtaccacggtcaatatatcactatacacgacattgctcagcaacttgcggtgtcctctcgtactattcaccgtgaattaaaaggtgttgaagcatatttaacttcattttcattaactttagaacgcgcaaacaaaaaagggctacgcattgctggcacagattctgatttaaacgatttgaagcaatcgattgcacaacatcaaaccattgacttatctgttgaagagcagaaagtaattattatatacgctttgatacaagccaaggagccagttaaacaatatagtttagcgcaagaaattggcgtttctgtccagactttagcaaagatgttagatgatttagagcttgatttaaataagtaccaactatctttatctcgaaagcgtggcgaaggcatttacttggtaggtactgaatcaaagaaacgtgaatttttaagtcaattaatggtgaataacttaaatagtactagcgtttattcagtaattgaaaatcattttgtctttcattcattaaatcaaatccacaaagactttgttgacttagagcgcatttttaatgttgaaagactattaatggactacctaagtgccttaccctaccaacttaccgaatcaagttatttaactttaactgtccatatcgtgctctccatttcacgtataaaaaatggagagtctgtcgcattaaacgatgatatttatgattctgtacaaaacacatttgaacacaaagtagcaagcgaacttgctgataaacttggtcaaatatatgacgtcacgtttaatcaggcagaaattgctttcattactatccatttacgtggagctaaacgaaaaaatcttaatgatacatcattaaataatcgttgtgaagaaaacaaaattaaagcgtttgttaacaaagtagaaatgatttccggtatgacatttgcagatttggatactttagtagatggactgacgctacaccttaatcctgcaatcaatcgtttgcaagctaatatcgagacctataatccgttaacagacatgattaagttcaaatatccaagactatttgaaaatgtaagattagctttaaatgattgttggcctgatttgatttttccagagagtgaaattgcttttatagttttacactttggtggctcgattaaaaaccaaggtaatcgatttttaaacatattagtcgtttgcagcagtggtatgggaactagtcgtctattatcaactcgtctagagcaagtttttagtgagattgagcgtattacacaagcatcagtcagcgatttgaagtcactagatttaagtcaatatgatggcattatttctactgtgaatttagacatcgactccccctatttaacggtaaacccattattaccagatagtgatatcagttatgtcgcacagtttttaaatacaaagtctacgttccaagagacgcatgataaatcatcaaacatgattgataaggatgatgttcatgttgaaacgaaagatgttgatggcaacacatcttttgaaaatgaacaaacttcatacttaacttcagttttcgaaaaacatttaagtgacgaaaaatcagaacaattattgcatcatatgcgttcgggtttaactttgcttgattcagtgaaaatagttagtaccgaagttaaacagtggcaaacatatatcgcagattatctatatcaatgcgatgtaataaacgatccaacgtcattcgctgaactactagagcaacgattgattgacaatccaggatggatattaagtccatatcctgttgcaataccacacctaagagacaatatgattaaacaccctatgattctaatcacagttttagaagaaccgttaacattgcctagtattcaaaatgacaatcaaacaattaaatatatgatttccatgtttatttctgacaatgattttatggcatcactggtaagtgacttgtccgaatttttaagtttgaaattagaatctattgatacttttatggaaaatccacaggaacttgaaacattattaagaaacaaatttttagaacgaattaaaaaacaatttatt

SEQ ID NO: 2272 - protein, 715 aa, Staphylococcus aureus
  MISC_FEATURE (1)..(715): hypothetical protein
MEDTAMLLSTREKEMIALLIKYHGQYITIHDIAQQLAVSSRTIHRELKGVEAYLTSFSLTLERANKKGLRIAGTDSDLNDLKQSIAQHQTIDLSVEEQKVIIIYALIQAKEPVKQYSLAQEIGVSVQTLAKMLDDLELDLNKYQLSLSRKRGEGIYLVGTESKKREFLSQLMVNNLNSTSVYSVIENHFVFHSLNQIHKDFVDLERIFNVERLLMDYLSALPYQLTESSYLTLTVHIVLSISRIKNGESVALNDDIYDSVQNTFEHKVASELADKLGQIYDVTFNQAEIAFITIHLRGAKRKNLNDTSLNNRCEENKIKAFVNKVEMISGMTFADLDTLVDGLTLHLNPAINRLQANIETYNPLTDMIKFKYPRLFENVRLALNDCWPDLIFPESEIAFIVLHFGGSIKNQGNRFLNILVVCSSGMGTSRLLSTRLEQVFSEIERITQASVSDLKSLDLSQYDGIISTVNLDIDSPYLTVNPLLPDSDISYVAQFLNTKSTFQETHDKSSNMIDKDDVHVETKDVDGNTSFENEQTSYLTSVFEKHLSDEKSEQLLHHMRSGLTLLDSVKIVSTEVKQWQTYIADYLYQCDVINDPTSFAELLEQRLIDNPGWILSPYPVAIPHLRDNMIKHPMILITVLEEPLTLPSIQNDNQTIKYMISMFISDNDFMASLVSDLSEFLSLKLESIDTFMENPQELETLLRNKFLERIKKQFI

SEQ ID NO: 2273 - DNA, 441 bp, Staphylococcus aureus
gtgtacaaaatgagcgaattatttagtaatgacaatatctttttaaatgtaaatgttaacagccaaaatgaagcaattgaaaaagcaggtaaagccttagttgatagtggtgctgtaacagatgcttatattcaagcaatgaaagatcgtgagcaagtcgtatcaacatttatgggaaatggcttagcaattcctcatggcacagatgaagctaaaacaaatgtgattcactcaggtttaacattattacaaatccctgaaggcgttgactgggatggcgaagtagttaaagttgtcgtgggaattgctggtaaagatggcgaacatttagacttgttatctaaaattgcaattacatttagcgaagaagaaaatgtggatcgtatcgttcaagcaaaatctgcagaagaaattaaacaagtattcgaggaggcagatgca

SEQ ID NO: 2274 - protein, 147 aa, Staphylococcus aureus
  MISC_FEATURE (1)..(147): PTS system, mannitol
VYKMSELFSNDNIFLNVNVNSQNEAIEKAGKALVDSGAVTDAYIQAMKDREQVVSTFMGNGLAIPHGTDEAKTNVIHSGLTLLQIPEGVDWDGEVVKVVVGIAGKDGEHLDLLSKIAITFSEEENVDRIVQAKSAEEIKQVFEEADA

SEQ ID NO: 2275 - DNA, 1104 bp, Staphylococcus aureus
atgaaagcagttcactttggtgctggtaacataggtcgtggtttcattggttatattcttgcagacaacaatgttaaagtaacatttgcagacgtcaatgaagaaatcattaatgctttagctcatgatcatcaatacgatgttattttagctgatgagtctaaaacaacgacgcgcgtgaataatgttgatgcaattaattcaatgcaaccttctgaagcgttgaaacaagcaattctagaagctgatattattacaacagctgttggtgttaacatactacctattattgctaaatcttttgcgcctttcttaaaagaaaaaacaaaccatgttaatattgttgcttgtgagaatgctattatggcaactgatacattgaaaaaagcagtacttgatattactggccctcttggtaacaatattcattttgctaactcagcagttgatagaattgtaccattacaaaagaatgaaaatatattagacgttatggttgagccattttacgaatgggttgttgaaaaagatgcatggtatggtccagaactaaaccatattaaatatgttgatgatttaacaccatatattgagcgtaaattattaactgtgaatacaggacatgcatatttagcgtatgctggtaaatttgcaggtaaagctacagttttagatgcagttgaagatagttcaattgaagctggcttacgccgtgttttagctgaaactagtcaatatattactaatgaatttgattttactgaagcggaacaagctggttatgttgaaaaaataatagatcgtttcaacaattcttatttatctgatgaagtaacacgtgtcggacgaggtacattacgtaaaattggccctaaagatagaattataaaaccattaacatatctttataataaagatttagaacgcactggtttattaaatacagctgcattgttattgaagtatgatgatacagcagaccaagaaactgttgagaaaaataattacattaaagaacacggtttaaaagcgtttttaagtgaatatgctaaagttgacgatggcttagccgatgaaataattgaagcgtacaattcactttca

SEQ ID NO: 2276 - protein, 368 aa, Staphylococcus aureus
  MISC_FEATURE (1)..(368): mannitol-1-phosphate
MKAVHFGAGNIGRGFIGYILADNNVKVTFADVNEEIINALAHDHQYDVILADESKTTTRVNNVDAINSMQPSEALKQAILEADIITTAVGVNILPIIAKSFAPFLKEKTNHVNIVACENAIMATDTLKKAVLDITGPLGNNIHFANSAVDRIVPLQKNENILDVMVEPFYEWVVEKDAWYGPELNHIKYVDDLTPYIERKLLTVNTGHAYLAYAGKFAGKATVLDAVEDSSIEAGLRRVLAETSQYITNEFDFTEAEQAGYVEKIIDRFNNSYLSDEVTRVGRGTLRKIGPKDRIIKPLTYLYNKDLERTGLLNTAALLLKYDDTADQETVEKNNYIKEHGLKAFLSEYAKVDDGLADEIIEAYNSLS

SEQ ID NO: 2277 - DNA, 7434 bp, Staphylococcus aureus
atgaatttattcagacaacaaaaatttagtatcagaaaatttaatgtcggtattttttcagctttaattgccactgttacttttatatctactaacccgacaacagcgtctgcagcagagcaaaatcagcctgcacaaaatcaaccagcacaaccagctgatgccaatacacagcctaacgcaaatgctggtgctcaagctaatcctacagcacagccagctgcacctgccaaccaaggacaaccagcagtacaaccagcaaaccaaggtggacaggctaatccagcaggaggagcagcacaaccaaatacacaaccagctggacaaggtgatcaagctgatccgaataacgctgcacaagcacaacctggaaatcaagcaacaccggcaaaccaagcaggtcaaggaaataaccaagcaacacctaataataatgcaacaccggcaaatcaaacacagccagcgaatgctccagcagcagcgcaaccagcagcacctgtagcagcaaacgcacaaactcaagatccaaatgctagcaatactggtgaaggcagtattaatacgacattaacatttgatgatcctgccatatcaacagatgagaatagacaggatccaactgtaactgttacagataaagtaaatggttattcattaattaacaacggtaagattggtttcgttaactcagaattaagacgaagcgatatgtttgataagaataaccctcaaaactatcaagctaaaggaaacgtggctgcattaggtcgtgtgaatgcaaatgattctacagatcatggtaactttaacggtatttcaaaaactgtaaatgtaaaaccagattcagaattaattattaactttactactatgcaaacgaatagtaagcaaggtgcaacaaatttagttattaaagatgctaagaaaaatactgaattagcaactgtaaatgttgctaagactggtactgcacatttatttaaagtaccaactgatgctgatcgtttagatttacaatttattcctgacaatacagcagttgctgatgcttcaagaattacaacaaataaagatggttataaatactattcattcattgataatgtaggtctattctcaggatcacatttatatgtcaaaaatagagatttagcaccgaaagcaactaacaataaagaatatactattaatactgaaatcggtaacaatggtaattttggtgcttcattaaaagcagatcaatttaaatatgaagtaacattaccacaaggtgtaacttacgttaataattcattaactacaacattccctaatggtaatgaagacagtacagtattgaaaaatatgactgttaattatgatcaaaatgcaaataaagttacatttacaagccaaggtgtgacaacggcacgtggtacacacactaaagaagttttattcccagataaatctttaaaattatcatataaagttaatgttgcgaatatcgatacacctaaaaatattgattttaatgaaaaattaacatatcgtactgcttcagatgttgtaattaataatgcgcaaccagaagttacactaactgcagatccattttcagtagcggttgaaatgaacaaagatgcgttgcaacaacaagtaaactcacaagttgataatagtcattacacaacagcatcaattgcagaatacaataaacttaaacaacaagcagatactattttaaatgaagatgcgaatcatgttaaaactgcaaatcgtgcatctcaagcggatattgatggtttagtaactaaattacaagctgcattaattgataatcaagcagcaattgctgaattagatactaaagctcaagaaaaggttacagcagcacaacaaagtaaaaaagttacgcaagatgaagttgcagcacttgtaactaaaattaacaatgataaaaataatgcaatcgcagaaattaataaacaaactacagcacaaggtgtcacaactgaaaaagataatggtatcgcagtgttagaacaagatgtgattacaccaacagttaaacctcaagcgaaacaagatattatccaagcagttacaactcgtaaacaacaaattaaaaagtcaaatgcatcattacaagatgaaaaagatgtagcaaatgataaaattggtaaaattgaaacaaaggcaattaaagatattgatgcagcaacaacaaatgcacaagtagaagccattaaaacaaaagcaatcaatgatattaatcaaactacacctgctacaacagctaaagcagcagctcttgaagaatttgacgaagttgttcaagcacaaattgatcaagcacctttaaatcctgatacaacaaatgaagaagtagcggaagctattgaacgtattaatgcagctaaagtttctggtgttaaagcaattgaagcgacaacgactgcacaagatttagaaagagttaaaaacgaagaaatctcaaaaattgaaaatattactgactctacgcaaacaaaaatggatgcctataatgaagttaaacaagctgcaacagctagaaaagctcaaaatgctacagtttcaaatgcaacaaatgaagaagtagcagaagctgatgcagcagtagatgcagctcaaaagcaaggtttacatgacatccaagttgttaaatcaaaacaggaagttgctgatacaaaatcaaaagtattagataaaatcaatgcaattcaaacacaagcaaaagttaaacctgcagctgatacggaagtagaaaacgcatataatacacgtaaacaagaaattcaaaatagcaatgcttcaactacagaagaaaaacaagctgcatatacagaattagatactaaaaagcaagaagcaagaacaaatcttgatgctgcaaatacaaacagtgatgtaacaacagctaaagacaatagtattgctgcaattaatcaagttcaagctgccacaactaagaaatcggatgcaaaagcggaaatcgctcaaaaagcaagtgaacgtaaaacagcaattgaagcaatgaatgattcgactactgaagaacaacaagcagcgaaagacaaagtggatcaagcagtagttactgcaaacgctgatatagataatgctgcagcaaacaatgatgtggataatgcaaaaactacaaatgaagctacaatcgcagccattacacctgatgcaaatgttaaaccagcagcaaaacaagcaattgcagataaagtacaagctcaagaaacagcaattgatggaaataacggctcaacaactgaagaaaaagcagctgctaaacaacaagttcaaactgaaaaaacaacagctgatgccgcaatagatgcagcacatacaaatgcggaagttgaagcggctaaaaaagcagcaattgctaaaattgaagcgattcagccagcaacaacaactaaagataatgcgaaagaagcaattgctacgaaagcgaatgaacgtaaaacagcaatcgctcaaacgcaagacattactgctgaagaaattgcagcggctaatgcggacgtagataatgctgtgacacaagcaaatagcaacattgaagctgctaatagtcaaaatgatgtagaccaagcgaaaacgacaggtgaaaatagtattgatcaagtaacaccaacagttaataaaaaagcaactgcacgtaatgaaatcacagcaattttaaataacaaattgcaagagattcaagctacgccagatgcaacagatgaagaaaaacaagcagctgatgctgaagcaaatactgaaaatggtaaagcaaatcaagccatttcagcagcaactactaacgcacaagttgatgaagctaaagcaaatgcagaagcagcgattaatgcggtaacaccaaaagttgtgaagaaacaagcggctaaagatgaaattgatcaattacaagcaacgcaaacaaatgttatcaataatgatcagaacgctacaacagaagaaaaagaagcagctattcaacaattagcaacagcagttacagacgcgaaaaataatattacagctgcaactgatgataatggtgtagatcaggcgaaagacgctggaaagaattcaattcaaagcacgcaaccagcaacagcggttaaatcaaatgctaaaaatgatgttgatcaagctgtgacaactcaaaatcaagcaattgataatacaactggtgctacaactgaagagaaaaatgcagcaaaagatttagttttaaaagctaaagaaaaagcgtatcaagatatcttaaatgcacaaacaactaatgatgttacgcaaattaaagatcaagcagttgctgatattcaaggtattactgcagatacaacaattaaagatgttgcgaaagatgaattagcaacaaaagcaaacgaacaaaaagcgcttattgcacaaactgcagatgcgactactgaagaaaaagaacaagcaaatcaacaagtagacgcacaattaacacaaggtaatcaaaatattgaaaatgcacagtcaatcgatgatgtaaacactgcaaaagataatgcaattcaagcaattgacccaattcaagcatcaacagatgttaaaacgaatgcaagagcggaattgctaactgaaatgcaaaataaaataactgaaatacttaataataatgagactactaatgaagaaaaaggtaacgatattggaccagttagagcagcatatgaagaaggtttaaataatattaatgcagcaactactacaggtgatgtaactactgctaaagatacagcagtacaaaaagttcaacaacttcatgcaaatcctgttaagaaaccagcaggtaaaaaagaattagatcaagctgcagctgataagaaaacacaaatagaacaaacaccaaatgcatcacaacaagaaattaatgatgcaaaacaagaagttgatactgaattaaatcaagcgaaaacaaatgtcgatcaatcatcaacaaatgaatatgttgataatgcagttaaagaaggaaaagctaaaattaatgcagttaaaacatttagtgagtacaaaaaagatgctttagctaaaattgaagatgcatataatgctaaagtaaacgaagcggataactctaacgcatcgacttcaagtgaaattgctgaagcgaaacaaaaacttgctgaattaaaacaaactgcggatcaaaatgttaatcaagctacttctaaagatgacattgaagttcaaattcataatgacttagataatattaacgattacacaattccaacaggtaaaaaagaatcagctacaacagatttatatgcttatgcagatcagaagaaaaataatatttcagctgacactaatgcaacacaagatgaaaagcaacaagcaattaagcaagttgaccaaaatgttcaaactgcattagaaagcattaataatggtgtggataatggtgacgttgatgatgcattaacacaaggtaaagcagcaattgatgctattcaagtagatgctactgttaaacctaaagcgaaccaagctattgaagttaaagcagaagatacgaaagaatctattgatcaaagtgaccagttaactgctgaagaaaaaactgaagcattagcaatgattaaacaaattacagatcaagctaaacaaggtattactgatgcaacaacaactgctgaagttgaaaaagcgaaagctcaaggacttgaagcatttgataacattcaaatcgactcaacagaaaaacaaaaagctatcgaagaattagaaactgcactagaccagattgaagcaggtgtaaatgtcaacgctgatgctacaactgaagaaaaagaagcgtttacgaatgctttagaagacattttatcaaaagcaactgaagatatttctgatcaaactacaaatgcagaaatcgctactgtcaaaaatagtgcgcttgaacaacttaaagcacaacgtattaatcctgaagttaagaaaaatgctttggaagcaatcagagaagtggttaacaagcaaatagaaataattaaaaatgcagatgcagatgcatcggcgaaagaaattgcacgtacggatttaggtagatattttgacagatttgctgataaattagataaaacacaaacaaatgcagaagttgctgaattacaaaatgtaacgatacctgcaattgaagcgattgtgcctcagaatgatccagatgctaatgatactaataatggtatagataataatgatgcaacagcaaattcaaatgctaatgcaacaccagaaaatactggacaacctaacgtatctgagacgacagctaatggcaaagcagacgcttctccgacaacaccaaataatagtgatgcggcaacaggtgaaacaacagcaacatcagcaactgatgatgcaaatgataaaccgcaagctaataacaattctagtgtagatgcatcaacaaacagtccgacaatggataacgatgtaactagtaaaccagaagtagaatcaactaataacggcacaactgataaacctgtaacagaaactgataatgcaacgccagcagaaagcacaacaaataacaatagtacaactacagcaacaaacgagaatgcaccaacaggatcaacagcaacggctccaacaactgcgagcacagaagcagcatcatctgctgatagcaaagataatgcatctgtaaatgattcaaaacaaaatgctgaagtaaataatagtgctgaatctcaatcaactaatgacaaggttgcacaaccaaaatctgaaaataaagctaaggcagaaaaagatggtagtgattcaacaaatcaaagtatggttgaatcaacaactgaaacattgccttcagcagacataacagaaccaaatgtaccttctaatacatcaaaagataaagaagaaagtacgacaaatcaaactgatgcaggacaacttaagtctgaaactaacgttgcatctaacgaagcagataaatcgccaagcaaagctgatactgaagtttcgaataaaccatcaacatctgcatcttctgaagcaaaagaaaaaatgacttcaactaatgttagccaaaaagatgatacggcaacagcagatactaatgatacgcaaaaatcagttggttcagctgcaaacaataaagctacgcaaaacgacggtgccaatgcatctccagctacagtttcaaatggaagcaatagtgctaatcaagatatgcttaatgtaactaacactgacgaccaccaagctaagacaaaatcagctcaacaaggaaaagttaataaagctaaacaacaagctaaaactttaccagatactggtatgtcacataatgacgatttaccatatgctgaattagctctaggtgcaggtatggcattcttaattagaagattcactaagaaagaccaacaaactgaagaa

SEQ ID NO: 2278 - protein, 2478 aa, Staphylococcus aureus
  MISC_FEATURE (1)..(2478): FmtB protein [Staphylococcus
MNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGDQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVTLTADPFSVAVEMNKDALQQQVNSQVDNSHYTTASIAEYNKLKQQADTILNEDANHVKTANRASQADIDGLVTKLQAALIDNQAAIAELDTKAQEKVTAAQQSKKVTQDEVAALVTKINNDKNNAIAEINKQTTAQGVTTEKDNGIAVLEQDVITPTVKPQAKQDIIQAVTTRKQQIKKSNASLQDEKDVANDKIGKIETKAIKDIDAATTNAQVEAIKTKAINDINQTTPATTAKAAALEEFDEVVQAQIDQAPLNPDTTNEEVAEAIERINAAKVSGVKAIEATTTAQDLERVKNEEISKIENITDSTQTKMDAYNEVKQAATARKAQNATVSNATNEEVAEADAAVDAAQKQGLHDIQVVKSKQEVADTKSKVLDKINAIQTQAKVKPAADTEVENAYNTRKQEIQNSNASTTEEKQAAYTELDTKKQEARTNLDAANTNSDVTTAKDNSIAAINQVQAATTKKSDAKAEIAQKASERKTAIEAMNDSTTEEQQAAKDKVDQAVVTANADIDNAAANNDVDNAKTTNEATIAAITPDANVKPAAKQAIADKVQAQETAIDGNNGSTTEEKAAAKQQVQTEKTTADAAIDAAHTNAEVEAAKKAAIAKIEAIQPATTTKDNAKEAIATKANERKTAIAQTQDITAEEIAAANADVDNAVTQANSNIEAANSQNDVDQAKTTGENSIDQVTPTVNKKATARNEITAILNNKLQEIQATPDATDEEKQAADAEANTENGKANQAISAATTNAQVDEAKANAEAAINAVTPKVVKKQAAKDEIDQLQATQTNVINNDQNATTEEKEAAIQQLATAVTDAKNNITAATDDNGVDQAKDAGKNSIQSTQPATAVKSNAKNDVDQAVTTQNQAIDNTTGATTEEKNAAKDLVLKAKEKAYQDILNAQTTNDVTQIKDQAVADIQGITADTTIKDVAKDELATKANEQKALIAQTADATTEEKEQANQQVDAQLTQGNQNIENAQSIDDVNTAKDNAIQAIDPIQASTDVKTNARAELLTEMQNKITEILNNNETTNEEKGNDIGPVRAAYEEGLNNINAATTTGDVTTAKDTAVQKVQQLHANPVKKPAGKKELDQAAADKKTQIEQTPNASQQEINDAKQEVDTELNQAKTNVDQSSTNEYVDNAVKEGKAKINAVKTFSEYKKDALAKIEDAYNAKVNEADNSNASTSSEIAEAKQKLAELKQTADQNVNQATSKDDIEVQIHNDLDNINDYTIPTGKKESATTDLYAYADQKKNNISADTNATQDEKQQAIKQVDQNVQTALESINNGVDNGDVDDALTQGKAAIDAIQVDATVKPKANQAIEVKAEDTKESIDQSDQLTAEEKTEALAMIKQITDQAKQGITDATTTAEVEKAKAQGLEAFDNIQIDSTEKQKAIEELETALDQIEAGVNVNADATTEEKEAFTNALEDILSKATEDISDQTTNAEIATVKNSALEQLKAQRINPEVKKNALEAIREVVNKQIEIIKNADADASAKEIARTDLGRYFDRFADKLDKTQTNAEVAELQNVTIPAIEAIVPQNDPDANDTNNGIDNNDATANSNANATPENTGQPNVSETTANGKADASPTTPNNSDAATGETTATSATDDANDKPQANNNSSVDASTNSPTMDNDVTSKPEVESTNNGTTDKPVTETDNATPAESTTNNNSTTTATNENAPTGSTATAPTTASTEAASSADSKDNASVNDSKQNAEVNNSAESQSTNDKVAQPKSENKAKAEKDGSDSTNQSMVESTTETLPSADITEPNVPSNTSKDKEESTTNQTDAGQLKSETNVASNEADKSPSKADTEVSNKPSTSASSEAKEKMTSTNVSQKDDTATADTNDTQKSVGSAANNKATQNDGANASPATVSNGSNSANQDMLNVTNTDDHQAKTKSAQQGKVNKAKQQAKTLPDTGMSHNDDLPYAELALGAGMAFLIRRFTKKDQQTEE

SEQ ID NO: 2279 - DNA, 1353 bp, Staphylococcus aureus
atgggaaaatattttggtacagacggagtaagaggtgtcgcaaaccaagaactaacacctgaattggcatttaaattaggaagatacggtggctatgttctagcacataataaaggtgaaaaacacccacgtgtacttgtaggtcgcgatactagagtttcaggtgaaatgttagaatcagcattaatagctggtttgatttcaattggtgcagaagtgatgcgattaggtattatttcaacaccaggtgttgcatatttaacacgcgatatgggtgcagagttaggtgtaatgatttcagcctctcataatccagttgcagataatggtattaaattctttggatcagatggttttaaactatcagatgaacaagaaaatgaaattgaagcattattggatcaagaaaacccagaattaccaagaccagttggcaatgatattgtacattattcagattactttgaaggggcacaaaaatatttgagctatttaaaatcaacagtagatgttaactttgaaggtttgaaaattgctttagatggtgcaaatggttcaacatcatcactagcgccattcttatttggtgacttagaagcagatactgaaacaattggatgtagtcctgatggatataatatcaatgagaaatgtggctctacacatcctgaaaaattagctgaaaaagtagttgaaactgaaagtgattttgggttagcatttgacggcgatggagacagaatcatagcagtagatgagaatggtcaaatcgttgacggtgaccaaattatgtttattattggtcaagaaatgcataaaaatcaagaattgaataatgacatgattgtttctactgttatgagtaatttaggtttttacaaagcgcttgaacaagaaggaattaaatctaataaaactaaagttggcgacagatatgtagtagaagaaatgcgtcgcggtaattataacttaggtggagaacaatctggacatatcgttatgatggattacaatacaactggtgatggtttattaactggtattcaattagcttctgtaataaaaatgactggtaaatcactaagtgaattagctggacaaatgaaaaaatatccacaatcattaattaacgtacgcgtaacagataaatatcgtgttgaagaaaatgttgacgttaaagaagttatgactaaagtagaagtagaaatgaatggagaaggtcgaattttagtaagaccttctggaacagaaccattagttcgtgtcatggttgaagcagcaactgatgaagatgctgaaagatttgcacaacaaatagctgatgtggttcaagataaaatgggattagataaa

SEQ ID NO: 2280 - protein, 451 aa, Staphylococcus aureus
  MISC_FEATURE (1)..(451): phosphoglucosamine-mutase
MGKYFGTDGVRGVANQELTPELAFKLGRYGGYVLAHNKGEKHPRVLVGRDTRVSGEMLESALIAGLISIGAEVMRLGIISTPGVAYLTRDMGAELGVMISASHNPVADNGIKFFGSDGFKLSDEQENEIEALLDQENPELPRPVGNDIVHYSDYFEGAQKYLSYLKSTVDVNFEGLKIALDGANGSTSSLAPFLFGDLEADTETIGCSPDGYNINEKCGSTHPEKLAEKVVETESDFGLAFDGDGDRIIAVDENGQIVDGDQIMFIIGQEMHKNQELNNDMIVSTVMSNLGFYKALEQEGIKSNKTKVGDRYVVEEMRRGNYNLGGEQSGHIVMMDYNTTGDGLLTGIQLASVIKMTGKSLSELAGQMKKYPQSLINVRVTDKYRVEENVDVKEVMTKVEVEMNGEGRILVRPSGTEPLVRVMVEAATDEDAERFAQQIADVVQDKMGLDK

SEQ ID NO: 2281 - DNA, 930 bp, Staphylococcus aureus
atgctagaaagtaaatggggcttgagatttattgcctttcttttggcattgtttttctttttatctgttaacaatgtttttggaaatatctttaacactggtaatcttggtcaaaagtctagtaaaacgattcaagatgtacccgttgaaattctttataacactaaagatttgcatttaacaaaagcgcctgaaacagttaatgtgactatttcaggaccacaatcaaagataataaaaattgaaaatccagaagatttaagagtagtgattgatttatcaaatgctaaagctggaaaatatcaagagaagtatcaagttaaagggttagctgatgacattcattattctgtaaaacctaaattagcaaatattacgcttgaaaacaaagtaactaaaaagatgacagttcaacctgatgtaagtcagagtgatattgatccactttataaaattacaaagcaagaagtttcaccacaaacagttaaagtaacaggtggagaagaacaattgaatgatatcgcttatttaaaagccacttttaaaactaataaaaagattaatggtgacacaaaagatgtcgcagaagtaacggcttttgataaaaaactgaataaattaaatgtatcgattcaacctaatgaagtgaatttacaagttaaagtagagccttttagcaaaaaggttaaagtaaatgttaaacagaaaggtagtttagcagatgataaagagttaagttcgattgatttagaagataaagaaattgaaatcttcggtagtcgagatgacttacaaaatataagcgaagttgatgcagaagtagatttagatggtatttcagaatcaactgaaaagactgtaaaaatcaatttaccagaacatgtcactaaagcacaaccaagtgaaacgaaggcttatataaatgtaaaa

SEQ ID NO: 2282 - protein, 310 aa, Staphylococcus aureus
  MISC_FEATURE (1)..(310): conserved hypothetical
MLESKWGLRFIAFLLALFFFLSVNNVFGNIFNTGNLGQKSSKTIQDVPVEILYNTKDLHLTKAPETVNVTISGPQSKIIKIENPEDLRVVIDLSNAKAGKYQEKYQVKGLADDIHYSVKPKLANITLENKVTKKMTVQPDVSQSDIDPLYKITKQEVSPQTVKVTGGEEQLNDIAYLKATFKTNKKINGDTKDVAEVTAFDKKLNKLNVSIQPNEVNLQVKVEPFSKKVKVNVKQKGSLADDKELSSIDLEDKEIEIFGSRDDLQNISEVDAEVDLDGISESTEKTVKINLPEHVTKAQPSETKAYINVK

SEQ ID NO: 2283 - DNA, 807 bp, Staphylococcus aureus
atggatttttccaacttttttcaaaacctcagtacgttaaaaattgtaacgagtatccttgatttactgatagtttggtatgtactttatcttctcatcacggtctttaagggaactaaagcgatacaattacttaaagggatattagtaattgttattggtcagcagataagtatgatattgaacttgactgcaacatctaaattattcgatatcgttattcaatggggggtattagctttaatagtaatattccaaccagaaattagacgtgcgttagaacaacttggtagaggtagctttttaaaacgctatacttctaatacgtatagtaaagatgaagagaaattgattcaatcggtttcaaaggctgtgcaatatatggctaaaagacgtataggtgcattaattgtctttgaaaaagaaacaggtcttcaagattatattgaaacaggtattgcaatggattcaaatatttcgcaagaacttttaattaatgtctttatacctaacacacctttacatgatggtgcaatgattattcaaggcacgaagattgcagcagcagcaagttatttgccattgtctgatagtcctaagatatctaaaagtttgggtacaagacatagagctgcggttggtatttcagaagtatctgatgcatttaccgttattgtatctgaagaaactggtgatatttcggtaacatttgatggaaaattacgacgagacatttcaaacgaaatttttgaagagttgcttgctgaacattggtttggcacacgctttcaaaagaaaggtgtgaaa

SEQ ID NO: 2284 - protein, 269 aa, Staphylococcus aureus
  MISC_FEATURE (1)..(269): conserved hypothetical
MDFSNFFQNLSTLKIVTSILDLLIVWYVLYLLITVFKGTKAIQLLKGILVIVIGQQISMILNLTATSKLFDIVIQWGVLALIVIFQPEIRRALEQLGRGSFLKRYTSNTYSKDEEKLIQSVSKAVQYMAKRRIGALIVFEKETGLQDYIETGIAMDSNISQELLINVFIPNTPLHDGAMIIQGTKIAAAASYLPLSDSPKISKSLGTRHRAAVGISEVSDAFTVIVSEETGDISVTFDGKLRRDISNEIFEELLAEHWFGTRFQKKGVK

SEQ ID NO: 2285 - DNA, 906 bp, Staphylococcus aureus
atgacaaagacaaaagcaattgatattataggtgcaccatcaacatttggacaaagaaaattaggtgttgatttaggaccaacagcaattagatatgctggattaatttcaagattaaagcaattagaccttgatgtatatgacaagggggatattaaggtacctgctgtgaacattgaaaaatttcatagtgaacaaaaaggattaagaaattatgatgaaattatagatgttaatcaaaaattaaataaagaggtttcagcatcaattgaaaataacagatttcctctagttcttggtggagatcattctattgcggtaggttcagtatcagcaataagtaaacattataataatttaggtgttatttggtatgatgcacatggtgatttaaatatacctgaagagtcaccaagtggaaatattcatggtatgcctctaaggattttgacaggcgaaggtcccaaagaacttttagaattaaatagtaatgtaatcaagccagaaaacatcgtactaattggtatgagagatttagataaaggtgaaagacaatttatcaaagatcataatattaaaacatttactatgtcagatattgataaattggggataaaggaagtaattgaaaatacaatagaatatttgaagtcacgcaatgttgatggcgttcatttatctttagatgttgatgctttagatccgcttgaaacgccaggcactggtactagagttttgggtggtcttagttatagagaaagccattttgcattggaattactgcatcaatcacatttaatttcctcaatggatttagttgaagtaaatccattgattgacagtaataatcatactgctgaacaagcggtttcattagttggaacattttttggtgaaactttatta

SEQ ID NO: 2286 - protein, 302 aa, Staphylococcus aureus
  MISC_FEATURE (1)..(302): arginase [Staphylococcus
MTKTKAIDIIGAPSTFGQRKLGVDLGPTAIRYAGLISRLKQLDLDVYDKGDIKVPAVNIEKFHSEQKGLRNYDEIIDVNQKLNKEVSASIENNRFPLVLGGDHSIAVGSVSAISKHYNNLGVIWYDAHGDLNIPEESPSGNIHGMPLRILTGEGPKELLELNSNVIKPENIVLIGMRDLDKGERQFIKDHNIKTFTMSDIDKLGIKEVIENTIEYLKSRNVDGVHLSLDVDALDPLETPGTGTRVLGGLSYRESHFALELLHQSHLISSMDLVEVNPLIDSNNHTAEQAVSLVGTFFGETLL

SEQ ID NO: 2287 - DNA, 231 bp, Staphylococcus aureus
atgattgcaaacgaaaacatccaagacaaagcactagagaattttaaagcaaaccaaactgaagtaactgtattctttctaaacggtttccaaatgaaaggtgttattgaagaatacgacaagtatgtcgtaagcttaaattctcaaggcaaacaacacttgatttacaaacatgcgatcagcacttatacagtagaaactgaaggtcaagcatctactgaaagtgaagaa

SEQ ID NO: 2288 - protein, 77 aa, Staphylococcus aureus
  MISC_FEATURE (1)..(77): hypothetical protein
MIANENIQDKALENFKANQTEVTVFFLNGFQMKGVIEEYDKYVVSLNSQGKQHLIYKHAISTYTVETEGQASTESEE

SEQ ID NO: 2289 - DNA, 1236 bp, Staphylococcus aureus
gtgaccaaacccaaactaaaggagacaagtgcgcctatgtgtaatgataccttagaattactaagaataaaagatgaaaatataaaatatataaaccaagaaattgacgtcattatcaaaggaaaaaaagcaacagtggttaatgctgtactaacgtataagccttcggcctgttattgttgtggagttaaaaatgaaggacaaattcataaacatggtaagcgtgtttctcgtattactttacttaaaactcaagggtataacacatacctcaacttagctaaacaacgttttaaatgcttagaatgcaatggcacttttactgctaaaacgtcaattgttgatgagtcgtgttttatctcaagatgtgttactcaaaaagttatagaagaagctactaaagttaaaacagagattgatactgcagaagataactgtatctctccatctactgtaagtcgtattagaactaaagcggctaattcattacgaattaaaccctttaattgtttgccagaacacatcgctatggatgaatttaaaagcgttaaaaatgtaactggatcaatgagtttcatttttatagataatgatactcatgatgttatagatattttagaaaatagaactacaagattcttgcgtgcctatttcgagcgattcgatttaaaaaatcgacaacaagttaagacggttactattgacatgtatgaaccctatgtccgattatttcgcgacctatttcctaatgcagctattatttttgacagattccatatcgttcaacatttaaatagagaacttaataagtatcgtgtacaagttatgaatgaataccgtaataaaaaaggacctgattatacaatttttaagaataactggaaagtcctattgatggatactagtaaaaccatatttagtaaatacagatggaataaatcttttaaggcttataaacgctcatctgacattgtagaattcatgctttcaaaagacgatatactacgacactcctacgaacttgtccaaggattacgaaaagacctaaggttatgtaattggcctaaatttattaatcgtttaaattcagttagtaaaaagtctgtgagtaagggtgtatggaaagtggttaaatattatagaaaacatcaaaggatgttaagaaatacaatttattacccagcatttaataatggtgctatagaaggaattaataataagataaaattaatcaag

SEQ ID NO: 2290 - protein, 412 aa, Staphylococcus aureus
  MISC_FEATURE (1)..(412): transposase [Staphylococcus
VTKPKLKETSAPMCNDTLELLRIKDENIKYINQEIDVIIKGKKATVVNAVLTYKPSACYCCGVKNEGQIHKHGKRVSRITLLKTQGYNTYLNLAKQRFKCLECNGTFTAKTSIVDESCFISRCVTQKVIEEATKVKTEIDTAEDNCISPSTVSRIRTKAANSLRIKPFNCLPEHIAMDEFKSVKNVTGSMSFIFIDNDTHDVIDILENRTTRFLRAYFERFDLKNRQQVKTVTIDMYEPYVRLFRDLFPNAAIIFDRFHIVQHLNRELNKYRVQVMNEYRNKKGPDYTIFKNNWKVLLMDTSKTIFSKYRWNKSFKAYKRSSDIVEFMLSKDDILRHSYELVQGLRKDLRLCNWPKFINRLNSVSKKSVSKGVWKVVKYYRKHQRMLRNTIYYPAFNNGAIEGINNKIKLIK

SEQ ID NO: 2291 - DNA, 102 bp, Staphylococcus aureus
ttgtattttaaaaatagttctttaaattatatacccaccacatttggtggagaacctaaaaaaaagcacttcccaaaaatggaaagtgcaagtagtgagcca

SEQ ID NO: 2292 - protein, 34 aa, Staphylococcus aureus
LYFKNSSLNYIPTTFGGEPKKKHFPKMESASSEP

SEQ ID NO: 2293 - DNA, 1545 bp, Staphylococcus aureus
atgtttgagtgtaccagttggaatactaaaggattacaacaagttaaaggagagaaagttatgtcagaagaaatgaatgaccaaatgttggttcgacgtcaaaaattacaagaattatatgatcttggtatagacccgtttggttctaaatttgaccgttcaggtttatctagtgatttgaaagaagagtgggaccagtattctaaagaagaattggtagaaaaagaagcggatagtcatgtcgctatagctggacgattaatgactaagcgtggtaaaggtaaagcaggatttgcacacgttcaggacttagctggacaaattcaaatttacgttcgtaaagatcaagttggcgatgacgaatttgatttatggaaaaatgctgatttaggcgatatcgttggtgttgaaggtgtaatgttcaaaacaaatactggcgaattatcggttaaagcgaagaaattcacgctactaactaaatcattgcgaccattaccggataaattccacggtttacaggatattgaacagagatatcgtcaaagatatttagatttaattacgaacgaagatagcactcgtacatttattaatcgtagtaaaatcattcaagaaatgcgtaattatttaaataataaaggtttcttggaagtagaaacacctatgatgcaccaaattgctggtggagcagctgctagaccatttgtaacacatcataatgcattagatgcaacgttatacatgcgtattgctattgagttgcatttaaaacgtttaattgtcggtggacttgaaaaagtatatgaaattggtagagtattccgtaatgaaggtgtatcaactagacataaccctgaattcacaatgattgaattatatgaagcatatgcagattatcatgacattatggatttaacagaatctatggtgagacatattgccaatgaagtgttaggttctgcaaaagtacaatacaatggggaaacgattgatttagaatctgcttggactcgtttgcatattgttgatgctgtaaaagaagctactggtgtagatttttatgaagttaaaagtgatgaagaagctaaagctttagctaaagaacatggtattgaaattaaagatacaatgaaatatggtcatattttaaatgaattctttgagcaaaaagttgaagaaacacttattcagccaacgtttatctatggtcatccgactgaaatttcacctttagcgaagaaaaatcctgaagatcctagatttactgatcgtttcgaattgttcattgtaggtagagagcatgcaaatgcatttactgaattaaatgatcctattgatcaaaaaggtcgttttgaagcgcaacttgttgaaaaagcgcaaggtaatgatgaagcgcatgaaatggatgaagattacattgaagcgttagaatatggtatgcctccgacaggtggtcttggtatcggtattgacagattggttatgttattaactgactctccatcaatcagagacgtattattattcccttatatgagacaaaaa

SEQ ID NO: 2294 - protein, 515 aa, Staphylococcus aureus
  MISC_FEATURE (1)..(515): lysyl-tRNA synthetase
MFECTSWNTKGLQQVKGEKVMSEEMNDQMLVRRQKLQELYDLGIDPFGSKFDRSGLSSDLKEEWDQYSKEELVEKEADSHVAIAGRLMTKRGKGKAGFAHVQDLAGQIQIYVRKDQVGDDEFDLWKNADLGDIVGVEGVMFKTNTGELSVKAKKFTLLTKSLRPLPDKFHGLQDIEQRYRQRYLDLITNEDSTRTFINRSKIIQEMRNYLNNKGFLEVETPMMHQIAGGAAARPFVTHHNALDATLYMRIAIELHLKRLIVGGLEKVYEIGRVFRNEGVSTRHNPEFTMIELYEAYADYHDIMDLTESMVRHIANEVLGSAKVQYNGETIDLESAWTRLHIVDAVKEATGVDFYEVKSDEEAKALAKEHGIEIKDTMKYGHILNEFFEQKVEETLIQPTFIYGHPTEISPLAKKNPEDPRFTDRFELFIVGREHANAFTELNDPIDQKGRFEAQLVEKAQGNDEAHEMDEDYIEALEYGMPPTGGLGIGIDRLVMLLTDSPSIRDVLLFPYMRQK

SEQ ID NO: 2295 - DNA, 90 bp, Staphylococcus aureus
atggttaatgataaagtattagaaacatcgaaagagatgtatgttgagcaaaaatgtctgatattttataaaactttaaaggaaaatgtt

SEQ ID NO: 2296 - protein, 30 aa, Staphylococcus aureus
MVNDKVLETSKEMYVEQKCLIFYKTLKENV

SEQ ID NO: 2297 - DNA, 474 bp, Staphylococcus aureus
atgattcaagcatacttaggattaggtagtaatattggtgatagagaaagccagttaaacgatgctataaagattttgaatgaatatgatggtattaacgtatctaatatttctccgatttatgaaacagcaccagttgggtatactgagcaacctaactttttaaatttgtgtgttgaaattcaaacaacactcacagtattacaactgttggaatgttgtttgaagacagaagaatgtttacaccgtattagaaaggaacgatggggtcctagaactttagatgtggatattttgttgtatggagaagaaatgatagatttaccaaaactgtcggtgccacatccgagaatgaatgaacgtgcatttgttttaatcccattaaatgatatagcagcaaatgtcgtagaaccacgttcgaaattgaaagtgaaagatttagtttttgtcgatgacagtgtaaagagatataaa

SEQ ID NO: 2298 - protein, 158 aa, Staphylococcus aureus
MIQAYLGLGSNIGDRESQLNDAIKILNEYDGINVSNISPIYETAPVGYTEQPNFLNLCVEIQTTLTVLQLLECCLKTEECLHRIRKERWGPRTLDVDILLYGEEMIDLPKLSVPHPRMNERAFVLIPLNDIAANVVEPRSKLKVKDLVFVDDSVKRYK

SEQ ID NO: 2299 - DNA, 369 bp, Staphylococcus aureus
atgaaaatgcaagacacaatctttcttaaaggtatgcgcttttatggatatcatggtgctttatcagctgaaaatgaaatagggcaaattttcaaagtggatgtaactttgaaagtagacttagctgaagctgggcgtactgataatgttattgatacagttcattatggtgaagtgttcgaagaggttaaatcaattatggaaggtaaggccgttaatttacttgagcatctagctgaacgtattgcaaatcgtataaattcacaatataatcgtgtaatggaaacgaaagtgagaatcactaaagaaaacccaccgattccgggtcattatgatggagtaggtatcgaaatagtgagggagaataaa

SEQ ID NO: 2300 - protein, 123 aa, Staphylococcus aureus
  MISC_FEATURE (1)..(123): 7,8-dihydroneopterin
MKMQDTIFLKGMRFYGYHGALSAENEIGQIFKVDVTLKVDLAEAGRTDNVIDTVHYGEVFEEVKSIMEGKAVNLLEHLAERIANRINSQYNRVMETKVRITKENPPIPGHYDGVGIEIVRENK

SEQ ID NO: 2301 - DNA, 810 bp, Staphylococcus aureus
gtggttaacatgactaaaacaaaaattatgggcatattaaacgtcacacctgattcattctcagatggtggaaaatttaataatgttgaatcagctataaatagagtgaaagccatgatagatgaaggtgctgacattatagatgttggaggtgtttcaacgagacccggtcatgaaatggtttcattagaagaagagatgaacagagtattacctgttgttgaagctattgtcggttttgatgtaaaaatttcagtcgatacatttcgaagtgaggttgctgaagcatgtttaaaattaggcgttgatatgattaatgatcaatgggcgggtctgtatgatcatcgtatgttccaaattgtagctaaatatgacgcggaaattattttaatgcataatggaaatggtaatcgtgatgaaccggttgtcgaagaaatgttaacatctttgttagcacaagcacatcaagctaaaatagctggtataccttcaaataaaatttggctagatccaggtataggtttcgctaaaactagaaatgaagaagccgaagttatggcaagactggatgaacttgttgcaacagaatatccagttttattagcgacaagccggaaacgtttcactaaagagatgatgggttatgatacaacaccggttgaaagagatgaagtaactgcagctacgactgcatatggtattatgaaaggcgttagagcagtacgcgttcataatgtcgagttgaatgctaaattagctaaaggtatagattttttaaaggagaatgaaaatgcaagacacaatctttct

SEQ ID NO: 2302 - protein, 270 aa, Staphylococcus aureus
  MISC_FEATURE (1)..(270): dihydropteroate synthase
VVNMTKTKIMGILNVTPDSFSDGGKFNNVESAINRVKAMIDEGADIIDVGGVSTRPGHEMVSLEEEMNRVLPVVEAIVGFDVKISVDTFRSEVAEACLKLGVDMINDQWAGLYDHRMFQIVAKYDAEIILMHNGNGNRDEPVVEEMLTSLLAQAHQAKIAGIPSNKIWLDPGIGFAKTRNEEAEVMARLDELVATEYPVLLATSRKRFTKEMMGYDTTPVERDEVTAATTAYGIMKGVRAVRVHNVELNAKLAKGIDFLKENENARHNLS

SEQ ID NO: 2303 - DNA, 939 bp, Staphylococcus aureus
gtgttcttaatggcacaaaaaccagtagataatattactcaaattattggcggtacaccggtagtcaaattgagaaatgtagtagatgacaatgcagcagatgtttatgtaaaattggaatatcaaaatccaggtggttctgtaaaggatagaattgctttagcaatgattgaaaaagcagagcgagaaggcaaaattaaacctggcgatacaattgtagaaccaacaagtggtaatacaggtatcggtttagcatttgtatgtgctgctaaaggatataaagcagtatttactatgcccgaaacaatgagccaagagcgtcgtaatttattaaaagcatacggtgcggaattagttttaacgcctggatcagaagcgatgaaaggtgcaattaaaaaagctaaagaattgaaagaagaacatggttacttcgagccacaacaatttgaaaaccctgcgaaccctgaagttcatgagttaactacaggtcctgagttattacaacaatttgaagggaaaactatcgatgcgttcctagctggtgttggtactggtggtacgttatctggtgtaggtaaagttctgaaaaaagaatatcctaacatcgaaattgttgctatagagcctgaggcttctccagtattgagcggtggtgagccaggtccacataaattacaaggtttaggtgctggatttattccaggcactttgaatacagaaatctatgacagtattattaaagtaggaaatgatacagcgatggaaatgtctcgtcgagttgctaaagaggaaggtattttagcaggtatttcatcaggtgctgcgatttatgctgccattcaaaaagcaaaagaattaggaaaaggtaaaacagtagtaacagtattgccgagtaatggtgaacgctacttatcaacacctttatattcattcgatgac

SEQ ID NO: 2304 - protein, 313 aa, Staphylococcus aureus
  MISC_FEATURE (1)..(313): cysteine synthase
VFLMAQKPVDNITQIIGGTPVVKLRNVVDDNAADVYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEVHELTTGPELLQQFEGKTIDAFLAGVGTGGTLSGVGKVLKKEYPNIEIVAIEPEASPVLSGGEPGPHKLQGLGAGFIPGTLNTEIYDSIIKVGNDTAMEMSRRVAKEEGILAGISSGAAIYAAIQKAKELGKGKTVVTVLPSNGERYLSTPLYSFDD

SEQ ID NO: 2305 - DNA, 879 bp, Staphylococcus aureus
atgacacacgattatattgttaaagcattagcatttgatggagagattagggcttatgctgctttgacaactgaaactgttcaagaagcacaaacgagacattatacatggccgacagcatctgctgcaatgggaagaacaatgacagcaacagctatgatgggcgcaatgttgaaaggtgatcaaaaattaactgtcactgtagatggccaaggacctattggacgaattattgccgatgcaaatgctaaaggcgaggtgcgtgcttatgtagaccatccacaaactcattttccattaaatgagcaaggtaaacttgatgtaagacgagcggtagggacaaatggatctattatggttgttaaagacgttggaatgaaagactatttctctggagcaagtccaattgtttcaggagaacttggtgaagattttacttattattatgctacaagtgaacaaacaccttcatcggtaggtcttggtgtattggtaaatcctgataatacgattaaagcagcaggaggatttatcattcaagttatgccaggtgccaaagatgaaacaatttcaaaattagaaaaagcaattagtgaaatgacaccagtttctaaattaattgaacaaggattaacgccagaaggattactaaacgaaatcttaggtgaagaccatgtgcaaattttagagaaaatgcctgttcaatttgaatgtaattgtagtcatgagaaatttttaaatgctattaaaggattgggcgaggctgagattcaaaatatgattaaagaagatcatggtgctgaagcagtatgtcatttctgtggaaataaatataaatatactgaagaagaattaaacgtgttgctagaaagtttagcg

SEQ ID NO: 2306 - protein, 293 aa, Staphylococcus aureus
  MISC_FEATURE (1)..(293): heat-shock protein HSP33
MTHDYIVKALAFDGEIRAYAALTTETVQEAQTRHYTWPTASAAMGRTMTATAMMGAMLKGDQKLTVTVDGQGPIGRIIADANAKGEVRAYVDHPQTHFPLNEQGKLDVRRAVGTNGSIMVVKDVGMKDYFSGASPIVSGELGEDFTYYYATSEQTPSSVGLGVLVNPDNTIKAAGGFIIQVMPGAKDETISKLEKAISEMTPVSKLIEQGLTPEGLLNEILGEDHVQILEKMPVQFECNCSHEKFLNAIKGLGEAEIQNMIKEDHGAEAVCHFCGNKYKYTEEELNVLLESLA

SEQ ID NO: 2307 - DNA, 2001 bp, Staphylococcus aureus
atgccgaaacagcttacatataatcaatttactgagaagttggaaaaaggtgaccttaaaactttagaaatccaaccacaacaaaatgtctatatggtaagtggtaaaacgaaaaatgatgaagactattcatcaactattttatataacaacgaaaaagaattacaaaaaattactgatgctgctaaaaagcaaaacggtgtaaaattaacgattaaagaagaagaaaaacaaagtgtctttgtgagtatactttcaacattaattccagttgtagtcatagcgttattatttattttcttcctaagccaagcacaaggtggcggtagtggcggtcgtatgatgaactttggtaaatctaaagcaaaaatgtacgataataataaacgtcgtgttcgtttctctgatgtagcaggggcagatgaagaaaaacaagaattaattgaaattgttgatttcttgaaagataataaaaaattcaaagaaatgggatctaggattcctaaaggtgtcttacttgttggacctccaggtactggtaaaacattacttgctagagcggttgcaggtgaagctggcgcaccattcttctctattagtggttcagactttgtagagatgtttgttggtgttggtgcgagccgtgttcgtgacttattcgataatgctaagaaaaacgcgccttgtatcatctttatcgatgagattgatgctgttggtcgtcaacgtggtgcaggtgttggtggcggtcatgatgaacgtgaacaaaccctaaaccaattattagttgaaatggatggtttcggtgaaaatgaaggtatcattatgatagctgctacaaaccgtcctgatatccttgacccagccttattacgtccaggtcgttttgatagacaaattcaagttggtcgtccagatgtgaaaggccgtgaagcaattcttcatgttcatgctaaaaacaaaccacttgatgaaacggttgatttaaaagcaatttcacaacgtacacctggtttctcaggtgctgatttagagaacttattaaatgaagcatctttaattgctgtacgtgaaggtaaaaagaaaattgacatgagagatatcgaagaggcaacggatagagttatagccggacctgctaagaaatctcgagttatttctaagaaagaacgtaatattgttgctcatcacgaagctggtcatacaattatcggtatggtacttgatgaggcagaagtagtgcataaagttactattgttccacgtggacaagcaggtggttatgcaatgatgctacctaaacaagatcgtttcttaatgactgaacaagagttattagataaaatctgtggtttacttggtggacgtgtatcagaagatattaactttaacgaagtatcaacaggtgcttcaaatgacttcgaacgtgcaacacaaatcgcacgctcaatggttacgcaatatggtatgagtaaaaaattaggaccattacagttcggtcatagcaatggtcaagtattcttaggtaaagatatgcaaggtgagcctaattattcaagccaaatcgcatatgaaattgataaagaagttcaacgaatcgttaaagaacaatacgaacgttgtaaacaaattttattagagcacaaagaacaattaattttaattgctgaaacattattaacagaagaaacattagttgctgaacaaattcaatcattattctacgaaggtaaattacctgaaattgattatgatgcagctaaagttgttaaagatgaagattctgaatttaatgatggtaaattcggtaaatcttatgaagagattcgtaaagagcaattagaagatggacaacgtgacgaaagtgaagatcgtaaagaagaaaaagatattgctgaggataaaaaagaagctgataaatctgatgaaaaagatgaaccagcacatcgacaagccccaaatatcgaaaaaccttacgatccaaatcacccagacaataaa

SEQ ID NO: 2308 - protein, 667 aa, Staphylococcus aureus
  MISC_FEATURE (1)..(667): cell-division protein
MPKQLTYNQFTEKLEKGDLKTLEIQPQQNVYMVSGKTKNDEDYSSTILYNNEKELQKITDAAKKQNGVKLTIKEEEKQSVFVSILSTLIPVVVIALLFIFFLSQAQGGGSGGRMMNFGKSKAKMYDNNKRRVRFSDVAGADEEKQELIEIVDFLKDNKKFKEMGSRIPKGVLLVGPPGTGKTLLARAVAGEAGAPFFSISGSDFVEMFVGVGASRVRDLFDNAKKNAPCIIFIDEIDAVGRQRGAGVGGGHDEREQTLNQLLVEMDGFGENEGIIMIAATNRPDILDPALLRPGRFDRQIQVGRPDVKGREAILHVHAKNKPLDETVDLKAISQRTPGFSGADLENLLNEASLIAVREGKKKIDMRDIEEATDRVIAGPAKKSRVISKKERNIVAHHEAGHTIIGMVLDEAEVVHKVTIVPRGQAGGYAMMLPKQDRFLMTEQELLDKICGLLGGRVSEDINFNEVSTGASNDFERATQIARSMVTQYGMSKKLGPLQFGHSNGQVFLGKDMQGEPNYSSQIAYEIDKEVQRIVKEQYERCKQILLEHKEQLILIAETLLTEETLVAEQIQSLFYEGKLPEIDYDAAKVVKDEDSEFNDGKFGKSYEEIRKEQLEDGQRDESEDRKEEKDIAEDKKEADKSDEKDEPAHRQAPNIEKPYDPNHPDNK

SEQ ID NO: 2309 - DNA, 945 bp, Staphylococcus aureus
gtggaattaaatatgaataaaaataagccttttattgtagtaattgtggggccaactgcttcaggtaaaacagagcttagcatcgaactcgcgaagcgtatcaatggtgaaatcataagcggtgactctatgcaagtctacaaacatatgaatattggaactgcaaaagtaacacctgaagaaatggatggtattccacatcatttaattgatatcttgaatcctgatgatacattttcagcatatgaattcaagcgattagcagaagatttaattactgatataacgaatagaggtaaagttccaatcatagcaggtggaacaggcttatatattcaatcattaatatataattatgaattagaagatgaaacagttacacctgcacaattatccatagttaaacaaaagttatctgcattagaacatttagataatcagcaactacacgattatttagctcaatttgatgcggtttctgcagaaaatattcaccctaacaaccgccaaagagtgttgcgcgctattgaatattatttaaaaacaaaaaaacttttgagtaatcgcaagaaagtgcaacaatttactgaaaattatgatacattattattagggattgaaatgtcgcgtaaaacattatattcaagaataaataaacgtgttgatattatgttggatcacggattatttagagaagtgcaacaacttgttgaacaaggctatgaatcttgccaaagtatgcaagctattggatataaagaattaatacctgtgattaacggacaaatgatttatgaagatgctgtcaatgatttaaagcaacattcacgccaatatgcaaaacgacaaatgacatggttcaagaataaaatgagtgttcattggttagataaagaaaatatgtcacttcaaatgatgttagatgagattacaacccagattaag

SEQ ID NO: 2310 - protein, 315 aa, Staphylococcus aureus
  MISC_FEATURE (1)..(315): tRNA
VELNMNKNKPFIVVIVGPTASGKTELSIELAKRINGEIISGDSMQVYKHMNIGTAKVTPEEMDGIPHHLIDILNPDDTFSAYEFKRLAEDLITDITNRGKVPIIAGGTGLYIQSLIYNYELEDETVTPAQLSIVKQKLSALEHLDNQQLHDYLAQFDAVSAENIHPNNRQRVLRAIEYYLKTKKLLSNRKKVQQFTENYDTLLLGIEMSRKTLYSRINKRVDIMLDHGLFREVQQLVEQGYESCQSMQAIGYKELIPVINGQMIYEDAVNDLKQHSRQYAKRQMTWFKNKMSVHWLDKENMSLQMMLDEITTQIK

SEQ ID NO: 2311 - DNA, 555 bp, Staphylococcus aureus
atggagatgaatagcgttatgcataatgatttgaaagaagtattgttaactgaagaagatattcaaaatatctgtaaggaattgggagcacaattaacaaaggattatcaaggtaaaccattagtatgcgtgggtatcttaaaaggctcagcaatgtttatgtcagatttaattaaacgaattgatacccatttatcaattgatttcatggatgtttctagttatcacggaggcactgagtcaactggtgaagttcaaatcattaaagatttaggttcttctattgaaaataaagacgtattaattattgaagatatcttagagactggtactacacttaagtcaattactgaattattacaatctagaaaagttaattcattagaaatagttactttattagataaaccaaaccgtcgtaaagcggacattgaagctaagtatgtaggtaaaaaaataccagatgaatttgttgttggttacggtttagattatcgtgaattataccgaaacttaccatatatcggtacgttaaaacctgaagtgtattcaaat

SEQ ID NO: 2312 - protein, 185 aa, Staphylococcus aureus
  MISC_FEATURE (1)..(185): hypoxanthine-guanine
MEMNSVMHNDLKEVLLTEEDIQNICKELGAQLTKDYQGKPLVCVGILKGSAMFMSDLIKRIDTHLSIDFMDVSSYHGGTESTGEVQIIKDLGSSIENKDVLIIEDILETGTTLKSITELLQSRKVNSLEIVTLLDKPNRRKADIEAKYVGKKIPDEFVVGYGLDYRELYRNLPYIGTLKPEVYSN

SEQ ID NO: 2313 - DNA, 1293 bp, Staphylococcus aureus
atgcagttaaatagtaatggttggcatgttgatgaccatattgttgtcgctgtttctacaggtattgatagtatgtgtttattgtatcaactactaaatgattataaagatagttatagaaaactaacatgcttacatgtcaatcatggcgttaggtcagcttcaattgaggaagccagatttttagaagcatactgcgaacgtcatcacatcgatttacatatcaaaaagttagatttgtcgcatagtctcgaccgaaataacagcattcagaatgaagctcgaattaaacgttacgaatggtttgatgaaatgatgaatgtattagaagcggatgtattgctaacggcgcatcatttggacgatcaattagaaactattatgtatcgtatttttaatgggaaatcaacacgtaataaactaggatttgatgagttatcgaagcgaaaaggttatcagatttatcgaccacttttagctgtctctaaaaaagaaataaaacaattccaagagagatatcatattccatattttgaagatgaatctaataaagataacaaatatgttagaaatgatattcgtaatagaattattccagctattgatgaaaataatcaacttaaagtatcgcatttattaaaattaaaacaatggcatgatgaacaatatgatattttgcaatattcagctaaacaatttattcaagaatttgtgaagtttgatgaacagtcaaaatatttagaggtttctagacaagcttttaataacttaccaaactcattaaagatggttgtgttggactgcctattatcaaagtattatgagttgtttaatattagtgctaaaacatacgaagagtggtttaaacaatttagtagtaagaaagcacaattcagtattaatctcacggataaatggataattcaaatcgcatatggtaaattaataataatggctaaaaataatggcgatacatattttagagttcaaacaattaaaaagccaggtaattatatttttaacaaatatcgattagagatacattctaatttaccaaaatgtttatttccgcttacagtgagaacacgacaaagtggcgatacatttaaactgaatgggcgcgatggttataagaaagtgaatcgcctgtttatagattgtaaagtgccacagtgggttcgggatcaaatgccaatcgtattggataaacaacagcgcattattgcggtaggagatttatatcaacaacaaacaataaaaaaatggattataattagtaaaaatggagatgaa

SEQ ID NO: 2314 - protein, 431 aa, Staphylococcus aureus
  MISC_FEATURE (1)..(431): conserved hypothetical
MQLNSNGWHVDDHIVVAVSTGIDSMCLLYQLLNDYKDSYRKLTCLHVNHGVRSASIEEARFLEAYCERHHIDLHIKKLDLSHSLDRNNSIQNEARIKRYEWFDEMMNVLEADVLLTAHHLDDQLETIMYRIFNGKSTRNKLGFDELSKRKGYQIYRPLLAVSKKEIKQFQERYHIPYFEDESNKDNKYVRNDIRNRIIPAIDENNQLKVSHLLKLKQWHDEQYDILQYSAKQFIQEFVKFDEQSKYLEVSRQAFNNLPNSLKMVVLDCLLSKYYELFNISAKTYEEWFKQFSSKKAQFSINLTDKWIIQIAYGKLIIMAKNNGDTYFRVQTIKKPGNYIFNKYRLEIHSNLPKCLFPLTVRTRQSGDTFKLNGRDGYKKVNRLFIDCKVPQWVRDQMPIVLDKQQRIIAVGDLYQQQTIKKWIIISKNGDE

SEQ ID NO: 2315 - DNA, 399 bp, Staphylococcus aureus
atgtcaatcgaagttggaaataagcttaaaggtaaagtcactggtattaaaaagtttggtgcattcgtagaattacctgaaggaaaaagtggtttagttcacattagtgaagtcgcagataattatgttgaaaacgtagaagagcacctttctgttggtgatgaagtagacgtaaaagtattatctattgctgatgatggaaaaattagtctttcaattaagaaagctaaagaccgtccacgtagacaacatacgagtaaaccaagtcatcaaaaaccagtgcaaaaagccgaagattttgaaaagaaattaagcaatttcttaaaagatagtgaagataaattaacttcaatcaaacgtcaaacagaatctagacgcggtggcaaaggttcaagacgt

SEQ ID NO: 2316 - protein, 133 aa, Staphylococcus aureus
  MISC_FEATURE (1)..(133): hypothetical protein
MSIEVGNKLKGKVTGIKKFGAFVELPEGKSGLVHISEVADNYVENVEEHLSVGDEVDVKVLSIADDGKISLSIKKAKDRPRRQHTSKPSHQKPVQKAEDFEKKLSNFLKDSEDKLTSIKRQTESRRGGKGSRR

SEQ ID NO: 2317 - DNA, 117 bp, Staphylococcus aureus
ttgattcaaaattatccgagtatagacattgtgaaaaaatccaaacaaggatataataagggaaaatcgaatcaaatcgggaggatttatttaacatatgtcaatcgaagttggaaa

SEQ ID NO: 2318 - protein, 39 aa, Staphylococcus aureus
LIQNYPSIDIVKKSKQGYNKGKSNQIGRIYLTYVNRSWK

SEQ ID NO: 2319 - DNA, 390 bp, Staphylococcus aureus
atgaaaaataaagtagaacatatagaaaatcagtacacgtcgcaagagaacaagaaaaaacaacgtcaaaaaatgaaaatgcgtgttgttcgtaggcgtattacagtatttgcgggcgtattacttgcgataattgttgttttatcaatcttgcttgttgtccaaaaacatcgcaatgatattgatgcacaggagcgaaaagcgaaagaagcacagtttcaaaagcaacaaaatgaagaaattgcgttaaaagaaaagttgaataatctgaatgacaaagattacattgaaaaaattgcgcgtgatgattattacttaagcaacaaaggtgaagtgatttttaggttgccagaagacaaagattcgtctagctcaaaatcttcgaaaaaa

SEQ ID NO: 2320 - protein, 130 aa, Staphylococcus aureus
  MISC_FEATURE (1)..(130): hypothetical protein
MKNKVEHIENQYTSQENKKKQRQKMKMRVVRRRITVFAGVLLAIIVVLSILLVVQKHRNDIDAQERKAKEAQFQKQQNEEIALKEKLNNLNDKDYIEKIARDDYYLSNKGEVIFRLPEDKDSSSSKSSKK

SEQ ID NO: 2321 - DNA, 261 bp, Staphylococcus aureus
atgagattagataaatatttaaaagtatcacggttaataaagcgacgtacgctagcaaaagaagtaagtgatcaaggtagaattacaataaatggtaatgttgctaaagctggatcggatgttaaagttgaagatgtgctgacgattcgctttggtcaaaaattagtaacagttaaagtaactgcattaaatgaacatgcatctaaagataacgcgaagggtatgtatgaaatcattgaagagcgtcgacttgaagaagcg

SEQ ID NO: 2322 - protein, 87 aa, Staphylococcus aureus
  MISC_FEATURE (1)..(87): conserved hypothetical
MRLDKYLKVSRLIKRRTLAKEVSDQGRITINGNVAKAGSDVKVEDVLTIRFGQKLVTVKVTALNEHASKDNAKGMYEIIEERRLEEA

SEQ ID NO: 2323 - DNA, 1194 bp, Staphylococcus aureus
ttgatggcacataccattacgattgttggcttaggaaactatggcattgatgatttgccgctagggatatataaatttttaaagacacaagataaagtttatgcaagaacgttagatcatccagttatagaatcattgcaagatgaattaacatttcagagttttgaccatgtttatgaagcacataaccaatttgaagatgtctatattgatattgtggcgcaattggttgaagctgctaatgaaaaagatattgtctatgcggttccgggtcatcctagagttgctgagacaactacagtgaaattactggctttagcaaaggacaatactgatatagatgtgaaagttttaggtgggaaaagctttattgatgatgtgtttgaagcagttaatgtagatccaaatgatggcttcacactgttagatgcgacatcattacaagaagtaacacttaatgttagaacgcatacattgattacgcaagtttatagtgcaatggttgctgctaatttgaaaatcactttaatggaacgatatcctgatgattaccctgttcaaattgtcactggtgcacgaagcgatggtgcggataacgttgtgacatgcccattatatgaattggatcatgatgaaaatgcattcaataatttgacgagtgtattcgtaccaaaaatcataacatcgacatatttgtatcatgactttgattttgcaacggaagtgattgatactttagttgatgaagataaaggttgtccatgggataaagtgcaaacgcatgaaacgctaaagcgttatttacttgaagaaacatttgaattgttcgaagctattgacaatgaagatgattggcatatgattgaagaactaggagatattttattacaagtgttattgcatactagtattggtaaaaaagaagggtatatcgacattaaagaagtgattacaagtcttaatgctaaaatgattcgtagacacccacacatatttggtgatgccaatgctgaaactatcgatgacttaaaagaaatttggtctaaggcgaaagatgctgaaggtaaacagccaagagttaaatttgaaaaagtatttgcagagcattttttaaatttatatgagaagacgaaggataagtcatttgatgaggccgcgttaaagcagtggctagaaaaaggggagagtaataca

SEQ ID NO: 2324 - protein, 398 aa, Staphylococcus aureus
  MISC_FEATURE (1)..(398): conserved hypothetical
LMAHTITIVGLGNYGIDDLPLGIYKFLKTQDKVYARTLDHPVIESLQDELTFQSFDHVYEAHNQFEDVYIDIVAQLVEAANEKDIVYAVPGHPRVAETTTVKLLALAKDNTDIDVKVLGGKSFIDDVFEAVNVDPNDGFTLLDATSLQEVTLNVRTHTLITQVYSAMVAANLKITLMERYPDDYPVQIVTGARSDGADNVVTCPLYELDHDENAFNNLTSVFVPKIITSTYLYHDFDFATEVIDTLVDEDKGCPWDKVQTHETLKRYLLEETFELFEAIDNEDDWHMIEELGDILLQVLLHTSIGKKEGYIDIKEVITSLNAKMIRRHPHIFGDANAETIDDLKEIWSKAKDAEGKQPRVKFEKVFAEHFLNLYEKTKDKSFDEAALKQWLEKGESNT

SEQ ID NO: 2325 - DNA, 1527 bp, Staphylococcus aureus
gtgatgaagcataaagaagcatttaatggcgttgtcgtgttaactgctgcattaattgtcattaaaattctgagtgctgtatatcgaattccatatcaaaatatattaggcgatacaggtttgtatgcatatcaacaagtgtatccaattgtagcattaggaatgatattatcgatgaatgccattcctagtgcaattacacaaaatatagggaagtatcatagtgacgaagcatatgcaaaagcagtcgcttatatacaattagttggtatattattatttattgctatttttgtgtttgcgaacaatattgcacatatgatgggtgatggccatttaacaccaatgattcaagctgcaagtttaagctttatatttataggtatgcttggcgtgttaagaggttattatcaatctgcaaataatatgacagttccggctatttcccaggttatagaacaagttatacgagtaggtattatcattgttactattgttatttttgtagacagaggttggacgatatatgaagcgggaacaattgctattttagcatcaacgataggttttttaggttcttcaatttatttagtagcgcaccgaccttttaagtttaaaatggtaaataacactgcaaagatcgtttggaaacagttcgcactttcggttttgattttcgctatcagtcaattaatcgtaattttatggcaagtgattgatagtgttactattattaagtcacttcaagcgatacgcgtgccattcgatgttgccataactgaaaaaggagtctatgaccgtggtgcatcatttattcagatgggattgattgtaactacaacatttagttttgcgctcattcctctgttaagtgacgcaatcaaaatgaataatcaggtacttatgaatcgttatgcaaatgcgtcattaaagattacgattttaataagtacagcagcgggaataggattaattaatttattgcctttaatgaacggtgtgttttttaagacgaatgatttaaccttaacgttaagtgtttatatgattacggtcatttgtgtatcgttaattatgatggatatggcattattacaagcgcaacatgctgtgagacctatttttgttggtatgacggcaggattggttattaaatttatacttaatatcattttgattcgtttaagtggcattattggtgcgagcattagtactgttgtatcattaattatattcggtacgattatccatattgctgtcacgagaaaataccacttatatgcgatgagacgattttttatcaatgttgttttaggtatggtatttatgtcgattgttgttcaatgcgtgttaaacatagtgacaacacacggtagaatcactggactcattgaattattatgtgcagcagtattaggtatcattgcattgtttttctatatttttagatttaatgttttgacatataaagagttaacttatttaccatttggttcaaagttgtatcaaattaagaaaggaagacgt

SEQ ID NO: 2326 - protein, 509 aa, Staphylococcus aureus
  MISC_FEATURE (1)..(509): hypothetical protein
VMKHKEAFNGVVVLTAALIVIKILSAVYRIPYQNILGDTGLYAYQQVYPIVALGMILSMNAIPSAITQNIGKYHSDEAYAKAVAYIQLVGILLFIAIFVFANNIAHMMGDGHLTPMIQAASLSFIFIGMLGVLRGYYQSANNMTVPAISQVIEQVIRVGIIIVTIVIFVDRGWTIYEAGTIAILASTIGFLGSSIYLVAHRPFKFKMVNNTAKIVWKQFALSVLIFAISQLIVILWQVIDSVTIIKSLQAIRVPFDVAITEKGVYDRGASFIQMGLIVTTTFSFALIPLLSDAIKMNNQVLMNRYANASLKITILISTAAGIGLINLLPLMNGVFFKTNDLTLTLSVYMITVICVSLIMMDMALLQAQHAVRPIFVGMTAGLVIKFILNIILIRLSGIIGASISTVVSLIIFGTIIHIAVTRKYHLYAMRRFFINVVLGMVFMSIVVQCVLNIVTTHGRITGLIELLCAAVLGIIALFFYIFRFNVLTYKELTYLPFGSKLYQIKKGRR

SEQ ID NO: 2327 - DNA, 3504 bp, Staphylococcus aureus
atgacaatattgacaacgcttataaaagaagataatcattttcaagaccttaatcaggtatttggacaagcaaacacactagtaactggtctttccccgtcagctaaagtgacgatgattgctgaaaaatatgcacaaagtaatcaacagttattattaattaccaataatttataccaagcagataaattagaaacagatttacttcaatttatagatgctgaagaattgtataagtatcctgtgcaagatattatgaccgaagagttttcaacacaaagccctcaactgatgagtgaacgtattagaactttaactgcgttagctcaaggtaagaaagggttatttatcgttcctttaaatggtttgaaaaagtggttaactcctgttgaaatgtggcaaaatcaccaaatgacattgcgtgttggtgaggatatcgatgtggaccaatttcttaacaaattagttaatatggggtacaaacgggaatccgtggtatcgcatattggtgaattctcattgcgaggaggtattatcgatatctttccgctaattggggaaccaatcagaattgagctatttgataccgaaattgattctattcgggattttgatgttgaaacgcagcgttccaaagataatgttgaagaagtcgatatcacaactgcaagtgattatatcattactgaagaagtgatcagccatcttaaagaagagttaaaaactgcatatgaaaatacaagacccaaaatagataaatcagtgcgcaatgatttgaaagaaacgtatgaaagctttaaattattcgaaagtacatactttgatcatcaaatactacgtcgcttagtagcgtttatgtatgaaacaccttcgacaattattgagtatttccaaaaagatgcaatcattgcagttgatgaatttaatcgtattaaagaaactgaagaaagtttaacagtagagtctgattcgtttattagcaatattattgaaagtggtaatggatttataggacaaagttttataaaatatgatgattttgaaacattgattgaaggctatcctgtcacttatttttcattattcgctacaacaatgccgataaaactaaatcatattattaaattttcatgtaaacctgtccaacaattttatgggcaatatgacattatgcgttctgaatttcaacgatatgttaatcaaaactatcatatcgtggttttggtcgaaaccgaaactaaagttgaacgtatgcaagcgatgttaagtgaaatgcatattccatcaataacaaaattgcatcgctcaatgtcatcggggcaagcagtgattattgaaggcagtttatctgaaggatttgaactacctgatatgggattagttgtcattactgagcgtgagctttttaaatcaaaacagaaaaagcaacgaaaacgtacgaaagctatctcaaatgctgaaaaaattaagtcttaccaagatttaaatgtgggagattatattgttcatgtgcatcatggtgttggtagatatttaggtgttgagacgctcgaagtggggcaaacgcatcgtgattatattaaattgcaatataaaggtacggatcaactatttgttccagtagatcaaatggatcaagttcaaaaatatgtagcttcggaagataagacgccaaaattaaataaactcggtggcagtgaatggaaaaaaacaaaagctaaagttcaacaaagtgttgaagatattgctgaagagttgattgatttatataaagaaagagaaatggcagaaggttatcaatatggggaagacacagctgagcaaacaacatttgaattagattttccatatgaacttacgcctgaccaagctaaatctatcgatgaaattaaagatgacatgcaaaaatcgcgtccaatggatcgcttgctatgtggtgatgttggttatggtaaaactgaagttgcagtgagagcagcattcaaagctgtaatggaaggaaagcaggttgcatttttagttcctacaactattttagctcagcaacattatgagacgttaattgagcgtatgcaagattttcctgttgaaattcaattaatgagtcgttttagaacgcctaaagagataaaacaaactaaggaaggacttaaaactggatttgttgacatagttgttggtacacacaaattacttagtaaagatatacagtataaagatttagggctgttgattgtagatgaagaacaacgatttggtgtacgccataaagagcgtattaaaacattaaaacataatgtagatgtactaacattgactgcaaccccaatacctagaacattgcatatgagtatgctaggtgtgcgggatttgtcagtgattgaaacgccgccagaaaatcgtttcccagttcaaacatatgtattagaacagaacatgagttttatcaaagaagctttagaaagagaactatcccgtgatggccaagtgttttatctttataataaagtgcaatccatttatgaaaaacgagaacaactccagatgttaatgccagatgctaacattgcagttgctcatggacaaatgacagagcgcgatttagaagaaacgatgttaagttttatcaataatgaatatgatattttagtaacgacgacgattattgaaacaggtgtcgatgtcccaaatgcaaatactttgatcattgaagatgcagatcgctttggattgagtcagttgtatcaattaagaggtcgtgttggtcgttcaagtcgtattggttatgcatacttcttacatccagcaaataaggtactaactgagactgcagaagatcgattacaagcgattaaagaatttacggagttaggctcaggatttaagattgcgatgcgtgatttgaacattcgtggtgctggtaatttgttaggtaaacaacagcacggctttattgatacagttggatttgatttgtacagtcaaatgttagaagaagctgtaaatgaaaaacgtggtattaaggaaccagaatctgaggtgccagaagtcgaagttgatttaaacttggatgcatatttgccaacagaatatattgcaaatgaacaagctaaaattgaaatttataaaaagctacgaaaaactgaaacatttgatcaaattatcgacattaaagatgaattaattgatcgtttcaatgattatcctgttgaagtagcacgtttgcttgatatagtggaaataaaagtacacgcattacattcaggtatcacgttgattaaagataaagggaaaataattgatattcatttatctgtaaaagccactgaaaatattgatggcgaagtgctgttcaaagcaacacaacctttaggtagaacaatgaaggttggtgttcaaaataatgcaatgacaattactttaacgaaacaaaatcaatggcttgatagtttgaagtttttagttaagtgcattgaagaaagtatgagaatcagtgatgaagca

SEQ ID NO: 2328 - protein, 1168 aa, Staphylococcus aureus
  MISC_FEATURE (1)..(1168): transcription-repair coupling
MTILTTLIKEDNHFQDLNQVFGQANTLVTGLSPSAKVTMIAEKYAQSNQQLLLITNNLYQADKLETDLLQFIDAEELYKYPVQDIMTEEFSTQSPQLMSERIRTLTALAQGKKGLFIVPLNGLKKWLTPVEMWQNHQMTLRVGEDIDVDQFLNKLVNMGYKRESVVSHIGEFSLRGGIIDIFPLIGEPIRIELFDTEIDSIRDFDVETQRSKDNVEEVDITTASDYIITEEVISHLKEELKTAYENTRPKIDKSVRNDLKETYESFKLFESTYFDHQILRRLVAFMYETPSTIIEYFQKDAIIAVDEFNRIKETEESLTVESDSFISNIIESGNGFIGQSFIKYDDFETLIEGYPVTYFSLFATTMPIKLNHIIKFSCKPVQQFYGQYDIMRSEFQRYVNQNYHIVVLVETETKVERMQAMLSEMHIPSITKLHRSMSSGQAVIIEGSLSEGFELPDMGLVVITERELFKSKQKKQRKRTKAISNAEKIKSYQDLNVGDYIVHVHHGVGRYLGVETLEVGQTHRDYIKLQYKGTDQLFVPVDQMDQVQKYVASEDKTPKLNKLGGSEWKKTKAKVQQSVEDIAEELIDLYKEREMAEGYQYGEDTAEQTTFELDFPYELTPDQAKSIDEIKDDMQKSRPMDRLLCGDVGYGKTEVAVRAAFKAVMEGKQVAFLVPTTILAQQHYETLIERMQDFPVEIQLMSRFRTPKEIKQTKEGLKTGFVDIVVGTHKLLSKDIQYKDLGLLIVDEEQRFGVRHKERIKTLKHNVDVLTLTATPIPRTLHMSMLGVRDLSVIETPPENRFPVQTYVLEQNMSFIKEALERELSRDGQVFYLYNKVQSIYEKREQLQMLMPDANIAVAHGQMTERDLEETMLSFINNEYDILVTTTIIETGVDVPNANTLIIEDADRFGLSQLYQLRGRVGRSSRIGYAYFLHPANKVLTETAEDRLQAIKEFTELGSGFKIAMRDLNIRGAGNLLGKQQHGFIDTVGFDLYSQMLEEAVNEKRGIKEPESEVPEVEVDLNLDAYLPTEYIANEQAKIEIYKKLRKTETFDQIIDIKDELIDRFNDYPVEVARLLDIVEIKVHALHSGITLIKDKGKIIDIHLSVKATENIDGEVLFKATQPLGRTMKVGVQNNAMTITLTKQNQWLDSLKFLVKCIEESMRISDEA

SEQ ID NO: 2329 - DNA, 354 bp, Staphylococcus aureus
atgaaaaagaaaaaaggttttggtcttggtattagtttaatcgccatcatgttaattgtatgtattgtattagtaatcatgatgatgactggcggaaagaaagatacatactatggaattatgaaagataatactactattgaaaaaatgattagtgaaaaagatgaaagtattgaaaaaaatgttaaattaccttcagattcagatgttaaagttaaaaaaggtgattttgtaattgtttataaattagcagattcagataaaattgttaaagttaaaaaagttgaccatgacgatgtaccacatggtttaatgatgaaaattcatgacatgggcaaaatgcacatgaaacac

SEQ ID NO: 2330 - protein, 118 aa, Staphylococcus aureus
  MISC_FEATURE (1)..(118): hypothetical protein
MKKKKGFGLGISLIAIMLIVCIVLVIMMMTGGKKDTYYGIMKDNTTIEKMISEKDESIEKNVKLPSDSDVKVKKGDFVIVYKLADSDKIVKVKKVDHDDVPHGLMMKIHDMGKMHMKH

SEQ ID NO: 2331 - DNA, 570 bp, Staphylococcus aureus
atgaaatgtattgtaggtctaggtaatataggtaaacgttttgaacttacaagacataatatcggctttgaagtcgttgattatattttagagaaaaataatttttcattagataaacaaaagtttaaaggtgcatatacaattgaacgaatgaacggcgataaagtgttatttatcgaaccaatgacaatgatgaatttgtcaggtgaagcagttgcaccgattatggattattacaatgttaatccagaagatttaattgtcttatatgatgatttagatttagaacaaggacaagttcgcttaagacaaaaaggaagtgcgggcggtcacaatggtatgaaatcaattattaaaatgcttggtacagaccaatttaaacgtattcgtattggtgtgggaagaccaacgaatggtatgacggtacctgattatgttttacaacgcttttcaaatgatgaaatggtaacgatggaaaaagttatcgaacacgcagcacgcgcaattgaaaagtttgttgaaacatcacgatttgaccatgttatgaatgaatttaatggtgaagtgaaa

SEQ ID NO: 2332 - protein, 190 aa, Staphylococcus aureus
  MISC_FEATURE (1)..(190): peptidyl-tRNA hydrolase
MKCIVGLGNIGKRFELTRHNIGFEVVDYILEKNNFSLDKQKFKGAYTIERMNGDKVLFIEPMTMMNLSGEAVAPIMDYYNVNPEDLIVLYDDLDLEQGQVRLRQKGSAGGHNGMKSIIKMLGTDQFKRIRIGVGRPTNGMTVPDYVLQRFSNDEMVTMEKVIEHAARAIEKFVETSRFDHVMNEFNGEVK

SEQ ID NO: 2333 - DNA, 663 bp, Staphylococcus aureus
gtggaaatgagaatggcttcattaaagtcaatcatccgtcaaggtaaacaaacacgttcagatcttaaacaattaagaaaatctggtaaagtaccagcagtagtatacggttacggtactaaaaacgtgtcagttaaagttgatgaagtagaattcatcaaagttatccgtgaagtaggtcgtaacggtgttatcgaattaggcgttggttctaaaactatcaaagttatggttgcagactaccaattcgatccacttaaaaaccaaattactcacattgacttcttagcaatcaatatgagtgaagaacgtactgttgaagtaccagttcaattagttggtgaagcagtaggcgctaaagaaggcggcgtagttgaacaaccattattcaacttagaagtaactgctactccagacaatattccagaagcaatcgaagtagacattactgaattaaacattaacgacagcttaactgttgctgatgttaaagtaactggcgacttcaaaatcgaaaacgattcagctgaatcagtagtaacagtagttgctccaactgaagaaccaactgaagaagaaatcgaagctatggaaggcgaacaacaaactgaagaaccagaagttgttggcgaaagcaaagaagacgaagaaaaaactgaagag

SEQ ID NO: 2334 - protein, 221 aa, Staphylococcus aureus
  MISC_FEATURE (1)..(221): 50S ribosomal protein L25
VEMRMASLKSIIRQGKQTRSDLKQLRKSGKVPAVVYGYGTKNVSVKVDEVEFIKVIREVGRNGVIELGVGSKTIKVMVADYQFDPLKNQITHIDFLAINMSEERTVEVPVQLVGEAVGAKEGGVVEQPLFNLEVTATPDNIPEAIEVDITELNINDSLTVADVKVTGDFKIENDSAESVVTVVAPTEEPTEEEIEAMEGEQQTEEPEVVGESKEDEEKTEE

SEQ ID NO: 2335 - DNA, 963 bp, Staphylococcus aureus
atgttaaataatgaatataagaattcgtcattaaagattttttcattgaaaggaaacgaagcattagcgcaagaagttgctgaccaagtaggaattgaactaggtaaatgttcagttaaacgttttagtgatggagaaattcaaattaatatcgaagagagtattcgtggttgtgacgtatttattattcaaccaacatcatatcctgtgaatctacatttaatggaattattaattatgattgatgcttgtaaacgtgcttctgcagcaacaatcaatattgtagtgccatattatggatatgcaagacaagatagaaaagcccgtagccgtgagccaatcactgctaaattagttgcaaacttaatcgaaacagctggcgcaactcgtatgattgcgttagacttacatgcaccacaaattcaaggattctttgatattccaattgaccacttaatgggtgtgccaattcttgctaaacatttcaaagatgatccgaatattaacccagaagaatgtgtcgttgtttcaccagaccatggcggcgttacacgtgcacgtaaattagctgacattttaaaaactccaattgcaattatagataaacgtcgtcctagaccaaatgttgctgaagtgatgaacattgttggtgagattgaaggacgtacggcaattattattgacgatattattgatacagcaggtacaatcactttagctgcacaagcattaaaagataaaggtgctaaagaagtatatgcttgttgtacacaccctgttttatcaggaccggctaaagaacgtatcgaaaattctgctataaaagaattaatcgtaacaaactcaattcatttagatgaagatcgcaaaccatctaacactaaagaattatctgttgctggtttaatcgcacaagctatcattcgtgtatacgaaagagaatcagttagcgtattatttgac

SEQ ID NO: 2336 - protein, 321 aa, Staphylococcus aureus
  MISC_FEATURE (1)..(321): ribose-phosphate
MLNNEYKNSSLKIFSLKGNEALAQEVADQVGIELGKCSVKRFSDGEIQINIEESIRGCDVFIIQPTSYPVNLHLMELLIMIDACKRASAATINIVVPYYGYARQDRKARSREPITAKLVANLIETAGATRMIALDLHAPQIQGFFDIPIDHLMGVPILAKHFKDDPNINPEECVVVSPDHGGVTRARKLADILKTPIAIIDKRRPRPNVAEVMNIVGEIEGRTAIIIDDIIDTAGTITLAAQALKDKGAKEVYACCTHPVLSGPAKERIENSAIKELIVTNSIHLDEDRKPSNTKELSVAGLIAQAIIRVYERESVSVLFD

SEQ ID NO: 2337 - DNA, 1356 bp, Staphylococcus aureus
atgttcatgcgaagacacgcgataattttggcagcaggtaaaggcacaagaatgaaatctaaaaagtataaagtgctacacgaggttgctgggaaacctatggtcgaacatgtattggaaagtgtgaaaggctctggtgtcgatcaagttgtaaccatcgtaggacatggtgctgaaagtgtaaaaggacatttaggcgagcgttctttatacagttttcaagaggaacaactcggtactgcgcatgcagtgcaaatggcgaaatcacacttagaagacaaggaaggtacgacaatcgttgtatgtggtgacacaccgctcatcacaaaggaaacattagtaacattgattgcgcatcacgaggatgctaatgctcaagcaactgtattatctgcatcgattcaacaaccatatggatacggaagaatcgttcgaaatgcgtcaggtcgtttagaacgcatagttgaagagaaagatgcaacgcaagctgaaaaggatattaatgaaattagttcaggtatttttgcgtttaataataaaacgttgtttgaaaaattaacacaagtgaaaaatgataatgcgcaaggtgaatattacctccctgatgtattgtcgttaattttaaatgatggcggcatcgtagaagtctatcgtaccaatgatgttgaagaaatcatgggtgtaaatgatcgtgtaatgcttagtcaggctgagaaggcgatgcaacgtcgtacgaatcattatcacatgctaaatggtgtgacaatcatcgatcctgacagcacttatattggtccagacgttacaattggtagtgatacagtcattgaaccaggcgtacgaattaatggtcgtacagaaattggcgaagatgttgttattggtcagtactctgaaattaacaatagtacgattgaaaatggtgcatgtattcaacagtctgttgttaatgatgctagcgtaggagcgaatactaaggtcggaccgtttgcgcaattgagaccaggcgcgcaattaggtgcagatgttaaggttggaaattttgtagaaattaaaaaagcagatcttaaagatggtgccaaggtttcacatttaagttatattggcgatgctgtaattggcgaacgtactaatattggttgcggaacgattacagttaactatgatggtgaaaataaatttaaaactatcgtcggcaaagattcatttgtaggttgcaatgttaatttagtagcacctgtaacaattggtgatgatgtattggtggcagctggttccacaatcacagatgacgtaccaaatgacagtttagctgtggcaagagcaagacaaacaacaaaagaaggatataggaaa

SEQ ID NO: 2338 - protein, 452 aa, Staphylococcus aureus
  MISC_FEATURE (1)..(452): UDP-N-acetylglucosamine
MFMRRHAIILAAGKGTRMKSKKYKVLHEVAGKPMVEHVLESVKGSGVDQVVTIVGHGAESVKGHLGERSLYSFQEEQLGTAHAVQMAKSHLEDKEGTTIVVCGDTPLITKETLVTLIAHHEDANAQATVLSASIQQPYGYGRIVRNASGRLERIVEEKDATQAEKDINEISSGIFAFNNKTLFEKLTQVKNDNAQGEYYLPDVLSLILNDGGIVEVYRTNDVEEIMGVNDRVMLSQAEKAMQRRTNHYHMLNGVTIIDPDSTYIGPDVTIGSDTVIEPGVRINGRTEIGEDVVIGQYSEINNSTIENGACIQQSVVNDASVGANTKVGPFAQLRPGAQLGADVKVGNFVEIKKADLKDGAKVSHLSYIGDAVIGERTNIGCGTITVNYDGENKFKTIVGKDSFVGCNVNLVAPVTIGDDVLVAAGSTITDDVPNDSLAVARARQTTKEGYRK

SEQ ID NO: 2339 - DNA, 129 bp, Staphylococcus aureus
ttgcgtttgaatgatgctcgtatttttgaagtaagaaaaaagttgtttttaaaattacaacgaattaaaaacaatgccttttatatgttgaaagagtattgcagattaaattataataatgacgaagtg

SEQ ID NO: 2340 - protein, 43 aa, Staphylococcus aureus
LRLNDARIFEVRKKLFLKLQRIKNNAFYMLKEYCRLNYNNDEV

SEQ ID NO: 2341 - DNA, 300 bp, Staphylococcus aureus
atgaaagtgacagatgtaagacttagaaaaatacaaacagatggacgaatgaaagcactcgtttccattacattagatgaagctttcgtaattcatgatttacgtgtaattgaaggaaactctggcttgttcgttgcaatgccaagtaaacgtacaccagatggtgaattccgcgacatcgcgcatcctattaattcagatatgagacaagaaattcaagatgcagtgatgaaagtatatgatgaaacagatgaagtagtaccagataaaaacgctacatcagaagattcagaagaagct

SEQ ID NO: 2342 - protein, 100 aa, Staphylococcus aureus
  MISC_FEATURE (1)..(100): stage V sporulation protein
MKVTDVRLRKIQTDGRMKALVSITLDEAFVIHDLRVIEGNSGLFVAMPSKRTPDGEFRDIAHPINSDMRQEIQDAVMKVYDETDEVVPDKNATSEDSEEA

SEQ ID NO: 2343 - DNA, 378 bp, Staphylococcus aureus
atgaaaatcattaacacaacaagattaccggaagcacttggaccatattcgcatgcaacagttgtgaatggtatggtttatacttctggtcagattccattgaatattgatggacatatcgtaagcgctgatgttcaagcacagacaaaacaagttttagaaaatttaaaggttgttttggaagaagcaggatctgatttgaattctgttgcgaaagcgaccattttcattaaagatatgaatgatttccaaaaaataaatgaagtgtatggtcaatattttaatgaacacaagccagcgcgtagttgtgtagaggttgcgcgtttgccaaaagatgtgaaagtagaaattgaattagtaagtaaaattaaggaatta

SEQ ID NO: 2344 - protein, 126 aa, Staphylococcus aureus
  MISC_FEATURE (1)..(126): translation initiation
MKIINTTRLPEALGPYSHATVVNGMVYTSGQIPLNIDGHIVSADVQAQTKQVLENLKVVLEEAGSDLNSVAKATIFIKDMNDFQKINEVYGQYFNEHKPARSCVEVARLPKDVKVEIELVSKIKEL

SEQ ID NO: 2345 - DNA, 822 bp, Staphylococcus aureus
atgagatataaacgaagcgagagaattgtttttatgacgcaatatttgatgaaccatccgaataaattgattccattaactttttttgtgaaaaaatttaaacaggcgaagtcttcaataagtgaagatgtccaaattataaaaaatacattccaaaaagaaaagttaggtacagtaattactactgctggcgcaagtggtggtgttacgtataaaccaatgatgagtaaagaagaggcgactgaagttgttaatgaggtcattactctattagaagagaaagaacgtttgttacctggcggatatttatttttatcagatttggtaggtaatccatcgctactaaacaaagttggtaagttaattgccagtatttacatggaagaaaaattagatgctgttgttaccattgcgacaaaaggtatttcattggcaaatgcggttgctaatattttaaatttaccagtagtagtgattagaaaagacaacaaggtgactgaaggttctacagtttcaattaattacgtttcaggatcttcaagaaaaatagaaacaatggtactttcgaagagaactttagcagaaaattcaaatgttttagttgtcgatgattttatgagggctggtggctctattaatggtgttatgaatttaatgaatgagtttaaagcccatgtaaaaggggtatcagtacttgtagaatcaaaagaagttaaacaaagattgattgaagattatacttccttagtgaaattatctgatgtagatgaatataatcaagagtttaacgtagaacctggcaacagtttatctaagttttca

SEQ ID NO: 2346 - protein, 274 aa, Staphylococcus aureus
  MISC_FEATURE (1)..(274): pur operon repressor
MRYKRSERIVFMTQYLMNHPNKLIPLTFFVKKFKQAKSSISEDVQIIKNTFQKEKLGTVITTAGASGGVTYKPMMSKEEATEVVNEVITLLEEKERLLPGGYLFLSDLVGNPSLLNKVGKLIASIYMEEKLDAVVTIATKGISLANAVANILNLPVVVIRKDNKVTEGSTVSINYVSGSSRKIETMVLSKRTLAENSNVLVVDDFMRAGGSINGVMNLMNEFKAHVKGVSVLVESKEVKQRLIEDYTSLVKLSDVDEYNQEFNVEPGNSLSKFS

SEQ ID NO: 2347 - DNA, 846 bp, Staphylococcus aureus
atgatatatgaaacggcaccagccaaaattaattttacgctcgatacactttttaaaagaaatgatggctatcatgagattgaaatgataatgacaacagttgatttaaatgatcgtttaacttttcataaaagaaaagatcgaaagatagttgttgagattgaacataattatgtgccttctaatcataaaaatctcgcatatcgtgcagcgcaactatttattgagcaatatcaactaaagcaaggtgtaacaatttctatcgataaagaaatacctgtttctgctggcttagctggaggttcggctgatgcagcagcaacgttaagaggattgaatcgactttttgatataggggcgagtttggaagaattggctctactaggcagtaaaatcgggacagatattccgttttgtatttataataaaactgcactatgtactggaagaggagagaaaatcgagtttttaaataaaccaccttcagcttgggtgattcttgctaaaccaaacttaggcatatcatcaccagatatatttaagttgattaatttagataagcgttacgacgtacatacgaaaatgtgttatgaggccttagaaaatcgagattatcaacaattatgtcaaagtttgtctaatcgattagagccaatttctgtttcaaaacacccacaaatcgataaattaaaaaataatatgttgaaaagtggtgcagatggtgcgttaatgagtggaagcggacctactgtgtatgggctagcacgaaaagaaagccaagcaaaaaatatttataatgcagttaacggttgttgtaatgaagtgtacttagttagactattagga

SEQ ID NO: 2348 - protein, 282 aa, Staphylococcus aureus
  MISC_FEATURE (1)..(282): hypothetical protein
MIYETAPAKINFTLDTLFKRNDGYHEIEMIMTTVDLNDRLTFHKRKDRKIVVEIEHNYVPSNHKNLAYRAAQLFIEQYQLKQGVTISIDKEIPVSAGLAGGSADAAATLRGLNRLFDIGASLEELALLGSKIGTDIPFCIYNKTALCTGRGEKIEFLNKPPSAWVILAKPNLGISSPDIFKLINLDKRYDVHTKMCYEALENRDYQQLCQSLSNRLEPISVSKHPQIDKLKNNMLKSGADGALMSGSGPTVYGLARKESQAKNIYNAVNGCCNEVYLVRLLG

SEQ ID NO: 2349 - DNA, 261 bp, Staphylococcus aureus
atgccaaaatcaattttggacatcaaaaattctattgattgtcatgtaggaaatcgtattgtactgaaagccaatggaggccgtaagaaaacaataaaacgttctggaattttaaaagaaacatatccgtcagttttcattgttgagttagatcaagacaaacacaactttgagagagtatcttatacatacactgatgtgttaactgaaaatgttcaagtttcatttgaagaggataatcatcacgaatcaattgcacac

SEQ ID NO: 2350 - protein, 87 aa, Staphylococcus aureus
  MISC_FEATURE (1)..(87): VEG protein homologue
MPKSILDIKNSIDCHVGNRIVLKANGGRKKTIKRSGILKETYPSVFIVELDQDKHNFERVSYTYTDVLTENVQVSFEEDNHHESIAH

SEQ ID NO: 2351 - DNA, 915 bp, Staphylococcus aureus
atgatgactgaaaaacaatttaaattaactgtacaagataatacgaatattgaagttaaagtgaattttacagatgtagattcaaaaggaattattcatatatttcatggtatggctgaacatatggaacgttacgataaattagcacatgcactttcaaagcatggcttcgatgtgatacgtcataatcatcgaggacatggtattaatattgatgaatcaacaagagggcattacgatgatatgaaacgagttatcggtgatgcctttgaagtagcgcaaacagtgagaggcaatgttgataaaccatacattataatcggacattcaatgggatccgttatagctagattgtttgtagaaacatatccgcaatatgttgatggtctaattttaagtggtactggtatgtattcattatggaaaggtttaccaaccgttaaagtgttacaactgattacaaaaatttatggtgctgagaaacgagttgaatgggttaaccagttagtatcaaatagttttaataaaaaaatacgtccattacgtacacaaagtgattggatttctagtaatccaattgaagtagataactttattaaagatccatatagtggatttaatgtgtcaaatcaattattatatcaaacagcctattatatgctacatacatcacaattaaaaaatatgaaaatgttaaatcatgccatgcctatattattagtttcaggatatgacgatcctttaggtgattatggtaaagggattttaaaattggcgaatatatatagaaaagctggcattaaaaatgttaaagtgaatctttatcatcataaacgtcatgaagtgttatttgaaaaagatcatgacaaaatttgggaagacttgtttaaatggttgaatcaattttataaaaaa

SEQ ID NO: 2352 - protein, 305 aa, Staphylococcus aureus
  MISC_FEATURE (1)..(305): hypothetical protein
MMTEKQFKLTVQDNTNIEVKVNFTDVDSKGIIHIFHGMAEHMERYDKLAHALSKHGFDVIRHNHRGHGINIDESTRGHYDDMKRVIGDAFEVAQTVRGNVDKPYIIIGHSMGSVIARLFVETYPQYVDGLILSGTGMYSLWKGLPTVKVLQLITKIYGAEKRVEWVNQLVSNSFNKKIRPLRTQSDWISSNPIEVDNFIKDPYSGFNVSNQLLYQTAYYMLHTSQLKNMKMLNHAMPILLVSGYDDPLGDYGKGILKLANIYRKAGIKNVKVNLYHHKRHEVLFEKDHDKIWEDLFKWLNQFYKK

SEQ ID NO: 2353 - DNA, 909 bp, Staphylococcus aureus
atgaatgaggaagtgaaaatgttggataataaagatattgcaacaccatcaagaacgcgagcgttgttagataaatatggctttaattttaaaaaaagtttaggacagaactttttgatagatgtgaatatcattaataatatcattgatgcaagtgatattgatgcacaaactggggtgattgaaattggtccaggcatggggtcattgacagaacaattggccagacatgctaaaagagtattggcatttgaaattgatcaacgtttaatacctgtattaaatgatacactatcaccttatgataatgtgacggtgattaatgaagatattttaaaagcgaatattaaagaagctgttgaaaatcatttacaagattgtgaaaaaataatggttgttgcaaacctgccgtactatattacgacgccaattttattaaatttgatgcaacaagatataccaattgatggctacgtggtgatgatgcaaaaagaagtgggcgaacgcttaaatgctgaagtaggttcaaaagcatatggttcgttatcaattgtcgtacaatactatacagagactagtaaagtattaacggtacctaaatctgtatttatgccaccacctaatgttgattcaatagttgtaaaactgatgcagagaactgaaccgttagtaacagtagataacgaggaagcattctttaagttagcaaaagcagcatttgcacaaagaagaaagacaattaacaataactatcaaaattattttaaagatggtaaacaacacaaagaagtgattttacaatggttggaacaagcaggtattgatccaagacgtcgcggtgaaacgctatctattcaagattttgctaaattgtatgaagaaaagaaaaaattccctcaattagaaaat

SEQ ID NO: 2354 - protein, 303 aa, Staphylococcus aureus
  MISC_FEATURE (1)..(303): dimethyladenosine
MNEEVKMLDNKDIATPSRTRALLDKYGFNFKKSLGQNFLIDVNIINNIIDASDIDAQTGVIEIGPGMGSLTEQLARHAKRVLAFEIDQRLIPVLNDTLSPYDNVTVINEDILKANIKEAVENHLQDCEKIMVVANLPYYITTPILLNLMQQDIPIDGYVVMMQKEVGERLNAEVGSKAYGSLSIVVQYYTETSKVLTVPKSVFMPPPNVDSIVVKLMQRTEPLVTVDNEEAFFKLAKAAFAQRRKTINNNYQNYFKDGKQHKEVILQWLEQAGIDPRRRGETLSIQDFAKLYEEKKKFPQLEN

SEQ ID NO: 2355 - DNA, 534 bp, Staphylococcus aureus
atgaaaatcaatgagtttatagttgtagaaggacgagatgatactgagcgtgttaaacgagctgttgaatgtgatacgattgaaacgaatggtagtgccatcaacgaacaaactttagaagtaattagaaatgctcaacaaagtcgaggcgttattgtattaacagatccagatttcccaggagataaaattagaagtacaattactgaacatgtcaaaggtgttaaacatgcgtatattgatagagaaaaagctaaaaataaaaaagggaaaattggtgttgaacatgccgacttaattgatattaaagaagcgttaatgcatgttagttcaccctttgatgaagcttatgaatcaattgataaatctgtgctaatagagttggggttaattgttgggaaagatgcaaggcgccgtagagaaattttaagtagaaaattgcgaatcggccattccaatggtaagcagttattgaaaaagttaaatgcatttggttataccgaagcggatgtaaggcaagctttagaagatgaa

SEQ ID NO: 2356 - protein, 178 aa, Staphylococcus aureus
  MISC_FEATURE (1)..(178): conserved hypothetical
MKINEFIVVEGRDDTERVKRAVECDTIETNGSAINEQTLEVIRNAQQSRGVIVLTDPDFPGDKIRSTITEHVKGVKHAYIDREKAKNKKGKIGVEHADLIDIKEALMHVSSPFDEAYESIDKSVLIELGLIVGKDARRRREILSRKLRIGHSNGKQLLKKLNAFGYTEADVRQALEDE

SEQ ID NO: 2357 - DNA, 771 bp, Staphylococcus aureus
atgttaatcgatacacatgtccatttaaatgatgagcaatacgatgatgatttgagtgaagtgattacacgtgctagagaagcaggtgttgatcgtatgtttgtagttggttttaacaaatcgacaattgaacgcgcgatgaaattaatcgatgagtatgattttttatatggcattatcggttggcatccagttgacgcaattgattttacagaagaacacttggaatggattgaatctttagctcagcatccaaaagtgattggtattggtgaaatgggattagattatcactgggataaatctcctgcagatgttcaaaaggaagtttttagaaagcaaattgctttagctaagcgtttgaagttaccaattatcattcataaccgtgaagcaactcaagactgtatcgatatcttattggaggagcatgctgaagaggtaggcgggattatgcatagctttagtggttctccagaaattgcagatattgtaactaataagctgaatttttatatttcattaggtggacctgtgacatttaaaaatgctaaacagcctaaagaagttgctaagcatgtgtcaatggagcgtttgctagttgaaaccgatgcaccgtatctttcgccacatccgtatagagggaagcgaaatgaaccggcgagagtaactttagtagctgaacaaattgctgaattaaaaggcttatcttatgaagaagtgtgcgaacaaacaactaaaaatgcagagaaattgtttaatttaaattca

SEQ ID NO: 2358 - protein, 257 aa, Staphylococcus aureus
  MISC_FEATURE (1)..(257): conserved hypothetical
MLIDTHVHLNDEQYDDDLSEVITRAREAGVDRMFVVGFNKSTIERAMKLIDEYDFLYGIIGWHPVDAIDFTEEHLEWIESLAQHPKVIGIGEMGLDYHWDKSPADVQKEVFRKQIALAKRLKLPIIIHNREATQDCIDILLEEHAEEVGGIMHSFSGSPEIADIVTNKLNFYISLGGPVTFKNAKQPKEVAKHVSMERLLVETDAPYLSPHPYRGKRNEPARVTLVAEQIAELKGLSYEEVCEQTTKNAEKLFNLNS

SEQ ID NO: 2359 - DNA, 1971 bp, Staphylococcus aureus
atggctaaagaaacattttatataacaaccccaatatactatcctagtgggaatttacatataggacatgcatattctacagtggctggagatgttattgcaagatataagagaatgcaaggatatgatgttcgctatttgactggaacggatgaacacggtcaaaaaattcaagaaaaagctcaaaaagctggtaagacagaaattgaatatttggatgagatgattgctggaattaaacaattgtgggctaagcttgaaatttcaaatgatgattttatcagaacaactgaagaacgtcataaacatgtcgttgagcaagtgtttgaacgtttattaaagcaaggtgatatctatttaggtgaatatgaaggttggtattctgttccggatgaaacatactatacagagtcacaattagtagacccacaatacgaaaacggtaaaattattggtggcaaaagtccagattctggacacgaagttgaactagttaaagaagaaagttatttctttaatattagtaaatatacagaccgtttattagagttctatgaccaaaatccagattttatacaaccaccatcaagaaaaaatgaaatgattaacaacttcattaaaccaggacttgctgatttagctgtttctcgtacatcatttaactggggtgtccatgttccgtctaatccaaaacatgttgtttatgtttggattgatgcgttagttaactatatttcagcattaggctatttatcagatgatgagtcactatttaacaaatactggccagcagatattcatttaatggctaaggaaattgtgcgattccactcaattatttggcctattttattgatggcattagacttaccgttacctaaaaaagtctttgcacatggttggattttgatgaaagatggaaaaatgagtaaatctaaaggtaatgtcgtagaccctaatattttaattgatcgctatggtttagatgctacacgttattatctaatgcgtgaattaccatttggttcagatggcgtatttacacctgaagcatttgttgagcgtacaaatttcgatctagcaaatgacttaggtaacttagtaaaccgtacgatttctatggttaataagtactttgatggcgaattaccagcgtatcaaggtccacttcatgaattagatgaagaaatggaagctatggctttagaaacagtgaaaagctacactgaaagcatggaaagtttgcaattttctgtggcattatctacggtatggaagtttattagtagaacgaataagtatattgacgaaacaacgccttgggtattagctaaggacgatagccaaaaagatatgttaggcaatgtaatggctcacttagttgaaaatattcgttatgcagctgtattattacgtccattcttaacacatgcgccgaaagagatttttgaacaattgaacattaacaatcctcaatttatggaatttagtagtttagagcaatatggtgtgcttaatgagtcaattatggttactgggcaacctaaacctattttcccaagattggatagcgaagcggaaattgcatatatcaaagaatcaatgcaaccgcctgctactaaagaggaaaaagaagagattcctagcaaacctcaaattgatattaaagactttgataaagttgaaattaaggcagcaacgattattgatgctgaacatgttaagaagtcagataagcttttaaaaattcaagtagacttagattctgaacaaagacaaattgtatcaggaattgccaaattctatacaccagatgatattattggtaaaaaagtagcagttgttactaacctgaaaccagctaaattaatgggacaaaaatctgaaggtatgatattatctgctgaaaaagatggtgtattaaccttagtaagtttaccaagtgcaattccaaatggtgcagtgattaaa

SEQ ID NO: 2360 - protein, 657 aa, Staphylococcus aureus
  MISC_FEATURE (1)..(657): methionyl-tRNA synthetase
MAKETFYITTPIYYPSGNLHIGHAYSTVAGDVIARYKRMQGYDVRYLTGTDEHGQKIQEKAQKAGKTEIEYLDEMIAGIKQLWAKLEISNDDFIRTTEERHKHVVEQVFERLLKQGDIYLGEYEGWYSVPDETYYTESQLVDPQYENGKIIGGKSPDSGHEVELVKEESYFFNISKYTDRLLEFYDQNPDFIQPPSRKNEMINNFIKPGLADLAVSRTSFNWGVHVPSNPKHVVYVWIDALVNYISALGYLSDDESLFNKYWPADIHLMAKEIVRFHSIIWPILLMALDLPLPKKVFAHGWILMKDGKMSKSKGNVVDPNILIDRYGLDATRYYLMRELPFGSDGVFTPEAFVERTNFDLANDLGNLVNRTISMVNKYFDGELPAYQGPLHELDEEMEAMALETVKSYTESMESLQFSVALSTVWKFISRTNKYIDETTPWVLAKDDSQKDMLGNVMAHLVENIRYAAVLLRPFLTHAPKEIFEQLNINNPQFMEFSSLEQYGVLNESIMVTGQPKPIFPRLDSEAEIAYIKESMQPPATKEEKEEIPSKPQIDIKDFDKVEIKAATIIDAEHVKKSDKLLKIQVDLDSEQRQIVSGIAKFYTPDDIIGKKVAVVTNLKPAKLMGQKSEGMILSAEKDGVLTLVSLPSAIPNGAVIK

SEQ ID NO: 2361 - DNA, 837 bp, Staphylococcus aureus
atggctgtattatatttagtgggcacaccaattggtaatttagcagatattacttatagagcagttgatgtattgaaacgtgttgatatgattgcttgtgaagacactagagtaactagtaaactgtgtaatcattatgatattccaactccattaaagtcatatcacgaacataacaaggataagcagactgcttttatcattgaacagttagaattaggtcttgacgttgcgctcgtatctgatgctggattgcccttaattagtgatcctggatacgaattagtagtggcagccagagaagctaatattaaagtagagactgtgcctggacctaatgctgggctgacggctttgatggctagtggattaccttcatatgtatatacatttttaggatttttgccacgaaaagagaaagaaaaaagtgctgtattagagcaacgtatgcatgaaaatagcacattaattatatacgaatcaccgcatcgtgtgacagatacattaaaaacaattgcaaagatagatgcaacacgacaagtatcactagggcgtgaattaactaagaagttcgaacaaattgtaactgatgatgtaacacaattacaagcattgattcagcaaggcgatgtaccattgaaaggcgaattcgttatcttaattgaaggtgctaaagcgaacaatgagatatcgtggtttgatgatttatctatcaatgagcatgttgatcattatattcaaacttcacagatgaaaccaaaacaagctattaaaaaagttgctgaagaacgacaacttaaaacgaatgaagtatataatatttatcatcaaataagt

SEQ ID NO: 2362 - protein, 279 aa, Staphylococcus aureus
  MISC_FEATURE (1)..(279): conserved hypothetical
MAVLYLVGTPIGNLADITYRAVDVLKRVDMIACEDTRVTSKLCNHYDIPTPLKSYHEHNKDKQTAFIIEQLELGLDVALVSDAGLPLISDPGYELVVAAREANIKVETVPGPNAGLTALMASGLPSYVYTFLGFLPRKEKEKSAVLEQRMHENSTLIIYESPHRVTDTLKTIAKIDATRQVSLGRELTKKFEQIVTDDVTQLQALIQQGDVPLKGEFVILIEGAKANNEISWFDDLSINEHVDHYIQTSQMKPKQAIKKVAEERQLKTNEVYNIYHQIS

SEQ ID NO: 2363 - DNA, 246 bp, Staphylococcus aureus
atggatagtcattttgtatatattgtaaaatgtagtgatggaagtttatatacaggatacgctaaagacgttaatgcacgtgttgaaaaacataaccgaggtcaaggagccaaatatacgaaagtaagacgtccggtgcatttagtttatcaagaaatgtatgagacaaagtctgaagcattgaagcgtgaatatgaaattaaaacttataccagacaaaagaaattgcgattaattaaggagcga

SEQ ID NO: 2364 - protein, 82 aa, Staphylococcus aureus
  MISC_FEATURE (1)..(82): conserved hypothetical
MDSHFVYIVKCSDGSLYTGYAKDVNARVEKHNRGQGAKYTKVRRPVHLVYQEMYETKSEALKREYEIKTYTRQKKLRLIKER

SEQ ID NO: 2365 - DNA, 723 bp, Staphylococcus aureus
atgttaaaagagaatgaacgatttgatcaactaatcaaagaagattttagtattattcaaaatgatgatgttttttcattttcaacggatgctttgttgttagggcattttacaaaacctagaacaaaagatattgtgttggacttatgttcaggcaatggggtgatacccttgttattgtttgcgaaacatccacgacatatagaaggtgttgagattcaaaaaacacttgtcgatatggcgcgacgcacatttcaattcaatgatgttgatgaatatttaacaatgcatcacatggatttgaaaaacgttactaaagtatttaaaccttcacaatatactttagtaacgtgtaatccgccttattttaaagagaatcagcaacaccaacatcaaaaagaagcacataagatagcgagacatgagattatgtgtacacttgaagattgcatgattgcagcccgtcatttattaaaagaaggtggcaggctaaacatggtacatcgtgcagagagactaatggatgtcttgtttgaaatgagaaaagtgaatattgaacctaagaaagtcgtttttatatatagtaaagtagggaaatcagcacaaacgatagtagtagaaggtcgaaaaggtggaaatcaaggtttagaaatcatgcccccattttatatttataatgaagatggtaattatagcgaagaaatgaaggaagtatattatgga

SEQ ID NO: 2366 - protein, 241 aa, Staphylococcus aureus
  MISC_FEATURE (1)..(241): conserved hypothetical
MLKENERFDQLIKEDFSIIQNDDVFSFSTDALLLGHFTKPRTKDIVLDLCSGNGVIPLLLFAKHPRHIEGVEIQKTLVDMARRTFQFNDVDEYLTMHHMDLKNVTKVFKPSQYTLVTCNPPYFKENQQHQHQKEAHKIARHEIMCTLEDCMIAARHLLKEGGRLNMVHRAERLMDVLFEMRKVNIEPKKVVFIYSKVGKSAQTIVVEGRKGGNQGLEIMPPFYIYNEDGNYSEEMKEVYYG

SEQ ID NO: 2367 - DNA, 345 bp, Staphylococcus aureus
ttggatcgcaatgaaatatttgaaaaaataatgcgtttagaaatgaatgtcaatcaactttcaaaggaaacttcagaattaaaggcacttgcagttgaattagtagaagaaaatgtagcgcttcaacttgaaaatgataatttgaaaaaggtgttgggcaatgatgaaccaactactattgatactgcgaattcaaaaccagcaaaagctgtgaaaaagccattaccaagtaaagataatttggctatattgtatggagaaggatttcatatttgtaaaggcgaattatttggaaaacatcgacatggtgaagattgtctgttctgtttagaagttttaagtgat

SEQ ID NO: 2368 - protein, 115 aa, Staphylococcus aureus
  MISC_FEATURE (1)..(115): conserved hypothetical
LDRNEIFEKIMRLEMNVNQLSKETSELKALAVELVEENVALQLENDNLKKVLGNDEPTTIDTANSKPAKAVKKPLPSKDNLAILYGEGFHICKGELFGKHRHGEDCLFCLEVLSD

SEQ ID NO: 2369 - DNA, 801 bp, Staphylococcus aureus
atgccaaatgtaataggtgttcagtttcaaaaagcgggaaaattagaatattatacacctaatgatatacaagtagatatagaagactgggtagttgtcgaatctaaaagaggcatagagataggtattgttaaaaatccattaatggatattgctgaagaggatgttgtgttacctcttaaaaatattattcgcattgctgatgacaaagatattgataaatttaattgtaatgaacgagatgctgaaaatgcattaatactatgtaaagacattgtaagagaacaaggtttggacatgcgtttagtcaattgcgaatatacattagataaatcgaaagttatttttaattttacggcggatgatcgtattgattttagaaaattagtaaaaatattagcgcaacatttaaaaacacgtatcgagttgagacaaattggtgtaagggatgaagccaaattgcttggcggtatcggaccttgtggtaggtcgttatgttgttctacatttttaggggattttgaaccagtatcgattaagatggctaaggatcaaaatttatcattaaatccaactaaaatttctggtgcatgtggtcgtttgatgtgttgtttaaaatatgaaaatgactattatgaggaagtacgtgcacaattacctgatattggtgaagcaattgaaacgcctgatggtaacgggaaagtagttgctttaaatatattagacatttctatgcaggtgaagcttgagggacatgaacagccacttgaatataaattagaagaaatagaaactatgcat

SEQ ID NO: 2370 - protein, 267 aa, Staphylococcus aureus
  MISC_FEATURE (1)..(267): hypothetical protein
MPNVIGVQFQKAGKLEYYTPNDIQVDIEDWVVVESKRGIEIGIVKNPLMDIAEEDVVLPLKNIIRIADDKDIDKFNCNERDAENALILCKDIVREQGLDMRLVNCEYTLDKSKVIFNFTADDRIDFRKLVKILAQHLKTRIELRQIGVRDEAKLLGGIGPCGRSLCCSTFLGDFEPVSIKMAKDQNLSLNPTKISGACGRLMCCLKYENDYYEEVRAQLPDIGEAIETPDGNGKVVALNILDISMQVKLEGHEQPLEYKLEEIETMH

SEQ ID NO: 2371 - DNA, 924 bp, Staphylococcus aureus
atggatgaacagcaacaattgacgaatgcatatcattcaaataaattatcgcatgcctatttatttgaaggtgatgatgcacaaacgatgaaacaagttgcgattaattttgcaaagcttattttatgtcaaacagatagtcaatgtgaaacaaaggttagtacatataatcatccagactttatgtatatatcaacaactgagaatgcaattaagaaagaacaagttgaacaacttgtgcgtcatatgaatcaacttcctatagaaagcacaaataaagtgtacatcattgaagactttgaaaagttaactgttcaaggggaaaacagtatcttgaaatttcttgaagaaccaccggacaatacgattgctattttattgtctacaaaacctgagcaaattttagacacaatccattcaaggtgtcagcatgtatatttcaagcctattgataaagaaaagtttataaatagattagttgaacaaaacatgtctaagccagtagctgaaatgattagtacttatactacgcaaatagataatgcaatggctttaaatgaagaatttgatttattagcattaaggaaatcagttatacgttggtgtgaattgttgcttactaataagccaatggcacttataggtattattgatttattgaaacaggctaaaaataaaaaactgcaatctttaactattgcagctgtgaatggtttcttcgaagatatcatacatacaaaggtaaatgtagaggataaacaaatatatagtgatttaaaaaatgatattgatcaatatgcgcaaaagttgtcgtttaatcaattaattttgatgtttgatcaactgacggaagcacataagaaattgaatcaaaatgtaaatccaacgcttgtatttgaacaaatcgtaattaagggtgtgagt

SEQ ID NO: 2372 - protein, 308 aa, Staphylococcus aureus
  MISC_FEATURE (1)..(308): probable DNA polymerase III
MDEQQQLTNAYHSNKLSHAYLFEGDDAQTMKQVAINFAKLILCQTDSQCETKVSTYNHPDFMYISTTENAIKKEQVEQLVRHMNQLPIESTNKVYIIEDFEKLTVQGENSILKFLEEPPDNTIAILLSTKPEQILDTIHSRCQHVYFKPIDKEKFINRLVEQNMSKPVAEMISTYTTQIDNAMALNEEFDLLALRKSVIRWCELLLTNKPMALIGIIDLLKQAKNKKLQSLTIAAVNGFFEDIIHTKVNVEDKQIYSDLKNDIDQYAQKLSFNQLILMFDQLTEAHKKLNQNVNPTLVFEQIVIKGVS

SEQ ID NO: 2373 - DNA, 1725 bp, Staphylococcus aureus
ttgtttatgtgggacaagtctctcgtttttacattttttaggaggcgttttggaatggcattgtctacttttaagagagaacatattaaaaagaatttaagaaatgatgaatatgatttagtaattattggtggcggtattacaggtgcaggtattgcactagacgcgagtgaaagaggaatgaaagttgcattagttgaaatgcaagactttgcacaaggaacaagctcaagatctacaaaattagtccatggtggtttgcgttacttaaaacaattccaaattggagtagttgccgaaactggtaaagaacgtgcgattgtttatgaaaatgggcctcatgttacgactccagagtggatgcttttaccaatgcataaaggtggaacatttggtaaattctcaacatcaattggtttaggaatgtatgatcgtttagcaggtgttaagaagtctgaacgtaaaaaaatgttatctaaaaaagaaactttagctaaagaaccattagttaaaaaagaaggtctaaaaggcggcggttactatgttgaatatcgtactgacgatgcgcgtttaactattgaagttatgaagcgtgctgctgaaaaaggcgcagaaattatcaactatactaaatctgaacacttcacttatgataaaaatcaacaagtaaatggtgttaaagttatagataaattaactaatgaaaattatacaattaaggctaaaaaagtggttaatgcagcaggtccatgggttgatgatgttagaagtggtgattatgcacgcaataataaaaaattacgtttaactaaaggtgtacatgttgttattgatcaatcaaaattcccattaggtcaagcagtatactttgatactgaaaaagatggaagaatgatttttgcaattccacgtgaaggaaaagcgtatgtaggtactacagatacattctatgacaatatcaaatcttcaccattaactacacaagaagacagagactatttaatcgatgcgattaattacatgttccctagtgttaatgttacagatgaagatattgaatcaacatgggcaggaattagaccattaatttacgaagaaggcaaagacccttctgaaatctctcgtaaggatgaaatttgggaaggtaaatcaggtttattaactattgcaggtggtaaattaacaggctatcgtcacatggctcaagacattgttgatttagtatctaaacgcttgaaaaaagactacggtttaacatttagtccatgtaatacaaaaggtctggcaatttcaggtggcgatgtaggtggtagcaagaactttgatgcgtttgtagagcaaaaagtagatgtagctaaaggattcggcattgatgaagatgttgcaagacgtttagcatctaaatatggttcaaatgttgatgaattgttcaacattgcgcaaacatctcaataccatgatagcaagttaccattagaaatttatgtagaacttgtttatagtattcaacaagaaatggtatacaaacctaacgatttcttagttcgtcgttctggtaaaatgtatttcaatattaaagatgtattagattataaagatgctgtcatcgatattatggcagatatgcttgattactctccagctcaaattgaagcatatactgaagaagttgagcaagcaattaaagaagcgcaacatggaaataatcaaccagcagttaaagaa

SEQ ID NO: 2374 - protein, 575 aa, Staphylococcus aureus
  MISC_FEATURE (1)..(575): aerobic
LFMWDKSLVFTFFRRRFGMALSTFKREHIKKNLRNDEYDLVIIGGGITGAGIALDASERGMKVALVEMQDFAQGTSSRSTKLVHGGLRYLKQFQIGVVAETGKERAIVYENGPHVTTPEWMLLPMHKGGTFGKFSTSIGLGMYDRLAGVKKSERKKMLSKKETLAKEPLVKKEGLKGGGYYVEYRTDDARLTIEVMKRAAEKGAEIINYTKSEHFTYDKNQQVNGVKVIDKLTNENYTIKAKKVVNAAGPWVDDVRSGDYARNNKKLRLTKGVHVVIDQSKFPLGQAVYFDTEKDGRMIFAIPREGKAYVGTTDTFYDNIKSSPLTTQEDRDYLIDAINYMFPSVNVTDEDIESTWAGIRPLIYEEGKDPSEISRKDEIWEGKSGLLTIAGGKLTGYRHMAQDIVDLVSKRLKKDYGLTFSPCNTKGLAISGGDVGGSKNFDAFVEQKVDVAKGFGIDEDVARRLASKYGSNVDELFNIAQTSQYHDSKLPLEIYVELVYSIQQEMVYKPNDFLVRRSGKMYFNIKDVLDYKDAVIDIMADMLDYSPAQIEAYTEEVEQAIKEAQHGNNQPAVKE

SEQ ID NO: 2375 - DNA, 327 bp, Staphylococcus aureus
atgaaaatgattatagcgatcgtacaagatcaagatagtcaggaacttgcagatcaacttgttaaaaataactttagagcaacaaaattggcaacaacaggtgggtttttaagagcgggtaatacaacattcttatgtggtgtcaatgatgaccgtgtagatgaaatattgtctgtgattaatcaaacgtgtggtaatagagaacagttggtttcacctattacacctatgggaggcagtgcggattcgtacattccatatccagttgaagttgaagttggcggtgctactgtatttgttatgccagttgatgcattccatcaattt

SEQ ID NO: 2376 - protein, 109 aa, Staphylococcus aureus
  MISC_FEATURE (1)..(109): conserved hypothetical
MKMIIAIVQDQDSQELADQLVKNNFRATKLATTGGFLRAGNTTFLCGVNDDRVDEILSVINQTCGNREQLVSPITPMGGSADSYIPYPVEVEVGGATVFVMPVDAFHQF

SEQ ID NO: 2377 - DNA, 630 bp, Staphylococcus aureus
ttgaggatgaataaaatgtcagcttttataacttttgagggcccagaaggctctggaaaaacaactgtaattaatgaagtttaccatagattagtaaaagattatgatgtcattatgactagagaaccaggtggtgttcctactggtgaagaaatacgtaaaattgtattagaaggcaatgatatggacattagaactgaagcaatgttatttgctgcatctagaagagaacatcttgtattaaaggtcataccagctttaaaagaaggtaaggttgtgttgtgtgatcgctatatcgatagttcattagcttatcaaggttatgctagagggattggcgttgaagaagtaagagcattaaacgaatttgcaataaatggattatatccagacttgacgatttatttaaatgttagtgctgaagtaggtcgcgaacgtattattaaaaattcaagagatcaaaatagattagatcaagaagatttaaagtttcacgaaaaagtaattgaaggttaccaagaaatcattcataatgaatcacaacggttcaaaagcgttaatgcagatcaacctcttgaaaatgttgttgaagacacgtatcaaactatcatcaaatatttagaaaagata

SEQ ID NO: 2378 - protein, 210 aa, Staphylococcus aureus
  MISC_FEATURE (1)..(210): thymidylate kinase
LRMNKMSAFITFEGPEGSGKTTVINEVYHRLVKDYDVIMTREPGGVPTGEEIRKIVLEGNDMDIRTEAMLFAASRREHLVLKVIPALKEGKVVLCDRYIDSSLAYQGYARGIGVEEVRALNEFAINGLYPDLTIYLNVSAEVGRERIIKNSRDQNRLDQEDLKFHEKVIEGYQEIIHNESQRFKSVNADQPLENVVEDTYQTIIKYLEKI

SEQ ID NO: 2379 - DNA, 1335 bp, Staphylococcus aureus
atgaagcaacctattttaaataaattagaaagtttaaatcaagaagaagcgatttctttgcatgttccgggtcataaaaatatgactatcggtcatttatctcaattatcaatgacaatggataaaactgaaatacctggattagatgatttacatcatcctgaagaagtcattttggaaagtatgaagcaggtggagaaacattcagattatgatgcttatttcttagtgaatggcaccacttcaggaatattatctgtcatccagtctttttcacagaaaaaaggcgatatcttaatggcaagaaatgtacataaatctgtgttacatgcgctcgatattagccaacaagaagggcattttattgaaacgcatcaaagtccgttaacgaatcattataataaagttaatttaagccgtttgaataatgacggtcacaaacttgctgtgttgacttatcctaactattacggtgaaacatttaatgtagaagaggttatcaaatctttgcaccaattaaatattcctgtactcattgacgaagcacacggcgcgcactttggattgcaaggatttccagattctacattaaattatcaagctgactatgttgttcaatcttttcataaaacgttaccagctttaacgatgggctcggtactttatattcataaaaatgcaccttatagagaaactattatagaatatctaagctacttccaaacatctagtccttcgtatttgattatggctagtttagagtcagctgccgagttctataaaacatatgatagtaccgtgttttttgataagagagcgcaattaatcgaatgtttggagaagaagggttttgaaatgcttcaagttgatgatccgttgaagttgctgataaaatatgaaggttttacaggtcatgatattcaaaattggtttatgaatgcacatatctatttagaattagcggacgactatcaagcattagcgatattgccgttatggcatcatgatgatacgtatttatttgattcgcttttacgtaaaattgaagatatgattttaccgaaaaaatcagtttctaaagttaaacaaacacaacttttaacaactgaaggtaactataaaccaaaacgctttgaatatgttacttggtgtgatttgaaaaaggcaaaaggtaaagttctggcgcgacatattgtcccgtatccgccagggattcctattattttcaaaggagaaacaataactgaaaatatgatagaattggtaaatgaatatctggaaactggaatgatagttgaaggaattaaaaataataaaattttagttgaggatgaa

SEQ ID NO: 2380 - protein, 445 aa, Staphylococcus aureus
  MISC_FEATURE (1)..(445): hypothetical protein
MKQPILNKLESLNQEEAISLHVPGHKNMTIGHLSQLSMTMDKTEIPGLDDLHHPEEVILESMKQVEKHSDYDAYFLVNGTTSGILSVIQSFSQKKGDILMARNVHKSVLHALDISQQEGHFIETHQSPLTNHYNKVNLSRLNNDGHKLAVLTYPNYYGETFNVEEVIKSLHQLNIPVLIDEAHGAHFGLQGFPDSTLNYQADYVVQSFHKTLPALTMGSVLYIHKNAPYRETIIEYLSYFQTSSPSYLIMASLESAAEFYKTYDSTVFFDKRAQLIECLEKKGFEMLQVDDPLKLLIKYEGFTGHDIQNWFMNAHIYLELADDYQALAILPLWHHDDTYLFDSLLRKIEDMILPKKSVSKVKQTQLLTTEGNYKPKRFEYVTWCDLKKAKGKVLARHIVPYPPGIPIIFKGETITENMIELVNEYLETGMIVEGIKNNKILVEDE

SEQ ID NO: 2381 - DNA, 1173 bp, Staphylococcus aureus
  MISC_FEATURE (1)..(1173): n = g, a, t, or c
gtgcatgacatgacaaaagatattgaatatctaacagctgattatgacaatgaaaagtcatctatccaaagtgtaatagatgcaatagagggtcaagacttcttagatgtagatacaacaatggatgatgcggtaagcgatgtcagttctttagacgaagatggcgcaatatcattaacaagtagtgtagtaggtccacaaggatctaaattaatggggtattatcaaaatgagttatatgattatgcatctcaattagattcgaaaatgaaagaaattattgacacgccatttatagaagatatagataaagcattcaaaggtataacgaatgttaaattggaaaatatactaattaaaaatggtggtggacatggtagagatacctatggggcttctgggaaaattgcaaagggagatgccaagaaaagtgacagcgatgtttatagcatcgatgaaatattaaaatcggatcaagaatttgtaaaagtaattgatcagcattacaaagaaatgaaaaaagaagataagaaattatctaaaagtgattttgaaaaaatgatgactcagggcgcttcttgtgattacatgacagtagctgaagcggaagagctagaggagcaaaagaaaaaagaagaagctatagagattgcagcactagctggtatggtagttttatcttgtattaatcctgttgctggagcagtagctattggtgcttattccgcttattcagcagcaaatgcagccacaggaaaaaatattgtaactggaagaaagctatctaaagaagaacgaatcatggaaggactttcgcttattccattgccaggtatgggcttcctcaaaggtgctgggaaaagtttaatgaaattaggcttcaaaggcggagaaaaatttgcagttaaaacaggattgcaaaagacaatgcaacaagcagttagtcgtatttcacctaaaatgggaatgatgaaaaacagtgtgttgaatcaatctcgtaactttgctcaaaatactcatgttggacaaatgctgagtaacatgcgtggtcaagcaactcatactgttcaacaaagtagaaattggattggacaacaagcacaaaatgtcaaacgaatagtgaataatggacttgataaagaaatagcacatccatttaannnnntaaataat

SEQ ID NO: 2382 - protein, 391 aa, Staphylococcus aureus
  MISC_FEATURE (1)..(391): Xaa = any amino acid
  MISC_FEATURE (1)..(391): conserved hypothetical
VHDMTKDIEYLTADYDNEKSSIQSVIDAIEGQDFLDVDTTMDDAVSDVSSLDEDGAISLTSSVVGPQGSKLMGYYQNELYDYASQLDSKMKEIIDTPFIEDIDKAFKGITNVKLENILIKNGGGHGRDTYGASGKIAKGDAKKSDSDVYSIDEILKSDQEFVKVIDQHYKEMKKEDKKLSKSDFEKMMTQGASCDYMTVAEAEELEEQKKKEEAIEIAALAGMVVLSCINPVAGAVAIGAYSAYSAANAATGKNIVTGRKLSKEERIMEGLSLIPLPGMGFLKGAGKSLMKLGFKGGEKFAVKTGLQKTMQQAVSRISPKMGMMKNSVLNQSRNFAQNTHVGQMLSNMRGQATHTVQQSRNWIGQQAQNVKRIVNNGLDKEIAHPFXXXNN

SEQ ID NO: 2383 - DNA, 315 bp, Staphylococcus aureus
atgacgttgagtggaaaaattagtgttaaagctgaaacgattgcacatgttgtaaaagaattggaaagcataagtcaaaagtatgatgaaatagctcaaaactttggaaaaatagcgcaattaaattactacagtagtgaaaaagctgcacattctatggaaaatggctatagtagtgctgcaacagtcattagtggtctcaaaggtccattgagtacactcggtggtggcgtcatgaattcagcacaaaagttctttgaagcagatgaacattggggtacggaatttgccaagctttactataatattgaggga

SEQ ID NO: 2384 - protein, 105 aa, Staphylococcus aureus
  MISC_FEATURE (1)..(105): hypothetical protein
MTLSGKISVKAETIAHVVKELESISQKYDEIAQNFGKIAQLNYYSSEKAAHSMENGYSSAATVISGLKGPLSTLGGGVMNSAQKFFEADEHWGTEFAKLYYNIEG

SEQ ID NO: 2385 - DNA, 675 bp, Staphylococcus aureus
atgatgaaagatgttaagcgaatagattatttttcttacgaagaattaacaattttaggtggtagtaaattgcctctcgtaaattttgaattgtttgatccatcaaattttgaagaagctaaagctgctttaattgaaaaggaattagtaacagagaatgacaagttaactgatgcaggttttaaagtggctacattagtcagagagtatattagcgccattgtaaatattcgaattaatgatatgtattttgcaccatttagctatgaaaaagatgaatatattttgttaagccggtttaaaaataatgggtttcaaatacgaattatcaataaagacattgcatggtggtcgattgtacaatcatatcctttattgatgagacaagaaaagtccaatgattgggactttaaacaaattgacgatgaaacattggagaacttaaataatgaaagtatcgatacgattgggcgtgttttagaaattgaaatatacaatcatcaaggtgaccctcaacaaagtttatataacatttatgaacaaaatgatttgttattcattcgatacccattaaaagataaagtgctgaatgttcatattggtgtcattaatacatttatacgagaattatttggattcgatactgatgaaaatcatattaataaagcagaggag

SEQ ID NO: 2386 - protein, 225 aa, Staphylococcus aureus
  MISC_FEATURE (1)..(225): hypothetical protein
MMKDVKRIDYFSYEELTILGGSKLPLVNFELFDPSNFEEAKAALIEKELVTENDKLTDAGFKVATLVREYISAIVNIRINDMYFAPFSYEKDEYILLSRFKNNGFQIRIINKDIAWWSIVQSYPLLMRQEKSNDWDFKQIDDETLENLNNESIDTIGRVLEIEIYNHQGDPQQSLYNIYEQNDLLFIRYPLKDKVLNVHIGVINTFIRELFGFDTDENHINKAEE

SEQ ID NO: 2387 - DNA, 312 bp, Staphylococcus aureus
atgggtggatataaaggtattaaagcagatggtggcaaggttgatcaagcgaaacaattagcggcaaaaacagctaaagatattgaagcatgtcaaaagcaaacgcaacagctcgctgagtatatcgaaggtagtgattgggaaggacagttcgccaataaggtgaaagatgtgttactcattatggcaaagtttcaagaagaattagtacaaccgatggctgaccatcaaaaagcaattgataacttaagtcaaaatctagcgaaatacgatacattatcaattaagcaagggcttgatagggtgaaccca

SEQ ID NO: 2388 - protein, 104 aa, Staphylococcus aureus
  MISC_FEATURE (1)..(104): hypothetical protein
MGGYKGIKADGGKVDQAKQLAAKTAKDIEACQKQTQQLAEYIEGSDWEGQFANKVKDVLLIMAKFQEELVQPMADHQKAIDNLSQNLAKYDTLSIKQGLDRVNP

SEQ ID NO: 2389 - DNA, 390 bp, Staphylococcus aureus
atgaattttaatgatattgaaacaatggttaagtcgaaatttaaagatattaaaaagcatgctgaagagattgcgcatgaaattgaagttcgttctggatatttaagaaaagctgaacaatataagcgattagaatttaatttgagttttgcactagatgatattgaaagcacagcaaaggacgtacaaactgcaaaatctagtgctaataaggacagtgtaactgttaagggaaaggcgcccaatacgttatatattgaaaaaagaaatttgatgaaacaaaagcttgaaatgttgggtgaagatatcgataaaaataaagaatccctccaaaaagctaaggaaattgctggcgaaaaggcaagtgaatattttaataaagcaatgaat

SEQ ID NO: 2390 - protein, 130 aa, Staphylococcus aureus
  MISC_FEATURE (1)..(130): hypothetical protein
MNFNDIETMVKSKFKDIKKHAEEIAHEIEVRSGYLRKAEQYKRLEFNLSFALDDIESTAKDVQTAKSSANKDSVTVKGKAPNTLYIEKRNLMKQKLEMLGEDIDKNKESLQKAKEIAGEKASEYFNKAMN

SEQ ID NO: 2391 - DNA, 4437 bp, Staphylococcus aureus
atgcataaattgattataaaatataacaaacaattgaagatgctcaatttgcgagatggtaagacatatactattagcgaagacgagcgtgcagatattacgttgaaatcgttaggcgaagtcattcatttagaacaaaataatcaaggtacttggcaagcgaatcatacttctattaataaggtgcttgttagaaaaggtgaccttgatgacattacattacagctttatacagaagctgattatgcatcatttgcgtatccttcaattcaagatacgatgacaattggaccaaatgcgtatgatgatatggttattcaaagcttgatgaatgccatcattattaaagattttcaatcaatacaagaatcacaatacgtacgcattgtgcacgataaaaatacagatgtgtatattaactatgaactacaagagcaactaacgaacaaagcttacattggtgatcatatttatgttgaagggatatggctcgaagtacaagctgatggtttaaatgtattgagtcagaatacagtggcatcgtcattaattcgcttaacacaagagatgccacatgcacaggcagatgattacaatacgtaccatcgttcgccaaggattattcaccgtgaaccgacggatgatattaagattgaaagaccgccacagccaatacagaagaacaatacagtgatatggcgttccattataccgccattagtaatgattgctttaactgttgtcatctttttagtgagaccaattggtatttatattttaatgatgattggtatgagtacagtaacgatagtatttggtattacaacgtatttctctgaaaagaaaaagtataacaaagatgttgaaaaacgagagaaagattacaaagcttatttggataataaatctaaagaaattaataaagcgattaaagcacaacgttttagtttgaattaccattatccaacggttgctgaaattaaagatatcgttgaaacgaaagcaccaagaatatatgaaaaaacatcgcatcatcacgatttcttacattataagttaggtattgcgaatgtagaaaagtcattcaaattagattaccaagaagaagaatttaaccaacgtcgtgatgaactattcgacgatgctaaagaattgtatgaattttacacagatgtagaacaagcaccattaatcaatgatttaaatcatgggccaattgcatatattggtgcacgacatctcattttagaagaattggagaaaatgctaattcaattgtcaacattccatagttatcatgatttagagtttctatttgtgacacgtgaagatgaagttgaaacattgaaatgggcacgttggttgccacatatgacattgagagggcaaaacattagaggatttgtttacaatcaacgaacgcgtgaccaaattttaacgtcaatttatagcatgattaaagaacgtatccaagctgtgcgtgaacgcagcagaagtaatgagcaaattattttcacaccgcaattagtgtttgtcattacagatatgtcattaattattgatcatgtcattttagaatatgtaaaccaagatttatcagaatatggtatttcattaatctttgttgaagatgtgattgaaagtttgccagagcatgtagataccattattgatatcaagtctcgtactgaaggcgaactgattacgaaagaaaaagaattagttcaattgaaatttacacctgaaaatattgataacgtcgataaagaatatatcgcgcgacgtttggcgaatttgatacacgtcgaacatttgaaaaatgcaattcctgatagtattacatttttagagatgtataacgtgaaagaagtagatcagcttgatgtggttaatcgatggagacaaaacgaaacatacaaaacgatggcagtacctttaggtgtaagaggtaaagatgatattttatcattgaacttacatgaaaaagcacacgggccacatggtttagttgctggtaccactggttcagggaaatctgagattatccaatcatacattttatctttagctattaattttcaccctcatgaagttgcattcctattgattgactataaaggtgggggtatggcgaacttatttaaagatttagtccatttagttggtacgattacaaacttagatggcgatgaagcgatgcgtgccttaacatcaatcaaagccgaattgagaaaacgtcaacgtttattcggagagcatgatgttaaccatattaatcaataccataagttatttaaagaaggtattgcgacagaaccaatgccacatttattcattatttccgatgagtttgccgaattaaaatcagaacaacctgattttatgaaagaacttgtatcaacggcacgtattggacgttcgttaggtattcatttaatacttgcgacacaaaaaccatcgggtgttgttgatgaccaaatttggtctaactctaaatttaagttggcattaaaagtacaagatagacaagacagtaatgaaattttaaaaacaccagatgcagcagacattacattaccaggtcgtgcgtatttacaagttggtaataatgaaatttatgaattattccaatctgcatggagtggtgcaacatatgacatcgaaggcgataaattagaagttgaagataagacgatttacatgattaatgactatggtcaacttcaagcaatcaacaaagacttgagtggacttgaagatgaagaaacgaaagaaaatcaaactgagttagaagcggtcatagatcatatcgaatctattacaacacgattagaaatcgaagaagttaagcgtccatggctaccaccattgccagaaaatgtatatcaagaagatttagtagaaacagatttcagaaaattatggtcagatgatgcaaaagaagtggaattaacattaggacttaaagacgtaccagaagaacaatatcaaggaccgatggtattgcaattgaaaaaagctgggcacatcgcgttaatcggaagtccaggatatggtagaacaacgttcttacacaacattattttcgatgttgcaagacaccatcgtcctgatcaagcacacatgtacttgttcgatttcggtaccaatggtttgatgccagttacagacataccacatgtcgctgattactttacagtagatcaagaagacaagattgctaaggcgatacgtatatttaatgatgaaattgatcgtcgtaagaagattttaagtcagtatcgtgtcactagtatttctgaatatcgaaaattaactggtgaaacaattccgcatgtctttattcttattgataactttgacgcagtaaaagattcacctttccaagaagtttttgaaaatatgatgattaaaatgacgcgtgaagggctagcattagacatgcaagtaaccttaactgcttcaagagctaacgctatgaaaacaccaatgtacattaatatgaaaacgcgtatcgcaatgtttttatatgataaatcagaggtgtcgaacgtagtaggacagcaaaaatttgcggttaaagatgttgtgggtcgagcattgttaagtagtgatgacaacgtatcattccatattggccaaccatttaaacatgatgagaccaaatcatataatgatcaaattaatgatgaagtatcggcgatgacagaattttataaaggtgaaacaccaaatgatattcctatgatgccagatgaaattaaatatgaagattacagagaatcattaaacttaccagatatagttgcaaatggtgctttaccaattggattagattatgaaggtgttacactacaaaaaattaaattaactgaaccagcaatgatttcatcagaaaatccgagagaaattgcgcatattgctgaaattatgatgaaagaaattgacatattaaatgaaaaatatgcgatttgtatcgcagactcaagtggagagtttaaagcttataggcatcaagtggctaactttgccgaagaaagagaagacattaaagcgattcatcaactaatgattgaagacttaaagcaaagagaaatggacggcccatttgaaaaagattcactttatattatcaatgattttaaaacatttattgattgcacgtatattccggaagatgatgttaaaaagcttattacaaaaggaccagaacttggcttgaacattttatttgtcggcattcataaagaattaatagatgcttatgataaacagattgatgttgcacgtaaaatgattaaccaatttagtataggtattcgtatttcagaccaacaattctttaaatttagatttattcaacgagaacctgttattaaagaaaatgaagcatatatggtcgcaaaccaagcttatcaaaagattagatggtttaaa

SEQ ID NO: 2392 - protein, 1479 aa, Staphylococcus aureus
  MISC_FEATURE (1)..(1479): conserved hypothetical
MHKLIIKYNKQLKMLNLRDGKTYTISEDERADITLKSLGEVIHLEQNNQGTWQANHTSINKVLVRKGDLDDITLQLYTEADYASFAYPSIQDTMTIGPNAYDDMVIQSLMNAIIIKDFQSIQESQYVRIVHDKNTDVYINYELQEQLTNKAYIGDHIYVEGIWLEVQADGLNVLSQNTVASSLIRLTQEMPHAQADDYNTYHRSPRIIHREPTDDIKIERPPQPIQKNNTVIWRSIIPPLVMIALTVVIFLVRPIGIYILMMIGMSTVTIVFGITTYFSEKKKYNKDVEKREKDYKAYLDNKSKEINKAIKAQRFSLNYHYPTVAEIKDIVETKAPRIYEKTSHHHDFLHYKLGIANVEKSFKLDYQEEEFNQRRDELFDDAKELYEFYTDVEQAPLINDLNHGPIAYIGARHLILEELEKMLIQLSTFHSYHDLEFLFVTREDEVETLKWARWLPHMTLRGQNIRGFVYNQRTRDQILTSIYSMIKERIQAVRERSRSNEQIIFTPQLVFVITDMSLIIDHVILEYVNQDLSEYGISLIFVEDVIESLPEHVDTIIDIKSRTEGELITKEKELVQLKFTPENIDNVDKEYIARRLANLIHVEHLKNAIPDSITFLEMYNVKEVDQLDVVNRWRQNETYKTMAVPLGVRGKDDILSLNLHEKAHGPHGLVAGTTGSGKSEIIQSYILSLAINFHPHEVAFLLIDYKGGGMANLFKDLVHLVGTITNLDGDEAMRALTSIKAELRKRQRLFGEHDVNHINQYHKLFKEGIATEPMPHLFIISDEFAELKSEQPDFMKELVSTARIGRSLGIHLILATQKPSGVVDDQIWSNSKFKLALKVQDRQDSNEILKTPDAADITLPGRAYLQVGNNEIYELFQSAWSGATYDIEGDKLEVEDKTIYMINDYGQLQAINKDLSGLEDEETKENQTELEAVIDHIESITTRLEIEEVKRPWLPPLPENVYQEDLVETDFRKLWSDDAKEVELTLGLKDVPEEQYQGPMVLQLKKAGHIALIGSPGYGRTTFLHNIIFDVARHHRPDQAHMYLFDFGTNGLMPVTDIPHVADYFTVDQEDKIAKAIRIFNDEIDRRKKILSQYRVTSISEYRKLTGETIPHVFILIDNFDAVKDSPFQEVFENMMIKMTREGLALDMQVTLTASRANAMKTPMYINMKTRIAMFLYDKSEVSNVVGQQKFAVKDVVGRALLSSDDNVSFHIGQPFKHDETKSYNDQINDEVSAMTEFYKGETPNDIPMMPDEIKYEDYRESLNLPDIVANGALPIGLDYEGVTLQKIKLTEPAMISSENPREIAHIAEIMMKEIDILNEKYAICIADSSGEFKAYRHQVANFAEEREDIKAIHQLMIEDLKQREMDGPFEKDSLYIINDFKTFIDCTYIPEDDVKKLITKGPELGLNILFVGIHKELIDAYDKQIDVARKMINQFSIGIRISDQQFFKFRFIQREPVIKENEAYMVANQAYQKIRWFK

SEQ ID NO: 2393 - DNA, 1590 bp, Staphylococcus aureus
atgtttgattcatggattatgctattttttcgccaaaatttaacagattttgtacaatgggttagcgattattttttaataaaggagatactactaatggaaaaatatattttatctatagaccaaggaacaacaagctcaagagcgattttattcaatcaaaaaggggaaattgcaggggtagcacaacgtgagtttaagcaatattttccacaatcaggttgggttgaacatgatgcaaatgaaatttggacatctgtgttagctgtaatgacggaagtaattaatgaaaatgatgttagagctgatcaaattgcaggtatcggtattacaaaccaacgtgaaacaacggttgtttgggacaaacatactggccgcccaatttatcacgcaattgtttggcaatcacgtcaaacacaatcaatttgttcagaattaaaacaacaaggatatgaacaaacatttagagataagacaggattacttttagatccgtattttgcaggtacaaaagttaaatggattctagacaatgttgaaggtgcacgagaaaaagcagaaaatggcgatctattatttggaacgattgatacttggttagtatggaaattatcaggaaaagctgcgcatattactgattattcaaatgcgagtcgtacattaatgtttaatatccatgatttagaatgggacgatgagttattagaactacttacagtacctaaaaatatgttgccagaagttaaagcttcgagtgaagtatatggtaagacaattgattaccacttctatggtcaagaagtaccaatcgctggagtagctggtgatcaacaagcagcattatttggacaagcttgcttcgaacgtggtgacgtgaaaaacacatatggaactggtggcttcatgttaatgaatacaggtgacaaagcggttaaatctgaaagtggtttattaacaacaattgcttatggtattgatggaaaagtaaattatgcgcttgaaggttccatctttgtttcgggttcagcaatccaatggttacgtgatggattaagaatgattaattcagcaccacaatcagaaagttatgcgacacgagttgactctactgagggtgtttatgttgttccagcttttgtaggtttaggaacaccatattgggattctgaagcacgtggtgcgattttcggtttaacacgtggaactgaaaaagagcactttatccgtgcaactttagaatcactatgttaccaaactcgtgacgttatggaagcaatgtcaaaagactctggtattgatgtccaaagtttacgtgtcgatggtggtgcagttaaaaataactttattatgcagttccaagcagacattgttaatacttctgttgaaagacctgaaattcaagaaactacagctttaggtgctgcatttttggcaggtttagcagttggattctgggagagtaaagatgatatcgctaaaaactggaaattagaagaaaaattcgatccgaaaatggatgaaggcgaaagagaaaaattatatagaggttggaaaaaagctgttgaagcaacacaagtttttaaaacagaa

SEQ ID NO: 2394 - protein, 530 aa, Staphylococcus aureus
  MISC_FEATURE (1)..(530): glycerol kinase
MFDSWIMLFFRQNLTDFVQWVSDYFLIKEILLMEKYILSIDQGTTSSRAILFNQKGEIAGVAQREFKQYFPQSGWVEHDANEIWTSVLAVMTEVINENDVRADQIAGIGITNQRETTVVWDKHTGRPIYHAIVWQSRQTQSICSELKQQGYEQTFRDKTGLLLDPYFAGTKVKWILDNVEGAREKAENGDLLFGTIDTWLVWKLSGKAAHITDYSNASRTLMFNIHDLEWDDELLELLTVPKNMLPEVKASSEVYGKTIDYHFYGQEVPIAGVAGDQQAALFGQACFERGDVKNTYGTGGFMLMNTGDKAVKSESGLLTTIAYGIDGKVNYALEGSIFVSGSAIQWLRDGLRMINSAPQSESYATRVDSTEGVYVVPAFVGLGTPYWDSEARGAIFGLTRGTEKEHFIRATLESLCYQTRDVMEAMSKDSGIDVQSLRVDGGAVKNNFIMQFQADIVNTSVERPEIQETTALGAAFLAGLAVGFWESKDDIAKNWKLEEKFDPKMDEGEREKLYRGWKKAVEATQVFKTE

SEQ ID NO: 2395 - DNA, 1332 bp, Staphylococcus aureus
atggttaaaaatcataaccctaaaaatgaaatgcaagatatgttaacgcctttagatgctgaagaagcagctaaaacaaaattacgcttagatatgagagagattcctaagtcttcaattaaaccagaacattttcatttaatgtacttattagaacaacattctccatattttatagatgctgaattaactgaactacgtgacagtttccaaatacattatgacattaatgacaatcatacaccttttgataatattaaatcatttactaaaaatgaaaaattacgttacttactcaatatcaaaaatttagaagaagtaaatcgtacacgctacacatttgtgttggcaccagatgaattatttttcacaagagatggattacccattgctaaaacaagagggttacaaaatgttgttgatccattacctgtgtcagaagctgaatttttaacaagatataaagcgctggttatctgtgcattcaatgagaaacaatcatttgatgctttagttgaaggaaacttagaactacataaaggaacgccatttgaaactaaagttattgaagcggcaacgttagatttactaacggcatttttagatgaacagtatcagaaacaagaacaagattatagtcaaaattatgcatatgtacgcaaagtaggacataccgttttcaaatgggttgctatcggtatgacaacgttaagtgttttattaattgcattcttagcctttttatatttttcagtaatgaagcataatgagcgcattgaaaaaggataccaagcatttgtaaaggatgattatacgcaagtactaaatacgtatgatgatttagatggtaaaaaattagataaagaggcactttacatttatgccaaaagttatatccaaacaaataaacaaggtttagaaaaagataagaaagaaaatttacttaataatgtgacaccaaattcaaacaaagactacttattatattggatggaattaggacaaggacatcttgatgaagcgattaatattgccacttatttagatgataacgatattacaaagttagcgttgattaataaattaaatgagattaaaaataacggagatttatcgaatgataaacgttctgaagaaacgaaaaagtataacgataaattgcaagatattttagacaaagaaaaacaagttaaagatgaaaaagcgaaatctgaagaagagaaagcaaaagcgaaagatgagaaattaaagcaacaagaagagaacgaaaagaaacaaaaagaacaagcacaaaaagataaagaaaaacgccaagaagctgaaagaaaaaaa

SEQ ID NO: 2396 - protein, 444 aa, Staphylococcus aureus
  MISC_FEATURE (1)..(444): conserved hypothetical
MVKNHNPKNEMQDMLTPLDAEEAAKTKLRLDMREIPKSSIKPEHFHLMYLLEQHSPYFIDAELTELRDSFQIHYDINDNHTPFDNIKSFTKNEKLRYLLNIKNLEEVNRTRYTFVLAPDELFFTRDGLPIAKTRGLQNVVDPLPVSEAEFLTRYKALVICAFNEKQSFDALVEGNLELHKGTPFETKVIEAATLDLLTAFLDEQYQKQEQDYSQNYAYVRKVGHTVFKWVAIGMTTLSVLLIAFLAFLYFSVMKHNERIEKGYQAFVKDDYTQVLNTYDDLDGKKLDKEALYIYAKSYIQTNKQGLEKDKKENLLNNVTPNSNKDYLLYWMELGQGHLDEAINIATYLDDNDITKLALINKLNEIKNNGDLSNDKRSEETKKYNDKLQDILDKEKQVKDEKAKSEEEKAKAKDEKLKQQEENEKKQKEQAQKDKEKRQEAERKK

SEQ ID NO: 2397 - DNA, 240 bp, Staphylococcus aureus
atgaatcagcacgtaaaagtaacatttgattttactaattataattacggcacatatgacttagcagtaccagcatatttaccgataaaaaacttaatagctttagtattggatagtttggacatttcaatatttgatgtcaatacacaaattaaagtgatgacgaaaggtcaattacttgttgaaaatgatcgactcattgattatcaaatcgctgatggagatattttgaagttacta

SEQ ID NO: 2398 - protein, 80 aa, Staphylococcus aureus
  MISC_FEATURE (1)..(80): conserved hypothetical
MNQHVKVTFDFTNYNYGTYDLAVPAYLPIKNLIALVLDSLDISIFDVNTQIKVMTKGQLLVENDRLIDYQIADGDILKLL

SEQ ID NO: 2399 - DNA, 456 bp, Staphylococcus aureus
atgttgatgaatagcgtgattgctttaacttttttaacagcatctagcaataatggcggacttaatattgatgtgcaacaagaagaggaaaagcgaatcaataatgatttaaatcaatatgatacaacgctatttaataaagacagcaaagcggttaatgatgcgattgctaagcagaaaaaagaacgacaacaacaaataaaaaatgatatgtttcaaaatcaagcgagtcactcgactcgcttgaatgaaactaaaaaagtgttattttccaaatctaacttagaaaagacttcggagagtgataaaagcccctatattcaaaacaagcaggagaaaaaaatattcccgtacattttgatgtctgtaggggcttttttgactttaggatttgtcattttttcaattcataaagggagacgaacgaaaaatgaatcagcacgtaaaagtaacatt

SEQ ID NO: 2400 - protein, 152 aa, Staphylococcus aureus
  MISC_FEATURE (1)..(152): hypothetical protein
MLMNSVIALTFLTASSNNGGLNIDVQQEEEKRINNDLNQYDTTLFNKDSKAVNDAIAKQKKERQQQIKNDMFQNQASHSTRLNETKKVLFSKSNLEKTSESDKSPYIQNKQEKKIFPYILMSVGAFLTLGFVIFSIHKGRRTKNESARKSNI

SEQ ID NO: 2401 - DNA, 3027 bp, Staphylococcus aureus
atgaaaaagaaaaattggatttatgcattaattgtcactttaattattataattgccatagttagtatgatattttttgttcaaacaaaatatggagatcaatcagaaaaaggatcccaaagtgtaagtaataaaaataataaaatacatatcgcaattgttaacgaggatcaaccaacgacatataacggtaaaaaagttgagctgggtcaagcatttattaaaaggttagcaaatgagaaaaactataaatttgaaacagtaacaagaaacgttgctgagtctggtttgaaaaatggtggataccaagtcatgattgttatcccagaaaacttttcaaaattggcaatgcaattagacgctaaaacaccatcgaaaatatcgctacagtataaaacagctgtaggacaaaaagaagaagtagctaaaaacacagaaaaagttgtaagtaatgtacttaacgactttaacaaaaacttagtcgaaatttatttaacaagcatcattgataatttacataatgcacaaaaaaatgttggcgctattatgacgcgtgaacatggtgtgaatagtaaattctcgaattacttattaaatccaattaacgacttcccggaattatttacagatacgcttgtaaattcaatttctgcaaacaaagacattacaaaatggttccaaacatacaataaatcattattgagtgcgaattcagatacgttcagagtgaacacagattataatgtttcgactttaattgaaaaacaaaattcattatttgacgagcacaatacagcgatggataaaatgttacaagattataaatcgcaaaaagatagcgtggaacttgataactatatcaatgcattaaaacagatggacagccaaattgatcaacaatcaagtatgcaagatacaggtaaagaagaatataaacaaactgttaaagaaaacttagataaattaagagaaatcattcaatcacaagagtcaccattttcaaaaggtatgattgaagactatcgtaagcaattaacagaatcactgcaagatgagcttgcaaataacaaagacttacaagatgcgctaaatagcattaaaatgaacaatgctcaattcgctgaaaacttagagaaacaacttcatgatgatattgtcaaagaacctgatacagatacaacatttatctataacatgtctaaacaagactttatagctgcaggtttaaatgaggatgaagctaataaatacgaagcaattgtcaaagaagcaaaacgttataaaaatgaatataatttgaaaaaaccgttagcagaacacattaatttaacagattacgataaccaagttgcgcaagacacaagtagtttgattaatgatggtgtcaaagtgcaacgtactgaaacgattaaaagtaatgatattaatcaattaactgttgcaacagatcctcattttaattttgaaggcgacattaaaattaatggtaaaaaatatgacattaaggatcaaagtgttcaactcgatacatctaacaaggaatataaagttgaagtcaatggcgttgctaaattgaaaaaggatgctgagaaagatttcttaaaagataaaacaatgcatttacaattgttatttggacaagcaaatcgtcaagatgaaccaaatgataagaaagcaacgagtgttgtggatgtaacattgaatcataaccttgatggtcgcttatcgaaagatgcattaagccagcaattgagtgcattatctaggtttgatgcgcattataaaatgtacacagatacaaaaggcagagaagataaaccattcgacaacaaacgtttaattgatatgatggttgaccaagttatcaatgacatggaaagtttcaaagacgataaagtagctgtgttacatcaaattgattcaatggaagaaaactcagacaaactgattgatgacattttaaataacaaaaagaatacaacaaaaaataaagaagatatttccaagctgattgatcagttagaaaacgttaaaaagacttttgctgaagagccacaagaaccaaaaattgataaaggcaaaaatgatgaatttaatacgatgtcttcaaatttagataaagaaattagtagaatttctgaaaagagtacgcaattgctatcagatacacaagaatcaaaatcaattgcagattctgttagtggccaattaaatcaagtcgacaataatgtgaataagctacatgcgacaggtcgagcattaggcgtaagagctaacgatttgaatcgtcaaatggctaaaaacgataaagataatgagttgttcgctaaagaatttaaaaaagtattacaaaattctaaagatggcgacagacaaaaccaagcattaaaagcatttatgagtaatccggttcaaaagaaaaacttagaaaatgttttagctaataatggtaatacagacgtgatttcaccgacattattcgtattattgatgtatttactatcaatgattacagcatatattttctatagttatgaacgtgccaaaggacaaatgaatttcattaaagatgattatagtagtaaaaaccatctttggaataatgtcattacgtcaggtgttattggtacaactggtttggtagaagggttaattgtcggtttaattgcaatgaataagttccatgtattagctggctatagagcgaaattcatcttaatggtgattttaactatgatggtcttcgtacttattaatacgtatttactaagacaggtaaaatctatcggtatgttcttaatgattgctgcattgggtctatactttgtagctatgaataatttgaaagcagctggacaaggtgtgactaataaaatttcaccattgtcttatatcgataacatgttcttcaattatttaaatgcagagcatcctataggcttggtgctagtaatattaacagtacttgtgattattggctttgtactgaacatgtttataaaacactttaagaaagagagattaatc

SEQ ID NO: 2402 - protein, 1009 aa, Staphylococcus aureus
  MISC_FEATURE (1)..(1009): hypothetical protein
MKKKNWIYALIVTLIIIIAIVSMIFFVQTKYGDQSEKGSQSVSNKNNKIHIAIVNEDQPTTYNGKKVELGQAFIKRLANEKNYKFETVTRNVAESGLKNGGYQVMIVIPENFSKLAMQLDAKTPSKISLQYKTAVGQKEEVAKNTEKVVSNVLNDFNKNLVEIYLTSIIDNLHNAQKNVGAIMTREHGVNSKFSNYLLNPINDFPELFTDTLVNSISANKDITKWFQTYNKSLLSANSDTFRVNTDYNVSTLIEKQNSLFDEHNTAMDKMLQDYKSQKDSVELDNYINALKQMDSQIDQQSSMQDTGKEEYKQTVKENLDKLREIIQSQESPFSKGMIEDYRKQLTESLQDELANNKDLQDALNSIKMNNAQFAENLEKQLHDDIVKEPDTDTTFIYNMSKQDFIAAGLNEDEANKYEAIVKEAKRYKNEYNLKKPLAEHINLTDYDNQVAQDTSSLINDGVKVQRTETIKSNDINQLTVATDPHFNFEGDIKINGKKYDIKDQSVQLDTSNKEYKVEVNGVAKLKKDAEKDFLKDKTMHLQLLFGQANRQDEPNDKKATSVVDVTLNHNLDGRLSKDALSQQLSALSRFDAHYKMYTDTKGREDKPFDNKRLIDMMVDQVINDMESFKDDKVAVLHQIDSMEENSDKLIDDILNNKKNTTKNKEDISKLIDQLENVKKTFAEEPQEPKIDKGKNDEFNTMSSNLDKEISRISEKSTQLLSDTQESKSIADSVSGQLNQVDNNVNKLHATGRALGVRANDLNRQMAKNDKDNELFAKEFKKVLQNSKDGDRQNQALKAFMSNPVQKKNLENVLANNGNTDVISPTLFVLLMYLLSMITAYIFYSYERAKGQMNFIKDDYSSKNHLWNNVITSGVIGTTGLVEGLIVGLIAMNKFHVLAGYRAKFILMVILTMMVFVLINTYLLRQVKSIGMFLMIAALGLYFVAMNNLKAAGQGVTNKISPLSYIDNMFFNYLNAEHPIGLVLVILTVLVIIGFVLNMFIKHFKKERLI

SEQ ID NO: 2403 - DNA, 342 bp, Staphylococcus aureus
gtgtccctaaaaagttttgataaacttaaaatattcaggaggtttctagttatggcaatgattaagatgagtccagaggaaatcagagcaaaatcgcaatcttacgggcaaggttcagaccaaatccgtcaaattttatctgatttaacacgtgcacaaggtgaaattgcagcgaactgggaaggtcaagctttcagccgtttcgaagagcaattccaacaacttagtcctaaagtagaaaaatttgcacaattattagaagaaattaaacaacaattgaatagcactgctgatgccgttcaagaacaagaccaacaactttctaataatttcggtttgcaa

SEQ ID NO: 2404 - protein, 114 aa, Staphylococcus aureus
  MISC_FEATURE (1)..(114): conserved hypothetical
VSLKSFDKLKIFRRFLVMAMIKMSPEEIRAKSQSYGQGSDQIRQILSDLTRAQGEIAANWEGQAFSRFEEQFQQLSPKVEKFAQLLEEIKQQLNSTADAVQEQDQQLSNNFGLQ

SEQ ID NO: 2405 - DNA, 900 bp, Staphylococcus aureus
atggttattatgaagaaaacaattttactgacgatgacaactcttactttatttagtatgtcgcctaactcggctcaagcatatacgaatgatagcaaaacattagaagaagcaaagaaagcacacccaaacgcacagttcaaagtgaataaagacaccggcgcgtatacttatacatatgacaaaaacaacacgccaaacaacaatcatcaaaaccagtcacgtacaaacgacaatcatcaacacgcaaatcaacgtgatcttaacaacaatcagtaccattcttcattaagtggtcagtatacgcacattaatgacgcaattgattcacacacaccgcctcaaacgtcaccaagcaatcctttgacaccagcaataccgaatgtcgaagacaatgacgatgaattaaataacgctttttcaaaagataacaaagggcttattacaggcatcgatttagacgaattgtatgacgaattacaaatcgccgaatttaatgacaaagcaaagaccgctgacggtaaacctttagcattaggtaacggtaaaatcattgatcagcctcttatcacaagtaagaacaacttatatactgctggacaatgtacatggtatgtctttgataaacgtgccaaagatggacacacgattagtacattttggggagatgctaaaaactgggcaggccaagcttcaagcaatggcttcaaagtagatagacacccaacacgaggatcaattttacaaacagtaaatggtccatttggtcatgtagcctacgttgaaaaagttaatattgatggaagtattctaatttcagaaatgaactggattggtgaatatatcgtttcatcaagaaccatctctgcttcagaagtttcatcatataattacatccat

SEQ ID NO: 2406 - protein, 300 aa, Staphylococcus aureus
  MISC_FEATURE (1)..(300): hypothetical protein
MVIMKKTILLTMTTLTLFSMSPNSAQAYTNDSKTLEEAKKAHPNAQFKVNKDTGAYTYTYDKNNTPNNNHQNQSRTNDNHQHANQRDLNNNQYHSSLSGQYTHINDAIDSHTPPQTSPSNPLTPAIPNVEDNDDELNNAFSKDNKGLITGIDLDELYDELQIAEFNDKAKTADGKPLALGNGKIIDQPLITSKNNLYTAGQCTWYVFDKRAKDGHTISTFWGDAKNWAGQASSNGFKVDRHPTRGSILQTVNGPFGHVAYVEKVNIDGSILISEMNWIGEYIVSSRTISASEVSSYNYIH

SEQ ID NO: 2407 - DNA, 585 bp, Staphylococcus aureus
atgataatttttattttaataacaatatttgctatttattatatagctatgattgctagtttgtttaaaagtgaaggtttttcaataataggtttaatattagatgttgttataatggggacattgattttttactattttataggcgctcgctttgttgatcatgatttaagcaactttttaatgtttatggatactggatcatatatttttatgtactttgcaattaagtgtttatgggtgaaacctaaggtagtaaattatttgattgcaaaagaattgggtgaatctaaagaggtcattgaagagcaggaattagatttacagacatcaaagataagaggtatctactttttcattatttcagtagtgatgttaattatcactaaattaagaatgcaacctgagttacaggcagatgctatatcgatgaatcctgtatttatttttgttggtgttataatcattttaatttggctagtactggatatatatcgcaagaaaaaatacggtatattcttattcaagacgatagtgccactagttgttacgacttggattattatagctacaattatactttcg

SEQ ID NO: 2408 - protein, 195 aa, Staphylococcus aureus
  MISC_FEATURE (1)..(195): hypothetical protein
MIIFILITIFAIYYIAMIASLFKSEGFSIIGLILDVVIMGTLIFYYFIGARFVDHDLSNFLMFMDTGSYIFMYFAIKCLWVKPKVVNYLIAKELGESKEVIEEQELDLQTSKIRGIYFFIISVVMLIITKLRMQPELQADAISMNPVFIFVGVIIILIWLVLDIYRKKKYGIFLFKTIVPLVVTTWIIIATIILS

SEQ ID NO: 2409 - DNA, 651 bp, Staphylococcus aureus
atggaattgaaagtcgatgattttgtaaagaatataaaaagaccatacttgactgtattgggagtatttgtagttgcagtttcattattttttgacgcgattatgtttttctacgctaaactatatgataaattgcctatgtatttactggtgtttatggcctttacagctgtaattttgattatgatgtacatacaagagaaaaatgaaaattacaaagttgaaaaaagatatgtggttagatatctcacacttaacgttattgtgggatatactttgccattgctttttgtatctatttacgtttttggtgtagtcggttttggatttgatgttttcaattattgtctaggtattatcttgatgttatttatttcttggttaggtttatttttattttataaaaacgaatttgatagtgaaaatcctaatcctgcagttaatgccatagcaattattataaaattatttgcttttggaggaatattttatataagtctaatagttcctgtaacacagcaagaagagatttttatagggttaagtatattcatcaatataattgttgatgctcttcttgttaggtcatattttaattacgcgttatataagagtattaagaaagatatcgaaaatgaaggtaagacaatg

SEQ ID NO: 2410 - protein, 217 aa, Staphylococcus aureus
MELKVDDFVKNIKRPYLTVLGVFVVAVSLFFDAIMFFYAKLYDKLPMYLLVFMAFTAVILIMMYIQEKNENYKVEKRYVVRYLTLNVIVGYTLPLLFVSIYVFGVVGFGFDVFNYCLGIILMLFISWLGLFLFYKNEFDSENPNPAVNAIAIIIKLFAFGGIFYISLIVPVTQQEEIFIGLSIFINIIVDALLVRSYFNYALYKSIKKDIENEGKTM

SEQ ID NO: 2411 - DNA, 1536 bp, Staphylococcus aureus
ttgggaggaagcaaaatgtctaaaaagttaaaaattataattcctattattattgtcttactattaataggtggaatcgcatggggagtttatgcattttttgctaatacaccgaaaaatacatacctaaaaagtgaacaacaaacagcaaaaatgtataaagattattttaatgaccgttttgaaaatgaagtgaagttccaagaaaagatgaaagataattcgtttttatcttcattagaattaagcgcagatgcatcagatgaaattgttaaagggcttggcattcctaaatctgttgttaatgcatcgaaaattaaaatgtcatatggacatgatcctaaaaaagagaaatcaatgattaatcttgaaccaacaatcgcagactctgcattagggaaattccagttagctgcagataaagataagcattatttcgaatcaccattatttaaagggaaatatagtgttaataattctgatttattatcaacttattcaaaacttacaggtgaagatgaagaaacagcaaaagaaaatggtattacaaaccaacaactaaatttaaatactctttttaataatgctcaagcacaacaaagtgactacagcaaaattgccgaaaaatattccgaacttattgtcgacaaattagatgacgataattttgataaaggtaaaaaagaagaaattaaggttaatggtgaaaagtacaaagttagacctgtcacgttaacacttagcagagctgacactaaaaaaattacattagctgtattagaagaagctaaaaaggataaagaccttaaaaaattaatggaagaacaaggtgctacaaaagactttgaaaaagacatcaaaaaagcaattgacgatgtcaaagaaactaaaaaggatgaatttgctaaaattcaatctaaaatttataccgaaaaacatacgattgtaaaacgagaaattactattacagacaaagaaaataataaaactaaaatcaaaggtactaatactttagaagacgataagttaaaactagattacgcacttgatttcgatcaagataaatacacgtatgctgaagcgaaatatacaattaaaggcgtatcttctaaagaaaaagataataaatataatgataaatacgaatttggtaaaaagacagaatatgatgaatcaaaaatcaaattagataaccaagaaaaagtagatggcacaaaacgtcaagataaaggtaaaatcactgtcgcattagataaatatagcgacgaaaatgaattcacttttgaaaataatatagattctgacgtaaaaaataacactcagaaatctacgttaaatatcggcatcaaatatgctgaagaaccaattaatttcattttaaaatctagcacaaaattgaaagcagatattgattttgatgatagtggtgcaaaagatttcaatagtctatcttcaaaagaccgtgaaaaacttgaaaaagaaatcgaaaaaaatggcggcaaaatgtttgaatcaattttaaaaaaggcatctaaa

SEQ ID NO: 2412 - protein, 512 aa, Staphylococcus aureus
  MISC_FEATURE (1)..(512): hypothetical protein
LGGSKMSKKLKIIIPIIIVLLLIGGIAWGVYAFFANTPKNTYLKSEQQTAKMYKDYFNDRFENEVKFQEKMKDNSFLSSLELSADASDEIVKGLGIPKSVVNASKIKMSYGHDPKKEKSMINLEPTIADSALGKFQLAADKDKHYFESPLFKGKYSVNNSDLLSTYSKLTGEDEETAKENGITNQQLNLNTLFNNAQAQQSDYSKIAEKYSELIVDKLDDDNFDKGKKEEIKVNGEKYKVRPVTLTLSRADTKKITLAVLEEAKKDKDLKKLMEEQGATKDFEKDIKKAIDDVKETKKDEFAKIQSKIYTEKHTIVKREITITDKENNKTKIKGTNTLEDDKLKLDYALDFDQDKYTYAEAKYTIKGVSSKEKDNKYNDKYEFGKKTEYDESKIKLDNQEKVDGTKRQDKGKITVALDKYSDENEFTFENNIDSDVKNNTQKSTLNIGIKYAEEPINFILKSSTKLKADIDFDDSGAKDFNSLSSKDREKLEKEIEKNGGKMFESILKKASK

SEQ ID NO: 2413 - DNA, 816 bp, Staphylococcus aureus
atgaatgtatatttagcagaattcctaggaactgcaatcttaatcctttttggtggtggcgtttgtgccaatgtcaatttaaagagaagtgctgcgaatggtgctgattggattgtcatcacagctggatggggattagcggttacaatgggtgtgtttgctgtcggtcaattctcaggtgcacatttaaacccagcggtgtctttagctcttgcattagacggaagttttgattggtcattagttcctggttatattgttgctcaaatgttaggtgcaattgtcggagcaacaattgtatggttaatgtacttgccacattggaaagcgacagaagaagctggcgcgaaattaggtgttttctctacagcaccggctattaagaattactttgccaactttttaagtgagattatcggaacaatggcattaactttaggtattttatttatcggtgtaaacaaaattgccgatggtttaaatcctttaattgtcggagcattaattgttgcaatcggattaagtttaggcggtgctactggttatgcaatcaacccagcacgtgatttaggtccgagaattgcacatgcgattttaccaatagctggtaaaggtggttcaaattggtcatatgcaatcgttcctatcttaggaccaattgccggtggtttattaggtgcagtggtatacgctgtattttataaacatacatttaatattggttgtgcaattgcaattgttgtagttattattactttgattttaggttacattttaaataaatcatcaaaaaaaggtgatatcgaatcaatttac

SEQ ID NO: 2414 - protein, 272 aa, Staphylococcus aureus
  MISC_FEATURE (1)..(272): glycerol uptake facilitator
MNVYLAEFLGTAILILFGGGVCANVNLKRSAANGADWIVITAGWGLAVTMGVFAVGQFSGAHLNPAVSLALALDGSFDWSLVPGYIVAQMLGAIVGATIVWLMYLPHWKATEEAGAKLGVFSTAPAIKNYFANFLSEIIGTMALTLGILFIGVNKIADGLNPLIVGALIVAIGLSLGGATGYAINPARDLGPRIAHAILPIAGKGGSNWSYAIVPILGPIAGGLLGAVVYAVFYKHTFNIGCAIAIVVVIITLILGYILNKSSKKGDIESIY

SEQ ID NO: 2415 - DNA, 1164 bp, Staphylococcus aureus
atgaaaacaatacatttgtttcgcatctaccactcttttttattgaaaaagtggtatttgattatctatttactatttatattagcggcactccttattacattaacgacaatccaacatgtaacagaagatgacaatcattttaatataggtgtcgtagataaagatcaatcaagtgaaacgaaattaatcttaaactctattggtaaagggagtaacctaggaaaaaacgtgagcattaaagcatatgatgataagcaagcacatactttgttaaaaaaacataaacttcaaggctattttgtttttgataaaggtatgaccaaggcattttataaacaaggcgaactaccaatttcagtatatacatatgatcaacaatccatgaaaagtgtcgtgctatctcagctaacagattctgtttaccaacgtcttatgcgatcaatgggtggcatcttagcttttcaagacttagcaccgaaagcatcacattctgacagtatcaatgttatgactgatttgctgattacaggattaaaccgttcaggtgcatttaacttagaaccgattcatttatacgatacgggcagttattatgcaattacaggatttttaacaacggtattcatctttgcactatctttatttacagttttgaaaatgaatcaagatactgtattgaaagcgcgattgaaaatgtttcatttttctaaagagcgtttattaatcattcgtacgttgattacatggttttatactatgttatggagtatcgttggtgtagtttggattgtgttcagtattccgaatatctttgaattatataattggccaacgttagccattcatttaagctattatgttacctttttaatactgtggttattactcatcgaacttttaacaacaggcttgttgaatagtattagtaaagtcatattagctattgtcatcctggtgttatctggtttaacaatacctacgatttttttacaacatatagcaaatggtgttttcaatattcaaccgttcgcagttgtaacaaatcaattgttagaaattattttaaacaactacattttagaactgcaccctagtttctatcttagcttcatcgcacttttgataattaatttagctgtattggtttggaggtatcgtcaa

SEQ ID NO: 2416 - protein, 388 aa, Staphylococcus aureus
  MISC_FEATURE (1)..(388): hypothetical protein
MKTIHLFRIYHSFLLKKWYLIIYLLFILAALLITLTTIQHVTEDDNHFNIGVVDKDQSSETKLILNSIGKGSNLGKNVSIKAYDDKQAHTLLKKHKLQGYFVFDKGMTKAFYKQGELPISVYTYDQQSMKSVVLSQLTDSVYQRLMRSMGGILAFQDLAPKASHSDSINVMTDLLITGLNRSGAFNLEPIHLYDTGSYYAITGFLTTVFIFALSLFTVLKMNQDTVLKARLKMFHFSKERLLIIRTLITWFYTMLWSIVGVVWIVFSIPNIFELYNWPTLAIHLSYYVTFLILWLLLIELLTTGLLNSISKVILAIVILVLSGLTIPTIFLQHIANGVFNIQPFAVVTNQLLEIILNNYILELHPSFYLSFIALLIINLAVLVWRYRQ

SEQ ID NO: 2417 - DNA, 933 bp, Staphylococcus aureus
ttggaggtatcgtcaatgaagccttatatacaacttgttgtgttcaagcaatggttacaatacatcttgctcgtaacaaccattgtcatcgcactcgtacttattggtatcggttaccgtgtagcacatgacaacttcaaaataccgattaccattcaagatttagaccaaaccactgcatcaaaatcattcgtcaataaaattaaacaatctgactatgtaactattaaaaaagtcgatgaagatgaaagctatattgaagatgatgttactaaaaaggaagctattttaagtatgcaaattcctaaaggtttctctcaaaaattaaaagagaaccgtttaaaagaaacgatacagttatatggtagagatgactttataggtggtattgctgtagaaattgttagtagttcattatatgagcagcaaattcctaacattatttatgaacaccttgaggatatgaaacagcatcaatccatcgatgctatcaacaagtcctatcataaacatacacctgaatctaaaatcaaatttgtgtcgcttactaaacaagcacaacactctatttcaattagcttaatctttgcggtgattttatttgttagcgctgttcaagtagtacttcattatcgtttaaaccaacaagcagcattgcaacgattatcacaatatcatttaagccgtttcaaactatatagtacttatgtaatgacacatacgattttgttattgttggtactattggcagttagtctatatttgtctcaaccactcagcttaatattttacttaaaatcactgttacttatattgatttatgagataggtatcgtctttatcttattccatattcaaacaataagtcatcgattattcatgacatttatatatgcacttgctatgggtatcgtatacttgattattttcatg

SEQ ID NO: 2418 - protein, 311 aa, Staphylococcus aureus
  MISC_FEATURE (1)..(311): hypothetical protein
LEVSSMKPYIQLVVFKQWLQYILLVTTIVIALVLIGIGYRVAHDNFKIPITIQDLDQTTASKSFVNKIKQSDYVTIKKVDEDESYIEDDVTKKEAILSMQIPKGFSQKLKENRLKETIQLYGRDDFIGGIAVEIVSSSLYEQQIPNIIYEHLEDMKQHQSIDAINKSYHKHTPESKIKFVSLTKQAQHSISISLIFAVILFVSAVQVVLHYRLNQQAALQRLSQYHLSRFKLYSTYVMTHTILLLLVLLAVSLYLSQPLSLIFYLKSLLLILIYEIGIVFILFHIQTISHRLFMTFIYALAMGIVYLIIFM

SEQ ID NO: 2419 - DNA, 657 bp, Staphylococcus aureus
atgatagaaattaataacctttcaaagcgttaccgtaacaaacagattttcaatcatttaactatgtcctttgatagtaatcgtttaaccgtattacttggtgataatggtgctggaaaatcaacattacttcgtatgattgctggtattgaaaaagctaatgatggaactatcaactatttcggcgaaaaatggaatcaaagacaaatacaaaatcacatcggttatgtgccacaagacattgcgttatttgaacacatgacagtggctgaaaacattaaattttttaaatcactttgtaaaaatccaattaacgatacaactatcaacgaatatttacagcaattaaactttgatgatacgtctgccaaagtatctacattgtccggtgggaataaacgtaaaattaatatattagtaggtttactaggtcaacctcgaattctcattttagatgaaccgacagttggtattgatttaaaatctagacatgacatccaccaactacttaacatcatgaaatctaaatgtttaattatattaactacccatcatttagatgaagttgaagcacttgcagatgatatcaagttaattggccaagatcctttttatcaacatgttttagaggacaaacaatggacttatacctattat

SEQ ID NO: 2420 - protein, 219 aa, Staphylococcus aureus
  MISC_FEATURE (1)..(219): conserved hypothetical
MIEINNLSKRYRNKQIFNHLTMSFDSNRLTVLLGDNGAGKSTLLRMIAGIEKANDGTINYFGEKWNQRQIQNHIGYVPQDIALFEHMTVAENIKFFKSLCKNPINDTTINEYLQQLNFDDTSAKVSTLSGGNKRKINILVGLLGQPRILILDEPTVGIDLKSRHDIHQLLNIMKSKCLIILTTHHLDEVEALADDIKLIGQDPFYQHVLEDKQWTYTYY

SEQ ID NO: 2421 - DNA, 966 bp, Staphylococcus aureus
atggaggatgttttatacatgaaaaaattaacagcagcagcgattgcaacgatgggcttcgctacatttacaatggcgcatcaagcagatgcagcagaaacgacaaacacccaacaagcacatacacaaatgtcaacacaatcacaagacgtatcttatggtacttattatacaattgattctaatggggattatcatcacacacctgatggtaactggaatcaagcaatgtttgataataaagaatatagctatacattcgtagatgctcaaggacatacgcattatttttataactgttatccaaaaaatgcaaatgccaatggaagcggccaaacatatgtgaatccagcaacagcaggagataacaatgactacacagcgagtcaaagccaacagcatattaatcaatatggttatcaatcaaatgtaggtccagacgcgagctattattcacatagtaacaacaaccaagcgtataacagccatgatggtaatggaaaggtcaattatcctaatggcacatctaatcaaaatggtggatcagcaagtaaagcgacagctagtggtcatgcgaaagacgcaagctggttaacaagtcgtaaacaactacaaccatatggacaatatcacggtggtggtgcgcattacggtgtcgactatgcaatgcctgaaaattcaccagtttactcattaactgatggtacagtagtacaagcaggttggagtaactatggtggcggcaatcaagtaacgattaaagaagcgaacagtaataactaccaatggtatatgcataataatcgtttaactgtttcagctggtgataaagtcaaagctggtgaccaaattgcatattcaggtagtacgggtaattcaacagcgcctcacgtacacttccaacgtatgtctggtggcatcggtaatcaatatgcagtagacccaacgtcatacttgcaaagtaga

SEQ ID NO: 2422 - protein, 322 aa, Staphylococcus aureus
  MISC_FEATURE (1)..(322): peptidoglycan hydrolase
MEDVLYMKKLTAAAIATMGFATFTMAHQADAAETTNTQQAHTQMSTQSQDVSYGTYYTIDSNGDYHHTPDGNWNQAMFDNKEYSYTFVDAQGHTHYFYNCYPKNANANGSGQTYVNPATAGDNNDYTASQSQQHINQYGYQSNVGPDASYYSHSNNNQAYNSHDGNGKVNYPNGTSNQNGGSASKATASGHAKDASWLTSRKQLQPYGQYHGGGAHYGVDYAMPENSPVYSLTDGTVVQAGWSNYGGGNQVTIKEANSNNYQWYMHNNRLTVSAGDKVKAGDQIAYSGSTGNSTAPHVHFQRMSGGIGNQYAVDPTSYLQSR

SEQ ID NO: 2423 - DNA, 999 bp, Staphylococcus aureus
gtgagaacaatgtgcacaggattcacaatacaaactttaaataatcaagtacttcttggacgcacgatggattatgattatccattagatggttcgccagcagtgacgcctagaaattatcgttggaaatcttgcactggcacgacaggccaaacgcaatatggctttattggcacaggaacagatatggaaggttttatttatggtgatggtgttaatgaacatggcgttgccatttcaacacaatatttccgaggttatagttcatatggatcaacacacaaagcggacgcgatgaatattacgcaaaatgaaattgtgacatggattttgggatatacaacaagcattgaagatatgaaacaacaagcatcccaaatacatgttgtagctgtatatttaaatgacatcggtgaagttccgccattgcattatcatgtttccgatgcaactggacatacagtcgaagtttcatttaaagagggtgaagtggttataaaagataatcctattggtgtcttaacaaatcatccagacttaaattggcattatagtaatttaagacaatatatcaatatttctccttatccagcaacagcaaatttattggaaggtgtaacgattgaacctttaggcaatgaagcaggtacatttggattgccaggtggatttacttcaactgagcgctttgtgagaatggcatttatgaaagcaaacattgctcaaaacaatgataaagaaatggatttaatgaatgcattttatttattagatgcggtaaatataccgattggaattgtacgtccgcatgatgctgacaatcactatacgatgtatcagaccgtaataaatttaactacaagaacgttatatattaagtattatggcagcaatgaattagtagcattaaagctcacagatgatttaattaatagaaaagatatgacgatttttaagcctgagaagcatatcactattagaaagttgaatgacaatcaa

SEQ ID NO: 2424 - protein, 333 aa, Staphylococcus aureus
  MISC_FEATURE (1)..(333): hypothetical protein
VRTMCTGFTIQTLNNQVLLGRTMDYDYPLDGSPAVTPRNYRWKSCTGTTGQTQYGFIGTGTDMEGFIYGDGVNEHGVAISTQYFRGYSSYGSTHKADAMNITQNEIVTWILGYTTSIEDMKQQASQIHVVAVYLNDIGEVPPLHYHVSDATGHTVEVSFKEGEVVIKDNPIGVLTNHPDLNWHYSNLRQYINISPYPATANLLEGVTIEPLGNEAGTFGLPGGFTSTERFVRMAFMKANIAQNNDKEMDLMNAFYLLDAVNIPIGIVRPHDADNHYTMYQTVINLTTRTLYIKYYGSNELVALKLTDDLINRKDMTIFKPEKHITIRKLNDNQ

SEQ ID NO: 2425 - DNA, 1383 bp, Staphylococcus aureus
gtgacatctgtgaataacacacaatcttcaccacgcagtaatattattattgcgattatgttgtctgcattaacatattggttgtttgcacaatcatttattaatataggacctctcgttggtcaaacatatcaaacctctcctgccgtgttaaatttatctattagtttaacttccttcgccacaggtatcttcatggtggctgcaggtgatattgctgataaaataggacaactgagaatgacatacatgggtctcataatcagtatgtttgcatctcttctattaattatatcggacatcactgcactgctcatcatcggtagaattttacaaggtctatcagcagctatcttgttaccttcaacagttggcgtgttaaataatcaatttaaaggagaacatttaagacgagcgattagttatctaatgattagtactgttggtggcatcggcctagctggtgttatcggcggtttaattgcctcaaatttcggatggcaaacgaatttcatcattagtatagtcattgctttcattgccatattgcttctaaaaggcacacctgaaaaagtaagtcaacatagccaccgtcatccattcgattacaaaggtatgtcgattttcgctgttatgattggtagctttacattattgttaacacaaggattcgaacaaggttggtttagtacattttcaatcatttgtctgagcatttttatcatcactacgttgatattcatcatcatcgaacgtcgacatgaagtaccttttattgatttctcagtattacgcaaccgtccgttcattggtgcatttttaaataactttgttttaaatagcggtctaggcgtaacagtggtctttttcatatatgctcaaacacaccttggtttatcagctgcgcaatctggacttgttacattgccatatgccattgtggcagttgcgatgattcgtttaggtgaaaaagcaacattacgtttcggtggcaaattgatgctcatcattggtccgttgttccctgtcatcggcatcactattattagcatgactcaattattggcatcacaatatgtcattgcagttatcattggtttcgtcatatgtgcgataggtaatggtttagtcgcaacacctggacttacgattgcaattttcagtatgcctaatgaaaaagttggtttagctacaggattatataaaatgagtggtacattaggtggctcctttggtatagcactaagtactacagttttcagtatgttacaactaaactatgcaccaagtgtagctgcaaccgtaacatttatagtcagcattgtattgatgatccttggctcattgtctgcatacatgatcattccaaaaacagttaaatct

SEQ ID NO: 2426 - protein, 461 aa, Staphylococcus aureus
  MISC_FEATURE (1)..(461): hypothetical protein
VTSVNNTQSSPRSNIIIAIMLSALTYWLFAQSFINIGPLVGQTYQTSPAVLNLSISLTSFATGIFMVAAGDIADKIGQLRMTYMGLIISMFASLLLIISDITALLIIGRILQGLSAAILLPSTVGVLNNQFKGEHLRRAISYLMISTVGGIGLAGVIGGLIASNFGWQTNFIISIVIAFIAILLLKGTPEKVSQHSHRHPFDYKGMSIFAVMIGSFTLLLTQGFEQGWFSTFSIICLSIFIITTLIFIIIERRHEVPFIDFSVLRNRPFIGAFLNNFVLNSGLGVTVVFFIYAQTHLGLSAAQSGLVTLPYAIVAVAMIRLGEKATLRFGGKLMLIIGPLFPVIGITIISMTQLLASQYVIAVIIGFVICAIGNGLVATPGLTIAIFSMPNEKVGLATGLYKMSGTLGGSFGIALSTTVFSMLQLNYAPSVAATVTFIVSIVLMILGSLSAYMIIPKTVKS

SEQ ID NO: 2427 - DNA, 402 bp, Staphylococcus aureus
ttgaaatactttaaaaaaataagacactttgcccaacttacactaccaataaaaacttctgttagaattcctcaaaatgatatttcgcgacatgttaatgaaattgttgaaacgatacctgatagcaaattcgatgaattcagacatcatcgtggcgcaacatcctatcatccaaagatgatgttaaaaatcatcttatatgcatatactcaatctgtattttctggtcgtagaatagagaaattacttcatgacagtattcgaatgatgtggttagctcaagatcaaacaccttcttataaaactattaatcgttttagagtgaatcctaatactgatgcgttaattgaatctttatttattcagttcgcttatttttcttggatttcttgtatatcattt

SEQ ID NO: 2428 - protein, 134 aa, Staphylococcus aureus
  MISC_FEATURE (1)..(134): truncated transposase
LKYFKKIRHFAQLTLPIKTSVRIPQNDISRHVNEIVETIPDSKFDEFRHHRGATSYHPKMMLKIILYAYTQSVFSGRRIEKLLHDSIRMMWLAQDQTPSYKTINRFRVNPNTDALIESLFIQFAYFSWISCISF

SEQ ID NO: 2429 - DNA, 390 bp, Staphylococcus aureus
atgcaattcaaattaaaagaagaagagattattagttttttagaattgaaatatccagaaaaagagttcgaatatggtcgtttgttagttggacaacataaacgtgatgatttagatgtttattactttggtgatacgtttttaatgtgcacgattatttcattcaagacatttgaaattaaagaaacagtagaattatcatatgatgctgttaatcgtattgtgttaaaagatggatggttatttagaaaaatgagaatagaaacaatgcaaaaagtgttaaaatacggtacatctaaattaatgttaactgattttcaaaaagagaattataataaatatattcaaggtcagaaacaacgcgtgatatttgaaaatggccattttgtc

SEQ ID NO: 2430 - protein, 130 aa, Staphylococcus aureus
  MISC_FEATURE (1)..(130): hypothetical protein
MQFKLKEEEIISFLELKYPEKEFEYGRLLVGQHKRDDLDVYYFGDTFLMCTIISFKTFEIKETVELSYDAVNRIVLKDGWLFRKMRIETMQKVLKYGTSKLMLTDFQKENYNKYIQGQKQRVIFENGHFV

SEQ ID NO: 2431 - DNA, 177 bp, Staphylococcus aureus
ttgagacgagagaatatattattaaggttaataccttttaatgattatgataacaagaattttaaaatgtttattgtgattaaaaatacaaaagtcattattttaaagaataaaatatttgtttttgaacaaagtattaaaaaacataacgaaatgatgtatattgaactatgtgat

SEQ ID NO: 2432 - protein, 59 aa, Staphylococcus aureus
  MISC_FEATURE (1)..(59): NADH dehydrogenase
LRRENILLRLIPFNDYDNKNFKMFIVIKNTKVIILKNKIFVFEQSIKKHNEMMYIELCD

SEQ ID NO: 2433 - DNA, 996 bp, Staphylococcus aureus
atgaaaaaagtgtcaattaaagatgttgctagagaagctggtgtatcagttacaactgtgtcacatattttaaatcataatgatagtcgtttttccgcaacaacgataaaaaacgtacatgctgtttcagaacgtttaggctatgcccctaataaacatgcaaaacaattgcgcggcagtaaaattcaaactattggcgtcattttgcctagcttaacaaatccgtttttctcagcactgatgcaaagtattcatgaccataaaccatctgatgttgatttatgctttttaacatctacagcaactgatttgtatgacaatattaaacatttaattgatcgaggtattgacggattaattatcgcacaatacatatcatccccggacgccctaaataactatctaaagaaacatcatgtaccttatgtcgtactggatcaaaatgaccatcaaggctatacagattttgttcggacaaatgaatatcaaggtggacaacttgcagcacaacatttaatagaactcggtcacaaccatatgataattgttgcaccatatgacatgatggcgaatatgtcgactcgtgtcgctggatttgtcgatactttgcgcgcgaatcaattgccagaaccacaaatcgtccatactgaattatctaagcgcggtgggctaaccattgttgatgacatcatggttcaatctgccactgcaatcttcgctattaacgatgaactcgctattggcattttacgaggactaattgaacatggcatcagtatcccgaaagatatctcattaataggttatgacgacattgattatgcagcgtacgtctcgccacctttaactactgtggcacaacctataactgatattggcaaaacatctttaaccttattacttcaacgattacagcacttagataaatccattgatatgattgaattaccaacgactttaaaaattcgtgcaacaactggctatcatctttcaaac

SEQ ID NO: 2434 - protein, 332 aa, Staphylococcus aureus
  MISC_FEATURE (1)..(332): hypothetical protein
MKKVSIKDVAREAGVSVTTVSHILNHNDSRFSATTIKNVHAVSERLGYAPNKHAKQLRGSKIQTIGVILPSLTNPFFSALMQSIHDHKPSDVDLCFLTSTATDLYDNIKHLIDRGIDGLIIAQYISSPDALNNYLKKHHVPYVVLDQNDHQGYTDFVRTNEYQGGQLAAQHLIELGHNHMIIVAPYDMMANMSTRVAGFVDTLRANQLPEPQIVHTELSKRGGLTIVDDIMVQSATAIFAINDELAIGILRGLIEHGISIPKDISLIGYDDIDYAAYVSPPLTTVAQPITDIGKTSLTLLLQRLQHLDKSIDMIELPTTLKIRATTGYHLSN

SEQ ID NO: 2435 - DNA, 1332 bp, Staphylococcus aureus
gtgaaaaactatttccagttcgataaatatggaacaaactttaaaagagaaatcttaggcggtatcacaactttcttatctatggcctatattttagcagttaacccgcaagttttaagtttagcaggtgttaaaggcgtatcagaagatatgaaaatggaccaaggtgccatttttgtagcgactgcattagcagcatttgtaggctcgctattcatggggctaatagctaaatatccaattgcgttagcaccaggtatgggattaaatgcattctttgcatttactgttgtgttaaccatgggtattccttggcaagttggtttaacaggcgttttattctcaggtatattctttgcgatattaaccgtcacagggtttagggaagttattattaatgcaattccttatcaaatgaagatggctgtttcagcaggtataggattattcattacatttgtaggtttacaaagttcgggtattatagttaaaaatgaatctacattagtaacattgggacatttaactgatccaccagtacttttggcgatattcggtatcgttattacagttattttatatgcaattaaattgccgggttctatctttatcggtatgatcatcacagcaatcgttggtatgttcactggattgattcaaatgccatctggtattgtgggtaagattccaagtattgaaccaacgttcggtgctgcatttgaagcgtttaaagacccaagtcaattattaacgatacagttcttaattgttattttaacgttcttatttattgatttctttgatacagctggtacattagtagctgttgctactcaagcaggtattatgaaagataataaattaccaagagctggtagagcattgttctcagattctttagctacgattgtaggatcagtttttggaacaactacaacaacttcttatatcgaatcaacttcaggtgttgctgtaggtgctagaacaggatttgctagtatcgtaacaggttgttgtttcctattagcgctgttctttagtccgttaatcgctgttgtaacaagtgcagttacgacaccagccttagtggtggtaggtgtattaatggctgcaaactttgctgagataaactggaaaagttttgaagttgcagtgccagccttcattacaatcattatgatgcctttatcatattcaattgcaactggtattgcgtgtggatttattttctatccaattacaatgcttatctctaaaaaacataaagaagtacatccgataatgtatgtattaatggtactattcattctgtacttcatatttgttcatggt

SEQ ID NO: 2436 - protein, 444 aa, Staphylococcus aureus
  MISC_FEATURE (1)..(444): conserved hypothetical
VKNYFQFDKYGTNFKREILGGITTFLSMAYILAVNPQVLSLAGVKGVSEDMKMDQGAIFVATALAAFVGSLFMGLIAKYPIALAPGMGLNAFFAFTVVLTMGIPWQVGLTGVLFSGIFFAILTVTGFREVIINAIPYQMKMAVSAGIGLFITFVGLQSSGIIVKNESTLVTLGHLTDPPVLLAIFGIVITVILYAIKLPGSIFIGMIITAIVGMFTGLIQMPSGIVGKIPSIEPTFGAAFEAFKDPSQLLTIQFLIVILTFLFIDFFDTAGTLVAVATQAGIMKDNKLPRAGRALFSDSLATIVGSVFGTTTTTSYIESTSGVAVGARTGFASIVTGCCFLLALFFSPLIAVVTSAVTTPALVVVGVLMAANFAEINWKSFEVAVPAFITIIMMPLSYSIATGIACGFIFYPITMLISKKHKEVHPIMYVLMVLFILYFIFVHG

SEQ ID NO: 2437 - DNA, 888 bp, Staphylococcus aureus
gtgtataacatgagcattgttgcattacttatcgggttaggccccttaattggctggggcttcttcccaacagtcgcttcaaagtttggtggtaaacctgtacatcaaattatcggtgctactgtaggtacgttaatcttcgctattttattagccgtagtcacatcaagtggcttccctactggaaccaatttgctattcgccttattatcaggtgcaggatggggattcggacaaatcattacatttaaagcgttcgaattagtcggctcatctcgtgccatgccagtcacaacagcattccaattattaggcgcatctttatggggtgtctttgcattaggaaattggccaggcattggtcataaaatcattggatttacagctttagtcgttattctaattggagcgcgtatgacagtttggagtgaacgcaaagaagcaagtaacgccaaaaatttacgtcgtgcagtggtacttctgttaattggtgaatttggatactggttatattcagctgcaccgcaagcaacttctattgatggcctaactgcctttttacctcaagcaatgggtatggtaattgttgcagtcatttatggctttatgaatatgaaagcagagaatccattccgtaataaaattacgtggttacaaattatttcaggtttcttctttgcatttggtgctttaacatatcttatttcagcacaacctaatatgaatggtttagcaactggatttattctttctcaaacatccgttgtgcttgctacattaactggtatttatttcttaaaacaacataaaacgtcaaaagaaatggttattacaatcatcggcttagtactcattttagtagccgcttctgttacagtatttataaaa

SEQ ID NO: 2438 - protein, 296 aa, Staphylococcus aureus
  MISC_FEATURE (1)..(296): hypothetical protein
VYNMSIVALLIGLGPLIGWGFFPTVASKFGGKPVHQIIGATVGTLIFAILLAVVTSSGFPTGTNLLFALLSGAGWGFGQIITFKAFELVGSSRAMPVTTAFQLLGASLWGVFALGNWPGIGHKIIGFTALVVILIGARMTVWSERKEASNAKNLRRAVVLLLIGEFGYWLYSAAPQATSIDGLTAFLPQAMGMVIVAVIYGFMNMKAENPFRNKITWLQIISGFFFAFGALTYLISAQPNMNGLATGFILSQTSVVLATLTGIYFLKQHKTSKEMVITIIGLVLILVAASVTVFIK

SEQ ID NO: 2439 - DNA, 402 bp, Staphylococcus aureus
atgaaaaaatcagctgttttaaatgaacatatttcaaaagcaatcgcgacaattggtcattttgatttattaacgattaatgacgctggcatgccaattccaaatgatcatcgtcgtatcgacctagctgtaactaaaaacttaccacgctttattgatgtcttagctacagtgttagaagaaatggaaatccaaaaaatatacttagcagaagaaataaaagaacataaccctacacaattgcaacaaattaaacaattgatttcatcggaaatcgaaatcattttcattcctcacgaagaaatgaaaagtaacttagctcacccattaaataaaggtaatattcgtactggtgaaacaacgccctactctaatattgcattagaatcgaatgttactttt

SEQ ID NO: 2440 - protein, 134 aa, Staphylococcus aureus
  MISC_FEATURE (1)..(134): ribose permease
MKKSAVLNEHISKAIATIGHFDLLTINDAGMPIPNDHRRIDLAVTKNLPRFIDVLATVLEEMEIQKIYLAEEIKEHNPTQLQQIKQLISSEIEIIFIPHEEMKSNLAHPLNKGNIRTGETTPYSNIALESNVTF

SEQ ID NO: 2441 - DNA, 912 bp, Staphylococcus aureus
atgaccaacaaagttgttattttaggttcaacgaatgtcgatcaatttttaacagttgaaagatatgcacaaccaggcgaaacattacatgttgaagaagcacaaaaagcattcggcggaggtaaaggtgccaaccaggctattgccactgcacgcatgcaagcagacacaacatttattactaaaattggcactgatggcgttgctgatttcatcttagaagattttaaagtagctcatattgatacatcatatattatcaaaacagctgaagcaaaaacgggccaagcctttatcactgtgaatgcagaaggacaaaacaccatctatgtttatggtggtgcgaatatgacgatgacacctgaagatgttattaacgcaaaagacgctataatcaatgcagactttgtcgttgcacaattagaagtacccatcccggctattatatctgcatttgaaattgccaaggcacatggtgtgacgacagtattaaatcctgcaccagcgaaagcattacctaatgaattattatcattaatcgatattattgtgccaaacgaaacagaagccgaattgttatctgggattaaagtaactaatgaacaatctatgaaagacaatgccaattactttttatctataggcattaagactgttttgattacgctaggtaagcaaggtacatattttgctactaaaaatcaaagccaacacatcgaagcttataaagtaaatgcgattgatacaactgctgcaggcgacacatttattggtgcatttgtcagtcgcttaaacaagtcgcaagataacttagcagatgctattgattttggtaataaagcgagctcactcactgtacaaaaacacggcgcgcaagcatctattcctctactagaagaagtaaatcaagtt

SEQ ID NO: 2442 - protein, 304 aa, Staphylococcus aureus
  MISC_FEATURE (1)..(304): probable ribokinase
MTNKVVILGSTNVDQFLTVERYAQPGETLHVEEAQKAFGGGKGANQAIATARMQADTTFITKIGTDGVADFILEDFKVAHIDTSYIIKTAEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSIGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 2443 - DNA, 759 bp, Staphylococcus aureus
atgtctaaagaagctggtcatacatttttagctaaattaggaaaaactcgtctacgccccggtggtaaagaagcaacagattggttaatacaacaaggggcattttcacaagataaacaagtgttagaagtggcatgtaatatgtgcacaacatctatttatctagctcatacatatggctgtcacattcaaggcgttgatataaataagaaagcattagaaaaagcacaggaaaacatttcagcagcaggtcttgaatcatatattcaagttcaacaagcgaatgctgttaaattgccctttgatgacaatcaattcgatatcgttttaaatgaagcaatgttaacaatgttacccatcgccataaaggaaaaagcattacgcgagtactaccgagtcttaaagcctgggggtatcttgttaacacatgatattgtcatcgttaatgaatcacatgccacacatgttgttaaatcattatctgcagcaattaatgtcaatgtctcaccgcagacgaaacttggctggttagatttatataatcaagctggttttaatcatgtgcattatcatactggtccaatgagtttaatgacaccaaaaggtttaatttatgacgaaggtattgttggaactataaagattatcaacaatgctttgaaaaaagaaaatcgaccaatgttttgtaaaatgtttaaaacgatgactaaattgcgtaaagatatgaattatattacttttgtcgctaaaaaagagcac

SEQ ID NO: 2444 - protein, 253 aa, Staphylococcus aureus
  MISC_FEATURE (1)..(253): conserved hypothetical
MSKEAGHTFLAKLGKTRLRPGGKEATDWLIQQGAFSQDKQVLEVACNMCTTSIYLAHTYGCHIQGVDINKKALEKAQENISAAGLESYIQVQQANAVKLPFDDNQFDIVLNEAMLTMLPIAIKEKALREYYRVLKPGGILLTHDIVIVNESHATHVVKSLSAAINVNVSPQTKLGWLDLYNQAGFNHVHYHTGPMSLMTPKGLIYDEGIVGTIKIINNALKKENRPMFCKMFKTMTKLRKDMNYITFVAKKEH

SEQ ID NO: 2445 - DNA, 1434 bp, Staphylococcus aureus
atgacaaaattaccgcaaaatttcatgtggggtggcgctcttgccgcaaatcaatttgaaggtggatatgataaaggtggtaaagggttaagtgtaattgatgttatgacgagtggtgcacatggcaaagcacgtcagattacagaatctatagatcccaatcactattatccaaatcatgaaggtattgatttttatcatcgttataaggaagatattgccttgtttaaagaaatgggattgaaatgtttacgtacgtcgattgcgtggacacgtatctttccgaatggggatgaagatgtgccaaatgaagaaggactcgccttttatgatcgtatctttgatgaattaattgcacaaggtattgaacctgttgtgacgttatcacattttgagatgccacttcatttagcgaaacattatggtggatttagaaatagagaagttgtcgattattttgtgcattttgcgcgtgttgtatttgaaagatataaagataaagttacatattggatgacgtttaatgaaattaataatcagatggacacatcaaatcctatctttttatggacgaattctggggtagcattgacagaaaatgataatcctgaagaagtcttgtatcaagtagcacatcatgaacttttagccagtgctttagcagttcgtcttggtaaagagattaatccgaagtttaagattggaacaatgatttcacatgtacccatttatccatattcgtgtcatccgaaagatatgatggaagcacaaattgcgaatcgcttacgtttctttttcccggatgtccaagtgagaggttattatccaagctatgctaaaaaaatgttggcacgaaaaggatatgatgttggatggcaagaaggggacgacagtattttacagcagggcacggttgattatattggctttagttattacatgtctacggctgtaaaacatgatgttgatactacagttgaaaacaacatcgtcaacggtggtttgaatcattctgtggagaatccgcatatcgcaacgagtgattggggttgggcgattgatccagatggcttaagatatacattgaatgtgttatatgatcgttatcagttaccactttttattgtggaaaatggttttggtgcagttgatgaagtggtagatggacatattcatgatgattatcgcattgaatatttaaaagcacatattacagcagcgatagaagcagttgatcaagatggtgtagatttaatcggttatacaccgtggggaatcattgatattgtttcatttacaaccggtgaaatgaagaaacgctatggtttaatatatgttgatcgagataatgatggtcatggcacgatggaacgcttgaaaaaagattcgttctattggtatcaacaagtgatagcatcaaatggagataaatta

SEQ ID NO: 2446 - protein, 478 aa, Staphylococcus aureus
  MISC_FEATURE (1)..(478): 6-phospho-beta-glucosidase
MTKLPQNFMWGGALAANQFEGGYDKGGKGLSVIDVMTSGAHGKARQITESIDPNHYYPNHEGIDFYHRYKEDIALFKEMGLKCLRTSIAWTRIFPNGDEDVPNEEGLAFYDRIFDELIAQGIEPVVTLSHFEMPLHLAKHYGGFRNREVVDYFVHFARVVFERYKDKVTYWMTFNEINNQMDTSNPIFLWTNSGVALTENDNPEEVLYQVAHHELLASALAVRLGKEINPKFKIGTMISHVPIYPYSCHPKDMMEAQIANRLRFFFPDVQVRGYYPSYAKKMLARKGYDVGWQEGDDSILQQGTVDYIGFSYYMSTAVKHDVDTTVENNIVNGGLNHSVENPHIATSDWGWAIDPDGLRYTLNVLYDRYQLPLFIVENGFGAVDEVVDGHIHDDYRIEYLKAHITAAIEAVDQDGVDLIGYTPWGIIDIVSFTTGEMKKRYGLIYVDRDNDGHGTMERLKKDSFYWYQQVIASNGDKL

SEQ ID NO: 2447 - DNA, 789 bp, Staphylococcus aureus
atgagcaataaatataaagaacaagcccaagacattcttacagctgtaggtggtgtcgaaaacattgttgatgcaacgtatgatacgaagtgcattacaattcatatgcaacatacaattccttctacagcaaatgaagtgaaacaaatagttgatgtgacatctgtagcagaaaatgatacgcagttagtcataaaattaaatggaaatgtcgatgaagtgtatcagcaattacagcgattaattaagaatgctaatgtcgaagagagtgagaatactgacaatattaatagtcaagatacaagttatacacctcaagtaaaagtaacaacaccaattttagtgaaagcaccaatcgctggtcgtcgtattttacttaaagaagtaagagattcaatttttagagagaaaatggtaggtgaaggcttagcaatcaaagctcatgaagaatccaaagtaatcgcaccgttcaatggtttaatatctatgattgtaccaactaagcatgcagttggtattcaatcagaagacggtgtggacatagtcattcatattggcgtgaatacagttgacttggaaggtaaagggttcaagtgctttgtaaagcaaaatgatcatgttgaagcagggcaaacgttgttgcaattcgaccagcaatatatacaacaacaaggctacaatgctgacgttattgtcgttattagcaactctgccgatttaggaaaagtagaactgacaatgaatgaaatcattacgactgaagatgttatttttaaaatatttaaaaac

SEQ ID NO: 2448 - protein, 263 aa, Staphylococcus aureus
  MISC_FEATURE (1)..(263): hypothetical protein
MSNKYKEQAQDILTAVGGVENIVDATYDTKCITIHMQHTIPSTANEVKQIVDVTSVAENDTQLVIKLNGNVDEVYQQLQRLIKNANVEESENTDNINSQDTSYTPQVKVTTPILVKAPIAGRRILLKEVRDSIFREKMVGEGLAIKAHEESKVIAPFNGLISMIVPTKHAVGIQSEDGVDIVIHIGVNTVDLEGKGFKCFVKQNDHVEAGQTLLQFDQQYIQQQGYNADVIVVISNSADLGKVELTMNEIITTEDVIFKIFKN

SEQ ID NO: 2449 - DNA, 702 bp, Staphylococcus aureus
ttgttaaagtatgaacatattgctaagcaacttaatgcgtttatacatcaatctaatttcaaacccggtgataaattgccaagcgtgacgcaattaaaagaacgttatcaagtaagtaagagtactatcattaaagcattaggcttattggaacaagatggtttgatctatcaagcacaaggcagtggtatttatgtgagaaatattgctgatgccaatcgtatcaacgtctttaagactaatggtttctctaaaagtttaggtgaacaccgaatgacaagtaaggtacttgtttttaaggagattgcaacgccacctaaatctgtacaagatgagctccaattaaatgcagatgataccgtctactatttagagcgattaagattcgtggacgatgatgttttatgtatcgaatattcttattatcataaagaaatcgtgaaatatttaaatgatgatattgctaagggctctatcttcgactatttagaatcaaacatgaaacttcgtattggtttttcagatattttctttaatgtagatcaactcacttcaagtgaagcttcattactacaattgtctacaggtgaaccatgtttacgttaccaccagactttttatacaatgactggcaaaccctttgattcatctgacatcgtatttcattatcgtcatgcacagttttatattcctagtaaaaag

SEQ ID NO: 2450 - protein, 234 aa, Staphylococcus aureus
  MISC_FEATURE (1)..(234): hypothetical protein
LLKYEHIAKQLNAFIHQSNFKPGDKLPSVTQLKERYQVSKSTIIKALGLLEQDGLIYQAQGSGIYVRNIADANRINVFKTNGFSKSLGEHRMTSKVLVFKEIATPPKSVQDELQLNADDTVYYLERLRFVDDDVLCIEYSYYHKEIVKYLNDDIAKGSIFDYLESNMKLRIGFSDIFFNVDQLTSSEASLLQLSTGEPCLRYHQTFYTMTGKPFDSSDIVFHYRHAQFYIPSKK

SEQ ID NO: 2451 - DNA, 699 bp, Staphylococcus aureus
atgattaaccacttagcactaaacacaccttacttcggaatactgttatccgttataccatttttcttagcgaccatattatttgaaaaaactaatcgtttcttcttattcgcaccgctatttgtcagtatggtatttggtgtggccttcctctatttaacaggcattccgtataagacttacaaaataggtggagacattatttacttcttcttagaaccggcaacaatctgttttgcgattccgttatataaaaagcgtgaagtgcttgttaaacattggcatcgtatcatcggaggtattggtatcggtacagttgtagcgttattaattattttaacttttgcgaagttagcacaatttgccaatgatgttattttatcaatgttacctcaagcagcaactacagcgattgcgttaccagtatcagctggtatcggtggtataaaagaattaacatcattagcagttattttaaatggtgtcattatttatgccctaggtaataaattcttaaagcttttccgaattactaaccctattgcccgaggattagcacttggaacaagtggtcacacattaggtgtagcaccagccaaagaattaggacctgtagaagaatcaatggcaagtatagctttagtgttagttggtgtagttgttgtagcagttgtgcctgtctttgtagcaatattcttc

SEQ ID NO: 2452 - protein, 233 aa, Staphylococcus aureus
  MISC_FEATURE (1)..(233): holin-like protein
MINHLALNTPYFGILLSVIPFFLATILFEKTNRFFLFAPLFVSMVFGVAFLYLTGIPYKTYKIGGDIIYFFLEPATICFAIPLYKKREVLVKHWHRIIGGIGIGTVVALLIILTFAKLAQFANDVILSMLPQAATTAIALPVSAGIGGIKELTSLAVILNGVIIYALGNKFLKLFRITNPIARGLALGTSGHTLGVAPAKELGPVEESMASIALVLVGVVVVAVVPVFVAIFF

SEQ ID NO: 2453 - DNA, 441 bp, Staphylococcus aureus
atggtcgtgaaacaacaaaaagacgcatcaaaaccagcacacttttttcaccaagtcattgtaattgctttagtactctttgtatcgaaaataattgaatcatttatgccaattcctatgcctgcatcagtaatcggtttagtattattatttgtattattatgtactggtgctgttaagttaggcgaagtcgaaaaagtaggaacgacactaacaaataacattggcttactcttcgtaccagccggtatctcagttgttaactctttaggtgtcattagccaagcaccatttttaatcattggactaataatcgtctcaacaatactattacttatttgtactggctatgtcacacaaattattatgaaagttacttcgagatctaaaggtgacaaagtcacaaaaaagatcaaaatagaggaggcacaagctcatgat

SEQ ID NO: 2454 - protein, 147 aa, Staphylococcus aureus
  MISC_FEATURE (1)..(147): holin-like protein
MVVKQQKDASKPAHFFHQVIVIALVLFVSKIIESFMPIPMPASVIGLVLLFVLLCTGAVKLGEVEKVGTTLTNNIGLLFVPAGISVVNSLGVISQAPFLIIGLIIVSTILLLICTGYVTQIIMKVTSRSKGDKVTKKIKIEEAQAHD

SEQ ID NO: 2455 - DNA, 738 bp, Staphylococcus aureus
atgaaagcattaatcatagatgatgagccattagcacgtaatgaattaacatatttattaaatgaaattggtggttttgaagaaattaatgaggcagaaaatgtaaaagaaacattggaagcactactgatcaatcaatatgacattatatttttagatgtcaatttaatggatgaaaatgggatcgaattaggagctaagattcaaaagatgaaagagccacctgcgattatttttgcaactgcacatgaccaatacgcagtacaggcatttgaattaaatgcgacagactatattttgaaaccgtttggtcaaaaacgtattgaacaagcagtcaataaagtgcgtgcgactaaagccaaagatgataataacgcaagtgcaattgcgaatgatatgtcggcgaattttgatcaaagcttacctgttgaaattgacgataaaattcacatgttaaagcaacaaaatattattgggattggcacacataatggtattacaaccatacatacaacgaatcataaatacgaaacaacagagccattgaatcgttatgaaaaacgattgaatcccacttattttatacgtattcatcgttcatatattattaacacgaaacacattaaagaagtgcaacaatggtttaactatacttatatggtaatattgacaaatggtgtcaagatgcaagttggacgttcatttatgaaagattttaaagcgtcgataggattactt

SEQ ID NO: 2456 - protein, 246 aa, Staphylococcus aureus
  MISC_FEATURE (1)..(246): two-component response
MKALIIDDEPLARNELTYLLNEIGGFEEINEAENVKETLEALLINQYDIIFLDVNLMDENGIELGAKIQKMKEPPAIIFATAHDQYAVQAFELNATDYILKPFGQKRIEQAVNKVRATKAKDDNNASAIANDMSANFDQSLPVEIDDKIHMLKQQNIIGIGTHNGITTIHTTNHKYETTEPLNRYEKRLNPTYFIRIHRSYIINTKHIKEVQQWFNYTYMVILTNGVKMQVGRSFMKDFKASIGLL

SEQ ID NO: 2457 - DNA, 2133 bp, Staphylococcus aureus
atgaaatctttaatattagctgaaaaaccatcagtcgcaagagatattgctgatgctttacaaataaatcagaagcgtaatggttactttgaaaataaccaatatattgtcacgtgggcgttaggtcatctagtgacaaatgcgacacctgaacaatacgataaaaatttaaaggaatggcgattagaagaccttccaattatacctaaatatatgaaaactgttgttattggtaaaacaagcaaacaatttaaaacagtaaaagcgttaattttagataataaagtgaaagatattattattgcaacagatgctggacgagaaggtgaactagttgcaagattgattttggataaagttggtaacaaaaagccaatccgtcgattatggattagctcagttactaaaaaagctattcaacaaggttttaaaaatttaaaagacggtcgtcaatataacgatttgtattatgcagcgttagcgagaagtgaggcagattggattgttgggattaatgcaacgcgtgcactaacaacaaagtatgatgcacagctatccctgggacgtgttcagacaccaacgattcaattagtaaatacacgacaacaagagattaatcagttcaaaccacaacaatactttacattatcattaacggtaaaagggtttgattttcagctagaatcaaatcagcgatataccaataaagaaactttagaacagatggttaataatttgaaaaatgtcgatggtaagattaaatctgttgctactaaacataagaagtcgtatccgcaatcactgtacaatttaacagatttacaacaagatatgtatagacgttataaaattggacctaaagaaacattgaatacacttcaaagcttatatgagagacataaagtcgtaacctatccaagaacagattcaaactatttaacaactgatatggtagatactatgaaagaacgtattcaggtgacgatggcaacaacatataaagaccaagcacgcccattaatgtctaaaacattttcatcaaaaatgtcgatatttaataatcaaaaagtatctgatcaccatgcaattattcctacagaagtgagacctgtcatgtcagacttaagtaatagagaattaaagttatacgatatgattgtcgagcgttttttagaagctttaatgcctccgcacgagtatgacgcgataactgtaactttagaggttgcagggcacacatttgttttgaaagagaatgtaacaactgttttaggttttaaatctattagacaaggtgaatctattacagagatgcaacagcctttttcagaaggcgatgaagtgaagatttcaaaaacaaatattagagaacatgaaacaacacctccagaatattttaatgaaggttcgttattaaaagcgatggagaaccctcagaactttattcaattgaaggataaaaaatatgcgcaaactttaaaacaaacaggtggtatcggcacagttgcaacaagggccgacattatcgataaattatttaatatgaatgccattgaatcaagagacggtaaaattaaagtaacgtcaaaaggtaaacaaatattagaattagcaccagaagaattaacgtcgccacttttaactgcacaatgggaagaaaaattacttttaattgaacgtggtaaatatcaggcgaaaacatttattaatgaaatgaaagattttacgaaagatgttgtaaatgggattaaaaatagtgatcgtaaatataaacacgataatttaacaaccacagaatgcccaacgtgtggtaaattcatgattaaagttaaaactaaaaatggtcagatgcttgtgtgccaagatccatcttgtaagacgaaaaagaatgtacagcgcaaaacaaatgcaagatgtccaaactgtaaaaagaaattaacgttgtttggtaaagggaaagaagcggtatatcgttgtgtttgtggacattctgaaacgcaagcacatatggatcagcgtatgaagtctaaatcctctggtaaagtatctcgtaaagaaatgaaaaagtatatgaataaaaatgaaggtttagacaataatccgtttaaagatgcattaaagaacttgaattta

SEQ ID NO: 2458 - protein, 711 aa, Staphylococcus aureus
  MISC_FEATURE (1)..(711): DNA topoisomerase III topB
MKSLILAEKPSVARDIADALQINQKRNGYFENNQYIVTWALGHLVTNATPEQYDKNLKEWRLEDLPIIPKYMKTVVIGKTSKQFKTVKALILDNKVKDIIIATDAGREGELVARLILDKVGNKKPIRRLWISSVTKKAIQQGFKNLKDGRQYNDLYYAALARSEADWIVGINATRALTTKYDAQLSLGRVQTPTIQLVNTRQQEINQFKPQQYFTLSLTVKGFDFQLESNQRYTNKETLEQMVNNLKNVDGKIKSVATKHKKSYPQSLYNLTDLQQDMYRRYKIGPKETLNTLQSLYERHKVVTYPRTDSNYLTTDMVDTMKERIQVTMATTYKDQARPLMSKTFSSKMSIFNNQKVSDHHAIIPTEVRPVMSDLSNRELKLYDMIVERFLEALMPPHEYDAITVTLEVAGHTFVLKENVTTVLGFKSIRQGESITEMQQPFSEGDEVKISKTNIREHETTPPEYFNEGSLLKAMENPQNFIQLKDKKYAQTLKQTGGIGTVATRADIIDKLFNMNAIESRDGKIKVTSKGKQILELAPEELTSPLLTAQWEEKLLLIERGKYQAKTFINEMKDFTKDVVNGIKNSDRKYKHDNLTTTECPTCGKFMIKVKTKNGQMLVCQDPSCKTKKNVQRKTNARCPNCKKKLTLFGKGKEAVYRCVCGHSETQAHMDQRMKSKSSGKVSRKEMKKYMNKNEGLDNNPFKDALKNLNL

SEQ ID NO: 2459 - DNA, 1752 bp, Staphylococcus aureus
gtgctatcgctaacaatgttattacttgagcgtgtaggtttaattattattttggcctatgtgttgatgaatattccatattttaaaaacttaatgaatcgtcgacgtacatggaaagcacgttggcaattatgtattattttcagtttgtttgccttaatgtctaatttaactggtatcgtcatcgatcatcaacatagtttgtcaggaagtgtgtacttccgtttagatgatgatgtatctttagctaacacacgtgtattaacgataggtgtcgcaggattagttggtggcccttttgtaggtctatttgttggcgttatttcaggtattttcagagtgtatatgggtggggcggatgcacaagtttatcttatctcatctatatttattggtataattgctggttattttggcttacaagctcaaagacgcaagcgttacccgagtattgcgaaaagtgccatgattggaattgttatggaaatgattcaaatgttgagcattttaacattttcccacgacaaagcatatgcggttgacctcatatcattaattgcactaccaatgattattgttaatagcgttggtacggcgatttttatgtctattatcatttcaacattaaagcaagaggagcaaatgaaggctgttcaaacacatgatgtactgcaattgatgaaccagacattgccgtattttaaagaaggattgaatagagaatcggcacagcaaattgcgatgattattaaaaatttaatgaaagtatctgccgtagcaattacaagcaaaaatgaaatcttatcgcatgtaggtgcaggtagtgatcatcacataccaacaaatgaaatattaacaagtctgtctaaagatgtattgaaatcaggaaagttgaaagaagttcatactaaagaagagattggttgtagtcatccgaattgcccgcttagagcagctatcgtgataccacttgagatgcatggttctatcgtcggtacattgaagatgtattttacaaaccctaatgatttaacttttgtggaacgtcaacttgcagaaggattggcaaatatttttagtagccaaattgaacttggtgaagccgaaacgcaaagtaagttattgaaagatgctgagattaagtcattacaggcacaagtgagtccacattttttcttcaattcaattaacacgatctcagctttagttagaataaatagcgaaaaggcacgagagttactattagaattgagttattttttcagagcgaatttacaaggctctaagcaacatacgattactttagataaagagttaagtcaagtgcgtgcatacttatcactcgaacaagcacgttatccaggaagatttaatatcaatattaatgttgaagacaaatatcgcgatgtgcttgtaccaccatttttaattcaaattttagttgaaaatgccatcaaacatgcgtttacgaatcgaaagcaaggtaacgatattgacgtgtcagtgattaaagaaactgcaacacatgtacgtattattgtacaagataatggtcagggtatttctaaagataaaatgcatttgttgggagaaacatctgtagaatcagagtctggaactggtagtgctttagaaaatttaaacttacgcctaaaaggattatttggaaaatccgcagcattacaatttgaatcgacatcgagcggtaccactttttggtgtgtacttccttatgaaagacaagaggaggaa

SEQ ID NO: 2460 - protein, 584 aa, Staphylococcus aureus
  MISC_FEATURE (1)..(584): two-component sensor
VLSLTMLLLERVGLIIILAYVLMNIPYFKNLMNRRRTWKARWQLCIIFSLFALMSNLTGIVIDHQHSLSGSVYFRLDDDVSLANTRVLTIGVAGLVGGPFVGLFVGVISGIFRVYMGGADAQVYLISSIFIGIIAGYFGLQAQRRKRYPSIAKSAMIGIVMEMIQMLSILTFSHDKAYAVDLISLIALPMIIVNSVGTAIFMSIIISTLKQEEQMKAVQTHDVLQLMNQTLPYFKEGLNRESAQQIAMIIKNLMKVSAVAITSKNEILSHVGAGSDHHIPTNEILTSLSKDVLKSGKLKEVHTKEEIGCSHPNCPLRAAIVIPLEMHGSIVGTLKMYFTNPNDLTFVERQLAEGLANIFSSQIELGEAETQSKLLKDAEIKSLQAQVSPHFFFNSINTISALVRINSEKARELLLELSYFFRANLQGSKQHTITLDKELSQVRAYLSLEQARYPGRFNININVEDKYRDVLVPPFLIQILVENAIKHAFTNRKQGNDIDVSVIKETATHVRIIVQDNGQGISKDKMHLLGETSVESESGTGSALENLNLRLKGLFGKSAALQFESTSSGTTFWCVLPYERQEEE

SEQ ID NO: 2461 - DNA, 705 bp, Staphylococcus aureus
ttgtatacactggaaatgaggaggttatctataatgataaataaaaatgacatagtagcagatgtagtaactgattatccgaaagcagcggatatttttagaagtgtgggaatagatttttgttgtggcggacaagtaagtatagaagcagcagccttagaaaagaaaaatgtagatttgaacgaattattacagcgtctcaacgacgttgaacaaacgaatacaccaggttcgttaaatcctaaatttttaaatgtttcatcacttattcaatatattcaatcagcatatcatgaacctctaagagaagaatttaaaaatttaacaccttatgtgacgaagttatcgaaagtacatggacctaatcatccatatttagttgagttaaaagaaacatacgatacatttaaaaatggcatgttagagcatatgcaaaaagaagacgatgtcgattttccaaaactcattaaatatgagcaaggtgaggtagtagacgatattaatactgtgatagatgatttagtttcagaccacattgcaacgggagaattgttagtaaaaatgagcgaattaacatctagttatgaacctccgatagaagcgtgtggtacttggcgacttgtttatcagagattaaaagcacttgaagtgttaacacatgaacacgtacatttagagaatcacgtattatttaaaaaagtatca

SEQ ID NO: 2462 - protein, 235 aa, Staphylococcus aureus
  MISC_FEATURE (1)..(235): cell division and
LYTLEMRRLSIMINKNDIVADVVTDYPKAADIFRSVGIDFCCGGQVSIEAAALEKKNVDLNELLQRLNDVEQTNTPGSLNPKFLNVSSLIQYIQSAYHEPLREEFKNLTPYVTKLSKVHGPNHPYLVELKETYDTFKNGMLEHMQKEDDVDFPKLIKYEQGEVVDDINTVIDDLVSDHIATGELLVKMSELTSSYEPPIEACGTWRLVYQRLKALEVLTHEHVHLENHVLFKKVS

SEQ ID NO: 2463 - DNA, 1722 bp, Staphylococcus aureus
atgatgaaattttcagtaatagttccaacatacaattcagaaaagtatataacagaattacttaatagccttgcgaaacaagattttccgaaaactgaatttgaagtggttgtagttgatgactgttcaacagatcaaacgttacaaatagttgaaaagtatcgcaataaattgaacttgaaagtaagtcaactcgaaacaaattctggtggtccaggtaaacctagaaatgtggcgttaaaacaagcagaaggtgaatttgtattatttgtggactccgatgactatataaacaaagagactttaaaggatgcagcagcatttattgatgaacatcactcagatgtcttattgattaaaatgaaaggtgttaatggtcgtggtgtaccacaatctatgtttaaagaaacagcacctgaagttactttgttaaattcaagaattatctatactttaagcccgactaaaatctatagaacagcattactaaaagataatgacatttattttccagaagaattaaagagtgcagaagatcaattatttacaatgaaagcatatttaaatgcaaatcgaatcagtgtgttaagtgataaagcgtattattatgctacaaagcgtgaaggtgaacatatgagtagtgcgtatgtttcacctgaagacttttatgaagtcatgagattgattgctgtagaaatattaaatgcagatttagaagaagcccataaaaatcaaatcttagcagaatttttaaatcgtcattttagtttttctcgtacgaatggcttctcacttaaagttaaactagaagatcaaccacaatggattaatgctctaggagactttatacaagcagttccagaacgtgtagatgcattggtgatgagtaaattacgaccattgttgcactacgcgagagcgaaagatatagacaactatagaactgtggaagaaagttaccgtcaaggtcaatactaccgttttgatattgtagatggtaaattaaacattcaattcaatgaaggcgaaccatactttaaaggcattgatatcgctaagccaaaagtgaaaatgacagcatttaaatttgataatcataaaattgttacagagctaacgttaaatgaatttatgattggcgaaggacattatgatgtcagacttaaattacattcacgaaacaagaagcacacaatgtatgtacctttaagtgtcaatgcgaataaacaatatcgttttaacattatgttagaagatattaaagcgtatttacctaaagaaaaaatttgggatgttttcttagaagtccaaataggtacggaagtatttgaagtgcgtgttggtaatcaacgtaataaatatgcatatactgcagaaacaagtgcattaattcatttgaataatgatttttatagattaacaccgtatttcacaaaagactttaataacatttcgttatactttacagctattacattaacggattcaatctcattgaagttaaaaggtaaaaacaaaatcattttaactggtctggatcgtggttatgtatttgaagaaggtatggctagtgtcgtactaaaagacgacatggtgatgggaatgttaagccaaacatcagaaaacgaagtgcaaatcttacttagcaaagatattaaaaagcgagacttcaaaaatattgttaagttaaacactgcacatatcacttatccactaaataaa

SEQ ID NO: 2464 - protein, 574 aa, Staphylococcus aureus
  MISC_FEATURE (1)..(574): hypothetical protein
MMKFSVIVPTYNSEKYITELLNSLAKQDFPKTEFEVVVVDDCSTDQTLQIVEKYRNKLNLKVSQLETNSGGPGKPRNVALKQAEGEFVLFVDSDDYINKETLKDAAAFIDEHHSDVLLIKMKGVNGRGVPQSMFKETAPEVTLLNSRIIYTLSPTKIYRTALLKDNDIYFPEELKSAEDQLFTMKAYLNANRISVLSDKAYYYATKREGEHMSSAYVSPEDFYEVMRLIAVEILNADLEEAHKNQILAEFLNRHFSFSRTNGFSLKVKLEDQPQWINALGDFIQAVPERVDALVMSKLRPLLHYARAKDIDNYRTVEESYRQGQYYRFDIVDGKLNIQFNEGEPYFKGIDIAKPKVKMTAFKFDNHKIVTELTLNEFMIGEGHYDVRLKLHSRNKKHTMYVPLSVNANKQYRFNIMLEDIKAYLPKEKIWDVFLEVQIGTEVFEVRVGNQRNKYAYTAETSALIHLNNDFYRLTPYFTKDFNNISLYFTAITLTDSISLKLKGKNKIILTGLDRGYVFEEGMASVVLKDDMVMGMLSQTSENEVQILLSKDIKKRDFKNIVKLNTAHITYPLNK

SEQ ID NO: 2465 - DNA, 1686 bp, Staphylococcus aureus
ttggttaaaagtaagatatatatagataaaatctattgggaacgtgttcagttattcgttgaaggacatagtgaaaacctagatttagaagatagtaattttgtattaagaaatttaactgagacacgtacaatgaaggcgaatgatgtcaaaatagatgggaatcaattcgtttgtcgtttcaatgtagctatcttagataatggttattacttacctgaagataagtacttattagtgaatgagcaagaacttgattatattgcacagttaaacccagatgtgattaatgatgcatatcaaaatctaaagccagaacaagaagaagaatacaacgaattagaaacacaaaatggtaaaatcaatttcttattgcagacttacctaaaagaatttagaaaaggcggcatttcgaagaaaacggtttatactgttacacctgaaatttctagcgatgttaatgaatttgtccttgatgttgttgtaacgactccggaagttaaaagtatttatatcgttcgtaaatataaagaattacgtaagtatttccgcaaacaatcatttaatacaagacaatttatttttaaagcgatatttaatacgacgaaatttttccacttgaaaaaagggaatacggtgttgttcacatcagactctagaccaacgatgtctggaaactttgaatacatctataacgaaatgttacgtcaaaatttagataaaaagtatgatattcacactgtttttaaagcgaatattacagatagacgtggcatcatcgacaagtttagattgccatatttacttgggaaggcagactacatctttgttgatgactttcacccattgatttatacagtgcgttttagacgttctcaagaagttattcaagtatggcatgccgttggtgcctttaaaacagttggctttagtcgtactggtaaaaagggtggaccatttattgattcattaaatcatcgtagctatacaaaagcttatgtatcatctgaaaccgatattccattctacgctgaagcatttggtattaaagagaaaaatgtagtgcctacaggtgttccacgtactgatgtactatttgatgaagcttatgcgacacagatcaaacaagagatggaagatgaattaccaattattaaaggtaagaaagtcattcttttcgcaccaacatttagaggtagtggtcatggtacagcacattacccatttttcaaaattgattttgaacgtttagcaagatattgcgaaaaaaataacgcggttgtattatttaaaatgcatccatttgtgaaaaatagacttaatattgcagacaaacataaacaatattttgttgacgtttctgactttagagaagttaatgatatactgttcataacagatttattaattagtgactattcatctttaatatatgaatatgcagtatttaaaaagccaatgattttctatgcatttgatttagaagattatattacgacgcgtgatttttatgaaccatatgaatcatttgttccaggtaaaattgtgcaatcatttgacgcattaatggacgccttggacaatgaagattatgaaggagaaaaagtcattccattcttagataaacattttaaatatcaagatggccgatcaagtgagcgtttagtcagaaatttatttggtagc

SEQ ID NO: 2466 - protein, 562 aa, Staphylococcus aureus
  MISC_FEATURE (1)..(562): hypothetical protein
LVKSKIYIDKIYWERVQLFVEGHSENLDLEDSNFVLRNLTETRTMKANDVKIDGNQFVCRFNVAILDNGYYLPEDKYLLVNEQELDYIAQLNPDVINDAYQNLKPEQEEEYNELETQNGKINFLLQTYLKEFRKGGISKKTVYTVTPEISSDVNEFVLDVVVTTPEVKSIYIVRKYKELRKYFRKQSFNTRQFIFKAIFNTTKFFHLKKGNTVLFTSDSRPTMSGNFEYIYNEMLRQNLDKKYDIHTVFKANITDRRGIIDKFRLPYLLGKADYIFVDDFHPLIYTVRFRRSQEVIQVWHAVGAFKTVGFSRTGKKGGPFIDSLNHRSYTKAYVSSETDIPFYAEAFGIKEKNVVPTGVPRTDVLFDEAYATQIKQEMEDELPIIKGKKVILFAPTFRGSGHGTAHYPFFKIDFERLARYCEKNNAVVLFKMHPFVKNRLNIADKHKQYFVDVSDFREVNDILFITDLLISDYSSLIYEYAVFKKPMIFYAFDLEDYITTRDFYEPYESFVPGKIVQSFDALMDALDNEDYEGEKVIPFLDKHFKYQDGRSSERLVRNLFGS

SEQ ID NO: 2467 - DNA, 1050 bp, Staphylococcus aureus
atgctattattcgaggtggtattgccgatgattaatcaagtatatcaattagttgcacctagacaatttgaagttacgtataacaacgtagatatttacagtgactatgtcattgtacgtcctttatatatgtcaatttgtgctgccgatcaaagatattatactggtagccgtgatgagaatgtcttatctcagaaattgccaatgtctttaattcatgaaggtgttggtgaggtcgtatttgacagtaaaggtgtgtttaataaaggtacaaaagtagttatggtaccgaatacgccgacagaaaaagacgatgtcattgctgaaaactatttaaaatcgagctacttcagatcaagtggacatgatgggtttatgcaagattttgtgttgctaaatcatgatagagctgtaccactacctgatgatattgatttaagtattatttcatatacagagcttgtaacagtaagtttgcatgctattcgtcgttttgaaaagaaatctatttcaaataaaaatacatttggtatttggggtgatggtaacttaggttacattacagccattttattacgtaaattatatccagagtctaaaatatatgtctttggtaaaacagattataaattgagtcacttctcatttgttgatgatgtcttctttattaataaaatacctgaaggcttaacatttgatcatgcatttgagtgtgtgggtggtcgcggtagtcaatcagccataaatcaaatgatcgattacatttcaccagaaggaagcattgcactgttaggtgtaagtgagttcccagtagaagttaatacacgtctagtattggaaaaaggactaacgttgattggtagtagtcgaagtggttcaaaagatttccaagatgttgtagacttatacattcaatacccagatattgtagataaattagcgttgttaaaaggtcaagaatttgaaattgcaacaattaatgatcttacagaagcttttgaagcagacctgtctacatcttggggtaaaacagtattaaaatggattatg

SEQ ID NO: 2468 - protein, 350 aa, Staphylococcus aureus
  MISC_FEATURE (1)..(350): hypothetical protein
MLLFEVVLPMINQVYQLVAPRQFEVTYNNVDIYSDYVIVRPLYMSICAADQRYYTGSRDENVLSQKLPMSLIHEGVGEVVFDSKGVFNKGTKVVMVPNTPTEKDDVIAENYLKSSYFRSSGHDGFMQDFVLLNHDRAVPLPDDIDLSIISYTELVTVSLHAIRRFEKKSISNKNTFGIWGDGNLGYITAILLRKLYPESKIYVFGKTDYKLSHFSFVDDVFFINKIPEGLTFDHAFECVGGRGSQSAINQMIDYISPEGSIALLGVSEFPVEVNTRLVLEKGLTLIGSSRSGSKDFQDVVDLYIQYPDIVDKLALLKGQEFEIATINDLTEAFEADLSTSWGKTVLKWIM

SEQ ID NO: 2469 - DNA, 714 bp, Staphylococcus aureus
atgaaatacgctggtattctagctggaggtataggctcaagaatgggtaacgtacctttacctaaacaatttttagatttagacaacaaaccgattttaatccatacattagaaaaatttattttaattaatgattttgaaaaaattattatcgcgacgccacaacaatggatgacgcatacgaaagatacacttagaaaattcaaaatttctgatgaaagaattgaagtcattcaaggtggtagcgatcgtaacgatacaattatgaatatcgttaaacatattgaatcaacaaatggtattaacgatgacgatgtcattgtgacacatgatgcagttagaccatttttaacgcatcgtattattaaagaaaatattcaagctgctttagagtacggtgcagtagatacagtgattgatgctatagatacgattgttacatctaaagataatcaaacgattgatgcaattccagtgcgtaatgaaatgtaccaaggtcaaacacctcaatcgtttaatattaatttattaaaagaaagctatgcacagttgagtgatgagcaaaagagtattttatctgatgcttgtaagattattgtagaaacaaacaaaccggttcgacttgtaaaaggtgagttatataacattaaagtaacaacaccttacgatttaaaagtagcgaatgctattattcgaggtggtattgccgatgat

SEQ ID NO: 2470 - protein, 238 aa, Staphylococcus aureus
  MISC_FEATURE (1)..(238): conserved hypothetical
MKYAGILAGGIGSRMGNVPLPKQFLDLDNKPILIHTLEKFILINDFEKIIIATPQQWMTHTKDTLRKFKISDERIEVIQGGSDRNDTIMNIVKHIESTNGINDDDVIVTHDAVRPFLTHRIIKENIQAALEYGAVDTVIDAIDTIVTSKDNQTIDAIPVRNEMYQGQTPQSFNINLLKESYAQLSDEQKSILSDACKIIVETNKPVRLVKGELYNIKVTTPYDLKVANAIIRGGIADD

SEQ ID NO: 2471 - DNA, 1230 bp, Staphylococcus aureus
atggttacaatgagcttgctcatacatattaatataattacaaaaacacgtcggaggtacgacatgattaaaaatacaattaaaaaattgatagaacatagtatatatacgacttttaaattactatcaaaattgccaaacaagaatctaatttattttgaaagctttcatggtaaacaatacagcgacaaccccaaagcattatatgaatacttaactgaacatagcgatgcccaattaatatggggtgtgaaaaaaggatatgaacacatattccaacagcacaatgtaccatatgttacaaagttttcaatgaaatggtttttagcgatgccaagagcgaaagcgtggatgattaacacacgtacaccagattggttatataaatcaccgcgaacgacgtacttacaaacatggcatggcacgccattaaaaaagattggtttggatattagtaacgttaaaatgctaggaacaaatactcaaaattaccaagatggctttaaaaaagaaagccaacggtgggattatctagtgtcacctaatccatattcgacatcgatatttcaaaatgcatttcatgttagtcgagataagattttggaaacaggttatccaagaaatgataaattatcacataaacgcaatgatactgaatatattaatggtattaagacaagattaaatattccattagataaaaaagtgattatgtacgcgccaacttggcgtgacgatgaagcgattcgagaaggttcatatcaatttaatgttaactttgatatagaagctttgcgtcaagcgctggatgatgattatgttattttattacgcatgcattatttagttgtgacacgtattgatgaacatgatgattttgtgaaagacgtttcagattatgaagacatttcggatttatacttaatcagcgatgcgttagttaccgactactcatctgtcatgttcgacttcggtgtattaaagcgtccgcaaattttctatgcatatgacttagataaatatggcgatgagcttagaggtttttacatggattataaaaaagagttgccaggtccaattgttgaaaatcaaacagcactcattgatgcattaaaacaaatcgatgagactgcaaatgagtatattgaagcacgaacggtattttatcaaaaattctgttcattagaagatggacaagcgtcacaacgaatttgccaaacgatttttaag

SEQ ID NO: 2472 - protein, 410 aa, Staphylococcus aureus
  MISC_FEATURE (1)..(410): hypothetical protein
MVTMSLLIHINIITKTRRRYDMIKNTIKKLIEHSIYTTFKLLSKLPNKNLIYFESFHGKQYSDNPKALYEYLTEHSDAQLIWGVKKGYEHIFQQHNVPYVTKFSMKWFLAMPRAKAWMINTRTPDWLYKSPRTTYLQTWHGTPLKKIGLDISNVKMLGTNTQNYQDGFKKESQRWDYLVSPNPYSTSIFQNAFHVSRDKILETGYPRNDKLSHKRNDTEYINGIKTRLNIPLDKKVIMYAPTWRDDEAIREGSYQFNVNFDIEALRQALDDDYVILLRMHYLVVTRIDEHDDFVKDVSDYEDISDLYLISDALVTDYSSVMFDFGVLKRPQIFYAYDLDKYGDELRGFYMDYKKELPGPIVENQTALIDALKQIDETANEYIEARTVFYQKFCSLEDGQASQRICQTIFK

SEQ ID NO: 2473 - DNA, 1692 bp, Staphylococcus aureus
atgacaaaaacgaaacaagcaatacatattgataacatatactgggaacgtgttcagttatatattgaaggacatagtgaaggtgtcgatttaacatcaggacaatttgttctgaggaatttaaccgaaacaaaaacattagaagcaaatgaaatgaaaatagacggtaatacatttatatgtagattcaacgtcgcaatattagacgatgggtattatttaccaatggataaatatttatttgtttatcatgaccagttagagtatattggacaacttaatccaaatattattgatcaagcttatgcggcattaaatgaagagcaaattgaagaatacaatgagctgactacacaaaatggaaaagtgaactatttattagcgtatgatgctaaagttttccgtaaaggtggcgtatcacaacatacggtctataccattactccggaaatagcaagtgacgttaacgaatttgtatttgatattgaaatcaccttacctcaagagaaatcaggggtcattgcgacaagtgcacactggcttcataaacaaggtcataaagcttcatttgaaagtagaagtttcttatttaaagctatttttaatattacaaagttactacatattaaaagaagcaaaacaatattattcacatcagattcgcgtccgaatttatcagggaatttcaagtatgtatatgatgagttactacgccaaaaagtagattttgattatgatattaaaacggtatttaaggagaatattacggatagacgcaaatggagagacaagtttagattgccatatttacttggtaaggccgattatatttttgttgatgatttccatccattaatttatacggttcgctttagaccatcacaagaaattattcaagtgtggcatgctgttggtgcctttaaaacagttggctttagtcgtacaggtaaaaaaggtggtccgtttatcgattcattaaaccatcgtagttacacgaaagcatatgtttcatcagaaaccgatattccattttatgctgaagcatttggaattagagaagaaaatgttgtaccaacaggtgtaccacgtactgatgtactatttgatgaagcttatgcaacacaaattaaacaagagatggaagatgaattgccaattataaaaggtaagaaagttattctattcgcaccgacatttagaggtaatggtcacggtacggcacattatccattttttaaaattgattttgaacgtttagcaagatactgcgagaagcataatgcagttgtgttattcaaaatgcatccgttcgtaaaaaatagacttaatatttcacgtgaacatagacaatactttatcgatgtgtcagatcatcgtgaagttaacgatattctctttgttacagacttgttgattagtgattattcatctttaatatatgaatatgcagtatttaaaaagccgatgattttctatgcatttgacttagaagattacattacgacgcgtgatttctatgaaccatttgaatcatttgttccaggtaaaattgtacagtcctttgatgcattaatggatgctttggacaatgaagattatgaggttgaaaaagttgtgccattcttagataaacattttaaatatcaagatggtcgctcaagtgaacgtttagtcaaagatttgtttagacgc

SEQ ID NO: 2474 - protein, 564 aa, Staphylococcus aureus
  MISC_FEATURE (1)..(564): hypothetical protein
MTKTKQAIHIDNIYWERVQLYIEGHSEGVDLTSGQFVLRNLTETKTLEANEMKIDGNTFICRFNVAILDDGYYLPMDKYLFVYHDQLEYIGQLNPNIIDQAYAALNEEQIEEYNELTTQNGKVNYLLAYDAKVFRKGGVSQHTVYTITPEIASDVNEFVFDIEITLPQEKSGVIATSAHWLHKQGHKASFESRSFLFKAIFNITKLLHIKRSKTILFTSDSRPNLSGNFKYVYDELLRQKVDFDYDIKTVFKENITDRRKWRDKFRLPYLLGKADYIFVDDFHPLIYTVRFRPSQEIIQVWHAVGAFKTVGFSRTGKKGGPFIDSLNHRSYTKAYVSSETDIPFYAEAFGIREENVVPTGVPRTDVLFDEAYATQIKQEMEDELPIIKGKKVILFAPTFRGNGHGTAHYPFFKIDFERLARYCEKHNAVVLFKMHPFVKNRLNISREHRQYFIDVSDHREVNDILFVTDLLISDYSSLIYEYAVFKKPMIFYAFDLEDYITTRDFYEPFESFVPGKIVQSFDALMDALDNEDYEVEKVVPFLDKHFKYQDGRSSERLVKDLFRR

SEQ ID NO: 2475 - DNA, 1050 bp, Staphylococcus aureus
atgccattattcaaggtgatattgccgatgattaatcaagtatatcaactcgttgcaccgagacagttcgacgtcacatataataatgttgatatttatggtaatcatgtcatcgtaagacctttatacttgtctatttgtgcagctgatcaaaggtattacacaggtcgaagagatgaaaatgtactacgcaaaaaattaccaatgtcattagttcatgaagctgttggtgaagttgtatttgatagtaaaggggtatttgaaaaaggtacgaaagtagtaatggtaccgaatacacctacagagcaacatcatattattgcggagaattacttagcctctagttattttagatctagtggttatgatggttttatgcaagactacgttgtgatggcacatgatcgtatcgttccgctgcctaatgacattgatttgagtacgatttcatacacagagttagtgtcagtaagttatcatgctatacaacgatttgaacgtaaatctatacctttgaaaaccagctttggtatttggggtgatggtaacttaggttatattactgctattttgctacgtaagttgtacccagaagctaaaacttatgtatttggtaagacagactataaattaagtcatttttcatttgtagatgacatctttacagtaaatcaaataccagatgatcttaaaattgatcatgcatttgaatgtgttggaggtaaaggaagtcaagttgcacttcaacaaatagttgaacatatttcaccagaaggcagtattgctttgttaggcgtaagtgaattacccgtggaagtgaatacacgattagtacttgaaaaaggattaacgttgattggtagtagtcgaagcggctctaaagattttgagcaagttgttgatttatatcgtaagtacccagacatagttgaaaagttagcattattaaaaggacatgaaattaatgtatgtacgatgcaagatatcgtccaagcgtttgaaatggatttatcgacatcttggggaaaaacagtattgaaatggacgatt

SEQ ID NO: 2476 - protein, 350 aa, Staphylococcus aureus
  MISC_FEATURE (1)..(350): hypothetical protein
MPLFKVILPMINQVYQLVAPRQFDVTYNNVDIYGNHVIVRPLYLSICAADQRYYTGRRDENVLRKKLPMSLVHEAVGEVVFDSKGVFEKGTKVVMVPNTPTEQHHIIAENYLASSYFRSSGYDGFMQDYVVMAHDRIVPLPNDIDLSTISYTELVSVSYHAIQRFERKSIPLKTSFGIWGDGNLGYITAILLRKLYPEAKTYVFGKTDYKLSHFSFVDDIFTVNQIPDDLKIDHAFECVGGKGSQVALQQIVEHISPEGSIALLGVSELPVEVNTRLVLEKGLTLIGSSRSGSKDFEQVVDLYRKYPDIVEKLALLKGHEINVCTMQDIVQAFEMDLSTSWGKTVLKWTI

SEQ ID NO: 2477 - DNA, 726 bp, Staphylococcus aureus
atggaggacaacatgatttatgcaggtattttagcaggaggtattggttcgagaatggggaacgtgccattaccaaaacaatttttagatattgataataaaccgattttaatccatacaattgagaagttcattttagtgagtgaatttaatgagattattatcgcaacgccagcacagtggatttcccatacacaggatattttaaaaaaatataacattacagatcaacgtgtcaaagtagttgcaggtggtacggatcgaaatgaaacaattatgaacattatcgaccatattcgcaatgtaaatggaattaataatgatgatgtgattgtaactcatgatgccgtaagaccatttttaactcaacgtattattaaagagaacattgaagtagcagcaaaatatggtgcagtagatacagtcattgaagcaattgatacgattgtaatgtctaaagataaacagaacatacacagtatccctgtaaggaatgaaatgtatcaaggccaaacaccacaatcatttaatattaaattattacaagatagttatcgcgccttaagtagtgaacaaaaagaaatcttatcagatgcatgtaaaatcattgtcgaatctggacatgcagttaaattggtacgtggagaactatacaacattaaagtgacaacaccgtatgatttaaaagtagcaaatgccattattcaaggtgatattgccgatgat

SEQ ID NO: 2478 - protein, 242 aa, Staphylococcus aureus
  MISC_FEATURE (1)..(242): hypothetical protein
MEDNMIYAGILAGGIGSRMGNVPLPKQFLDIDNKPILIHTIEKFILVSEFNEIIIATPAQWISHTQDILKKYNITDQRVKVVAGGTDRNETIMNIIDHIRNVNGINNDDVIVTHDAVRPFLTQRIIKENIEVAAKYGAVDTVIEAIDTIVMSKDKQNIHSIPVRNEMYQGQTPQSFNIKLLQDSYRALSSEQKEILSDACKIIVESGHAVKLVRGELYNIKVTTPYDLKVANAIIQGDIADD

SEQ ID NO: 2479 - DNA, 93 bp, Staphylococcus aureus
gtgatattaacatgttacaatacatttaacacatcatttgcaatcattgaatttaaatcaaagattagtggaatagatgaagcacgttcgaaa

SEQ ID NO: 2480 - protein, 31 aa, Staphylococcus aureus
VILTCYNTFNTSFAIIEFKSKISGIDEARSK

SEQ ID NO: 2481 - DNA, 975 bp, Staphylococcus aureus
atgtattgtaacatgttaatatcactattaactttcatttcagttgaaatactatataataaaagtaacaaaaagtacggaggtaatgacatgagcatagttcagttatatgatattacacaaataaaatcgttcattgaacattcgaattatgaatcagcatcatacttatataaacttcctcaacagtacaatgaaatagatgtattaataaccgatgcgattgaatcacctggtgtattttcgattaaagaaaacgattcaatcaaagcaatcatattgtcttttgcatacgataaaaataaattcaaagtcataggccctttcgtggctgacaattatgtattatctgtcgatacgtttgaaacgctatttaaagcaatgacttcgaaccaacctgacgatgccgtctttaacttttcttttgaagaaggcattcaacaatacaaaccattaatgaaagttattcaagcaagttataacttcactgactattacatagaagcccgtacaagattagaagaagatatgcaccaaccaaatatcattccttatcacaaagggttttatcgtgctttcagcaaattacacacaactacatttaaatatcaggcacagtcaccacaagatatcattgatagtttagacgaccatcatcatttgtttttatttgttagcgaaggtttacttaaaggttatttataccttgaaattgattcacaacagtcaatcgccgagattaaatacttcagttctcatgtagattaccgtttgaaaggtatcgctttcgagttgcttgcgtatgcattgcaatatgcttttgataattttgatattagaaaagtttattttaaaattcgtaataaaaataataaactcatcgaacgatttaatggtctaggtttccatatcaactatgagtacattaaattcaaattcgaatcacgtaacgtaaaagatcaaacaatccctgaa

SEQ ID NO: 2482 - protein, 325 aa, Staphylococcus aureus
  MISC_FEATURE (1)..(325): conserved hypothetical
MYCNMLISLLTFISVEILYNKSNKKYGGNDMSIVQLYDITQIKSFIEHSNYESASYLYKLPQQYNEIDVLITDAIESPGVFSIKENDSIKAIILSFAYDKNKFKVIGPFVADNYVLSVDTFETLFKAMTSNQPDDAVFNFSFEEGIQQYKPLMKVIQASYNFTDYYIEARTRLEEDMHQPNIIPYHKGFYRAFSKLHTTTFKYQAQSPQDIIDSLDDHHHLFLFVSEGLLKGYLYLEIDSQQSIAEIKYFSSHVDYRLKGIAFELLAYALQYAFDNFDIRKVYFKIRNKNNKLIERFNGLGFHINYEYIKFKFESRNVKDQTIPE

SEQ ID NO: 2483 - DNA, 1041 bp, Staphylococcus aureus
gtgaaagcattgaaattatatggcgtggaagatttacggtatgaggataatgaaaagccagtcattgaaagtgcgaatgacgttattattaaagtacgagcgactggcatatgtggttcagacacgtcacgatacaaaaaaatggggccatacattaaaggtatgccatttggtcatgaattttcaggtgtagtagatgccattggaagtgatgttacgcatgttaatgtgggcgacaaagtgacaggttgcccagcaataccttgttatcaatgcgagtattgtttaaaaggtgaatatgcacgatgtgaaaagttattcgtcattggctcatatgaacctggatcgttcgcggaatatgtcaaattgccagcgcaaaatgttttaaaggttccagacaatgttgattacattgaagcagcaatggttgagccatcagccgttgttgcgcatgggttttataaatcgaatatacaacctggtatgactgttgcagtaatggggtgtggcagtataggtttgttagctattcaatgggcacgaatatttggtgctgcacatatcatcgctatagatatagatgcgcataaactagatattgcaacatcattgggcgcacatcaaacaatcaattcaaaagaagaaaatcttgagaaattcatcgaaaatcattacgccaatcaaatcgatttagctatagaatcatcaggtgctaaagttacgattggtcaaatattgacgctacctaaaaaaggtggcgaggtggtattactcggaataccatatgatgatattgagattgatcgcgttcattttgaaaaaattctgcgtaacgagttgacagtatgtggctcttggaactgtttgtccagtaattttccgggcaaagagtggacggcaaccttacattatatgaagacgaaagatattaatgtaaagcctattatttctcattttttaccgttagaaaaaggcccggagacatttgataaattagttaacaagaaagaacgatttgataaagtcatgtttacgatttat

SEQ ID NO: 2484 - protein, 347 aa, Staphylococcus aureus
  MISC_FEATURE (1)..(347): sorbitol dehydrogenase
VKALKLYGVEDLRYEDNEKPVIESANDVIIKVRATGICGSDTSRYKKMGPYIKGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDLAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 2485 - DNA, 144 bp, Staphylococcus aureus
atggtagaatcaatgctaacttttatgcttgggccattaagacaaatcactgatttttatatggaacatttactcgtaagtaattccattgtcattgcaggttattttgcgacaggtatttttaaaaagaaaaaagttgtgaat

SEQ ID NO: 2486 - protein, 48 aa, Staphylococcus aureus
  MISC_FEATURE (1)..(48): hypothetical protein
MVESMLTFMLGPLRQITDFYMEHLLVSNSIVIAGYFATGIFKKKKVVN

SEQ ID NO: 2487 - DNA, 1062 bp, Staphylococcus aureus
gtgtttgtggtgaaagctttagtaaaaacaagagaaggacatggcaacttagaacttcttgataaagaagttgcaacaccgctagatgataaagtaaagattaaagtacattatgcaggaatttgtggcacagatattcatacttatgaaggtcattataaagttaattttccagtgacattaggtcatgaattttctggtgaaatcgttgaagttggagcagacgttaaagattttaaagttggtgaccgtgtcacatctgaaacgacattctatgtttgtaatgagtgtgaatactgtaaatcaaaagactataatttatgcaaccatcgaaaaggtattggaacacaagttgatggcgcatttactaattatgtcattgcacgtgaagaaagtttgcatcatattccagacgaagtatcgtatcagtctgcagctatgacagaaccattagcatgtgcacatcatggcgtttctaagattcaagtcaattcaggcgatgtagcagttgtaatgggacctgggccaatcggattacttgtagcacaagtgttaaaaagtaaaggcgcaactgttgtggtaactggattggacaatgacaaagtcagattagataaagcagaagcattgcacatggattatgtagtcaatttacaacaaacagacttaaaaacgtatatcaatggaattacagacggttacggtgcagatgttgttgttgaatgttcaggtgcagttccagcagcacgacaaggtttggatattttacgcaaaaaaggtttctacagtcaaataggtatttttaaggatgctgaaattccatttgatatggaaaaagtgattcaaaaagaaataacagttgttggtagtagaagtcaaaagccagcagattgggaaccttcattgcaacttatggcggatggtttagtaaatgctgaagctttggtgacaaaaatatatgatatttcgaaatgggacgaggcgtatcaacatttaaaatccggcgaaggtattaaagcattacttaagccgctcgatttagatgaaaatgaaggagagaat

SEQ ID NO: 2488 - protein, 354 aa, Staphylococcus aureus
  MISC_FEATURE (1)..(354): sorbitol dehydrogenase
VFVVKALVKTREGHGNLELLDKEVATPLDDKVKIKVHYAGICGTDIHTYEGHYKVNFPVTLGHEFSGEIVEVGADVKDFKVGDRVTSETTFYVCNECEYCKSKDYNLCNHRKGIGTQVDGAFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDILRKKGFYSQIGIFKDAEIPFDMEKVIQKEITVVGSRSQKPADWEPSLQLMADGLVNAEALVTKIYDISKWDEAYQHLKSGEGIKALLKPLDLDENEGEN

SEQ ID NO: 2489 - DNA, 1257 bp, Staphylococcus aureus
atgagttacttcactgattttgtaaggggatttttagatttaggtgcaactgttattttaccggttgtcatattcttgcttggcctattctttaggcagaaaattggagcggcatttaggtctggtttaacaataggtgtggcttttgtagggattttcttagtcatcgatttattagttaaaaatttagggccagcagcacaagcgatggttaaaaatttaggcgtcagtctgaatgtgattgatgtaggttggccagcaacatcatctatcgcttgggcatcatctgtcgcagcatttattattccactcggaatcatagttaacgttgtattgctagtaactaaagtgacaaagacgatgaatgtagatatttggaatttttggcattatacgtttacagcagcaatggtttatgccgtatcaggcagtatttggcaagcgttattagcagcagttattttccaaattatctgtttgaaagtagcagattggacagcaccgatgatgagtgagttctttgatttaccaggtgtatcgattgctacaggaagtacaatttcttatgcaccaggtatttacttagttaaattgttacaaaaagtacccggtctgaataagttagatgctgatcctgaaacaattcaaaaacgttttggcgcatttggagagtctatatttgtcggcttaattttaggtttaggtattggtgtgttagcaggttacaaacctggagacatcattaatttaggaatgtcaatggctgcagtaatggtattaatgcctagaatggtaaaaatcttaatggaaggtttaatgccagtttcagagtctgcaagaacatggctaaataaacgttttggcgaacgtgaaatttatattggattggatgcggctgtagcattaggtcatccagcagttatttcgacagcattaattttagtacctatcactgttttattagccgttattttaccaggaaaccaagtactaccttttggtgacttagcaacgataccatttgttgtcgcgtttattgttggtgcagcaagaggaaacattattcattctgtcattgtgggtacgattatgattgcaatttcactatatattgcaacagacgtagcacccattttcacagatatggcgaaaggtacgaatgtacaaatgccaaaaggttcatctgaaatttcaagtattgatcaaggtggtaatatcgttaactatcttatctttaaactatttagtctattcaat

SEQ ID NO: 2490 - protein, 419 aa, Staphylococcus aureus
  MISC_FEATURE (1)..(419): probable PTS
MSYFTDFVRGFLDLGATVILPVVIFLLGLFFRQKIGAAFRSGLTIGVAFVGIFLVIDLLVKNLGPAAQAMVKNLGVSLNVIDVGWPATSSIAWASSVAAFIIPLGIIVNVVLLVTKVTKTMNVDIWNFWHYTFTAAMVYAVSGSIWQALLAAVIFQIICLKVADWTAPMMSEFFDLPGVSIATGSTISYAPGIYLVKLLQKVPGLNKLDADPETIQKRFGAFGESIFVGLILGLGIGVLAGYKPGDIINLGMSMAAVMVLMPRMVKILMEGLMPVSESARTWLNKRFGEREIYIGLDAAVALGHPAVISTALILVPITVLLAVILPGNQVLPFGDLATIPFVVAFIVGAARGNIIHSVIVGTIMIAISLYIATDVAPIFTDMAKGTNVQMPKGSSEISSIDQGGNIVNYLIFKLFSLFN

SEQ ID NO: 2491 - DNA, 291 bp, Staphylococcus aureus
ttggaggaattgaaaatgaaacaagtattagtagcgtgtggtgcaggtattgcaacgtcaacagtagtaaataatgcaattgaagaaatggcaaaggaacacaatattaaagtagatattaaacaaatcaaaattacagaagttggaccttatgaagacactgcagatttattagttacaactgcaatgacaaaaaaagaatataaattcccagttatcaacgcacgtaatttcttaactggtattggtattgaagaaacaaaacaacaaatcttaacagagttacaaaaa

SEQ ID NO: 2492 - protein, 97 aa, Staphylococcus aureus
  MISC_FEATURE (1)..(97): hypothetical protein
LEELKMKQVLVACGAGIATSTVVNNAIEEMAKEHNIKVDIKQIKITEVGPYEDTADLLVTTAMTKKEYKFPVINARNFLTGIGIEETKQQILTELQK

SEQ ID NO: 2493 - DNA, 465 bp, Staphylococcus aureus
atgggacagcaattagtgcataaagaaaatataatgctcaatttgtcggcaactgataaagaatccgtattgtcacaaatgtcagatgtgttatttcaaaatgggttcgtgaagtcaacgtttaaagatgcagtcatcgacagagaaaaagaatttgctactggtttaccaacgcatctatgttcggtcgctataccgcatacagatgtcgaacatattaaccatagaacgataggtgtggctgttctagaaaaagaagtgccgtttattgaaatgggaacacttgatcaacagacagaagtgaaaatcgtttttatgttagcaatggataaagtagatgatcaacttaagctgttacaacagttgatgcaaatttttcaaagtgaagaaaaattggagcagattctacgaacgaaagatgaaacaattttagcaacactaatcaatgattatttggaatataac

SEQ ID NO: 2494 - protein, 155 aa, Staphylococcus aureus
  MISC_FEATURE (1)..(155): hypothetical protein
MGQQLVHKENIMLNLSATDKESVLSQMSDVLFQNGFVKSTFKDAVIDREKEFATGLPTHLCSVAIPHTDVEHINHRTIGVAVLEKEVPFIEMGTLDQQTEVKIVFMLAMDKVDDQLKLLQQLMQIFQSEEKLEQILRTKDETILATLINDYLEYN

SEQ ID NO: 2495 - DNA, 2094 bp, Staphylococcus aureus
atgaacggggataatcagcaaatactcagagaaattgtattgaatcctactattcatggtaaagaacttgaatcgatatttggtttgtctcgtagacaactaggatatcgcattcaaaaaatcaatttgtggcttgaacaagagggttatccaaaacttgaaagaacaagccaaggaaattttattgtaagttctgaaatcatgacgttattcaagcgagatgtatcggagcagcaaatgttaaacggcaacaatgtcatttttagcatagaaacacgtcgttattatttaatgctcatgctttttagtaaggaaaacgcaatgtctctaaaccatttttcaattgatttacaagtcagtaaaaatactgtcattcacgatataaatcatgtgaaagagcaattggaaaatcatggtttgtcacttaagtattctcgaaaacatggttatgaaattgttggtgatgaatttgaagttcgccgtttcttcattaagttgattgatcaaaggttgaatcatgatattactaaaagtgaagttttaaaggcgctcaacttaacattcgaagatatcgcatatcaaaaagacaagatcaaacaggtagaacaatttttgaagagtcgctttatagacaaatcacttagttcattgccttatgtcctttgtgtgattcgtagacgaattcaaagtggtcatgtgatgaatccattaaatattaattatcagtatttgagggatacgaaagaatatcaagcaacggagattatgacgcaacatgagccggatttgccagaagcggaaaagttatatttgacattacacttactttcaacaagtgtgcaatggactgatttgcaagaatcagatagcatatcgaatttaacgatggccatcgctcaaatgattcaccattttgaacaaatcacttttattaacattgaagataaggagaaattatcacagcaactcttgttacatttaacgcctgctttttataggattaaatataacttaacggatcgtgatgaattaataaatcctttacaaggaaattatcaatccttatttcatatggtgaaacaatcatgtcaatcgttaactgaatatttcggaaaatcgttgcctgataatgaaatagcatatttaaccatgttgttcggaggtagtttgagacgtcaagatgaaaacttcgatggcaagataaaagctattatcgtgtgtacacaaggcacgtcagtatcacaaatgatgttatacgagttgcgaaacttatttccagaaattattttcttagatgcgatttcacttagaacatttgaaaattacacattagattatgacatcgtcttttcaccaatgtttgtcctaacacataaaaaattatttatcacaaaagtagctttatctgaaaatgagcaacgaaagttacgtaaagaagtgatgaagtacattaataaggaatcggctgacattgataaggaaataaacaagttaatggcattaattgaacgcacaacgacagttaatgacattacagaactacgtgatggtttagaagattttattgccaattataattcaatttcaaccattaatggatcgattgtcacacaaaataagacattagatttagctgacttgataccggcaaggcacgtgaaaagaatgcatcatgttgaaaatattgatgaagctattgctaaagcaagtgatgtgttagttgctaatcattttattgatattaaatatattcatgagatgcaacaggtatttgatgattcgtatatggttatcatgcaaaatattgctattccacatgcatactctgaaaagcatgtacataaaacagcgatgagtatgttgatattacaagaaccaatatacatgtcagatggcacagcaatccatattattgtacctattgctgctgttgataaagtgacacacttaagagcgttactacaattgagagatgtggcgcaagacaatgacgcaattaagcgcatcatacaaagtcgcaaaaattctgatgtaaatgagattttaaaaaattattcaaataaagaagcgagggaaaatggatgggacagcaat

SEQ ID NO: 2496 - protein, 698 aa, Staphylococcus aureus
  MISC_FEATURE (1)..(698): hypothetical protein
MNGDNQQILREIVLNPTIHGKELESIFGLSRRQLGYRIQKINLWLEQEGYPKLERTSQGNFIVSSEIMTLFKRDVSEQQMLNGNNVIFSIETRRYYLMLMLFSKENAMSLNHFSIDLQVSKNTVIHDINHVKEQLENHGLSLKYSRKHGYEIVGDEFEVRRFFIKLIDQRLNHDITKSEVLKALNLTFEDIAYQKDKIKQVEQFLKSRFIDKSLSSLPYVLCVIRRRIQSGHVMNPLNINYQYLRDTKEYQATEIMTQHEPDLPEAEKLYLTLHLLSTSVQWTDLQESDSISNLTMAIAQMIHHFEQITFINIEDKEKLSQQLLLHLTPAFYRIKYNLTDRDELINPLQGNYQSLFHMVKQSCQSLTEYFGKSLPDNEIAYLTMLFGGSLRRQDENFDGKIKAIIVCTQGTSVSQMMLYELRNLFPEIIFLDAISLRTFENYTLDYDIVFSPMFVLTHKKLFITKVALSENEQRKLRKEVMKYINKESADIDKEINKLMALIERTTTVNDITELRDGLEDFIANYNSISTINGSIVTQNKTLDLADLIPARHVKRMHHVENIDEAIAKASDVLVANHFIDIKYIHEMQQVFDDSYMVIMQNIAIPHAYSEKHVHKTAMSMLILQEPIYMSDGTAIHIIVPIAAVDKVTHLRALLQLRDVAQDNDAIKRIIQSRKNSDVNEILKNYSNKEARENGWDSN

SEQ ID NO: 2497 - DNA, 111 bp, Staphylococcus aureus
atgatgtacatgctcattttgaaaatatgtgttcaaagtgtgtacatcggtgtgacgattgatgataaattgagctcagatgctcaaaggagaatcgaacatgaacgggga

SEQ ID NO: 2498 - protein, 37 aa, Staphylococcus aureus
MMYMLILKICVQSVYIGVTIDDKLSSDAQRRIEHERG

SEQ ID NO: 2499 - DNA, 96 bp, Staphylococcus aureus
atgtatgttaaaaatgcttcaaaaaaacacaaaacacaaaaatatatgcaaaaatttcaattgctttattttaaaagattaaaatcacaaaaaata

SEQ ID NO: 2500 - protein, 32 aa, Staphylococcus aureus
MYVKNASKKHKTQKYMQKFQLLYFKRLKSQKI

SEQ ID NO: 2501 - DNA, 933 bp, Staphylococcus aureus
atgaaaagaaagattattatggattgtgatccaggacacgatgatgcaatagcattaattttagcgggggcaattgacagtccactagagatattagctgtaacaacagtcgcaggtaatcaatcagttgacaagaatacgacaaacgccttgaacgtattggatattatgggacgccaagatatagcagtagcgaaaggtgcggataggccgttaattaaaccagctgcctttgcttctgaaatacatggggaatctggattagatggtccgaaactaccgtcgacaccatcacgtcaagcagttgcaatgccagcatcagatgtgattataaacaaagtgatgacgagtgatacacctgtaacaattgtagcgacaggtcctcttacgaatgtagcaacggcattgattcgtgagccaagaatcgctgagcatattgaatctattactttgatgggtggtggtacatttggaaattggacgcctacagcagaattcaatatttgggtagatgctgaagcagcgaagcgtgtttttgaaagtgggattactataaatgtgtttggtttagatgtaacacatcaagttttagccgacgatcacgtgattgaacgctttgaaagtatcaataatcctgttgcacagttcgtcgtagaattattgcaattctttaagaagacatacaagactcactttaatatggatggtggtccaatacatgatgcttgtacaattttgtatttgttacaaccagaattgtttacaatggtacccgttaatatcgacattgaacatcaaagtccactaacttatggcactatggctgtcgatttaaatcatgttacaggtaagcctgccaatgcttattttgctacagcagttgatgttgaagaagtgtggaacttgatagaccataagttacgtacatacgaa

SEQ ID NO: 2502 - protein, 311 aa, Staphylococcus aureus
  MISC_FEATURE (1)..(311): hypothetical protein
MKRKIIMDCDPGHDDAIALILAGAIDSPLEILAVTTVAGNQSVDKNTTNALNVLDIMGRQDIAVAKGADRPLIKPAAFASEIHGESGLDGPKLPSTPSRQAVAMPASDVIINKVMTSDTPVTIVATGPLTNVATALIREPRIAEHIESITLMGGGTFGNWTPTAEFNIWVDAEAAKRVFESGITINVFGLDVTHQVLADDHVIERFESINNPVAQFVVELLQFFKKTYKTHFNMDGGPIHDACTILYLLQPELFTMVPVNIDIEHQSPLTYGTMAVDLNHVTGKPANAYFATAVDVEEVWNLIDHKLRTYE

SEQ ID NO: 2503 - DNA, 861 bp, Staphylococcus aureus
ttgcaatttcttgatttcttaatcgcacttttacctgctttattctggggaagtgtcgttcttattaatgtgttcgtcggcggtggaccttacaaccaaattcgtggtacgacgctaggcgcactcattgttggattaggtttacttattactggtttcgcaaaattcaataatcctactgtaattattgtcggtcttatttctggtgcattatgggcgtttggacaagcgaatcagcttaaatctattagtttaatcggtgtatcaaatactatgccagtttctacaggtatgcaattagttggtacaacattattcagcgttatctttttaggtgaatggtcttcaatgactcaaattatctttggtttaatcgccatgatattattagttactggtgtagcacttacttcacttaaagctaaaaatgaacgtcaatcagataatcctgaatttaaaaaagcaatgggtattttaattgtatctacagttggatatgtaggtttcgttgtacttggtgacatctttggtgttggtggaactgatgcattgttcttccaatctgtcggtatggcaattggtggctttatcctatccatgaatcataaaacatcacttaaatcaacagcacttaatctattgccaggtgtgatttggggaattggtaacttgttcatgttctattctcaaccaaaagttggtgtagctacaagtttctcattatcacagttacttgttatcgtttcaaccttaggcggtattttcattttaggagaaagaaaagatcgtcgtcagatgacgggtatttgggcaggtattattattatcgtgatagctgctataattctaggtaatttgaaa

SEQ ID NO: 2504 - protein, 287 aa, Staphylococcus aureus
  MISC_FEATURE (1)..(287): glucose uptake protein
LQFLDFLIALLPALFWGSVVLINVFVGGGPYNQIRGTTLGALIVGLGLLITGFAKFNNPTVIIVGLISGALWAFGQANQLKSISLIGVSNTMPVSTGMQLVGTTLFSVIFLGEWSSMTQIIFGLIAMILLVTGVALTSLKAKNERQSDNPEFKKAMGILIVSTVGYVGFVVLGDIFGVGGTDALFFQSVGMAIGGFILSMNHKTSLKSTALNLLPGVIWGIGNLFMFYSQPKVGVATSFSLSQLLVIVSTLGGIFILGERKDRRQMTGIWAGIIIIVIAAIILGNLK

SEQ ID NO: 2505 - DNA, 1533 bp, Staphylococcus aureus
atgttgatgaaatctttatttgaaaaagcacagcagttcggcaagtcctttatgttacctatcgcaatcttaccagctgcaggtctattgttgggtatcggtggtgcattaagtaatccaaacaccgttaaagcataccctattttagatattaccttattacaaaatatttttacattaatgtcagctgcaggtagtattgttttccaaaatttaccggtcatctttgcaattggtgtcgcaatcggattatctagaagcgataaaggtactgcaggtttagctgcgctgctcggtttcttaattatgaacgcaactatgaatggcttattaactatcacgggcacattggcaaaagatcagcttgcacaaaatggacaaggcatggtgctcggtatacaaacggttgaaaccggtgtttttggcgggattatcacaggtattatgaccgcaatacttcacaacaaatatcacaaagtggtattaccaccgtatttaggtttctttggtggctctagatttgtccctattgtcacagcatttgccgcaatctttttaggtgtattgatgtttttcatttggccaagcatacaagccggcatttatcatgttggtggatttgtaacgaaaacaggtgccatcggtacttttgtttatggcttcatcttaagattgttaggtccactcggtttacaccatattttttacttaccgttttggcagacggcacttggtggtactttagaagtcaaagggcacttagttcaaggtacgcagaacatcttctttgctcaacttggtgatccagatgtgacgaagtattattcaggtgtgtcacgctttatgtcaggccgttttattacgatgatgttcggcttatgtggtgccgcacttgcaatttatcacacagctaaacctgaacataaaaaagttgtcggcggtttaatgttatccgctgcactcacttcatttttaacaggtattaccgaacctttagagtttagtttcttgtttgtcgcacctattctttatgtaatccatgccttctttgatggattagcatttatgatggcagacattttcaacattacaattggtcaaaccttcagtggaggctttatcgatttcttactctttggtgtgctacaaggtaatagtaaaacaaactacctatacgtcatacctattggaattgtgtggttctgtttgtattacatcgttttcagattcttaattacgaaatttaatttcaaaacacctggtcgagaagataaagctgcagcacaacaagttgaggctactgaaagagcacaaactattgttgctggtttgggaggcaaagataacattgaaatcgttgactgttgtgcaacgagactacgcgtcacacttcatcaaaatgacaaagtcgataaagtattactcgaaagtactggtgccaaaggtgtaatccagcaaggcactggtgtgcaagtaatttatgggcctcacgttacagttatcaaaaatgaaattgaagaattgctcggggat

SEQ ID NO: 2506 - protein, 511 aa, Staphylococcus aureus
  MISC_FEATURE (1)..(511): PTS enzyme [Staphylococcus
MLMKSLFEKAQQFGKSFMLPIAILPAAGLLLGIGGALSNPNTVKAYPILDITLLQNIFTLMSAAGSIVFQNLPVIFAIGVAIGLSRSDKGTAGLAALLGFLIMNATMNGLLTITGTLAKDQLAQNGQGMVLGIQTVETGVFGGIITGIMTAILHNKYHKVVLPPYLGFFGGSRFVPIVTAFAAIFLGVLMFFIWPSIQAGIYHVGGFVTKTGAIGTFVYGFILRLLGPLGLHHIFYLPFWQTALGGTLEVKGHLVQGTQNIFFAQLGDPDVTKYYSGVSRFMSGRFITMMFGLCGAALAIYHTAKPEHKKVVGGLMLSAALTSFLTGITEPLEFSFLFVAPILYVIHAFFDGLAFMMADIFNITIGQTFSGGFIDFLLFGVLQGNSKTNYLYVIPIGIVWFCLYYIVFRFLITKFNFKTPGREDKAAAQQVEATERAQTIVAGLGGKDNIEIVDCCATRLRVTLHQNDKVDKVLLESTGAKGVIQQGTGVQVIYGPHVTVIKNEIEELLGD

SEQ ID NO: 2507 - DNA, 951 bp, Staphylococcus aureus
atgaacaaatttaaagggaacaaagttgtattaataggtaatggtgcagtaggttcaagctacgcattttcattagtgaaccaaagcattgttgatgaattagtcatcattgatttagacactgaaaaagttcgaggagatgttatggatttaaaacatgccacaccatattctccaacaacagttcgtgtgaaagctggcgaatacagtgattgtcatgatgcggatctagttgtcatctgtgctggtgctgcacaaaaacctggagaaacacgtttagatttagtatctaaaaacttgaaaatattcaaatcaattgttggtgaagtaatggcatcaaaatttgatggtattttcttggtagctacaaatcctgttgatattttagcgtatgcaacatggaaattctctggtttacctaaagaacgtgttataggttctggtacaattttagactctgcacgctttagattattgttaagcgaagcgttcgatgttgcgccacgtagcgtcgatgctcaaattattggtgaacatggtgacactgaattaccagtatggtcacacgctaatattgcgggtcaacctttgaagacattacttgaacaacgtcctgagggcaaagcgcaaattgaacaaatttttgttcaaacacgtgatgcagcatatgacattattcaagctaaaggtgccacttattatggtgttgcaatgggattagctagaattactgaagcgattttcagaaatgaagatgccgtattgactgtatcagcattattagaaggcgaatatgaggaagaagatgtttatattggtgttccagcagtcatcaatagaaacggtattcgcaacgtcgtagaaatcccattaaacgacgaagaacaaagcaagttcgcacattcagctaaaacattaaaagatattatggctgaagcagaagaacttaaa

SEQ ID NO: 2508 - protein, 317 aa, Staphylococcus aureus
  MISC_FEATURE (1)..(317): L-lactate dehydrogenase
MNKFKGNKVVLIGNGAVGSSYAFSLVNQSIVDELVIIDLDTEKVRGDVMDLKHATPYSPTTVRVKAGEYSDCHDADLVVICAGAAQKPGETRLDLVSKNLKIFKSIVGEVMASKFDGIFLVATNPVDILAYATWKFSGLPKERVIGSGTILDSARFRLLLSEAFDVAPRSVDAQIIGEHGDTELPVWSHANIAGQPLKTLLEQRPEGKAQIEQIFVQTRDAAYDIIQAKGATYYGVAMGLARITEAIFRNEDAVLTVSALLEGEYEEEDVYIGVPAVINRNGIRNVVEIPLNDEEQSKFAHSAKTLKDIMAEAEELK

SEQ ID NO: 2509 - DNA, 105 bp, Staphylococcus aureus
ttgtctgtttgcacaccgacgattgagcgcatttatttgactaattcaaaaaacattgttgttttcctagaaaaaagtaaacatgataataaaaatgtgaaagtg

SEQ ID NO: 2510 - protein, 35 aa, Staphylococcus aureus
LSVCTPTIERIYLTNSKNIVVFLEKSKHDNKNVKV

SEQ ID NO: 2511 - DNA, 1143 bp, Staphylococcus aureus
atgcttacagaacaagagaaagacattatcaaacaaacggtgcctttacttaaagagaaagggacagaaattacgtcaatcttttatccaaaaatgtttaaagcgcatcctgaacttttaaacatgtttaatcaaacgaaccaaaaacgaggcatgcaatcttcagcattagcacaagctgtaatggccgcagcggttaatatcgataacttaagtgttattaaaccagtcattatgccagtcgcatataaacactgcgcactacaagtttatgctgaacattatccaattgtggggaaaaatttattaaaagccattcaagacgtgacaggattagaagaaaatgaccctgtcattcaagcttgggcaaaagcatatggcgttattgcggatgtgttcatccaaattgaaaaagaaatttatgatcaaatgatgtggattggttttaaaccattcaaaattaccaatattaaacaagaatctgaagacattaaatcatttacagttgaaactgaagaatatgactttagtgaatttacaccaggccaatacatcacagttgatgtttctagtgataaacttccatatagagctaaacgtcactattctatcgtatcaggtgaaaaaaaccatttaacttttggcgttaaacgtgatgtcacaacagaacatgaaggcgaagtttcaacaattttacacgatgagattaaagaaggcgatatgattaatttagctgcgcctgtaggtggattcgtattagagaatacgactgaaccacaacttttcttaggttcaggtattggtgttacacctttagtagctatgtatgaagctgcctctgccaaaggtttagatacacagatggttcaagttgctgaaaatgaacaacatttacctttcaaagacaacttcaacagtatcgcaagccatcatgacaacgctaaattatatacacacttaaaagataaacaaggctatattggtgctgaagaattacaagtatttttagcaaataaacctgaaatttatatctgtggtggtacaaaattcttacaatctatgatcgaagcacttaaatctttaaattacgatatggatcgcgtacactacgaaacatttattccaagactaagcgttgcagta

SEQ ID NO: 2512 - protein, 381 aa, Staphylococcus aureus
  MISC_FEATURE (1)..(381): hypothetical protein
MLTEQEKDIIKQTVPLLKEKGTEITSIFYPKMFKAHPELLNMFNQTNQKRGMQSSALAQAVMAAAVNIDNLSVIKPVIMPVAYKHCALQVYAEHYPIVGKNLLKAIQDVTGLEENDPVIQAWAKAYGVIADVFIQIEKEIYDQMMWIGFKPFKITNIKQESEDIKSFTVETEEYDFSEFTPGQYITVDVSSDKLPYRAKRHYSIVSGEKNHLTFGVKRDVTTEHEGEVSTILHDEIKEGDMINLAAPVGGFVLENTTEPQLFLGSGIGVTPLVAMYEAASAKGLDTQMVQVAENEQHLPFKDNFNSIASHHDNAKLYTHLKDKQGYIGAEELQVFLANKPEIYICGGTKFLQSMIEALKSLNYDMDRVHYETFIPRLSVAV

SEQ ID NO: 2513 - DNA, 171 bp, Staphylococcus aureus
atgaaacttaatcaacgttacgtaaaagtatttgcattatatttcgtaagtattgttactgcaaatattattgttaaaaataataatttaattaaaacattgatacaaaccatagccgggtacacggtctttgcagttggtttgaagtatttaactaaacgtaaaaataaa

SEQ ID NO: 2514 - protein, 57 aa, Staphylococcus aureus
  MISC_FEATURE (1)..(57): hypothetical protein
MKLNQRYVKVFALYFVSIVTANIIVKNNNLIKTLIQTIAGYTVFAVGLKYLTKRKNK

SEQ ID NO: 2515 - DNA, 390 bp, Staphylococcus aureus
atgctcactgaatttcataagaaaggagttcacaagatgaccgtagatattggacggatttatgacaataaagataataccgacgctattcgtatcctagtcgatagagtctggccgagaggtatttcgaaaagaactgctaacctagattattggttaaaagacattgccccttctactgagttgcgacaatggttccaacatgatcctaaactttttggagcttttaaagaaaaatatgaaaaagaattacgtgatcaggatgcgcaaaaagatgcttttgaaaaattaaaggatattgtaaatcagcataatcatgttctattgttatatgcagcaaaagatactaaacataaccaagctgtagtactacagcagttgctcaatact

SEQ ID NO: 2516 - protein, 130 aa, Staphylococcus aureus
  MISC_FEATURE (1)..(130): conserved hypothetical
MLTEFHKKGVHKMTVDIGRIYDNKDNTDAIRILVDRVWPRGISKRTANLDYWLKDIAPSTELRQWFQHDPKLFGAFKEKYEKELRDQDAQKDAFEKLKDIVNQHNHVLLLYAAKDTKHNQAVVLQQLLNT

SEQ ID NO: 2517 - DNA, 1473 bp, Staphylococcus aureus
atgaagtttaaaagactagcaactatattttcagcagtattagtgttatcaggatgtggctcaatgcattcatctggcaaagacttaaatatttcgttaccgttaaaaacaaagtctattgcaccttatgaaacagatgtaccagttaagattggtgctgcagaatcattatttaaaacaaatgatcaaggaaaaatagaaaaagcattagtgaaatcgtatcatcaaccaaatgatacaacgttagatatagaattaaaagataatattaaatttcaaaacggtcaaaaattgactgcagaaaaagtgaaatctagccttgaaaatagcatgaaaaaaagcgacttggtcaaatattcattaccaatatcatcaattaccgctaaaggtcaaaaactgacaattaaaaccaactccgcttaccctgaacttgtatctgaattagctaatccttttatggcaatttatgatacagatgctaaatcagatgttaatcaaactcctgttggtacaggcccttaccaaataaaagattataagcaatctcgaaaaatatcattgtcgaattttaaggactattggcaaggtaaaccgaaacttgatcatattactgtgacgtaccaagaagacggcaataatcgcgtcagaaatttagaatctcaaaaagatgatttaataactgatgtcccagttaataaagttcaagacatagaaaataatcaaaatttaaaagtgtcaaaagaatctggatttagaacttctttacttatgtataatcatactaataaaaaaatgactaaatccgttcgtgaagcattagatcatatcattgatagacaaggtattgcagatcatatttatcaaggttatgcgaaacctgcaacgagtccatttaatgataaaattccatatattaaagaacctaagttaaccaaacaaaatatcgaacaagcaaaaatgttattagctaaagatggttatacaaaagaacaccctttaaaaattaagttaattacgtatgacggtcgtccagagctatcgaaaattgcgcaagtattacaatcagatgctaaaaaagcaaatattgaaatcgacattaaaagtgttgatgacatagaaggttacttaaaagaccgttctgcatgggatgcaacgatgtatagtttcggaacaattcctcgtggagatacaggttatttctttaatcaagcatataaaaaagatggtgctattaataaaggagactacaataatagcaacgtcgatgatttaattaatcaattgaatcatactgtagatgttaaggaacgtcacaatatttctaatgatattattaaattatcaagtcgagatgtaccaaacagttatattgcttacaacgatcaaatagtcgctgctaactctaaggttaaaaattataaagtaacacctgaaggtatctatttaatcgattatcgaacaacgattgaacga

SEQ ID NO: 2518 - protein, 491 aa, Staphylococcus aureus
  MISC_FEATURE (1)..(491): hypothetical protein
MKFKRLATIFSAVLVLSGCGSMHSSGKDLNISLPLKTKSIAPYETDVPVKIGAAESLFKTNDQGKIEKALVKSYHQPNDTTLDIELKDNIKFQNGQKLTAEKVKSSLENSMKKSDLVKYSLPISSITAKGQKLTIKTNSAYPELVSELANPFMAIYDTDAKSDVNQTPVGTGPYQIKDYKQSRKISLSNFKDYWQGKPKLDHITVTYQEDGNNRVRNLESQKDDLITDVPVNKVQDIENNQNLKVSKESGFRTSLLMYNHTNKKMTKSVREALDHIIDRQGIADHIYQGYAKPATSPFNDKIPYIKEPKLTKQNIEQAKMLLAKDGYTKEHPLKIKLITYDGRPELSKIAQVLQSDAKKANIEIDIKSVDDIEGYLKDRSAWDATMYSFGTIPRGDTGYFFNQAYKKDGAINKGDYNNSNVDDLINQLNHTVDVKERHNISNDIIKLSSRDVPNSYIAYNDQIVAANSKVKNYKVTPEGIYLIDYRTTIER

SEQ ID NO: 2519 - DNA, 1245 bp, Staphylococcus aureus
gtgaaagtaggtaagtctatggaaggtcttaatcatcgaagaaatacagaaaaagaagagacaacacaaacgcaatcagttgcacctaatacaggtgaagaggggatgtcatcagcaagtacacaatcaactaagacgtccgacatacataatgaatctatcgataaacaaatggaagctaaagcgcatgaaacagcgcaaaatacagatttaaaaaacgaagcaagaagtttatttgataatgcaaccaaatcaatcggtagactagcgggcaatgatgaaagcttaaatcttaatttaaaagatatgctttctgaagtatttaagccgcatactaaaaacgaagcagatgaaatatttatagcgggtactgctaaaactacgccagcaatttgtgacatatcagaagaatgggggaagccatggctcttttctcgagtattcatcgctttcacagtaacatttattggattatgggtcatggcagcaatttttaataacactaacgcgattccgggtctcatttttataggggctttaacagtaccattatcgggtttgttcttcttttatgaatcaaatgcgtttaaaaatattagcatttttgaagttattatcatgttctttattggcggcgtattttcattactaagtacgatggtattatatagatttgtcgtttttagtgatcaattcgaaaggtttggttctttaacatttttcgatgcatttttagtaggattagttgaagaaactggaaaagcactcattattgtttatttcgtcaataaattgaaaacaaataagattttgaatggattattaatcggtgctgctattggtgcagggttcgcagtttttgaatcagcaggttatattttgaatttcgctttaggagaaaatgtcccattattagatattgtcttcacacgtgcgtggactgcgattggtggtcatttagtttggtcagcgattgttggtgctgcaatagttattgcgaaagaacagcatggctttgaattcaaagatatttttgataaacgctttttaatattctttttatcagccgttgttttacatggcatttgggatacatctttaactgtacttggcagtgatacgttgaaaatatttattttaatcgttattgtgtggatacttgtattcattttaatgggggcaggtttaaaacaagtgaatttactgcagaaagaatttaaagaacaacagaaaaaagtagacgaa

SEQ ID NO: 2520 - protein, 415 aa, Staphylococcus aureus
  MISC_FEATURE (1)..(415): hypothetical protein
VKVGKSMEGLNHRRNTEKEETTQTQSVAPNTGEEGMSSASTQSTKTSDIHNESIDKQMEAKAHETAQNTDLKNEARSLFDNATKSIGRLAGNDESLNLNLKDMLSEVFKPHTKNEADEIFIAGTAKTTPAICDISEEWGKPWLFSRVFIAFTVTFIGLWVMAAIFNNTNAIPGLIFIGALTVPLSGLFFFYESNAFKNISIFEVIIMFFIGGVFSLLSTMVLYRFVVFSDQFERFGSLTFFDAFLVGLVEETGKALIIVYFVNKLKTNKILNGLLIGAAIGAGFAVFESAGYILNFALGENVPLLDIVFTRAWTAIGGHLVWSAIVGAAIVIAKEQHGFEFKDIFDKRFLIFFLSAVVLHGIWDTSLTVLGSDTLKIFILIVIVWILVFILMGAGLKQVNLLQKEFKEQQKKVDE

SEQ ID NO: 2521 - DNA, 1578 bp, Staphylococcus aureus
gtgatggaggtgacttgcttgaaacaaatcacatggcacgacttacaacatatcattaaagatggtgatgtgattggtttaccagcattagctgtagccaacttacccgccgaagttctacgtgctgtgttagcgcaacatgacacatatcatacgcccaatgatttaacgtttatattagcgaatgatattcatagtttaggtgccgcaccggatttagatgattttatagaacgtcgcatgattaaacgtgtcattatgagtattttaacggcttcttccaaaacggcacaagcaatgaaaaataatgacattgaagcttattttttaccacaaggtatcattgcaactcattatcgtcagagtaatcaattattacctggagttattactaaaatcggattaaacacagctgttgatcctagatacggtggcggtaaagtaaatacacgaacaacggatgatttagtttcattagtaaccatcaacgatgaaacatacttacattacacattccctagcgttgatgtggcactactgagaggaacatacgcagatcaacaaggtaacatttatttaactcaagaagcgtacttgagcgagtgttatcatgtcgcattaaacgcgaaagccaatcatgggaaagttattgtacaagttaaagctttagttgacgactatcaactaaaaccgaatgaagttgttatcccaggaaatcttgtcgattatgtatacgtcacagaagatgaaaagaatcaccgccaagtaattcaaagtcattatttaccagccttgtctggagaagaacgaattgatggaatacctgaacccgcattaccttttaatagtcgcaaattgattctccgacgtgctgctcagtttttaacttatggcgatacaattagcatcggttatggcatcaataatgaactctctaatttattgcatgaagaatgtgttgaacatgatgtgcaaccgattttagatgttggcattttcggtggattcgttgggagtcgtgaacattttggtatgaattacaatgcagatgtgcgcatgcctcatgatcgagcatgggattttatttataacaatggtgtatcagttgcctatcttagctttgctgaggttgatcaatacggcaatgtcaacgtgtcttacttcaatgaccgactaaatggatgtggtggctttatagacattacgcaatctgtaaataaaattatcttttcaggtacttttgtagctggcagtcatgtctcatgccataatcaacgattaaacattgaaactgaaggacaaaaccagaaatttgtatcagatgtgagccatatcgactttaatgcacaatattcacaatcactcgagcaagaaatctattttgttactgatcgtgcagtattcgaactcaccaatcaaggcttgaaactaattgaaattgcaccaggtcttgatttgcataaagatattttgaatcaaatggcttttaaaccaattattgctgatcatttaaaattaattgataccagcatttacaaagaaaaatggggacaacttaaacaatcaattcataaagta

SEQ ID NO: 2522 - protein, 526 aa, Staphylococcus aureus
  MISC_FEATURE (1)..(526): conserved hypothetical
VMEVTCLKQITWHDLQHIIKDGDVIGLPALAVANLPAEVLRAVLAQHDTYHTPNDLTFILANDIHSLGAAPDLDDFIERRMIKRVIMSILTASSKTAQAMKNNDIEAYFLPQGIIATHYRQSNQLLPGVITKIGLNTAVDPRYGGGKVNTRTTDDLVSLVTINDETYLHYTFPSVDVALLRGTYADQQGNIYLTQEAYLSECYHVALNAKANHGKVIVQVKALVDDYQLKPNEVVIPGNLVDYVYVTEDEKNHRQVIQSHYLPALSGEERIDGIPEPALPFNSRKLILRRAAQFLTYGDTISIGYGINNELSNLLHEECVEHDVQPILDVGIFGGFVGSREHFGMNYNADVRMPHDRAWDFIYNNGVSVAYLSFAEVDQYGNVNVSYFNDRLNGCGGFIDITQSVNKIIFSGTFVAGSHVSCHNQRLNIETEGQNQKFVSDVSHIDFNAQYSQSLEQEIYFVTDRAVFELTNQGLKLIEIAPGLDLHKDILNQMAFKPIIADHLKLIDTSIYKEKWGQLKQSIHKV

SEQ ID NO: 2523 - DNA, 1590 bp, Staphylococcus aureus
ttgataccagcatttacaaagaaaaatggggacaacttaaacaatcaattcataaagtatgaaagtgaagctaaagggggtatactaatgaatttcgattggataaaaacgcgttcagacttcgatgatgacaagcctgccgttattgatcacgcaaaacaaacatcttggacataccaacaactcaatgcacgcgctgataatatggcacattatttaacatctcaaggtgttaaaaaaggcgatgttatcggtatttttgcgccaaatgatattgcaatattagatttattgtttgcttgttttaaaacaggtgcggtttttttaccattgaattggcggcttaacccaaaagaaattgcagccattgtggaagatgcacaattaaaactgctcttctatgctgaaaaacatttaagttcactcaccgatattgaccaaaacttattgcatatggatattgatgtggcgcaatatgatgaaatcgtaaatccagattatcaccaaccttttcaagcaacacctgttgaaccacaagatcttgcagcattaatttatacaagtggtacaaccggatcacctaaaggtgtgatgttctcatatgaatcatttgttcataacggtgcaaacttagagctgacgtataagttcaattcaaactatattacgattgtatcaacaccaatgttccatgttttagggtttaacgatactgtattaccagtattaatgtcaggtggcacacttattcttcaacgttactttaacggcgaagaattgaatgacatgattgcacaatatcaccctacatttattatcatgattccgacaatgtattatagtacgctacgtgctagtaattttaatcctgaaaattttagagctatggattatatcatccaaggtggttcacaaccattaccaagtatccaagcagcttttaaacaatatggcataaacattattaacggctatggtttaactgaagcacctcttgtacttgttaatacaccggaaaattcaaaacgtaagccaatgagtattggtaaagcagtcatgttcgttgatgcacgtatccttgatgataacggtgaggaagtacctactggtgagattggcgaacttgcaattaaggctaaaaatgtcacgccaggatattggaataaaccagcagagactgccaaagcatttcatggtcgatatttattaactggtgacttagcgaagatggacaacgatggcgatatatttattattgaccgcaaaaaagaattaatcataactggtggcgaaaatgtcttaccatccgaagtcgaaaatgctttagctgagcatccactagtagaccggtgtgtggtcgttggctatgatcatccaaaatatggtgaatcaattgctgcagccattatacttcgcgaagatgaacctcattacgctgaaattttaaatcaacatatgcgaagtcgtttagcaggttataaagtcccaagaatgtatgtaccagtgacacatatgccgttaaacagtacgcagaaaccagataaacttgcgattcgacaaatgatgaatgacaaagtctcgcaaacactt

SEQ ID NO: 2524 - protein, 530 aa, Staphylococcus aureus
  MISC_FEATURE (1)..(530): hypothetical protein
LIPAFTKKNGDNLNNQFIKYESEAKGGILMNFDWIKTRSDFDDDKPAVIDHAKQTSWTYQQLNARADNMAHYLTSQGVKKGDVIGIFAPNDIAILDLLFACFKTGAVFLPLNWRLNPKEIAAIVEDAQLKLLFYAEKHLSSLTDIDQNLLHMDIDVAQYDEIVNPDYHQPFQATPVEPQDLAALIYTSGTTGSPKGVMFSYESFVHNGANLELTYKFNSNYITIVSTPMFHVLGFNDTVLPVLMSGGTLILQRYFNGEELNDMIAQYHPTFIIMIPTMYYSTLRASNFNPENFRAMDYIIQGGSQPLPSIQAAFKQYGINIINGYGLTEAPLVLVNTPENSKRKPMSIGKAVMFVDARILDDNGEEVPTGEIGELAIKAKNVTPGYWNKPAETAKAFHGRYLLTGDLAKMDNDGDIFIIDRKKELIITGGENVLPSEVENALAEHPLVDRCVVVGYDHPKYGESIAAAIILREDEPHYAEILNQHMRSRLAGYKVPRMYVPVTHMPLNSTQKPDKLAIRQMMNDKVSQTL

SEQ ID NO: 2525 - DNA, 1254 bp, Staphylococcus aureus
atgcatttcacattagtattcatattatttttaggaggaatttatatgacatttgaaaaagaaacggtcttaaaaacattatttcctgaagatgtacttagtattgctaaaggtttaacagacggtgaagtcgaatttttacaacaagtagattcattgctagaaagtaagtaccgtgaaaatattaatcaacattggatagacgctactgtacccgaggactattttaaagatctgggagaattaaattattttaacaatccattactttacaaggatcgtccaaacgccaaaatgcctagtcaactatttcagtttttcatgtcttacctactcgcgcgatttgatatttccttagctaccctactcggtgttcaccaaggtttagggcataacactttctatttcggaggtagcaaagaacaaattgcgaaatatgtacctaaattacagtcacatgaactgcgtacatgctttgctttaactgaaccagaacacggttcggacgttgcgggaggtcttgaaacagtcgctgaacgccaaggcgatacttgggttatcaatggtgaaaagaaatggattggtggtgcacatgtatctgatgtcattccagtattcgcagtaaataaagaaactggcaaaccccattgctttgtagtcagaccagaacaagatggcgtcgatattgaagtcattgataataaaatcgcacttcgcattgttcctaacgccctaattaaattaactaatgtcaaagtagatgaagcggatcgcttacaaaacataacaagctttaaagatattgccaaaattctttattcaacgagagcaggcgttgcttatatggctacaggtggtatggctggcgctttacgtgccacattagattatgtcactgagcgtaagcaattcggcaaaccaattagtaaatatcagttaatacaagaaaagctagcaatgatgcaaggtaatttagctcaagcaatggcaacatgtgctcaattagctaatatgcaagcacatggtgaatatgacgaggttgcaacttcaacggcgaagatgatgaatgccttacgtttgcgtgagacagtagctatgggccgcggtattacaggtggtaatggcatactagctgacgattatgatattgcacgtttcttctctgatgcagaagcgatttacacgtacgaaggtacacatgaaattaatgccttagtaattggacgcgctttgactggagattctgctttcgta

SEQ ID NO: 2526 - protein, 418 aa, Staphylococcus aureus
  MISC_FEATURE (1)..(418): hypothetical protein
MHFTLVFILFLGGIYMTFEKETVLKTLFPEDVLSIAKGLTDGEVEFLQQVDSLLESKYRENINQHWIDATVPEDYFKDLGELNYFNNPLLYKDRPNAKMPSQLFQFFMSYLLARFDISLATLLGVHQGLGHNTFYFGGSKEQIAKYVPKLQSHELRTCFALTEPEHGSDVAGGLETVAERQGDTWVINGEKKWIGGAHVSDVIPVFAVNKETGKPHCFVVRPEQDGVDIEVIDNKIALRIVPNALIKLTNVKVDEADRLQNITSFKDIAKILYSTRAGVAYMATGGMAGALRATLDYVTERKQFGKPISKYQLIQEKLAMMQGNLAQAMATCAQLANMQAHGEYDEVATSTAKMMNALRLRETVAMGRGITGGNGILADDYDIARFFSDAEAIYTYEGTHEINALVIGRALTGDSAFV

SEQ ID NO: 2527 - DNA, 2259 bp, Staphylococcus aureus
atgacaattaataaagtaaccgttcttggcgcaggcacaatgggcgctcaactggcagcactttttgtgaatgctggacttaaagtaaaactattagatattgtagtggacaaaaacgatccaaatctcattgcgaaaaaatcttacgataaaattacagataagaaacggccgctactattcgacttaaatctagcgagtcatttaacatatggtaattttgatgatgacttggtaaatgatgatgctgatttatatatcgaagcagtcaaagaagatattgaaattaagcatgctgtttggcaacaagttctacaacatgctaaagaagatgctttattcgctacaaatacatcaggtattccaattaatgcgattgctcaagcatttaacgagaaggatcaagaacgattctttggtctacatttctttaacccaccacgtattatgaaattagtggagttaatacctacgtcacacacgaaggaatctattatattagatgtaaaaaatttcgcgcaaaatgtgttaggtaaaggtgtcattgtcgtcaatgatgtgcctggctttgtcgcaaatagagtcggcacgcaaacaatgaatgatattatgtatcgcgccgagcaacacaagataagcattgtagatgtggatgctttaactgggcaagcgattggtcgtcctaaaacaggtacatatgcgctatctgacctagtcggtttagatattgcagtgtctgtaattaaaggcatgcaacaagtacctgaagaaacaccttattttcatgatgtcaaaattgtaaatacgttgtttgacaatggcgcactcggacgtaaaacgaaacaaggattttacaaaaaggataaagaaactaaagctcgacttgtttacgatgttgaaaaacaagattatgtacctgtatcgcaaccacaattaccaattttaaatgaatttaataaagacttagtgcataaccttgataccatattcaatgcgcaagacgaagcgggactatttttatgggagacattacgtaataatttctattactctgctatcaatgtacctaaagctaccgatgatttccgagacatagaccgtgcgcttgtctgggggttcaactggaaacttggtccattccaattatgggatgcaatgggatacgaacgtgttaaaacacgtatggaagacgaacttggagacttaccacaatggattagtgatttagatggtggcttttataaacaagatgagaccattgaatatgcaacacctatttctcacttcgtaaaagatgaactttgggataaaggtgatgccaaactttccgtaactcatgatgatcaactgttactgaaattacaaagtaaaaataatgtcattaccgatgaattcaacgatgcgttagttgatgcgattgatttactggaaaatgaccattacacaagtatggttatttatgcagatggtaacaatttcagtgtgggtgctaaccttttcttaatgaaaaaggcgcatgaagacggtcttgtagatgatgtcgttgcacaatcaattgataaattacattatagctttaatcgtttgaagtatagtttgaaaccagtagtcacagctgttcaaggtcgtgccttaggcggtggctgtgagcttgtactttactcacctattgttgtcgctgcaagtgaaacatatatcggtcttgttgaagcaggtgttggcttattaccgagtggcggtggccttgcagaaatggctgatcgcatattacgcacatcgcataagtttgatgacaaacaagcttccatgacaaaagtactgacgaatatcgcatttgcgaaagtctctacaaatgcctttgaggcacgtcgttatggttatttacgtgatacagatacgattattttcaatacagcacaacgtgtcgaagttgcgctcaaacgtgcgaaatatgaagcagaaacaaactatattccgaatcctagacatcaatatatcgctttaggtgaagacttcaaagcattgatccaaggacaattagatgcgcaaagacggggtcattttattagcgaccatgattatcatattgccttaaatatcgccacaattttagcgggtggtgatttaccaagaaatacatttatcaatcaacgttacattcaatcgttggagaaaattggctttattgacttactaaaatctaaaaaatcatatgaaagaattgcacatatgttaaaaactggtaagccattacgtaat

SEQ ID NO: 2528 - protein, 753 aa, Staphylococcus aureus
  MISC_FEATURE (1)..(753): hypothetical protein
MTINKVTVLGAGTMGAQLAALFVNAGLKVKLLDIVVDKNDPNLIAKKSYDKITDKKRPLLFDLNLASHLTYGNFDDDLVNDDADLYIEAVKEDIEIKHAVWQQVLQHAKEDALFATNTSGIPINAIAQAFNEKDQERFFGLHFFNPPRIMKLVELIPTSHTKESIILDVKNFAQNVLGKGVIVVNDVPGFVANRVGTQTMNDIMYRAEQHKISIVDVDALTGQAIGRPKTGTYALSDLVGLDIAVSVIKGMQQVPEETPYFHDVKIVNTLFDNGALGRKTKQGFYKKDKETKARLVYDVEKQDYVPVSQPQLPILNEFNKDLVHNLDTIFNAQDEAGLFLWETLRNNFYYSAINVPKATDDFRDIDRALVWGFNWKLGPFQLWDAMGYERVKTRMEDELGDLPQWISDLDGGFYKQDETIEYATPISHFVKDELWDKGDAKLSVTHDDQLLLKLQSKNNVITDEFNDALVDAIDLLENDHYTSMVIYADGNNFSVGANLFLMKKAHEDGLVDDVVAQSIDKLHYSFNRLKYSLKPVVTAVQGRALGGGCELVLYSPIVVAASETYIGLVEAGVGLLPSGGGLAEMADRILRTSHKFDDKQASMTKVLTNIAFAKVSTNAFEARRYGYLRDTDTIIFNTAQRVEVALKRAKYEAETNYIPNPRHQYIALGEDFKALIQGQLDAQRRGHFISDHDYHIALNIATILAGGDLPRNTFINQRYIQSLEKIGFIDLLKSKKSYERIAHMLKTGKPLRN

SEQ ID NO: 2529 - DNA, 1191 bp, Staphylococcus aureus
atgataaccatgcaagaagcatacattgtagcttatgggcgttcagccgcagcgaaagcaaagcaaggcgcattattccacgaaagacctgatgatgtcgcagccaaagtattacaaggcgtattgaaacgtattgacggaaaattcaataagaatatgattgaagatgtcattgttggtacggcttttccagaaggattacaaggccaaaacattgcacgaacgattgcattgcgtgcgggattatctgacacggtaccgggtcaaacagtgaatcgctactgctcatcaggattacaaaccatcgcgattgcagccaatcaaattatggctggtcaaggagatatacttgtagctggtggcgttgaattgatgagtgccgtaccaatgggtggcaacgagcccacaaacaatccaaccttacaatatgatgatataggtgcgtcatatcctatgggtttaactgctgaaaatgtagcatcccaatttgacgtatcacgcgaagatcaagatgcttatgctgtcagaagtcatcaacgtgcctatgacgcacaacgtgatggtcggttcaaagatgaaattattccaatacaagtaaactcagttgaatatacaaacgcaggaccaaaagtacacacaaatatctttgaccaagatgaatttatacgccctgacaccacgatggaggcattagccaaattacgtacagtatttaaagctgacggcactatgactgcaggaacatctgccccactttctgatggtgcaggatttgtagttttaatgtctggagataaagtgaaagaactcggcgtgacacctattgcacgattcgttggttttaaggcagtaggcgttgacccgaaaattatgggtattgggcctgcatatgcgattcctgaagtattgtcactcagcaatctatctgttgaagacattgatttgatcgaattgaacgaagcatttgcttctcaaacgattgcatctattaaagaagtaggtctagatatatcacgtacgaatgtgaatggtggcgctattgctttaggtcatccattaggtgctacaggcgcaatgttaaccgcgcgtttacttaatgaaatgggtagacgtcccgatagccgttacggcatggttacgatgtgtattggtgtcggcatgggtgcagctgctatatttgaatatgtgcgt

SEQ ID NO: 2530 - protein, 397 aa, Staphylococcus aureus
  MISC_FEATURE (1)..(397): acetyl-CoA
MITMQEAYIVAYGRSAAAKAKQGALFHERPDDVAAKVLQGVLKRIDGKFNKNMIEDVIVGTAFPEGLQGQNIARTIALRAGLSDTVPGQTVNRYCSSGLQTIAIAANQIMAGQGDILVAGGVELMSAVPMGGNEPTNNPTLQYDDIGASYPMGLTAENVASQFDVSREDQDAYAVRSHQRAYDAQRDGRFKDEIIPIQVNSVEYTNAGPKVHTNIFDQDEFIRPDTTMEALAKLRTVFKADGTMTAGTSAPLSDGAGFVVLMSGDKVKELGVTPIARFVGFKAVGVDPKIMGIGPAYAIPEVLSLSNLSVEDIDLIELNEAFASQTIASIKEVGLDISRTNVNGGAIALGHPLGATGAMLTARLLNEMGRRPDSRYGMVTMCIGVGMGAAAIFEYVR

SEQ ID NO: 2531 - DNA, 105 bp, Staphylococcus aureus
gtgtgtgttcgaactagacttgtaagttccagttcggcacgactttctaaagcaattattattgctgtgattgtcgtatatcacttagatgtgcgtggtttattt

SEQ ID NO: 2532 - protein, 35 aa, Staphylococcus aureus
VCVRTRLVSSSSARLSKAIIIAVIVVYHLDVRGLF

SEQ ID NO: 2533 - DNA, 1908 bp, Staphylococcus aureus
atgaaaaagcaaataatttcgctaggcgcattagcagttgcatctagcttatttacatgggataacaaagcagatgcgatagtaacaaaggattatagtgggaaatcacaagttaatgctgggagtaaaaatgggacattaatagatagcagatatttaaattcagctctatattatttggaagactatataatttatgctataggattaactaataaatatgaatatggagataatatttataaagaagctaaagataggttgttggaaaaggtattaagggaagatcaatatcttttggagagaaagaaatctcaatatgaagattataaacaatggtatgcaaattataaaaaagaaaatcctcgtacagatttaaaaatggctaattttcataaatataatttagaagaactttcgatgaaagaatacaatgaactacaggatgcattaaagagagcactggatgattttcacagagaagttaaagatattaaggataagaattcagacttgaaaacttttaatgcagcagaagaagataaagcaactaaggaagtatacgatctcgtatctgaaattgatacattagttgtatcatattatggtgataaggattatggggagcacgcgaaagagttacgagcaaaactggacttaatccttggagatacagacaatccacataaaattacaaatgaacgtattaaaaaagaaatgattgatgacttaaattcaattattgatgatttctttatggaaactaaacaaaatagaccgaaatctataacgaaatataatcctacaacacataactataaaacaaatagtgataataaacctaattttgataaattagttgaagaaacgaaaaaagcagttaaagaagcagatgattcttggaaaaagaaaactgtcaaaaaatacggagaaactgaaacaaaatcgccagtagtaaaagaagagaagaaagttgaagaacctcaagcacctaaagttgataaccaacaagaggttaaaactacggctggtaaagctgaagaaacaacacaaccagttgcacaaccattagttaaaattccacagggcacaattacaggtgaaattgtaaaaggtccggaatatccaacgatggaaaataaaacggtacaaggtgaaatcgttcaaggtcccgattttctaacaatggaacaaagcggcccatcattaagcaataattatacaaacccaccgttaacgaaccctattttagaaggtcttgaaggtagctcatctaaacttgaaataaaaccacaaggtactgaatcaacgttaaaaggtactcaaggagaatcaagtgatattgaagttaaacctcaagcaactgaaacaacagaagcttctcaatatggtccgagaccgcaatttaacaaaacacctaaatatgttaaatatagagatgctggtacaggtatccgtgaatacaacgatggaacatttggatatgaagcgagaccaagattcaataagccatcagaaacaaatgcatataacgtaacaacacatgcaaatggtcaagtatcatacggagctcgtccgacatacaagaagccaagcgaaacgaatgcatacaatgtaacaacacatgcaaacggccaagtatcatacggagctcgtccgacacaaaacaagccaagcaaaacaaacgcatataacgtaacaacacatggaaacggccaagtatcatatggcgctcgcccaacacaaaacaagccaagcaaaacaaatgcatacaacgtaacaacacatgcaaacggtcaagtgtcatacggagctcgcccgacatacaagaagccaagtaaaacaaatgcatacaatgtaacaacacatgcagatggtactgcgacatatgggcctagagtaacaaaa

SEQ ID NO: 2534 - protein, 636 aa, Staphylococcus aureus
  MISC_FEATURE (1)..(636): staphylocoagulase precursor
MKKQIISLGALAVASSLFTWDNKADAIVTKDYSGKSQVNAGSKNGTLIDSRYLNSALYYLEDYIIYAIGLTNKYEYGDNIYKEAKDRLLEKVLREDQYLLERKKSQYEDYKQWYANYKKENPRTDLKMANFHKYNLEELSMKEYNELQDALKRALDDFHREVKDIKDKNSDLKTFNAAEEDKATKEVYDLVSEIDTLVVSYYGDKDYGEHAKELRAKLDLILGDTDNPHKITNERIKKEMIDDLNSIIDDFFMETKQNRPKSITKYNPTTHNYKTNSDNKPNFDKLVEETKKAVKEADDSWKKKTVKKYGETETKSPVVKEEKKVEEPQAPKVDNQQEVKTTAGKAEETTQPVAQPLVKIPQGTITGEIVKGPEYPTMENKTVQGEIVQGPDFLTMEQSGPSLSNNYTNPPLTNPILEGLEGSSSKLEIKPQGTESTLKGTQGESSDIEVKPQATETTEASQYGPRPQFNKTPKYVKYRDAGTGIREYNDGTFGYEARPRFNKPSETNAYNVTTHANGQVSYGARPTYKKPSETNAYNVTTHANGQVSYGARPTQNKPSKTNAYNVTTHGNGQVSYGARPTQNKPSKTNAYNVTTHANGQVSYGARPTYKKPSKTNAYNVTTHADGTATYGPRVTK

SEQ ID NO: 2535 - DNA, 342 bp, Staphylococcus aureus
atgacaacacaaatgaaaatcaaaacatatttagttgctggtattaaagcggcgctccttgatacgactggtattaaattagcaagcaaatctgaaactacatcacatacgtatcaacatcaagcgcttgtagatcaattacatgaattaatagcaaacactgacttaaataaattatcgtacctaaatttagatgcgtttcaaaaacgcgatattttagctgcgcactatattgcaaaatccgctatacgcactaaaaatttggatcaaatgactaaagcgaaacaaagattagaaagtatttacaattcaatttctaaccctttgcattcacaaaacaat

SEQ ID NO: 2536 - protein, 114 aa, Staphylococcus aureus
  MISC_FEATURE (1)..(114): hypothetical protein
MTTQMKIKTYLVAGIKAALLDTTGIKLASKSETTSHTYQHQALVDQLHELIANTDLNKLSYLNLDAFQKRDILAAHYIAKSAIRTKNLDQMTKAKQRLESIYNSISNPLHSQNN

SEQ ID NO: 2537 - DNA, 1797 bp, Staphylococcus aureus
atgaaacttaatattaaagcaatgcggagcgtgattatgaagagaattagtaaagatatatgggcagtatttaaattactgtatcaaaataaagggcgttttagcattaatgccttactattgcagttaatcatgatttttattagtagtacatacttaattttactatttaatatgatgttaaaagtagctgggcaaagccaacttacgattaacaattggacggaaatcgttagtcatcccgccagtgtgatacttcttattatattcatattaagtgttgcctttctgatttatgtagagttttcattgttagtttatatggtttatgccggctttgatcgacagattattacatttaaatccatttttaaaaatgcctttgtaaatgtgcgtaaactcataggtgtaccagttattttctttgtcatttatttaatgttaatgatacccattgccaacctaggactaagttcagtattaacaaaaaatatttacatacctaaatttttaacggaagaacttatgaaaacgacgaaaggtataatcatttacggtacctttatgattgctgtatttatattaaattttaaattaatatttactctaccgttaacgattttaaaccgccagtcgttatttaaaaatatgagactaagttggcaaattacgaagcgaaataagtttcggcttgttatagaaatagttatattagaactcatcattggtgcgattttaacattaattatttcaggagcaacatatcttgctatttgtgtagatgaagaaggagataagtttttagtctcatcaattttatttgttgtattgaaaagcgcattgttcttctattatttatttacgaaattatcattaatcagtgtgttagtactgcacttaaaacaagagaatgtattagaccaaccgggcttagaatttaaatatccaaaaccgaaacggaagtctaggttctttataatttcaatggtgcttgcagtgacatgttttatcggttataacatgtacttactttacaataatactatcaatacaaatatctccattattggccatcgtggtttcgaagataaaggtgttgaaaattctattccgtcattgaaagctgctgcaaaagcgaatgtcgaatacgttgagttagatacaattatgacgaaagataaacaatttgttgttagtcatgataacaatttgaaacgtttaacaggtgttaataaaaatatttctgaatctaatttcaaagatatcgtcggtttgaaaatgcgtcaaaatggacatgaagcaaaatttgtatccttagacgaatttattgaaacggctaaacaatcaaatgtgaagctactagtagagttaaagccacatggtaaagaaccagcagattatacacaacgtgttattgatattttgaaaaagcatggtgttgaacatcaatatcgtgtgatgtctttggattatgatgtgatgactaagttgaaaaaagaagcgccatatctcaagtgtggttatatcattccgttgcagtttggtcattttaaagaaacatcattagatttctttgtcatcgaagatttttcttattcgccaagacttgttaatcaagcgcacttggaaaataaagaagtctatacttggactattaacggcgaagaagatttaacgaaatacttacaaaccaatgttgatggtattatcacagatgacccagcattagctgatcagattaaagaagaaaagaaagacgaaacatacttcgatcgttctataagaattttgtttgaa

SEQ ID NO: 2538 - protein, 599 aa, Staphylococcus aureus
  MISC_FEATURE (1)..(599): hypothetical protein
MKLNIKAMRSVIMKRISKDIWAVFKLLYQNKGRFSINALLLQLIMIFISSTYLILLFNMMLKVAGQSQLTINNWTEIVSHPASVILLIIFILSVAFLIYVEFSLLVYMVYAGFDRQIITFKSIFKNAFVNVRKLIGVPVIFFVIYLMLMIPIANLGLSSVLTKNIYIPKFLTEELMKTTKGIIIYGTFMIAVFILNFKLIFTLPLTILNRQSLFKNMRLSWQITKRNKFRLVIEIVILELIIGAILTLIISGATYLAICVDEEGDKFLVSSILFVVLKSALFFYYLFTKLSLISVLVLHLKQENVLDQPGLEFKYPKPKRKSRFFIISMVLAVTCFIGYNMYLLYNNTINTNISIIGHRGFEDKGVENSIPSLKAAAKANVEYVELDTIMTKDKQFVVSHDNNLKRLTGVNKNISESNFKDIVGLKMRQNGHEAKFVSLDEFIETAKQSNVKLLVELKPHGKEPADYTQRVIDILKKHGVEHQYRVMSLDYDVMTKLKKEAPYLKCGYIIPLQFGHFKETSLDFFVIEDFSYSPRLVNQAHLENKEVYTWTINGEEDLTKYLQTNVDGIITDDPALADQIKEEKKDETYFDRSIRILFE

SEQ ID NO: 2539 - DNA, 753 bp, Staphylococcus aureus
atgcttaagggacacttacattctgtcgaaagtttaggtactgtcgatggaccgggattaagatatatattatttacacaaggatgcttacttagatgcttgtattgccacaatccagatacttggaaaattagtgagccatcaagagaagtcacagttgatgaaatggtgaatgaaatattaccatacaaaccatactttgatgcatcgggtggcggtgtaacagtcagtggtggcgaaccattgttacaaatgccattcttagaaaaattatttgcagaattaaaagaaaatggtgtgcacacttgcttagacacatcggctggatgtgctaatgatacaaaagcatttcaaaggcattttgaagaattacaaaaacatacagacttgatattattagatataaaacatattgataatgacaaacatattagattgacaggaaagcctaatacacacatccttaacttcgcgcgcaaactgtcagatatgaaacaacctgtatggattcgacatgtccttgtgcctggttattctgatgataaagacgatttaattaaactaggggaatttattaattctcttgataacgtcgaaaagtttgaaattctgccatatcatcagttaggtgttcataagtggaaaacattgggcattgcatatgaattagaagatgtcgaagcgcccgatgatgaagctgttaaagcagcctaccgttatgttaacttcaaagggaaaattcccgttgaatta

SEQ ID NO: 2540 - protein, 251 aa, Staphylococcus aureus
  MISC_FEATURE (1)..(251): formate acetyltransferase
MLKGHLHSVESLGTVDGPGLRYILFTQGCLLRCLYCHNPDTWKISEPSREVTVDEMVNEILPYKPYFDASGGGVTVSGGEPLLQMPFLEKLFAELKENGVHTCLDTSAGCANDTKAFQRHFEELQKHTDLILLDIKHIDNDKHIRLTGKPNTHILNFARKLSDMKQPVWIRHVLVPGYSDDKDDLIKLGEFINSLDNVEKFEILPYHQLGVHKWKTLGIAYELEDVEAPDDEAVKAAYRYVNFKGKIPVEL

SEQ ID NO: 2541 - DNA, 129 bp, Staphylococcus aureus
atgtatggcgcatacttgatatatgaatatcatcaagattttaaaagtatcgctaattttaaagtcttaaaacgcatgattaatgtcatgatgtgttattgcgttttgtttttagagccacgtatttcc

SEQ ID NO: 2542 - protein, 43 aa, Staphylococcus aureus
MYGAYLIYEYHQDFKSIANFKVLKRMINVMMCYCVLFLEPRIS

SEQ ID NO: 2543 - DNA, 2262 bp, Staphylococcus aureus
atggaggcgtttagtatgttagaaacaaataaaaatcatgcaacagcttggcaaggatttaaaaatggaagatggaacagacacgtagatgtaagagagtttatccaattaaactacactctttatgaaggtaatgattcatttttagcaggaccaacagaagcaacttctaaactttgggaacaagtaatgcagttatcgaaagaagaacgtgaacgtggcggcatgtgggatatggacacgaaagtagcttcaacaatcacatctcatgatgctggttatttagacaaagatttagaaacaattgtaggtgtacaaactgaaaagccattcaaacgttcaatgcaaccattcggtggtattcgtatggcgaaagcagcttgtgaagcttacggttacgaattagacgaagaaactgaaaaaatctttacagattatcgtaaaacacataaccaaggtgtattcgatgcatattctagagaaatgttgaactgccgtaaagcaggtgtaatcactggtttacctgatgcatacggacgtggacgtattatcggtgactatcgtcgtgtagctttatatggtgtagatttcttaatggaagaaaaaatgcacgacttcaacacgatgtctacagaaatgtcagaagatgtaattcgtttacgtgaagaattatcagaacaatatcgtgcattaaaagaattaaaagaacttggacaaaaatatggtttcgatttaagccgtccagcagaaaacttcaaagaagcagttcaatggttatacttagcataccttgctgcaattaaagaacaaaacggtgcagcaatgagtttaggtcgtacatcaacattcttagatatctatgctgaacgtgaccttaaagcaggcgttattactgaaagcgaagttcaagaaattattgaccacttcatcatgaaattacgtattgttaaatttgctcgtacacctgattacaatgaattattctctggagacccaacttgggtaactgaatctatcggtggtgtaggtattgacggacgtccacttgttacgaaaaactcattccgtttcttacactcattagataacttaggtccagctccagaaccaaacttaacagtattatggtcagtacgtttacctgacaacttcaaaacatactgtgcaaaaatgagtattaaaacaagttctatccaatatgaaaatgatgacattatgcgtgaaagctatggcgatgactatggtatcgcatgttgtgtatcagcgatgacaattggtaaacaaatgcaattcttcggtgcacgtgcgaacttagctaaaacattactttacgctatcaatggtggtaaagatgaaaaatctggtgcacaagttggtccaaacttcgaaggtattaacagcgaagtattagaatatgacgaagtattcaagaaatttgatcaaatgatggattggctagcaggtgtttacattaactcattaaatgttattcactacatgcacgataaatacagctatgaacgtattgaaatggcattacatgatacagaaattgtacgtacaatggcaacaggtatcgctggtttatcagtagcagctgactcattatctgcaattaaatatgcacaagttaaaccaattcgtaacgaagaaggtcttgtagtagactttgaaatcgaaggcgacttccctaaatacggtaacaatgacgaccgtgtagatgatattgcagttgatttagtagaacgcttcatgactaaattacgtagtcataaaacatatcgtgattcagaacatacaatgagtgtattaacaattacttcaaacgttgtatacggtaagaaaactggtaacacaccagacggacgtaaagctggcgaaccatttgctccaggtgcaaacccaatgcatggccgtgaccaaaaaggtgcattatcttcattaagttctgtagctaagatcccttacgattgctgtaaagatggtatttcaaatacattcagtatcgtaccaaaatcattaggtaaagaaccagaagatcaaaaccgtaacttaactagtatgttagatggttacgcaatgcaatgtggtcaccacttaaatattaacgtatttaaccgtgaaacattaatagatgcaatggaacatccagaagaatatccacagttaacaatccgtgtatctggttacgctgttaacttcattaaattaacacgtgaacaacaattagatgtaatttctcgtacattccatgaaagtatg

SEQ ID NO: 2544 - protein, 754 aa, Staphylococcus aureus
  MISC_FEATURE (1)..(754): formate acetyltransferase
MEAFSMLETNKNHATAWQGFKNGRWNRHVDVREFIQLNYTLYEGNDSFLAGPTEATSKLWEQVMQLSKEERERGGMWDMDTKVASTITSHDAGYLDKDLETIVGVQTEKPFKRSMQPFGGIRMAKAACEAYGYELDEETEKIFTDYRKTHNQGVFDAYSREMLNCRKAGVITGLPDAYGRGRIIGDYRRVALYGVDFLMEEKMHDFNTMSTEMSEDVIRLREELSEQYRALKELKELGQKYGFDLSRPAENFKEAVQWLYLAYLAAIKEQNGAAMSLGRTSTFLDIYAERDLKAGVITESEVQEIIDHFIMKLRIVKFARTPDYNELFSGDPTWVTESIGGVGIDGRPLVTKNSFRFLHSLDNLGPAPEPNLTVLWSVRLPDNFKTYCAKMSIKTSSIQYENDDIMRESYGDDYGIACCVSAMTIGKQMQFFGARANLAKTLLYAINGGKDEKSGAQVGPNFEGINSEVLEYDEVFKKFDQMMDWLAGVYINSLNVIHYMHDKYSYERIEMALHDTEIVRTMATGIAGLSVAADSLSAIKYAQVKPIRNEEGLVVDFEIEGDFPKYGNNDDRVDDIAVDLVERFMTKLRSHKTYRDSEHTMSVLTITSNVVYGKKTGNTPDGRKAGEPFAPGANPMHGRDQKGALSSLSSVAKIPYDCCKDGISNTFSIVPKSLGKEPEDQNRNLTSMLDGYAMQCGHHLNINVFNRETLIDAMEHPEEYPQLTIRVSGYAVNFIKLTREQQLDVISRTFHESM

SEQ ID NO: 2545 - DNA, 966 bp, Staphylococcus aureus
atgaaatcaaaaatttatatcttgctattatttctcatttttttatcagcatgcgctaatacgcgtcactctgaatccgataaaaatgtattaacagtttattctccgtatcaatcaaacttgattcgtccaattttaaatgaatttgaaaaacaagagcatgtcaaaattgaaattaaacacggatctactcaagtactgctttcaaacttgcataacgaagatttttcggagcgtggtgatgtctttatgggtggtgtgttgtcagaaacaattgatcatccagaagattttgttccctatcaagatacatctgtaacacagcaattagaggattatcgctcgaacaataaatatgttactagttttctattaatgccaacagttatagtagtgaattcagatttacaaggagatattaagattcgaggttatcaagatttattacaacctatacttaaaggtaaaattgcgtactcaaatccaaatacaacaacgacaggctatcaacatatgcgtgctatttatagcatgcatcatcgagtaagtgatgtgcatcaattccaaaaccatgcgatgcaactgtcaaagacgtctaaagtcattgaagatgttgcaaaaggtaaatattacgcaggtctaagctacgaacaagatgcacgcacatggaaaaacaaaggttatcctgtatcaatcgtttatccaattgaaggaacaatgttaaatgttgatggtattgctttagttaaaaatgcacaccctcatcctaagcgtaaaaagttagtgcaatatttaacaagccgctcagtacaacaacgattagttgcagagttcgatgccaagtcaattcgaaaggatgttagtgaacaaagcgatcagtctatcgaaaatcttaagaacatacctttaataccgaaatctaaattaccggatattccacatcataaatttttggagatgattcaa

SEQ ID NO: 2546 - protein, 322 aa, Staphylococcus aureus
  MISC_FEATURE (1)..(322): hypothetical protein
MKSKIYILLLFLIFLSACANTRHSESDKNVLTVYSPYQSNLIRPILNEFEKQEHVKIEIKHGSTQVLLSNLHNEDFSERGDVFMGGVLSETIDHPEDFVPYQDTSVTQQLEDYRSNNKYVTSFLLMPTVIVVNSDLQGDIKIRGYQDLLQPILKGKIAYSNPNTTTTGYQHMRAIYSMHHRVSDVHQFQNHAMQLSKTSKVIEDVAKGKYYAGLSYEQDARTWKNKGYPVSIVYPIEGTMLNVDGIALVKNAHPHPKRKKLVQYLTSRSVQQRLVAEFDAKSIRKDVSEQSDQSIENLKNIPLIPKSKLPDIPHHKFLEMIQ

SEQ ID NO: 2547 - DNA, 1554 bp, Staphylococcus aureus
atgacggcatacaaaccttatagacatcaattaagacgatcgttatttgcgtctactatttttccagtatttttagtcattattattggactagtaagcttctatgccatctatatttggattgagcatcgtacgattcatcaacatgttgatgaaagtcagtcatctttacatcatactgaaaagcagattcagacatttattacacagcataataattcgtttcaagagctcgatttaacaaatcatcatgatgtgaccgctacaaaacgtgaattattaaaattaatacaccaacagcccgcaacactttattatgaattatctggaccaaatcagtttataaccaataattatgaacatttaaacactaaaaatatgtatttattttcaacgcatcagcttaaattcaaaaatagtacatatatgcttaaaatttatatggctaacaccccacgtttaagtgaaattaagaaagataaccgacaattcgcacttatcgttgatcaatatgacaatattttatacgccaacgatgaccgttttactataggtgaaaagtatagaccacaacaattcggatttatgaatgaatctgtaaaattaaaccatgctgaccatcgtctcattatttataaagatatacatgaaaacattgaagatggtatcacgttgttaattgttatggccgtagttcttgttttactagtaatatttggtttcattagcgcagataatatggctaaacgacaaacaaaagatatcgaaacgattattcaaaaaatttactatgccaaaaatcgtcatctaggtacatatacgcctttaaaaaacaacagtgaactagaagaaattaataattatatttacgatttatttgaatcaaatgagcaactgatccattctatcgagcatacagaacgtcgcttgcgtgatattcagttaaaggaaatagaacgccaattccagcctcatttcctattcaatacgatgcaaacaatacaatatttaattacgttatctccgaaattagcacaaactgtggtccaacaattatcgcaaatgttacgttactcattacgtacaaactcacatacagtggaattaaacgaagagttgaactacattgaacagtatgttgcaatacaaaacatccgttttgatgacatgattaagctccatattgaaagttctgaagaagcgcgtcaccagacaattggtaaaatgatgcttcagccactcatagaaaatgctattaaacatggtagagatactgagtcattggacattactatacgcctgacattggcacgtcagaatttacatgttttagtttgcgacaatggtatcgggatgtcgtcatctcgcctgcaatatgtacgccaatctcttaataatgatgtatttgatactaagcatttgggattaaatcatttacacaataaagcaatgattcaatatggttcacatgcacgactccatattttttcaaagcgtaatcaaggtacgttaatttgttataaaataccactttcaagggggaatgtagatgtt

SEQ ID NO: 2548 - protein, 518 aa, Staphylococcus aureus
  MISC_FEATURE (1)..(518): hypothetical protein
MTAYKPYRHQLRRSLFASTIFPVFLVIIIGLVSFYAIYIWIEHRTIHQHVDESQSSLHHTEKQIQTFITQHNNSFQELDLTNHHDVTATKRELLKLIHQQPATLYYELSGPNQFITNNYEHLNTKNMYLFSTHQLKFKNSTYMLKIYMANTPRLSEIKKDNRQFALIVDQYDNILYANDDRFTIGEKYRPQQFGFMNESVKLNHADHRLIIYKDIHENIEDGITLLIVMAVVLVLLVIFGFISADNMAKRQTKDIETIIQKIYYAKNRHLGTYTPLKNNSELEEINNYIYDLFESNEQLIHSIEHTERRLRDIQLKEIERQFQPHFLFNTMQTIQYLITLSPKLAQTVVQQLSQMLRYSLRTNSHTVELNEELNYIEQYVAIQNIRFDDMIKLHIESSEEARHQTIGKMMLQPLIENAIKHGRDTESLDITIRLTLARQNLHVLVCDNGIGMSSSRLQYVRQSLNNDVFDTKHLGLNHLHNKAMIQYGSHARLHIFSKRNQGTLICYKIPLSRGNVDV

SEQ ID NO: 2549 - DNA, 756 bp, Staphylococcus aureus
atgtttaaggtagttatttgtgatgatgaacgaattattcgagaaggattaaagcaaatcattccttggggagactatcatttcaatacaatatacactgctaaagatggtgttgaagcattatcactaattcaacaacatcagccagaattagtaattactgatattcgtatgccacgtaaaaatggcgtcgatttactcaatgatattgcgcatctagattgtaatgtcatcatattatcgagttacgatgactttgaatatatgaaagccggcattcaacatcatgttcttgattatttattaaaaccagtagaccatgcacaattagaagttattttaggaagacttgtccgtaccttattagagcaacaatcacagaacggccgtagcttagcatcttgtcatgatgccttccaaccactattaaaagtagaatacgatgattattatgtaaaccagattgtggatcaaattaagcaatcttatcaaacgaaagtgactgtttcagatttaattcaacatatcgatgttagtgaatcgtatgcgatgcgaacatttaaagatcatgttggtattacaattgtcgattatttaaatcgctatcgtattttacaatctctgcaattgttagatcgacattacaaacactatgaaattgcagacaaagtaggcttttcagagtataaaatgtttagctatcattttaaaaaatatttacaaatgtcgccaagtgattattgtaagcaagcaaaa

SEQ ID NO: 2550 - protein, 252 aa, Staphylococcus aureus
  MISC_FEATURE (1)..(252): hypothetical protein
MFKVVICDDERIIREGLKQIIPWGDYHFNTIYTAKDGVEALSLIQQHQPELVITDIRMPRKNGVDLLNDIAHLDCNVIILSSYDDFEYMKAGIQHHVLDYLLKPVDHAQLEVILGRLVRTLLEQQSQNGRSLASCHDAFQPLLKVEYDDYYVNQIVDQIKQSYQTKVTVSDLIQHIDVSESYAMRTFKDHVGITIVDYLNRYRILQSLQLLDRHYKHYEIADKVGFSEYKMFSYHFKKYLQMSPSDYCKQAK

SEQ ID NO: 2551 - DNA, 1395 bp, Staphylococcus aureus
atgattgaggtgacagagatgaacttttttgatatccataagattccgaacaaaggcattccattatcggtacaacgtaaattatggcttagaaacttcatgcaagctttcttcgtagtgttctttgtttatatggctatgtatttaattcgaaacaactttaaggcggcacaaccgtttttaaaagaggaaattggattatctacattagaacttggttatatcggattagcatttagtatcacgtacggtttaggaaaaacattacttggatattttgtcgatggacgtaacacaaaacgtattatctcgttcttacttatcttatctgcgattacagttttaattatgggatttgttttaagttactttggttctgtaatgggattattaattgtactttggggacttaacggggtgttccaatcagttggtggacctgcaagttattcaacgatttcaagatgggcgccaagaacgaaacgtggccgatacttaggattctggaatacatcacataatatcggtggtgccatagcaggtggtgttgcactttggggtgctaatgtattcttccatggaaatgttatagggatgttcattttcccatcggtgattgcattacttattggtatcgcaacattatttatcggaaaagatgatccggaagaattaggatggaatcgtgctgaagaaatttgggaagagccggtcgataaagaaaatattgattctcaaggtatgacgaaatgggagatctttaaaaaatatatcctgggaaatcctgttatatggattctatgtgtttcaaacgtctttgtatacattgtacgaatcggtattgataactgggcaccgttatatgtgtcagagcatttacactttagtaaaggcgatgcagttaatacgatattctactttgaaattggtgcattagttgcaagtttattatggggctacgtatcagacttattaaaaggtcgtcgtgcaattgtagctattggctgtatgtttatgattacatttgttgtcttattctacacaaatgctacaagtgtcatgatggttaacatttcattgtttgcattaggtgcgttaatctttggtccgcaattattaattggtgtatcattgactggttttgttcctaaaaatgccatcagtgtagcaaacggaatgacaggttcattcgcgtatctattcggtgactcaatggcgaaagttggtttggcggctattgctgatccaacacgtaacggtttaaacatctttggatatacattaagtggatggacagatgttttcatcgtcttctatgttgcattattcctaggcatgattctattaggaatcgttgctttctatgaagaaaagaaaattagaagtttaaaaatt

SEQ ID NO: 2552 - protein, 465 aa, Staphylococcus aureus
  MISC_FEATURE (1)..(465): hexose phosphate transport
MIEVTEMNFFDIHKIPNKGIPLSVQRKLWLRNFMQAFFVVFFVYMAMYLIRNNFKAAQPFLKEEIGLSTLELGYIGLAFSITYGLGKTLLGYFVDGRNTKRIISFLLILSAITVLIMGFVLSYFGSVMGLLIVLWGLNGVFQSVGGPASYSTISRWAPRTKRGRYLGFWNTSHNIGGAIAGGVALWGANVFFHGNVIGMFIFPSVIALLIGIATLFIGKDDPEELGWNRAEEIWEEPVDKENIDSQGMTKWEIFKKYILGNPVIWILCVSNVFVYIVRIGIDNWAPLYVSEHLHFSKGDAVNTIFYFEIGALVASLLWGYVSDLLKGRRAIVAIGCMFMITFVVLFYTNATSVMMVNISLFALGALIFGPQLLIGVSLTGFVPKNAISVANGMTGSFAYLFGDSMAKVGLAAIADPTRNGLNIFGYTLSGWTDVFIVFYVALFLGMILLGIVAFYEEKKIRSLKI

SEQ ID NO: 2553 - DNA, 570 bp, Staphylococcus aureus
ttgacaagctttatctataaaatactttatgttgtcaaaatcaacgcttatacatatgacataatgacggaggacatcatgattctatctatattacttatctttttctgtatcagacttgtcagcttaaagatatctattaatcactcaaaacaattaaaagcagacggtgcagttgaatatggcgttaaaaattcgaagtttttagcaataacacacgttttaatttatgtattggctggtgtagaggcatttattaataaagatacatttagctttgcaaatggtattggcttagttatattaatctttgcttatatcatgttatttatggttattaaaactttaggtggtatttggacattaaaattattcattttacctaaccatcctattattaaatctggattatataaaattacaaaacacccaaattacttcttaaacatcattcctgaattaatcggtgtattattattaacacacgcaacatatacaactattttattagtaccgtatgcgtatttcttatatgtacgtattaaacaagaagagaaattaatgaatatt

SEQ ID NO: 2554 - protein, 190 aa, Staphylococcus aureus
  MISC_FEATURE (1)..(190): conserved hypothetical
LTSFIYKILYVVKINAYTYDIMTEDIMILSILLIFFCIRLVSLKISINHSKQLKADGAVEYGVKNSKFLAITHVLIYVLAGVEAFINKDTFSFANGIGLVILIFAYIMLFMVIKTLGGIWTLKLFILPNHPIIKSGLYKITKHPNYFLNIIPELIGVLLLTHATYTTILLVPYAYFLYVRIKQEEKLMNI

SEQ ID NO: 2555 - DNA, 1008 bp, Staphylococcus aureus
atgatacaaaattctcaatataaaaagaaggagtgcttttcaatgaaaataggtgtattttcagtattattttacgataaaaattttgaagatatgttagattatgtctcagaatctggattggatatgattgaagttggaacaggtggtaacccaggagataaattttgtaagttagatgagttgttagaaaatgaagacaagcgccaagcatttatgaagtcaatcacagacagaggcttacaaataagtggtttcagttgtcataacaatccaatttctccagatccgatagaagcgaaagaagccgatgaaacgttacgtaaaacaatccgtttagcaaatctattagacgtgccagttgttaatacattttctggcattgcaggatcagatgataccgctaaaaagcctaattggcctgttacaccttggccaacagcctactctgaaatttatgattatcagtggaatgaaaagttgataccatattggcaagatttagctgagtttgcaaaagagcaagatgtaaaaattgccatagagttgcatgcaggatttttagtgcatacaccatatacaatgttgaagttacgtgaggctacaaatgaatatatcggtgctaacttagatcctagtcatctatggtggcaaggtattgacccaattgctgcgattcgcatattaggccaagcaaatgcaattcatcacttccatgctaaagatacgtatattaatcaagaaaatgtaaatatgtatggtctaactgatatgcaaccatatggtaacgttgcgacaagagcatggacattccgtacagttggttatggacatagtccatatgtatgggcagatatcataagtcaacttattattaatggatatgattatgtattaagtattgaacatgaagatcctattatgtcagtagaagaaggtttccaaaaagcttgtcaaactttgaaatctgttaatatttacgacaagccagcagacatgtggtgggca

SEQ ID NO: 2556 - protein, 336 aa, Staphylococcus aureus
  MISC_FEATURE (1)..(336): conserved hypothetical
MIQNSQYKKKECFSMKIGVFSVLFYDKNFEDMLDYVSESGLDMIEVGTGGNPGDKFCKLDELLENEDKRQAFMKSITDRGLQISGFSCHNNPISPDPIEAKEADETLRKTIRLANLLDVPVVNTFSGIAGSDDTAKKPNWPVTPWPTAYSEIYDYQWNEKLIPYWQDLAEFAKEQDVKIAIELHAGFLVHTPYTMLKLREATNEYIGANLDPSHLWWQGIDPIAAIRILGQANAIHHFHAKDTYINQENVNMYGLTDMQPYGNVATRAWTFRTVGYGHSPYVWADIISQLIINGYDYVLSIEHEDPIMSVEEGFQKACQTLKSVNIYDKPADMWWA

SEQ ID NO: 2557 - DNA, 1038 bp, Staphylococcus aureus
atgacaaaattaaaagttggtgtgataggtgttggtggtattgcacaagaccgtcatattccagcattgctgaaactcaaagacacagtctcattagttgcagtacaagatattaatacagtgcagatgattgatgttgcgaagcgctttaatatacctcatgcagttgagacacctagcgagctgtttaaacttgttgatgcggtggtcatttgtacacctaataaattccatgctgatctttctatagaagcattgaaccatggtgtccatgtattgtgtgaaaagccaatggcgatgacgacggaagagtgtgatcgcatgattgaagcggctaataaaaatcacaaattattaactgtcgcatatcattatcgtcacacagatgtggcaattactgctaaaaaagcaattgaatcaggtgtggttggtaaacctttagtagcacgtgtacaagcgatgcgtaggcgtaaagtgcctggctggggtgtttttaccaataaagcgttgcaaggtggcggtagtttaatcgattatggttgccacttgttagacttatctttgtggctactaggtaaagatatggtgccgcatgaagtgctaggaaaaacatataatcaattgagcaaacaaccgaatcaaattaatgattggggaacatttgatcatactaaatttgatgtcgatgatcatgttactagttatatgacatttgccaatcgagcaagcatgcagtttgaatgttcgtggtctgcaaatatcaaagaagataaggttcacgttagtttatcaggagaagatggcggtatcaatttatttccatttgaaatatatgagccccgctttggaactatttttgaaagcaaagctaatgttgagcataacgaagacattgctggtgagagacaggcgcgtaactttgtcaatgcgtgtttagggatagaagagattgtggtgaaaccggaagaagcacgcaatgtaaatgcccttatagaagcgatttatcgtagcgatcttgataacaagagcatacaactt

SEQ ID NO: 2558 - protein, 346 aa, Staphylococcus aureus
  MISC_FEATURE (1)..(346): hypothetical protein
MTKLKVGVIGVGGIAQDRHIPALLKLKDTVSLVAVQDINTVQMIDVAKRFNIPHAVETPSELFKLVDAVVICTPNKFHADLSIEALNHGVHVLCEKPMAMTTEECDRMIEAANKNHKLLTVAYHYRHTDVAITAKKAIESGVVGKPLVARVQAMRRRKVPGWGVFTNKALQGGGSLIDYGCHLLDLSLWLLGKDMVPHEVLGKTYNQLSKQPNQINDWGTFDHTKFDVDDHVTSYMTFANRASMQFECSWSANIKEDKVHVSLSGEDGGINLFPFEIYEPRFGTIFESKANVEHNEDIAGERQARNFVNACLGIEEIVVKPEEARNVNALIEAIYRSDLDNKSIQL

SEQ ID NO: 2559 - DNA, 1077 bp, Staphylococcus aureus
atgatgacgattaaagttggaatcattgggtgtggtggtattgcgaatggcaagcacatgccaagtttacaaaaagttgaaaatgttgaaatgatcgcattttgtgacgtagacatttcgaaagcagcgagtgcggcagaagcatacggaactgacaatgcaaaggtttatgatgattacaaagcattgttaaaagatgacacgattgatgttatccatgtttgtacgccaaatgactcgcattgtgaaattactgtagcagggttgcatgctggtaaacatgtgatgtgtgaaaaaccaatggctaaaacgacagcagaagctcaaaaaatgatagatacagctaaatcaacaggtaaaaaattaacaataggttatcaaaatcgtttccgagcagatagtcaatttttacatcaagcagcgcaacgtggcgacttaggagacatttacttcggaaaggcacatgccattcgtcgtcgagcagtaccaacatggggtgtctttctagacgaagaagctcaaggtggaggaccattaatcgatatcggtacacacgctttagatttaacgttatggatgatggataattatgaaccagaatcagtgatgggttcaacattccataaattaaataaacagcatcatgcggcaaacgcttggggttcatggaatccagatgaatttacagttgaagattctgcgtttggatttattaaaatgaagaatggagcgacgatcattttagaatccgcttgggcgattaattctttagaagtggatgaggcaaaatgttcattatcaggaactaaagcaggtgctgatatgaaagatggtctacgtattcatggtgaagacatgggtacactttataccaaacacgttgaattggaaaacaaaggcgtcgacttttatgaaggtaatgaagtggatgaagctgaagaagaagcaaaagcttggattgatgcagttgtaaatgatactgaaccagttgtgaaaccggaacaagcaatggtagttacaaaaattcttgaagcgatttatcagtctgcaaaatcaggcaaagcaatttactttgaa

SEQ ID NO: 2560 - protein, 359 aa, Staphylococcus aureus
  MISC_FEATURE (1)..(359): hypothetical protein
MMTIKVGIIGCGGIANGKHMPSLQKVENVEMIAFCDVDISKAASAAEAYGTDNAKVYDDYKALLKDDTIDVIHVCTPNDSHCEITVAGLHAGKHVMCEKPMAKTTAEAQKMIDTAKSTGKKLTIGYQNRFRADSQFLHQAAQRGDLGDIYFGKAHAIRRRAVPTWGVFLDEEAQGGGPLIDIGTHALDLTLWMMDNYEPESVMGSTFHKLNKQHHAANAWGSWNPDEFTVEDSAFGFIKMKNGATIILESAWAINSLEVDEAKCSLSGTKAGADMKDGLRIHGEDMGTLYTKHVELENKGVDFYEGNEVDEAEEEAKAWIDAVVNDTEPVVKPEQAMVVTKILEAIYQSAKSGKAIYFE

SEQ ID NO: 2561 - DNA, 837 bp, Staphylococcus aureus
atgacaaagaagaaaaacatattaaaagcaatcggtatttacagttttatagcgatgatgtttgtcatcattttatatccactactgtggacatttggcatttcccttaatccaggtacgaacttgtatggtgccaaaatgataccagacaatgcaacatttaaaaattatgcattcttactattcgatgacagtagtcaatacctgacttggtataaaaatacgcttatcgtagcatctgcaaatgcactgtttagtgtgatatttgtcacgttaacagcatatgctttttctagatatcgctttgttggtcgtaaatacgggctgattacatttttgattttacaaatgttccctgtattaatggcaatggtcgcaatctatattttgctaaatacaattggattattagattctttatttggactaacactggtatatattggtggatcaataccgatgaatgcctttttagtgaaaggttacttcgatacgattccaaaagaacttgatgaatctgccaaaattgatggtgcagggcatatgcgtattttcttacaaattatgcttccattagctaagccgattttagcagttgttgctttgttcaattttatggggccatttatggactttatattacctaaaatactattaagaagtcctgaaaaattcacattagcagttggattgttcaactttattaatgataagtatgcaaataatttcacagtgtttgcagcaggggcaattatgattgcagtacctatagcaatcgtattcttgttcttgcaacgctatttagtatcaggtttaacaacaggtgcgacaaaaggt

SEQ ID NO: 2562 - protein, 279 aa, Staphylococcus aureus
  MISC_FEATURE (1)..(279): maltose/maltodextrin
MTKKKNILKAIGIYSFIAMMFVIILYPLLWTFGISLNPGTNLYGAKMIPDNATFKNYAFLLFDDSSQYLTWYKNTLIVASANALFSVIFVTLTAYAFSRYRFVGRKYGLITFLILQMFPVLMAMVAIYILLNTIGLLDSLFGLTLVYIGGSIPMNAFLVKGYFDTIPKELDESAKIDGAGHMRIFLQIMLPLAKPILAVVALFNFMGPFMDFILPKILLRSPEKFTLAVGLFNFINDKYANNFTVFAAGAIMIAVPIAIVFLFLQRYLVSGLTTGATKG

SEQ ID NO: 2563 - DNA, 855 bp, Staphylococcus aureus
ttgaagcgcattaattttataaaagcaacagatagtcaagtcattgctacattagttcttaatgtcacactcccatctttagttattgtgaatttaaacagtgcagaattaaaattgtcattctccattttaccaattttaatgattatatatggtattgtggcgaaaatgattgctgtctggttttttagaaaatatgataatcacatgcgtggatcagtaggtatgatgactggtgctatgaatattggattgtttgcatatccactaattgaagtgatatggcctaaaacgggacttatttattttgttatggctgatataggtggtgcctttgtgatgtttggaattacttactttgtaggtagctactttagtgaaggtagtgatcaattcgattttaaatatttaggtaagaaattattacaatcagtgccactcgttacatacattgtaatgtttatattgaatataagtcacatccatttaccacatgtggcaatcgatttctttagcatactttcccatgcaaatatgccgttatcaatgattttgctaggtgtcatgttgaattttactctggaaagaaagtatatacctgctactattaaatatttatgtttgcattatggattagcattagttgcgggattgttagtatatgtgttgttaccagtatcagatgatatgattaagacgacattgttggtcacttggatgttcccggtaggtgttgcaattatttcttatggtattcagtttaaatatcgaacactgccatttataggtatgacgaccaatttgacaatcattattagtatcattattttgtacgtgtatcaggcagtgtttgtc

SEQ ID NO: 2564 - protein, 285 aa, Staphylococcus aureus
  MISC_FEATURE (1)..(285): conserved hypothetical
LKRINFIKATDSQVIATLVLNVTLPSLVIVNLNSAELKLSFSILPILMIIYGIVAKMIAVWFFRKYDNHMRGSVGMMTGAMNIGLFAYPLIEVIWPKTGLIYFVMADIGGAFVMFGITYFVGSYFSEGSDQFDFKYLGKKLLQSVPLVTYIVMFILNISHIHLPHVAIDFFSILSHANMPLSMILLGVMLNFTLERKYIPATIKYLCLHYGLALVAGLLVYVLLPVSDDMIKTTLLVTWMFPVGVAIISYGIQFKYRTLPFIGMTTNLTIIISIIILYVYQAVFV

SEQ ID NO: 2565 - DNA, 1266 bp, Staphylococcus aureus
atgacgaaacgtaaccctaaattagcggcattattatctgttatacctggtttgggacagttttataataaaagacccattaaagggacgatattttttatctttttcatcagttttatttctgttttttatagctttttaaatattggtttttggggattgttcacattagggacagtacctaagttagacgattctcgtgtcttacttgcacaaggtattatttctatcttactcgttgctttcgcaatcatgctatatatcattaatattttagatgcatatcgtaatgctgaacgatttaatcgcaatgaggaaataaaggatccgaaggcgcgtatggtggcaacatgggacaagacgttcccatacttactaatctcaccaggtacattcttattgatatttgtagttgtatttccattaatatttatgtttggagtagcatttacaaattacaatttatacaacgcgcctccgagacacacattagaatgggttggtttagataactttaaaacgttattcacaattggcgtttggcgtaaaacatttttcagtgttattacttggacattagtatggacgcttgttgcaacgacacttcaaattgcattagggctgtttttggcaattattgtaaatcaccctgtcgtcaaaggtaagaaatttatccgtactgtgttaatcctaccttgggctgtaccatcatttgtgacaattttaatatttgtagcgttatttaatgatgaatttggtgcgataaataatgatattttgcaacctttattaggtgtagcaccagcatggttaagtgatccgttttgggcaaaagtggcattaatcggcattcaagtatggcttggattcccatttgtctttgcactgttcactggagtactgcaaagtatttcatcagattggtacgaagcagcagatatggatggtgcgtctagttggcaaaagtttagaaacatcacattcccgcatgtcatttacgccacagcgccattgttaattatgcaatatgcaggtaatttcaataattttaatcttatttatctatttaataaaggcggtccaccagtgtcagggcagaatgctggtagtacagatatcttgatatcttgggtgtataatctgacatttgagtttaacaacttcaacatgggtgcagttgtgtcattaattattggatttattgttgctattgtcgcatttattcaattcagacgtacaagtacgtttaaagatgagggaggttta

SEQ ID NO: 2566 - protein, 422 aa, Staphylococcus aureus
  MISC_FEATURE (1)..(422): maltose/maltodextrin
MTKRNPKLAALLSVIPGLGQFYNKRPIKGTIFFIFFISFISVFYSFLNIGFWGLFTLGTVPKLDDSRVLLAQGIISILLVAFAIMLYIINILDAYRNAERFNRNEEIKDPKARMVATWDKTFPYLLISPGTFLLIFVVVFPLIFMFGVAFTNYNLYNAPPRHTLEWVGLDNFKTLFTIGVWRKTFFSVITWTLVWTLVATTLQIALGLFLAIIVNHPVVKGKKFIRTVLILPWAVPSFVTILIFVALFNDEFGAINNDILQPLLGVAPAWLSDPFWAKVALIGIQVWLGFPFVFALFTGVLQSISSDWYEAADMDGASSWQKFRNITFPHVIYATAPLLIMQYAGNFNNFNLIYLFNKGGPPVSGQNAGSTDILISWVYNLTFEFNNFNMGAVVSLIIGFIVAIVAFIQFRRTSTFKDEGGL

SEQ ID NO: 2567 - DNA, 1269 bp, Staphylococcus aureus
atgtctaaaattttaaaatgtatcacgttagccgtggtaatgttattaatcgtaactgcatgtggccctaatcgttcgaaagaagatattgataaagcattgaataaagataattctaaagacaagcctaaccaacttacgatgtgggtggatggcgacaagcaaatggcgttttataaaaaaattacggatcaatatactaaaaaaactggcatcaaagtaaagcttgtaaatattggtcaaaatgatcaactagaaaatatttcgctagacgctcctgcaggaaaaggtccagatatctttttcttagcacatgataatactggaagtgcctatctacaaggcttagctgctgaaatcaaattatcaaaagatgagttgaaaggtttcaataagcaagcacttaaagcgatgaattatgacaataagcaactagcattgccagctatcgttgaaacaaccgcacttttttataataaaaaattagtgaaaaatgcaccgcaaacgttagaagaagttgaagctaatgctgccaaactaactgatagtaaaaagaaacaatacggtatgttatttgatgctaaaaatttctattttaattatccgtttttattcggcaatgatgattatattttcaagaaaaatggcagtgaatatgatattcatcagctaggactaaattcaaaacatgtcgtcaagaatgctgaacgattacaaaaatggtacgacaaagggtatcttcctaaggcagcaacacatgatgtcatgattggtctttttaaagaaggaaaagtaggacaatttgtcactggaccgtggaacattaatgaatatcaagaaacgtttggtaaagatttaggagtaacaacattacctacagatggtggcaaacctatgaaaccatttctaggtgtacgtggttggtatttatctgaatatagtaaacataagtattgggctaaagatttaatgctgtatatcactagtaaagatacattacaaaaatatacagatgaaatgagcgaaattactggacgtgttgacgtgaaatcatctaatccaaatttaaaagtgtttgaaaagcaagcacgtcatgctgaaccgatgcctaatattcctgaaatgcgacaagtttgggaaccgatgggcaatgcaagcatatttatttcaaatggtaagaatcctaaacaagcgttagatgaggcgacgaatgatataacgcaaaatattaagattcttcatccatcacaaaatgataagaaaggagat

SEQ ID NO: 2568 - protein, 423 aa, Staphylococcus aureus
  MISC_FEATURE (1)..(423): hypothetical protein
MSKILKCITLAVVMLLIVTACGPNRSKEDIDKALNKDNSKDKPNQLTMWVDGDKQMAFYKKITDQYTKKTGIKVKLVNIGQNDQLENISLDAPAGKGPDIFFLAHDNTGSAYLQGLAAEIKLSKDELKGFNKQALKAMNYDNKQLALPAIVETTALFYNKKLVKNAPQTLEEVEANAAKLTDSKKKQYGMLFDAKNFYFNYPFLFGNDDYIFKKNGSEYDIHQLGLNSKHVVKNAERLQKWYDKGYLPKAATHDVMIGLFKEGKVGQFVTGPWNINEYQETFGKDLGVTTLPTDGGKPMKPFLGVRGWYLSEYSKHKYWAKDLMLYITSKDTLQKYTDEMSEITGRVDVKSSNPNLKVFEKQARHAEPMPNIPEMRQVWEPMGNASIFISNGKNPKQALDEATNDITQNIKILHPSQNDKKGD

SEQ ID NO: 2569 - DNA, 1095 bp, Staphylococcus aureus
atggcagaactaaagttagagcatattaaaaagacgtatgataacaacaatactgtagtgaaagattttaatctacatattactgacaaagaattcattgtatttgttggaccatcgggatgtggtaaatcaacaacattacgaatggttgctggactagagtctatcacatctggagatttttatattgatggggaacgcatgaacgatgttgaaccaaagaatagagatattgcgatggtatttcaaaactatgcattatatccacatatgactgtttttgaaaatatggcatttgggctaaagctacgtaaagtaaataaaaaagagattgaacaaaaagttaatgaagcagctgaaatattaggattaactgagtatcttggtcgtaaaccaaaagcgttatctggcggacagcgtcaacgtgttgctttgggcagagctattgttagggatgcgaaagtctttttaatggatgaaccattatcgaatcttgatgcgaagcttcgagtacaaatgcgcacagaaatattgaaattacataagcgacttaatactacgacaatttatgttacacatgatcaaactgaagcattgacgatggctagtcgaattgttgttttgaaagatggcgacattatgcaagtcggcacacctagagaaatatatgatgcccctaattgcatatttgtggcgcaatttatcggctcaccagcaatgaatatgttgaatgctacagttgaaatggacggattgaaggtaggaacacaccattttaaattacataataaaaaatttgaaaagttaaaagctgctggctacttagacaaggaaattattttaggtattcgagctgaagacattcatgaagaaccaatatttattcaaacttctccagagacacaatttgaatctgaagtagttgtatccgaactgttaggttcagaaattatggtacatagcacattccaaggaatggaattgatttctaaattagattcaagaactcaagtgatggcgaacgacaagattacactagcatttgatatgaataagtgtcacttttttgatgaaaaaacaggaaatcgtatcgtc

SEQ ID NO: 2570 - protein, 365 aa, Staphylococcus aureus
  MISC_FEATURE (1)..(365): multiple sugar-binding
MAELKLEHIKKTYDNNNTVVKDFNLHITDKEFIVFVGPSGCGKSTTLRMVAGLESITSGDFYIDGERMNDVEPKNRDIAMVFQNYALYPHMTVFENMAFGLKLRKVNKKEIEQKVNEAAEILGLTEYLGRKPKALSGGQRQRVALGRAIVRDAKVFLMDEPLSNLDAKLRVQMRTEILKLHKRLNTTTIYVTHDQTEALTMASRIVVLKDGDIMQVGTPREIYDAPNCIFVAQFIGSPAMNMLNATVEMDGLKVGTHHFKLHNKKFEKLKAAGYLDKEIILGIRAEDIHEEPIFIQTSPETQFESEVVVSELLGSEIMVHSTFQGMELISKLDSRTQVMANDKITLAFDMNKCHFFDEKTGNRIV

SEQ ID NO: 2571 - DNA, 588 bp, Staphylococcus aureus
atggatgccactatgacaaagcgaccaaaacgtattttggcaacaattatcatttttctttcactattatttacgattatttatatagatgacattcaaaaatggtttaaccaatataccgataaattgacacaaaatcataaaggacaaggacactcaaaatgggaagacttttttagagggagtcggattactgagacttttggtaaatatcaacattcaccatttgatggtaagcattatggcattgattttgcattgccaaaaggtacaccaattaaagcgccgacgaatggtaaagtaacacgtatctttaataatgaattgggcggcaaggtattacagattgccgaagacaatggagaatatcaccagtggtatctacacttagacaaatataatgtcaaagtaggtgatcgagtcaaagcaggtgatattattgcatattcaggcaatacaggtatacaaacgacaggcgcacatttacattttcaaagaatgaagggtggcgtaggtaatgcatatgcagaagatccaaaaccgtttatcgatcagttacctgatggggaacgtagcctatatgatttg

SEQ ID NO: 2572 - protein, 196 aa, Staphylococcus aureus
  MISC_FEATURE (1)..(196): hypothetical protein
MDATMTKRPKRILATIIIFLSLLFTIIYIDDIQKWFNQYTDKLTQNHKGQGHSKWEDFFRGSRITETFGKYQHSPFDGKHYGIDFALPKGTPIKAPTNGKVTRIFNNELGGKVLQIAEDNGEYHQWYLHLDKYNVKVGDRVKAGDIIAYSGNTGIQTTGAHLHFQRMKGGVGNAYAEDPKPFIDQLPDGERSLYDL

SEQ ID NO: 2573 - DNA, 696 bp, Staphylococcus aureus
ttgatattaaattttatatcgagtataataattatacttaagaaaataacagaaacagaggagaattttcaaatggcaaaagtattatatattacagcacacccttttaatgaactggtatcaaattctatggcggctggtaaagcatttatcgaaacatatcaacaacaacatcctgatgatgaagtgaaacatattgatttatttgaaacttatattccagttattgacaaagatgtattaactggttggggaaaaatgagtaatggcgaaacgttaactgatgatgaacaaatgaaagtttcaagattgagtgacattttagaagaatttttaagtgcagataaatatgtatttgtaacgcctatgtggaacctttctttcccacctgtagttaaagcatatattgatgctatttcaattgcaggtaaaacttttaaatattctgctgaaggaccacaaggtttactaactgacaaaaaagtattacacattcaatcacgtggtggatattatactgaaggacctgctgctgattttgaaatgggtgaccgttatttaagaacaattatgacattcttaggtgtgccatcatatgaaacaatcattattgaaggacacaatgctgaacctcataagactgaagaaattaaagcaactagtattaataatgctgaaaaattagcaacaactttt

SEQ ID NO: 2574 - protein, 232 aa, Staphylococcus aureus
  MISC_FEATURE (1)..(232): NAD(P)H dehydrogenase
LILNFISSIIIILKKITETEENFQMAKVLYITAHPFNELVSNSMAAGKAFIETYQQQHPDDEVKHIDLFETYIPVIDKDVLTGWGKMSNGETLTDDEQMKVSRLSDILEEFLSADKYVFVTPMWNLSFPPVVKAYIDAISIAGKTFKYSAEGPQGLLTDKKVLHIQSRGGYYTEGPAADFEMGDRYLRTIMTFLGVPSYETIIIEGHNAEPHKTEEIKATSINNAEKLATTF

SEQ ID NO: 2575 - DNA, 807 bp, Staphylococcus aureus
gtgttaatgaagtattttgagaaacggtgggaatgtatgaaagcacataaaattttctggttaaacttagcagcaattattattatttcaattgtagtcagtggcgatatgtttttggcaatgaagtgggaacaaattcatttgaaagatggtcttaaaaaagtactaagtacgtatcctattaaaaacttagaaacgctttatgaaattgatggtcacgataatccccattatgaaaataatgatcaagacacatggtatatagaatcctcttattcagttgttggatcagatgagcttttaaaagaagaccgtatgttgttaaaggtagataagaacacacataaaataactggtgaatatgacacaactacaaacgatagaaaaaatgctactgactcgacatacaaaagttatccagtaaaagtagttaataataaaatcgttttcacaaaagacgtaaaagatcccgcgctgaaacaaaaaatcgaaaacaatcaatttttgattcaaagtggtgatttaacaagcattttaaatagcaatgatttgaaagtcacacatgatcctaccactgattattataatttatctggtaagttgtcgaacgataatccaaacgttaaacaattaaaacgtagatataatattcctaaaaacgcatcaacaaaggtggaattaaagggaatgagtgatttaaaaggcaataatcatcaagatcagaaactttatttttatttttcaagtcctggaaaagaccaaatcatttataaagaaagccttacttataataaaataagtgaacat

SEQ ID NO: 2576 - protein, 269 aa, Staphylococcus aureus
  MISC_FEATURE (1)..(269): hypothetical protein
VLMKYFEKRWECMKAHKIFWLNLAAIIIISIVVSGDMFLAMKWEQIHLKDGLKKVLSTYPIKNLETLYEIDGHDNPHYENNDQDTWYIESSYSVVGSDELLKEDRMLLKVDKNTHKITGEYDTTTNDRKNATDSTYKSYPVKVVNNKIVFTKDVKDPALKQKIENNQFLIQSGDLTSILNSNDLKVTHDPTTDYYNLSGKLSNDNPNVKQLKRRYNIPKNASTKVELKGMSDLKGNNHQDQKLYFYFSSPGKDQIIYKESLTYNKISEH

SEQ ID NO: 2577 - DNA, 2004 bp, Staphylococcus aureus
atggtcattaacttaaatgacaaacagacaaaaacatctaaagaagggttaatttccgtatcacatcctcttgcggctaaaattggtaaggatgtattagatcaaggtggcaacgccatggatgcagtgattgcaattcaactggcattgaatgtggtagaaccatttgcatcaggtattggtggtggcgggtatttgctatattatgagcaaagtactggcagtataactgcgtttgatgcacgtgagacagcacctgaacatgtagacaaacaattttatctagatgattcaggcgaatataaatcattttttgatatgactacacatggtaaaactgtcgctgtgccagcaattccaaagctgtttgattatattcacaagcgttatgctaaattgtcattggaagatttaattaatcctgcaattgaactagccattgaaggtcatgcagccaattgggctactgaaaaatattcgcgccagcaacacgcacgattgacaaagtatcatgaaacggcacaagtatttacgcatgaaaatcaatattggcgtgaaggtgattggattgtacaacccgaattaggtaagacatttcaaatattaagagaacaagggtttaatgcattttataaaggtgacattgcgaaacaattagtcaatgttgtcaaagcatgtggtgggacaatcactttagaggatctagccaaatatgacattcagattaaagcgccaatcagtgcaacatttaaagactatgacatttattcaatgggaccatctagttctggcggtatcacggtaattcaaatattgaagttattagaacatgtcgatttaccatctatgggtccaagatctgttgattacttgcatcatttgatacaagcgatgcatttagcatatagtgatcgtgcgcaatacttggcggatgataattttcatgaggtgcctgtacagtcattaattgatgatgattatttaaaagcacgcagtacgctcattgatagcaataaagcaaatattgatatagagcatggtgttgtgtctgattgcattagtcatacagatgttgaagaaaatcataccgaaacaactcatttttgtgtgattgataaggaaggtaatattgcttcatttacgacatcaattggtatgatttatggttcaggtatcacgattccaggctacggtgtgttattgaatacgacaatggatggctttgatgtagtagatggtggtattaacgaaattgcaccatataaacgaccactaagtaacatggctccaacgattgtgatgtatcacgggaagccaatattaacagtaggtgcacctggtgccataagtatcattgctagtgttgcgcaaacattaatcaatgtattagtgtttggcatggatattcagcaggctatagatgaacctagaatttatagtagccatcctaatcgcattgaatgggagcctcaattttcacaatctacaatattagcattgattgcacatggacatgcaatggaacataaaccagatgcttatattggagatgtacatggactacaggttgacccaacaacgtatgaagcttcgggtggaagtgatgatactagagaaggcaccgtaatgggtggcgaggtgttagtgattagaaaacagccattaccatatcggcaaatgtatgatagtgacggctttcgtctatatttcaatgatgtgcagttacctttattggcagatcaagtgcgatggatgcatgacaaatattgggttgatgaaagtgttgttagaatcattttccctgaagttagtgcacatattgaagatttaagaagttatgaaaacgcaggagaaaattatatagatattgcctggttagcacggaaatatgcttatcaagtaacattgaaggatgacggtttatacttaactgatgatacatatacttcagtgaaacggaacacaaatgcatactatagatatgatcgagatagtatcacaaga

SEQ ID NO: 2578 - protein, 668 aa, Staphylococcus aureus
  MISC_FEATURE (1)..(668): hypothetical protein
MVINLNDKQTKTSKEGLISVSHPLAAKIGKDVLDQGGNAMDAVIAIQLALNVVEPFASGIGGGGYLLYYEQSTGSITAFDARETAPEHVDKQFYLDDSGEYKSFFDMTTHGKTVAVPAIPKLFDYIHKRYAKLSLEDLINPAIELAIEGHAANWATEKYSRQQHARLTKYHETAQVFTHENQYWREGDWIVQPELGKTFQILREQGFNAFYKGDIAKQLVNVVKACGGTITLEDLAKYDIQIKAPISATFKDYDIYSMGPSSSGGITVIQILKLLEHVDLPSMGPRSVDYLHHLIQAMHLAYSDRAQYLADDNFHEVPVQSLIDDDYLKARSTLIDSNKANIDIEHGVVSDCISHTDVEENHTETTHFCVIDKEGNIASFTTSIGMIYGSGITIPGYGVLLNTTMDGFDVVDGGINEIAPYKRPLSNMAPTIVMYHGKPILTVGAPGAISIIASVAQTLINVLVFGMDIQQAIDEPRIYSSHPNRIEWEPQFSQSTILALIAHGHAMEHKPDAYIGDVHGLQVDPTTYEASGGSDDTREGTVMGGEVLVIRKQPLPYRQMYDSDGFRLYFNDVQLPLLADQVRWMHDKYWVDESVVRIIFPEVSAHIEDLRSYENAGENYIDIAWLARKYAYQVTLKDDGLYLTDDTYTSVKRNTNAYYRYDRDSITR

SEQ ID NO: 2579 - DNA, 1773 bp, Staphylococcus aureus
gtgaagaaaatcattagtatcgcaattatagttttagcgttggtattaagtggttgtggtgtccctacgaaatcagaagtggctcaaaagtcatcgaaagttgaagtgaaaggcgagcgaccaacaatacatttcctaggacaagcaagttatgaaaatgatatgaatatcgttaaagatcaattggaaaatgcaggatttaacgtgaagatgaatatccaaccagattatggtagctatcgtacacaacgtcaagccggcaattatgatatccaaattgatgactggatgacagtgtttggtgacccgaactatgctatgacggcattatttagttctacaggatcaaatagtttattgaaagataaacatgtagaccagttgttaaataaagcttctactcaaaatgaagcagatgttaaacaaacatataagcaaattgaagatgaagttgtatttgataaagggtatatggcgcctttatatggatcaaaaaagaatttagtatatgacaataaagtgttagataaaaatagtgttggattgccaaattcacgtgcattaatatggcaacaatttgattacaacaatagtagagaacgagatacgcggccacttgtgatgacacaacaagatggtgaaattcctacattggatccaatacgttcaattgcgccgtcagtatattcaattaatatgaatatgtacacaaggttattattattagatgaaaatgatcatttaacaacgaaaggttcgttaagtcatgattatgctgtgaataaggacaataaagcattttatttcttgttaagagatgatgattattttgcgaaagtggtcaatggacaagcacgtaatactggagagcgtgtatcggctgaagatgttaagttttctttagatagagcacgtgataaaaagtctgtgcctaacaataatacttacaatatgcacaaacatataaatgacatcaagatattaaaagatgaggacatcgatcagttgcgtaaagagaaagacaaggacgataaatcaatctatgataagttgattaaagcttataacgtcaaatcgttaacgacagatggtcaaaaagtaaataataaagacggtatttatcaaattgttaaaattacgacagatcaatcgatgcctcgagaggtaaattacttaacacactcttcggcaggcattttatctaaaaaatttgttaatcaagtaaatcaagaatatccaaaaggatatggggatagcagtacaattcctgcaaattcagatgggaaaaatgcgctgtatgcaagtggcgcatacattatgacacagaaaaatgcatatcaagcaacgtttcaacgtaatccaggattcaacgaaacagaaaaaggtagttatggaccagctaaaattaaaaatattacattgaagtttaatggtgacccgaataatgcattgtcagaacttagaaatcattcaattgatatgttggcagatgtgaatcaaaaacattttgatttaattaagtcggataaaaatttaagcattattcgcaaaaatggacgcaagtcagtctttttaatgctaaatattaaaaaaggtatatttaagacgcatccaaacttgagacaagcagtagttaatgcgatagatcaggatcaatttattaagttttatcgtggcgataaatttaaaattgcatcaccgattacaccacttgtcgatactggtaacgagcaacgtcaagatttagaaaaagtagaaaaagccattaatcaa

SEQ ID NO: 2580 - protein, 591 aa, Staphylococcus aureus
  MISC_FEATURE (1)..(591): RGD-containing lipoprotein
VKKIISIAIIVLALVLSGCGVPTKSEVAQKSSKVEVKGERPTIHFLGQASYENDMNIVKDQLENAGFNVKMNIQPDYGSYRTQRQAGNYDIQIDDWMTVFGDPNYAMTALFSSTGSNSLLKDKHVDQLLNKASTQNEADVKQTYKQIEDEVVFDKGYMAPLYGSKKNLVYDNKVLDKNSVGLPNSRALIWQQFDYNNSRERDTRPLVMTQQDGEIPTLDPIRSIAPSVYSINMNMYTRLLLLDENDHLTTKGSLSHDYAVNKDNKAFYFLLRDDDYFAKVVNGQARNTGERVSAEDVKFSLDRARDKKSVPNNNTYNMHKHINDIKILKDEDIDQLRKEKDKDDKSIYDKLIKAYNVKSLTTDGQKVNNKDGIYQIVKITTDQSMPREVNYLTHSSAGILSKKFVNQVNQEYPKGYGDSSTIPANSDGKNALYASGAYIMTQKNAYQATFQRNPGFNETEKGSYGPAKIKNITLKFNGDPNNALSELRNHSIDMLADVNQKHFDLIKSDKNLSIIRKNGRKSVFLMLNIKKGIFKTHPNLRQAVVNAIDQDQFIKFYRGDKFKIASPITPLVDTGNEQRQDLEKVEKAINQ

SEQ ID NO: 2581 - DNA, 1170 bp, Staphylococcus aureus
gtgaggcatatggcacaacttaattcaaagatagcttccttaaaattattcgcaagttacgccatagcaacttatattttagttatattaacgagtgcattaaatctttttaaaggttatgtggccgatacgttctatattgctgaaacattgctaatcgttttaaccatcattttaattattattttaacaacggaacaaacatggaagcatcatgacctatggcgacgtatcgtcgaagtgttgttattgttgatgacattaacaggcaacgtatttacattattaatgtttgtaagtattagacgttaccaacgtacatcgcaaatacatagttataacgggtgggaatcgtttatacgaaaaactactagacatcgtattgcgattatcgggttacttattttagtctacatgctgacattatcaattgtgtcacaatttacatttgatacgacattggctactaaaaatcagttcaatgcactgttacatggaccgagtctagcctatccgtttggtactgatgatttcggtagagacttatttacacgcgtagttgtaggaacgaagctgacattttcaatttcaattatttcagtagttattgcagttatttttggtgtgttactaggcactatcgcaggttattttaatcatattgataatttaataatgcgaattttagatgtagtgtttgcaattccatcattattgttagcggtggcaattattgcatcatttggagcaagtattccaaatttaattattgctttaagtatcggtaatataccatcatttgcacggacaatgcgtgccagtgttttagaaattaaacgcatggaatatgtagatgcagcacgtatcactggtgaaaacacttggaatatcatatggcgttatattttaccgaatgcgattgcgcctatgattgtacgtttttcattaaatataggtgtggttgtattaacaacaagtagtttaagtttcctaggacttggtgttgcacctgatgtagctgaatggggcaacattttacgtaccggtagtaactacttggaaacgcacagtaatttagctattgtacctggtgtttgtattatgttcgtcgttttagcatttaattttataggtgatgcagtgcgtgatgcactagatccaagaattcat

SEQ ID NO: 2582 - protein, 390 aa, Staphylococcus aureus
  MISC_FEATURE (1)..(390): hypothetical protein
VRHMAQLNSKIASLKLFASYAIATYILVILTSALNLFKGYVADTFYIAETLLIVLTIILIIILTTEQTWKHHDLWRRIVEVLLLLMTLTGNVFTLLMFVSIRRYQRTSQIHSYNGWESFIRKTTRHRIAIIGLLILVYMLTLSIVSQFTFDTTLATKNQFNALLHGPSLAYPFGTDDFGRDLFTRVVVGTKLTFSISIISVVIAVIFGVLLGTIAGYFNHIDNLIMRILDVVFAIPSLLLAVAIIASFGASIPNLIIALSIGNIPSFARTMRASVLEIKRMEYVDAARITGENTWNIIWRYILPNAIAPMIVRFSLNIGVVVLTTSSLSFLGLGVAPDVAEWGNILRTGSNYLETHSNLAIVPGVCIMFVVLAFNFIGDAVRDALDPRIH

SEQ ID NO: 2583 - DNA, 1476 bp, Staphylococcus aureus
ttgaattgtacattcagactgttgacttctaataaatttgacatgatgttgtgcctccctattcacaaatgtgtaaatttattctatacttttgtatatcatagtaatctactcaagattattttacaaggagtgattatcataattacttatttagaatcttttaagtcgttgtatcacaaggcattttacaagtttgtattatcggtattaagcttgccaatatttttatatgcagtgataaagtttttcttttctgctaagaggaaaaatttttacgctaataattctgaaatttcagaaattgaacaggcgttacatcaaaaatataaatatttatcgcagcaaaagtcatccacacaaatacataaagaagcattaaaaatattcaaggcacaaagttctaatacgagttcaaagaatattgaacaagcacatttttcaacatactttgaaaatgtattatttcataagttcatcatgatcaaagtgatattggccttgccgatgttcatcttattgactttttatttacagccattagttagatatatttttgaacgaattgtcatggctgtgattgtcatcattggtgttattgtcagtgtgtttaccattctgtatttttcaccgcttgatgcggcttatagcatactgggacaaaatgcaacaaaggcacagatacatcaattcaatgtattacatcatcttaacgaaccttattttattcaattgtgggataccatcaagggtgtttttacctttgacttaggtacgacttacaaagggaatgaggttgtgactaaagcagttggcgaaagaattccaattacaataattgtcgcagtattagcgctaatggtggcattaattattgcaataccaattggtattatcagtgcgatgaagcgaaatagttggcttgatatcacgttaatgataattgcattaattggtttatctattccaagtttctggcaagggctattattcattttagcgttctcattgaaattggatattttgccaccatcttatatgccagaacatccaatatcgttgattttacctgtacttgtcattggaacaagtattgctgcttctatcacgcgtatgacaaggtcttctgtacttgaagtaatgcgcagcgattatgttttaactgcttatgcaaaaggattatcgacgacacaagttgttattaaacatattttgaaaaatgccattattccaattgtaacgttagttggtcttctagtggcagagttactaggcggttcagcagtgacggaacaagtatttaacattaatggtatcgggcgttatatcgtccaaaaacaactaatacctgatattccagcagtcatgggtggggtcgtatatatatcaattgtaatatctttagcaaacttaattattgatatattttatgctttaatcgatccaaaattacgtagtgaaatcaacgaaaggaag

SEQ ID NO: 2584 - protein, 492 aa, Staphylococcus aureus
  MISC_FEATURE (1)..(492): truncated hypothetical
LNCTFRLLTSNKFDMMLCLPIHKCVNLFYTFVYHSNLLKIILQGVIIIITYLESFKSLYHKAFYKFVLSVLSLPIFLYAVIKFFFSAKRKNFYANNSEISEIEQALHQKYKYLSQQKSSTQIHKEALKIFKAQSSNTSSKNIEQAHFSTYFENVLFHKFIMIKVILALPMFILLTFYLQPLVRYIFERIVMAVIVIIGVIVSVFTILYFSPLDAAYSILGQNATKAQIHQFNVLHHLNEPYFIQLWDTIKGVFTFDLGTTYKGNEVVTKAVGERIPITIIVAVLALMVALIIAIPIGIISAMKRNSWLDITLMIIALIGLSIPSFWQGLLFILAFSLKLDILPPSYMPEHPISLILPVLVIGTSIAASITRMTRSSVLEVMRSDYVLTAYAKGLSTTQVVIKHILKNAIIPIVTLVGLLVAELLGGSAVTEQVFNINGIGRYIVQKQLIPDIPAVMGGVVYISIVISLANLIIDIFYALIDPKLRSEINERK

SEQ ID NO: 2585 - DNA, 90 bp, Staphylococcus aureus
atgaagattattgaaagaagggataacagtgacagaacaatttactatgattattttattaattgcgcttggttactttttgaagcgcat

SEQ ID NO: 2586 - protein, 30 aa, Staphylococcus aureus
MKIIERRDNSDRTIYYDYFINCAWLLFEAH

SEQ ID NO: 2587 - DNA, 162 bp, Staphylococcus aureus
atgtctttagaaaaccaactagccgaacttaaatatgattatgttcgtcttcaaggtgacatagaaaaacgggaatctttgaatttagatacttccgcacttgttcgtcaacttaaagatattgaaaatgaaattagaaacgttcgtgctcaaatgcaagat

SEQ ID NO: 2588 - protein, 54 aa, Staphylococcus aureus
  MISC_FEATURE (1)..(54): conserved hypothetical
MSLENQLAELKYDYVRLQGDIEKRESLNLDTSALVRQLKDIENEIRNVRAQMQD

SEQ ID NO: 2589 - DNA, 1590 bp, Staphylococcus aureus
atgtcaaatttattagaagtcaacagtctgaatgtacaattcaattatgatgaaactacagttcaagcggtaaaaaacgtctctttcgaattacgaaaaaaacatatcctaggtattgttggtgaatcaggatcaggaaaaagtattaccgctaaatctattttagggctactaccagattatccagatcacacattaacaggagaaattatttttaatgggcaatcgttaaataatttatcaacttcagcgttacaacaaattcgaggtaaggatatttcaatgatttttcaagatccactctcttcgttgaatccaagattaacgattggcaaacaaattacagaagtaatatttcaacataaacgtgtatctaaatctgaagcaaagtcgatgacaatagacattttagaaaaagtaggtataaaacatgcaactcgacaatttgatgcttatccacatgaactttctggtggtatgcgtcaacgtgtcatgatagcaatggcattgattttaaagccacaaattttaatcgcagatgaaccaacaacggcattagatgccagtacacaaaatcaattactgcagttaatgaagtccctttatgagtacacagaaacatctattatttttatcactcacgatttaggcgctgtgtatcaattttgcgacgatgtgattgtaatgaaagatggaagtgtcgttgaaagtggcacggttgaaagtatttttaaatcgccacaacatacctatacaaaacgcttaatagatgcgattcctgatattcatcaaacgcgtccgccaagaccgttaaacaatgatattttattaaaattcgatcgcgtgagcgtggattacacatcaccgagtggcagcctataccgagcagttaatgatattaacttggctattagaaaaggcgaaacattaggcattgtcggtgaatcagggtcagggaaatcgacattagctaagacggtcgtcggtctaaaggaagtgtcagaaggctttatttggtataacgaattaccattaagtttatttaaagatgatgaattgaaatctttacgacaagagatacaaatgatttttcaagatccattcgcatctattaatccaagatttaaagtcattgatgtgattaaacgaccactaatcattcatgggaaagtcaaagataatgatgacattattaaaactgtcgtatcgttgttagaaaaggttggcctagatcaaactttcttatatcgctatccacacgaattatctggtgggcaacgtcagcgtgtaagtatcgcgagagcacttgctgttgaacctaaagtgattgtttgcgacgaggcagtgtccgctttagacgtttcaattcaaaaagatatcatcgagttattaaaacaattacagttagacttcggcatcacttatttattcatcacacatgacatgggtgttatcaatgaaatatgtgatcgcgttgcagttatgaaaaatggcgaaatcgttgaactgaataacacagaagatattatcaaacatccgcagtcagactatgcaaagcaacttatttcagaagtagcagttattgctaaa

SEQ ID NO: 2590 - protein, 530 aa, Staphylococcus aureus
  MISC_FEATURE (1)..(530): oligopeptide transport
MSNLLEVNSLNVQFNYDETTVQAVKNVSFELRKKHILGIVGESGSGKSITAKSILGLLPDYPDHTLTGEIIFNGQSLNNLSTSALQQIRGKDISMIFQDPLSSLNPRLTIGKQITEVIFQHKRVSKSEAKSMTIDILEKVGIKHATRQFDAYPHELSGGMRQRVMIAMALILKPQILIADEPTTALDASTQNQLLQLMKSLYEYTETSIIFITHDLGAVYQFCDDVIVMKDGSVVESGTVESIFKSPQHTYTKRLIDAIPDIHQTRPPRPLNNDILLKFDRVSVDYTSPSGSLYRAVNDINLAIRKGETLGIVGESGSGKSTLAKTVVGLKEVSEGFIWYNELPLSLFKDDELKSLRQEIQMIFQDPFASINPRFKVIDVIKRPLIIHGKVKDNDDIIKTVVSLLEKVGLDQTFLYRYPHELSGGQRQRVSIARALAVEPKVIVCDEAVSALDVSIQKDIIELLKQLQLDFGITYLFITHDMGVINEICDRVAVMKNGEIVELNNTEDIIKHPQSDYAKQLISEVAVIAK

SEQ ID NO: 2591 - DNA, 1110 bp, Staphylococcus aureus
atgaaaatatgtgaaaaatgttttaataatactgaaatcgtagaaatcattgcaaatgataatagcaaatttgacaattgtgatattgataacaatcatcttggtgttaaaatatttgatacgactaaggacatagataaattagaacttattagagattatttaagaccagcattagaattatatgatattagtataaatttaccagatacttttagcccaaaagaaggtaaaaagattgaaatagcattaaaagacgactggagtatatttaatgttgaggaagctcaaataagttgtattttaaatgaactttttaaagatgatgaaaatttagatagacgagtgttggaagatttagtaggcgctaaaatcataaacgataaaaaatatacaaataaaaatctaattgtagcaaataatgactgggatggattttgtgagagcttgaagtataaaaatagatttcataaaaatatgatcaatttagagaatttagcgttctttctcgatatcactactaattactatagtattgaggaatttagagaaagatttgaaccattatatagatctagaatagttaagttcattacagagaaaagtgaactaatgtcaccaccaaagggatttgcaacggcaggaagattgaattctaaatggataagcgtattataccttagtacaaaagaacaggtcagtatagaagaagttaaacctaagcataatgacattatttatataggtaaggttaagttacaaaaaaacgtgacaaaagagaaattgaaaattgcgaatttaactaatttaactagtaatgcaatcaaagctggcgatgatggatttagaaagtattttgtaaattaccaaacattaaaaaagattcataaaggaataacaaatccaagcgatgaacaaggaatagattatttgccatttcaatatttagctgattatattcgaagccttaaatatgacgggataatgtatgagagcatattacaagatggtacttttaactttgtgttttttgatcaaagtttatttgaatgtgttaattatgaaagaaaaagagtaagtgacgttaaatatacattgactaagctaagt

SEQ ID NO: 2592 - protein, 370 aa, Staphylococcus aureus
MKICEKCFNNTEIVEIIANDNSKFDNCDIDNNHLGVKIFDTTKDIDKLELIRDYLRPALELYDISINLPDTFSPKEGKKIEIALKDDWSIFNVEEAQISCILNELFKDDENLDRRVLEDLVGAKIINDKKYTNKNLIVANNDWDGFCESLKYKNRFHKNMINLENLAFFLDITTNYYSIEEFRERFEPLYRSRIVKFITEKSELMSPPKGFATAGRLNSKWISVLYLSTKEQVSIEEVKPKHNDIIYIGKVKLQKNVTKEKLKIANLTNLTSNAIKAGDDGFRKYFVNYQTLKKIHKGITNPSDEQGIDYLPFQYLADYIRSLKYDGIMYESILQDGTFNFVFFDQSLFECVNYERKRVSDVKYTLTKLS

SEQ ID NO: 2593 - DNA, 921 bp, Staphylococcus aureus
atgtattatccttatttgcgtgggaaacaaaatgaactatttgcaattagagaattgttagagaaaggtttgattggtgattgtattcaacctataattgaaccaattaaatatacaaccacatttaaaaatactttgcaatactgtggtgaaaaagcattctctataaatttagtagtaaattcaaagttaactgaagaagagattagtaacgaaactgttgcacatttaactgaaataataacaaaaaacaaaagtgttattcaaaaagcttacttgggtccttctgatgaaggcaatgataggttgaaacagcaattttcaagtaatagtttagctattttaacaagtgtagatgattgggaaatgtttggagataaaaataaacttgaaatggtttttgtaccagatgatagacacattaaacgtaaattgcgtaatattccaaacaaaggcatcattatggatccttttaataaactaagtcgtaatgttgattatttagataatgatgacgagttttatagcgacgatcacctttattataaggaagatggatacgtagcattttcagactattctgttataggtggagaatatgtagacggtggcttttcgccattagctattgcgatacatattgtctattttgatgaggctaatgagctaagagttaagcattttgtctctgattctaataatgatagatcaaatccaggtaaaaagttttttgaggctgtagataaattagtaacatggtcaaaaaacttagatattaaaaatagatcttatgcgcttggacaatttgaagaattaaatgaaaataataagtatccaggattaggtttaattaaaaggttatctatcatgcatcacctagaaattatgaatagatacttggagtctcaaaatgaaaatatg

SEQ ID NO: 2594 - protein, 307 aa, Staphylococcus aureus
MYYPYLRGKQNELFAIRELLEKGLIGDCIQPIIEPIKYTTTFKNTLQYCGEKAFSINLVVNSKLTEEEISNETVAHLTEIITKNKSVIQKAYLGPSDEGNDRLKQQFSSNSLAILTSVDDWEMFGDKNKLEMVFVPDDRHIKRKLRNIPNKGIIMDPFNKLSRNVDYLDNDDEFYSDDHLYYKEDGYVAFSDYSVIGGEYVDGGFSPLAIAIHIVYFDEANELRVKHFVSDSNNDRSNPGKKFFEAVDKLVTWSKNLDIKNRSYALGQFEELNENNKYPGLGLIKRLSIMHHLEIMNRYLESQNENM

SEQ ID NO: 2595 - DNA, 825 bp, Staphylococcus aureus
atgattaatcgtgtttttagtcaaaagatattacatcaaattgcaatcaaaaataaaagtgatgttgttgatgaggcatatgatttttatatacagggacctaaaaatatcaatgtaatacagaagatgaaatctttatataactatcttaaaaagtcttatcgtaacgaatatttttacaaaaacacaatacttaataaactccttctaggacgacattctattaatacaactactgcactttctgagatgcccatagggaaaagtattgctgattttatattgttaaacggcaaaggcgttgtctatgagattaaaacagaattagataagctggatagattagataatcaaattaatgattattatgaagtgtttaattatgtcgtagttattacaaatgacaaacatctgaataaagttatggctagatacaaagatacaacagttggaattttagtgttaacaactagaaatacactgagtgaagttcaaaaacctaaagaaaacaatagtctcttaaacacaaaagcgatgtacaactttttacgaaaagaagaaagaaaaagagttattgcacaaaatcatatggatgtgccaacttataatgatttcacagagtatgatgtgttatttgacgtgtttaaagaaataccaatgacgaaactgcataacaatatgatttctgagttgaaaaaaagaggaaacatgaaagaatacaaagatgaatttttagcagcgccggctgaaattaagttcttgttatatttcgcaaaaatgacaaagaaagataaaaataaactatatcattttcttaaggaggat

SEQ ID NO: 2596 - protein, 275 aa, Staphylococcus aureus
MINRVFSQKILHQIAIKNKSDVVDEAYDFYIQGPKNINVIQKMKSLYNYLKKSYRNEYFYKNTILNKLLLGRHSINTTTALSEMPIGKSIADFILLNGKGVVYEIKTELDKLDRLDNQINDYYEVFNYVVVITNDKHLNKVMARYKDTTVGILVLTTRNTLSEVQKPKENNSLLNTKAMYNFLRKEERKRVIAQNHMDVPTYNDFTEYDVLFDVFKEIPMTKLHNNMISELKKRGNMKEYKDEFLAAPAEIKFLLYFAKMTKKDKNKLYHFLKED

SEQ ID NO: 2597 - DNA, 2787 bp, Staphylococcus aureus
atggcataccaaagtgaatacgcattagaaaatgaaatgatgaatcaacttgaacaattgggttacgaaagagtaacgatacgtgataataagcaattgcttgataattttagaacgattttaaatgagcgtcatgcggacaaattagaaggcaatcccttaacagataaagaatttcaacgtctgttaacgatgattgatggaaaaagtattttcgagagtgcccgtattttacgtgataaattaccacttagacgtgatgatgagtctgagatttatttgtcgtttttagatacgaaaagttggtgtaaaaataagtttcaagtgacgaatcaagtatctgtcgaggatacatataaagcacgttatgatgtaacgatattaatcaacggactaccccttgtccaagttgaattgaaacgtcgaggtattgatattaatgaggcgtttaaccaagtaaaacgttaccgcaaacaaaattacacaggcttattccgctacatacaaatgtttatcattagtaatggtgttgaaacgcgatacttttctaataatgatagcgaactattgaagagtcacatgttttattggagtgataaacagaataaccgtatcaatacattgcaatcgtttgctgagtcatttatgagaccttgtcaattagctaagatgatatcgcgctatatgattattaatgaaacagatagaatactgatggcaatgcgtccgtatcaagtgtatgcggtagaagcacttattcaacaagcgactgagacagggaataatggatatgtatggcatacaactggaagtggtaagacgttgacttcttttaaagcgagtcagattttatcacagcaagatgacattaagaaagttatctttttggttgaccgtaaagacttggatagtcaaacagaagaggaatttaataaatttgctaagggtgctgtagacaaaacttttaatacctcgcaactggtacgccaactaaatgataaaagtttgccacttattgtaacgacgattcaaaaaatggctaaagcgattcaagggaatgcccctttattagaacagtataaaacgaataaagttgtatttattattgatgagtgtcatcgcagtcaatttggtgacatgcatcgtctagttaaacaacatttcaaaaatgcccaatactttggattcactggtacgccacgttttccagaaaatagtagtcaagatggtagaacaactgcagatattttcggtagatgcttacatacgtatttaattagagatgccattcatgatggtaatgtacttggtttctcagttgactatattaatacttttaaaaataaagctttaaaagcagaagataacagcatggttgaagcaattgatacggaagaagtatggttagcggataaacgtgtggaattagtaacacgacatatcatcaataatcatgataaatatacacgtaatcgtcaatattcaagtatatttacagtccaaagtattcacgcgcttattaaatattatgagacatttaagcgacttaacaaaaagttggaacaaccgttaacgatagctggtatatttacgtttaaacctaatgaagatgatcgtgatggtgaagtgccatatcattcacgtgaaaaattagagataatgattagtgattataataaaaagttcgagacgaatttttcaacagacacaactaatgagtattttaatcatatttcaaaaaacgttaaaaagggcgttaaagatagtaaaattgatatcttaatcgttgttaatatgttcttaactggttttgatagtaaagtactgaacactttatatgttgataagaatttaatgtatcatgatttaattcaagcgtattcacgtacaaatagggttgaaaaagaatcaaagccatttggtaaaattgtaaactatcgtgacttgaaaaaagagacagacgatgcactgagagtattctcacaaacaaatgatacggatacaattttaatgcgcagttatgaagagtataaaaaagaatttatggacgcttatcgtgagcttaaaatgattgtgccgacaccacacatggttgatgacattcaagatgaagaagagctaaagcgctttgttgaagcttatcgtttattagctaaaataatattacgtttaaaagcatttgacgagtttgagtttacaattgatgaaattggaatggatgaacaagagaatgaagactataaaagtaaatatttagctgtgtacgatcaagtaaaaagagcgacggctgagaaaaataaagtatccattttaaatgatattgatttcgaaatagaaatgatgcgtaatgatacgattaatgtgaattatattatgaatatattgagacaaattgatcttgaagacaaagcggaacaacgtcgtaaccaagaacaaattagacgcattttagatcatgcagatgatccgacattgaggttaaaacgagatctaattagagaattcatcgacaatgttgtaccttctttaaataaggatgatgatatcgatcaagaatatgttaatttcgaaagtattaaaaaagaagcggagttcaaaggatttgctggagagagatctatcgatgaacaagccctaaaaacaatttcaaatgactaccagtatagtggtgttgtaaacccacatcaccttaaaaaaatgattggtgatttgccattgaaagaaaagcgtaaagcaagaaaagccattgaatctttcgtggcagaaacaactgaaaaatacggtgtg

SEQ ID NO: 2598 - protein, 929 aa, Staphylococcus aureus
  MISC_FEATURE (1)..(929): probable type I restriction
MAYQSEYALENEMMNQLEQLGYERVTIRDNKQLLDNFRTILNERHADKLEGNPLTDKEFQRLLTMIDGKSIFESARILRDKLPLRRDDESEIYLSFLDTKSWCKNKFQVTNQVSVEDTYKARYDVTILINGLPLVQVELKRRGIDINEAFNQVKRYRKQNYTGLFRYIQMFIISNGVETRYFSNNDSELLKSHMFYWSDKQNNRINTLQSFAESFMRPCQLAKMISRYMIINETDRILMAMRPYQVYAVEALIQQATETGNNGYVWHTTGSGKTLTSFKASQILSQQDDIKKVIFLVDRKDLDSQTEEEFNKFAKGAVDKTFNTSQLVRQLNDKSLPLIVTTIQKMAKAIQGNAPLLEQYKTNKVVFIIDECHRSQFGDMHRLVKQHFKNAQYFGFTGTPRFPENSSQDGRTTADIFGRCLHTYLIRDAIHDGNVLGFSVDYINTFKNKALKAEDNSMVEAIDTEEVWLADKRVELVTRHIINNHDKYTRNRQYSSIFTVQSIHALIKYYETFKRLNKKLEQPLTIAGIFTFKPNEDDRDGEVPYHSREKLEIMISDYNKKFETNFSTDTTNEYFNHISKNVKKGVKDSKIDILIVVNMFLTGFDSKVLNTLYVDKNLMYHDLIQAYSRTNRVEKESKPFGKIVNYRDLKKETDDALRVFSQTNDTDTILMRSYEEYKKEFMDAYRELKMIVPTPHMVDDIQDEEELKRFVEAYRLLAKIILRLKAFDEFEFTIDEIGMDEQENEDYKSKYLAVYDQVKRATAEKNKVSILNDIDFEIEMMRNDTINVNYIMNILRQIDLEDKAEQRRNQEQIRRILDHADDPTLRLKRDLIREFIDNVVPSLNKDDDIDQEYVNFESIKKEAEFKGFAGERSIDEQALKTISNDYQYSGVVNPHHLKKMIGDLPLKEKRKARKAIESFVAETTEKYGV

SEQ ID NO: 2599 - DNA, 876 bp, Staphylococcus aureus
atgatgacaaatattttatatcgcattgataagcagttgagtgattttacgaagacagaaaagataatcgctgattacattttaaagaatccacataaaatcattgatatgactgtgaatgatttggcagatgttacgaatgttagtacagcatcaattgttagatttagtcggaaaatgacacatcaaggttttcaagagctaaagattgcgatatctcgatacttacccgaagatattgcaaccaatccacatttagaattgattgaaaatgaatctgtagaaactttgaaaaataaaatgattgctagagcaacgaatacgatgcgatttgtagctactaatattatggatgcgcaaattgatgcaatttgtgatgtgttgaaaaatgccaggacaatatttttatttggatttggcgcatcgagtttgactattggtgatctttttcaaaagttatctcgtattggcttaaatgtcaggttattacatgaaacgcatttacttgtgtcaacatttgcgacgcatgatgatagagattgcatgatttttgtgacgaatcaaggtagtcatagtgaattgcagtcaattgcacaggtggccacacattacagtattcccatcataactatatctagtacagctaataatccagtggctcaaattgcagactatgcattgatttatggcagaactgatgaaaatgaaatgcgtatggcggctacaacgtcactatttgcacagttattcacggtagatatattgtactatcgatttgtagcattaaattatcatgcgattctagattgtataacccaatcgaaaatggcacttgataattacaggaagcatcttgcgacgatagattttaaacat

SEQ ID NO: 2600 - protein, 292 aa, Staphylococcus aureus
  MISC_FEATURE (1)..(292): hypothetical protein
MMTNILYRIDKQLSDFTKTEKIIADYILKNPHKIIDMTVNDLADVTNVSTASIVRFSRKMTHQGFQELKIAISRYLPEDIATNPHLELIENESVETLKNKMIARATNTMRFVATNIMDAQIDAICDVLKNARTIFLFGFGASSLTIGDLFQKLSRIGLNVRLLHETHLLVSTFATHDDRDCMIFVTNQGSHSELQSIAQVATHYSIPIITISSTANNPVAQIADYALIYGRTDENEMRMAATTSLFAQLFTVDILYYRFVALNYHAILDCITQSKMALDNYRKHLATIDFKH

SEQ ID NO: 2601 - DNA, 363 bp, Staphylococcus aureus
atgtacaaacgaatccaccagcatacgcagcaagtaatcctgcaatataacctaaatacatattatctgagattaatggtaatagtgacacaccacttgggcctattgctttggcaccaatatgtccaattccacctattacagcgccaccaataccaccaccaatacaagcagttaagaaaggtcgacctaatggcaaagtcacaccatagattaatggttctccgatacctaggaaaccaactggcaatgcaccttttaaagtattacgtaatgttgtgttgcgtttacatcttacccaaagtgctaatgcggcacctacttgtccagcaccagccatcgctgcaattggcaataagtaag

SEQ ID NO: 2602 - protein, 121 aa, Staphylococcus aureus
MYKRIHQHTQQVILQYNLNTYYLRLMVIVTHHLGLLLWHQYVQFHLLQRHQYHHQYKQLRKVDLMAKSHHRLMVLRYLGNQLAMHLLKYYVMLCCVYILPKVLMRHLLVQHQPSLQLAISK

SEQ ID NO: 2603 - DNA, 1452 bp, Staphylococcus aureus
atgaccaaagaacaacaacttgcagaacgaattattgctgcagtaggtggtatggataatatagatagtgtcatgaactgtatgacacgtgtgcgtattaaagtattagatgagaataaagtagatgaccaagaactaaggcatattgatggtgtcatgggtgttatacacgatgaacgcattcaagttgtggttggacctggtacagtcaataaagtggctaatcatatggcggaattaagtggtgttaaactaggtgacccaataccacaccatcacaatgatagtgaaaaaatggactataaatcatatgcagctgataaagcaaaggcgaataaggaagcgcataaagcaaaacaaaagaatggtaagttgaataaagtattgaaatcaattgccaatatctttataccgttgattcctgcatttattggagctggattaattggtggtattgcagcagtactgagtaacttaatggtggcaggctatatttcaggtgcttggattacgcaacttataacagtatttaatgtcattaaagacggtatgttagcatacttagctattttcactggtattaatgcggctaaagaatttggtgcgacaccaggacttggtggcgtgattggtggtacaacgttattaacgggtattgctggtaaaaatattttaatgaatgtcttcactggagaaccattgcaacctggacaaggtgggattattggcgttatttttgccgtttggattttaagtattgtcgaaaagagattacataaaattgtgccaaatgcgattgatattattgtaacgccgactattgcattgttgattgtaggactattaactatctttatctttatgccattagcaggttttgtttcagacagtttagtttcagtagttaacggaattattagtattggtggcgtatttagtggatttatcattggtgcaagcttcctaccgttagttatgttagggcttcatcatatttttacgccaattcatatagaaatgattaaccaatcaggtgctacttacttattgccaattgcagcgatggctggtgctggacaagtaggtgccgcattagcactttgggtaagatgtaaacgcaacacaacattacgtaatactttaaaaggtgcattgccagttggtttcctaggtatcggagaaccattaatctatggtgtgactttgccattaggtcgacctttcttaactgcttgtattggtggtggtattggtggcgctgtaataggtggaattggacatattggtgccaaagcaataggcccaagtggtgtgtcactattaccattaatctcagataatatgtatttaggttatattgcaggattacttgctgcgtatgctggtggattcgtttgtacatatttatttggaacgacaaaggcgatgcgacagacagatttgttgggtgat

SEQ ID NO: 2604 - protein, 484 aa, Staphylococcus aureus
  MISC_FEATURE (1)..(484): hypothetical protein
MTKEQQLAERIIAAVGGMDNIDSVMNCMTRVRIKVLDENKVDDQELRHIDGVMGVIHDERIQVVVGPGTVNKVANHMAELSGVKLGDPIPHHHNDSEKMDYKSYAADKAKANKEAHKAKQKNGKLNKVLKSIANIFIPLIPAFIGAGLIGGIAAVLSNLMVAGYISGAWITQLITVFNVIKDGMLAYLAIFTGINAAKEFGATPGLGGVIGGTTLLTGIAGKNILMNVFTGEPLQPGQGGIIGVIFAVWILSIVEKRLHKIVPNAIDIIVTPTIALLIVGLLTIFIFMPLAGFVSDSLVSVVNGIISIGGVFSGFIIGASFLPLVMLGLHHIFTPIHIEMINQSGATYLLPIAAMAGAGQVGAALALWVRCKRNTTLRNTLKGALPVGFLGIGEPLIYGVTLPLGRPFLTACIGGGIGGAVIGGIGHIGAKAIGPSGVSLLPLISDNMYLGYIAGLLAAYAGGFVCTYLFGTTKAMRQTDLLGD

SEQ ID NO: 2605 - DNA, 897 bp, Staphylococcus aureus
gtgatggaaaatagtacgaccgaagcgcgtaatgaagcgacgatgcatcttgatgaaatgactgtggaagaggctttaattacgatgaataaagaagatcagcaagtcccgttagcagttcgaaaggcaataccacaattgacaaaagtaattaaaaaaacaattgcacagtataaaaagggtggacgattgatttatatcggtgcaggtacaagtggaaggttgggtgtcttagatgcagcggagtgtgtacctacattcaatactgaccctcatgaaattataggtattattgctggtggacaacatgctatgacgatggctgtagaaggtgcggaagatcacaaaaaattagcggaagaagatttgaaaaatatagatttaacatcaaaagatgtcgttataggaattgccgcgagtggcaaaacgccatatgttataggcggtttaacatttgctaacacaatcggtgctacaacagtatctatttcatgcaatgaacatgcagttataagtgaaattgcgcagtatccagtagaagttaaagttggtccagaagtattaactggttcaacacgtttaaagtctggtacagcacaaaagttaattttaaatatgatttcaaccatcacaatggttggtgtcggaaaagtttacgataacctcatgattgatgttaaagcaaccaatcaaaaactgatcgaccgttcagtgcgtattattcaagaaatatgtgctatcacatatgatgaagcaatggcgttatatcaggtatctgagcatgatgtgaaagttgcgacagttatgggtatgtgtggcatttctaaggaagaagcaacaagacggttattaaacaatggtgacattgttaaacgagcaatcagagatagacaacct

SEQ ID NO: 2606 - protein, 299 aa, Staphylococcus aureus
  MISC_FEATURE (1)..(299): conserved hypothetical
VMENSTTEARNEATMHLDEMTVEEALITMNKEDQQVPLAVRKAIPQLTKVIKKTIAQYKKGGRLIYIGAGTSGRLGVLDAAECVPTFNTDPHEIIGIIAGGQHAMTMAVEGAEDHKKLAEEDLKNIDLTSKDVVIGIAASGKTPYVIGGLTFANTIGATTVSISCNEHAVISEIAQYPVEVKVGPEVLTGSTRLKSGTAQKLILNMISTITMVGVGKVYDNLMIDVKATNQKLIDRSVRIIQEICAITYDEAMALYQVSEHDVKVATVMGMCGISKEEATRRLLNNGDIVKRAIRDRQP

SEQ ID NO: 2607 - DNA, 1071 bp, Staphylococcus aureus
ttgttaaggagggctactttgacaggcttttcagtgtatttaggacaacctttagatgaagcgtatattaagcgaatgattaaacaaggttaccaaatgatttttacatctgtacaaataccagaagaagatgacgagacaaaatatcattatttcacaaaactactcaatttattaaaacatgaacaagtgacttacctcatagatgctaatccatctattttaacaccatctttttatgaccatcttcgacaatatgatgcacaatttatgattcgtatcgatcatagtacatcaattgaggcaatcgaagcgataatggcacagggtttaaagtgctgtttgaatgcaagtattatttcccgggaattgttaacaagcttacatcaacaattgaatgattttacattactttcattttgtcataactattatccaagaccagatacgggattatctgttgacttggtcaataagaaaaatgaactcatttatcaatttaatccaaaggcacaaatatatggttttattgtagggagtgatttgcgaggtcctttgcataaaggcttgccaacaattgaagcaacgagacatagtcatcctgtcgttgcagctaaattattacaagaaactggtgtatctgaagtgttagttggagactcattgattgaaatgaggcaggcaaaacaacttatagatttttgcaagcataggcatttcacgttatgtattgaagaagtgtttgatacgacagtgacttaccttttcgatatgtgtcataaagtacgcccggataatccggaaaatgtcattcgttcggaaacgtcaagacaaatatgtccacattcgattcaaccacagtttacgacgcaacgacgcattggttcagtaaccgttgataatttgaataacggacgttatcaaggcgaaatgcaaattgtgagacaaacgcttagtgcacatgacaatgtgaatgttgttgcacaaattattaaagaagacttaccactgttaagttgtatcgagccgaatgatacatttgattttcaaaaaactagggagtgtaagaag

SEQ ID NO: 2608 - protein, 357 aa, Staphylococcus aureus
  MISC_FEATURE (1)..(357): conserved hypothetical
LLRRATLTGFSVYLGQPLDEAYIKRMIKQGYQMIFTSVQIPEEDDETKYHYFTKLLNLLKHEQVTYLIDANPSILTPSFYDHLRQYDAQFMIRIDHSTSIEAIEAIMAQGLKCCLNASIISRELLTSLHQQLNDFTLLSFCHNYYPRPDTGLSVDLVNKKNELIYQFNPKAQIYGFIVGSDLRGPLHKGLPTIEATRHSHPVVAAKLLQETGVSEVLVGDSLIEMRQAKQLIDFCKHRHFTLCIEEVFDTTVTYLFDMCHKVRPDNPENVIRSETSRQICPHSIQPQFTTQRRIGSVTVDNLNNGRYQGEMQIVRQTLSAHDNVNVVAQIIKEDLPLLSCIEPNDTFDFQKTRECKK

SEQ ID NO: 2609 - DNA, 249 bp, Staphylococcus aureus
atggaagttgtatttactcgcattttgagaattattatgggtgtgttgttattattcgtcttagcattaacgacgatgagttttccaaaagagaattggtgggtatttatcgtcttattactcttagtcggtaatgtcgaagtgacaggatttaaaatgcttaaaaaagatctaaaaggcgtaaacatcttgaatttaatgtcattatttatctttgtcatatatttcatcttaaccatcgtattattc

SEQ ID NO: 2610 - protein, 83 aa, Staphylococcus aureus
  MISC_FEATURE (1)..(83): hypothetical protein
MEVVFTRILRIIMGVLLLFVLALTTMSFPKENWWVFIVLLLLVGNVEVTGFKMLKKDLKGVNILNLMSLFIFVIYFILTIVLF

SEQ ID NO: 2611 - DNA, 2058 bp, Staphylococcus aureus
ttggaggttggacaagtgaggaagaaacttttcggtcaattgcaacgtattggtaaagcgctaatgttacctgttgcgattttaccagcagctggtctgttattagctatcggtacagctatgcaaggtgaatcattacaacactacttgccgtttatacaaaatggtggcgtacaaactgtcgctaaattaatgacaggtgctggtggtatcatttttgataacttgcctatgattttcgcattaggtgtcgcaatcggattagctggcggtgatggcgtagcagctatcgcagcattcgtcggttacataatcatgaacaaaacaatgggcgactttttacaagttacacctaagaatattggtgatccagcgagtggttacgctagcattttaggtatcccaacattacaaacaggtgtgttcggcggtattataatcggggccctggcagcttggtgttataacaagttctataacattaacttaccatcttatttaggtttcttcgctggtaagcgtttcgtacctattatgatggctacaacatcatttattttagcattcccaatggcattaatttggccaacgattcaatcaggattaaatgcattcagtacaggattattagattcaaatactggtgttgccgtattcttatttggtttcatcaagcgtttattaattccattcggtctacatcacattttccacgcaccgttctggttcgagtttggttcatggaaaaatgcagctggtgaaattattcacggtgaccaacgtatctttatcgaacaaattcgtgaaggcgcacatttgacagctggtaaattcatgcaaggtgaattccctgttatgatgttcggtttacctgcagcagctttagcaatttatcacacagctaaacctgaaaataagaaagtagtagcaggtttaatgggttctgctgctttaacatcattcttaactggtattacagaaccattagaattctcattcttatttgtagcaccattattattctttattcacgcagtacttgatggtttatcattcttaacattgtacttattagatcttcatctaggttatacattctcaggtggtttcatcgactacttcttactcggtatactacctaataagacacaatggtggttagtcattcctgtaggtcttgtatacgcagttatttactacttcgtattccgattcttaattgtaaaattaaaatacaaaacaccaggtcgtgaagataaacaatcacaagcggctactgcttcagcaactgaattaccatatgcagtattagaagctatgggtggcaaagcaaacattaaacatttagacgcttgtatcacacgtctacgtgttgaagttaacgacaaatctaaagttgatgttcctggtttgaaagatttaggcgcatctggtgtattagaagtcggcaataatatgcaagcaatttttggtcctaaatctgaccaaatcaaacatgaaatgcaacagattatgaatggtcaagtagtagaaaatcctactactatggaagacgataaagacgaaactgttgttgttgcagaagataaatctgcaacaagcgaattgagccatatcgtgcatgcaccattaactggtgaagtaacaccattatcagaagtgcctgatcaagtgttcagcgaaaaaatgatgggtgacggtatcgctatcaaaccttcacaaggtgaagttcgtgcaccattcaacggtaaagtacaaatgattttcccaacaaaacatgcaattggtcttgtatcagatagtggtttagaactattaatccacatcggtttagacactgttaaattaaacggagaaggctttactttacatgttgaggaaggtcaagaagttaaacaaggtgatttattaatcaactttgatttagactacatccgcaatcatgcaaagagtgatattacgcctattatcgtgacacaaggaaacattacaaaccttgattttaaacaaggtgaacatggcaacatttcatttggcgatcaattatttgaagctaaa

SEQ ID NO: 2612 - protein, 686 aa, Staphylococcus aureus
  MISC_FEATURE (1)..(686): PTS enzyme II
LEVGQVRKKLFGQLQRIGKALMLPVAILPAAGLLLAIGTAMQGESLQHYLPFIQNGGVQTVAKLMTGAGGIIFDNLPMIFALGVAIGLAGGDGVAAIAAFVGYIIMNKTMGDFLQVTPKNIGDPASGYASILGIPTLQTGVFGGIIIGALAAWCYNKFYNINLPSYLGFFAGKRFVPIMMATTSFILAFPMALIWPTIQSGLNAFSTGLLDSNTGVAVFLFGFIKRLLIPFGLHHIFHAPFWFEFGSWKNAAGEIIHGDQRIFIEQIREGAHLTAGKFMQGEFPVMMFGLPAAALAIYHTAKPENKKVVAGLMGSAALTSFLTGITEPLEFSFLFVAPLLFFIHAVLDGLSFLTLYLLDLHLGYTFSGGFIDYFLLGILPNKTQWWLVIPVGLVYAVIYYFVFRFLIVKLKYKTPGREDKQSQAATASATELPYAVLEAMGGKANIKHLDACITRLRVEVNDKSKVDVPGLKDLGASGVLEVGNNMQAIFGPKSDQIKHEMQQIMNGQVVENPTTMEDDKDETVVVAEDKSATSELSHIVHAPLTGEVTPLSEVPDQVFSEKMMGDGIAIKPSQGEVRAPFNGKVQMIFPTKHAIGLVSDSGLELLIHIGLDTVKLNGEGFTLHVEEGQEVKQGDLLINFDLDYIRNHAKSDITPIIVTQGNITNLDFKQGEHGNISFGDQLFEAK

SEQ ID NO: 2613 - DNA, 1746 bp, Staphylococcus aureus
ttgttcactattgttagcgttttcacaacaaagtcaacttccttgaccttacactatattcgaggctatcattttaagtgtaaatatagagaaaaggtggctttttttatgaaacaacgcattggagcttacttaattgacgctattcatcgagcaggcgtcgataaaatttttggtgttcctggtgattttaatctcgcttttctagacgatattatcagcaatcccaatgtagattgggtaggaaatacaaatgaattaaacgcaagttacgcagcggacggttatgcccgtcttaatggactcgctgcattagttactacatttggtgttggcgaattaagtgccgtcaacggtatcgcaggttcatatgctgaacgcatacctgtcattgcgattacaggtgcgccgacacgtgctgttgaacaaggcggtaaatatgtacatcactcacttggtgaaggtacatttgacgactatcgaaaaatgtttgcacatataaccgttgcacaaggttatatcacacctgaaaatgcaacaaccgaaataccacgtttaattaatacagcaatcgccgaaagacgcccagttcatttacatttaccaatcgatgtcgcaatctctgaaattgagataccgacaccatttgaagtgacggcaactaaatatacggatgcatcaacatatatagagttattagcaactaaactgcatcaagcgaagcagcctatcatcattactggacatgaaattaacagttttcacctccatcaagaattagaagattttgtaaatcaaacacagataccagtagcacaactttcattaggaaaaggtgcttttaatgaggaaaatccatattatatgggtatttacgatgggaaaattgccgaagataaaatacgagattatgtggacaacagcgatttaattttaaatattggagccaaattaacagattcagcaacagcaggtttttcataccaattcaatatcgatgatgtcgttatgttaaatcatcacaatatcaaaattgacgatgttacaaatgatgaaatatctctaccatcattgttaaaacagttatccaatatttcatatacgaataacgcaacgttccctgcgtatcatcgtccaacatcacccgattatactgttggcacagaaccattaacacaacaaacttattttaaaatgatgcaaaatttcttaaaaccaaatgatgtcatcattgctgatcaaggtacatcattctttggtgcttatgatttagcattatacaaaaacaatacttttatagggcaaccgttatggggttctatcggctatacattacctgcaacattaggttcacaattagcagacaaagatcgtcgtaacttattattaattggtgatggctcattgcaactaactgttcaagctatttcaactatgattagacagcatattaaaccggtattatttgtgattaataatgacggctatacggtagaacgacttattcacggcatgtatgaaccttataatgaaattcacatgtgggattataaagctttaccagctgtatttggtggtaaaaatgttgaaattcatgacgttgaatcatcaaaagatttacaagacacgtttaatgcaattaatggtcatcccgatgtgatgcattttgtcgaagtcaaaatggctgtcgaagacgcaccgaagaaactcatcgatatcgctaaagctttttcacaacaaaataaa

SEQ ID NO: 2614 - protein, 582 aa, Staphylococcus aureus
  MISC_FEATURE (1)..(582): hypothetical protein
LFTIVSVFTTKSTSLTLHYIRGYHFKCKYREKVAFFMKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEQGGKYVHHSLGEGTFDDYRKMFAHITVAQGYITPENATTEIPRLINTAIAERRPVHLHLPIDVAISEIEIPTPFEVTATKYTDASTYIELLATKLHQAKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNNATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMAVEDAPKKLIDIAKAFSQQNK

SEQ ID NO: 2615 - DNA, 555 bp, Staphylococcus aureus
atgattaattttaataaaaccgctttagtgttaatcgacctgcaagaaggtattcttaaaatggattatgccccatatacagctgaaaatgtcgttcaaaacgctaataaattaatagatgtttttagaaaaaacaatggctttatcgcttttgttcgcgtgaatttctatgatggtaaagatgtattgcaaccaaatgtaatgatctcattaccaccaaaagaaggcgacgactacagtcgtttccatcatttattagacaagagagatgacgattttgtcatagacaaacgacattttagtgcatttgtaggaacagatttggacttacaattgcgacgtcgaggaattgatacgattgttcttggtggtgtcgcaacgcatattggcgtagatacgacagcgcgagatgcctatcaattaaactacaatcagttttttgttacagatatgatgagtgcacaaaacgaaacgctacatcaatttccaatagataatgtattcccattgatgggacaaacaataactacaaacgactttctaaatatattgaac

SEQ ID NO: 2616 - protein, 185 aa, Staphylococcus aureus
  MISC_FEATURE (1)..(185): hypothetical protein
MINFNKTALVLIDLQEGILKMDYAPYTAENVVQNANKLIDVFRKNNGFIAFVRVNFYDGKDVLQPNVMISLPPKEGDDYSRFHHLLDKRDDDFVIDKRHFSAFVGTDLDLQLRRRGIDTIVLGGVATHIGVDTTARDAYQLNYNQFFVTDMMSAQNETLHQFPIDNVFPLMGQTITTNDFLNILN

SEQ ID NO: 2617 - DNA, 1353 bp, Staphylococcus aureus
atgaagaagaaactaacatttaaagaaaacatgtttataggttctatgttatttggtttattctttggtgccggcaatcttatcttcccaatacacttgggtcaagctgctggttctaacgtttttatcgctaacttaggatttttaattacagcaattggcttaccatttctaggtatcattgctattggcatttcaaagacatctggtttatttgaaattgcatcgcgtgttaataaaacatatgcttacattttcacgattgccttatatctagttatcggaccatttttcgccttacctagactggcaacgacatcatttgaaattgcattttcgccatttttatcaccaaagcaaatcactttatatttatttatttttagcttcgtcttctttgtgattgcatggttttttgcgagaaagccatcaagaattttagaatatatcggtaaatttttaaatccggtattcttagtattattagcaattattttattatttgcttttatccatccattaggtggcatatctgatgcacctattagtaaacaatatcaatcacatgccttatttaacggctttttagatggatacaataccttagatgcgctagcgtcattggcatttggtattatcattgttgcaacgattaaaaagttaggtatcgaaaatccaactgatatcgctaaagaaacaattaagtctggtactatcagtatcattatgatggggatcatttataccctactagcaatcatgggtacattaagtattggtcatttcaaacttagtgaaaatggtggtattgccttagcgcaaattactcaatactacttaggtaactacggtatcgtcctgttgtcacttatcgttatggttgcttgtttaaaaacagccatcggtttgattacggcattttcagaaacattcgaacaccttttccctaaaatgaattacctagcgattgcaacagttgtaagctttatttcgttcttattcgcgaatgttggtttaactaagattattatgtactcagtcccagtgttaatgttcttatatccattagcaattgccttgattgtactaacattatttagtagcaaattccatcattcaaaacttatttatcaatgtaccattttctttacaatgattgctgcattagtagatggattaaaagctagtccagagttcatttcaagcacatcattctcacaaactttgattaatttcagccaaaaatatttaccattatcagacattggtatgggctgggttgttctcagtttgattggtttcattatcggcttcattatttataaaattaagcatcgtaaaattccacaagca

SEQ ID NO: 2618 - protein, 451 aa, Staphylococcus aureus
  MISC_FEATURE (1)..(451): hypothetical protein
MKKKLTFKENMFIGSMLFGLFFGAGNLIFPIHLGQAAGSNVFIANLGFLITAIGLPFLGIIAIGISKTSGLFEIASRVNKTYAYIFTIALYLVIGPFFALPRLATTSFEIAFSPFLSPKQITLYLFIFSFVFFVIAWFFARKPSRILEYIGKFLNPVFLVLLAIILLFAFIHPLGGISDAPISKQYQSHALFNGFLDGYNTLDALASLAFGIIIVATIKKLGIENPTDIAKETIKSGTISIIMMGIIYTLLAIMGTLSIGHFKLSENGGIALAQITQYYLGNYGIVLLSLIVMVACLKTAIGLITAFSETFEHLFPKMNYLAIATVVSFISFLFANVGLTKIIMYSVPVLMFLYPLAIALIVLTLFSSKFHHSKLIYQCTIFFTMIAALVDGLKASPEFISSTSFSQTLINFSQKYLPLSDIGMGWVVLSLIGFIIGFIIYKIKHRKIPQA

SEQ ID NO: 2619 - DNA, 1209 bp, Staphylococcus aureus
atgtataaatataaaggagggagaccgatgaattcaatcattgaattaactgattattatagctctaataattatgcaccacttaagcttgtcatttctaaaggtaaaggtgtcaaagtttgggatactgatggcaaacaatatatagattgcatttcgggtttttcagttgcaaaccaaggccattgtcatccaacaattgttaaagcgatgacagaacaagcttcaaagttgtctatcatttcacgtgtcctttatagtgacaatctcgggaaatgggaagaaaaaatttgtcatcttgctaagaaagacaaagtactcccccttaactctggtactgaagctgttgaagcagccattaaaattgctagaaaatggggctctgaagttaaaggcattactgacggacaagttgaaatcatcgctatgaataacaattttcacggtcgtacacttggctcattatcactatctaaccacgacgcatataaagcaggatttcaccccctacttcaaggcactacaacagtagattttggagacattgaacaattaacacaagctatttcaccgaatacagcagcaattattttggaaccaattcaaggtgaaggtggcgttaatataccaccgaaaggatatattcaagctgtgcgtcaactatgtgataaacatcaaatattattgattgcagatgaaattcaagttggtcttggtagaactgggaaatggtttgctatggaatgggagcaagtcgttccagacatttatattttaggtaaggcattgggtggcggcttataccctgtatctgctgtacttgcaaataatgatgtcatgcgtgttctaacaccaggtacacatggttcaacatttggtggtaaccctttagccattgcaatatcgacggcagcgcttgatgtacttaaagatgaacaactggttgaacgatcagaacgcttaggttcatttttattaaaagcgttgctacaacttaaacatcctagtattaaagaaattagaggtcgtggtttatttataggcatagagcttaacacagatgctgcaccttttgtggatcaactgattcaacgtggaatcttatgcaaagacacgcatcgtactatcattcgattgtctccacctctagtcattgataaagaggaaatccatcaaattgttgcagcttttcaagacgtttttaaaaat

SEQ ID NO: 2620 - protein, 403 aa, Staphylococcus aureus
  MISC_FEATURE (1)..(403): ornithine aminotransferase
MYKYKGGRPMNSIIELTDYYSSNNYAPLKLVISKGKGVKVWDTDGKQYIDCISGFSVANQGHCHPTIVKAMTEQASKLSIISRVLYSDNLGKWEEKICHLAKKDKVLPLNSGTEAVEAAIKIARKWGSEVKGITDGQVEIIAMNNNFHGRTLGSLSLSNHDAYKAGFHPLLQGTTTVDFGDIEQLTQAISPNTAAIILEPIQGEGGVNIPPKGYIQAVRQLCDKHQILLIADEIQVGLGRTGKWFAMEWEQVVPDIYILGKALGGGLYPVSAVLANNDVMRVLTPGTHGSTFGGNPLAIAISTAALDVLKDEQLVERSERLGSFLLKALLQLKHPSIKEIRGRGLFIGIELNTDAAPFVDQLIQRGILCKDTHRTIIRLSPPLVIDKEEIHQIVAAFQDVFKN

SEQ ID NO: 2621 - DNA, 1032 bp, Staphylococcus aureus
atgatgattaaagtaggtatcgttggcggtagcggttatggcgcaattgaattaattcgattgttacaaacacatcctcatgtaacgattgcacacatctactcacattcaaaagtagatgaaccgttgaaattaacatttccacatttacaacatattatgcaacatttcgaagcacttacagtggataataatgactgtgatgtaattttctttgcgacaccagcacccgtaagtaaaacatgtatccctcccttagtagaaaaaggtattcatgttatcgatttatctggcgcatttagaattaagaatcgtgaaatatatgaagcatattacaaagaaactgctgcagcacaagatgatttgaatcatgctatttacagcatttcagaatggcaatcgtttgataacaatggaacgaagctcatttctaatcctggctgtttccctacagcaacattattagcattacatccacttattagcgaaaaaatagtagatttgtcatctattattattgatgctaagaccggcgtgtcaggtgctggtcgttcattatcacaacgtgttcatttttcagaaatgaatgaaaatctaagcgcttatgcaatcggaaaccataaacacaaaccggaaatcgagcaatatttatctatcattgcgggtcaagatgtatcagtcatatttacaccacatctcgtaccaatgacacgaggtattttatcaacaatatatgtcaaattatcatctgaatatacgactgaatcattacataaattaatgacctcttattatgctaatcagccatttgtcagaattagagatattgggacttttccaaccacaaaagaagtactcggtagtaactactgcgatatcggcatctatgtagatgaaacaacgcaaacagcaattttagtatcagtgattgataaccttgtcaaaggcgcaagtgggcaagccattcaaaatttaaatatattatatgattttgaagtgacgactggcctaaatcaatcaccagtttatcca

SEQ ID NO: 2622 - protein, 344 aa, Staphylococcus aureus
  MISC_FEATURE (1)..(344): N-acetylglutamate
MMIKVGIVGGSGYGAIELIRLLQTHPHVTIAHIYSHSKVDEPLKLTFPHLQHIMQHFEALTVDNNDCDVIFFATPAPVSKTCIPPLVEKGIHVIDLSGAFRIKNREIYEAYYKETAAAQDDLNHAIYSISEWQSFDNNGTKLISNPGCFPTATLLALHPLISEKIVDLSSIIIDAKTGVSGAGRSLSQRVHFSEMNENLSAYAIGNHKHKPEIEQYLSIIAGQDVSVIFTPHLVPMTRGILSTIYVKLSSEYTTESLHKLMTSYYANQPFVRIRDIGTFPTTKEVLGSNYCDIGIYVDETTQTAILVSVIDNLVKGASGQAIQNLNILYDFEVTTGLNQSPVYP

SEQ ID NO: 2623 - DNA, 1239 bp, Staphylococcus aureus
atgaaacatcaagaaacgacatcacaacaatataacttttcaattattaaacatggcgatatcagtacacctcaaggcttcacggctggtggtatgcacatcggtttacgcgctaacaaaaaagactttgggtggatttactcatcgtctttggcaagtgcagctgccgtatatactttaaatcagtttaaagctgcaccacttattgtcactgaagacactttacaaaagtctaaaggaaaattacaagcacttgttgttaattcagctaatgcaaattcttgtaccggtcaacaaggcatagatgatgcacgacaaacacaaacatgggttgctcaacaacttcaaataccatctgagcatgttgctgttgcttcaactggggtcattggtgaatatttgcctatggataaaattaagactgggaccgaacatattaaggatgctaattttgcaacgccaggtgcgtttaacgaggcaattttaacaactgatacctgtacaaaacatatcgctgtatcactaaaaatcgatggtaaaaccgttacaattggtggtagcaccaaaggttcaggtatgattcacccaaatatggctaccatgcttgcttttataacaaccgatgcatcgattgaatcgaatacacttcatcaattattaaaatcttcgactgaccatacatttaatatgattactgttgatggcgatacaagtacaaatgacatggtattagtcatggcaaatcaccaagttgaacaccaaatacttagtcaagaccatccacaatgggaaacatttgttgatgcattcaattttgtctgtacatttttagctaaagctatagccagagatggcgaaggcgcaacaaagttaatcagcgtcaatgtgtcaggcgctaaatcaatatcagatgcaagaaaaatcggtaaaactatcgtaagttcaaatctagtaaaatcagctatttttggcgaagatgccaattttggtcgaatcattacagctattggctacagcggatgtgaaattgatcctaactgcacatatgttcaactgaaccaaatacctgtcgttgataaaggtatggctgtactatttgatgagcaagctatgtcgaatacattaactcatgaaaatgtcacaattgacgttcagcttggtttaggtaacgctgcagcgactgcatacggttgtgatttatcctatgattatgtgcgtatcaacgcatcatatcgaaca

SEQ ID NO: 2624 - protein, 413 aa, Staphylococcus aureus
  MISC_FEATURE (1)..(413): arginine biosynthesis
MKHQETTSQQYNFSIIKHGDISTPQGFTAGGMHIGLRANKKDFGWIYSSSLASAAAVYTLNQFKAAPLIVTEDTLQKSKGKLQALVVNSANANSCTGQQGIDDARQTQTWVAQQLQIPSEHVAVASTGVIGEYLPMDKIKTGTEHIKDANFATPGAFNEAILTTDTCTKHIAVSLKIDGKTVTIGGSTKGSGMIHPNMATMLAFITTDASIESNTLHQLLKSSTDHTFNMITVDGDTSTNDMVLVMANHQVEHQILSQDHPQWETFVDAFNFVCTFLAKAIARDGEGATKLISVNVSGAKSISDARKIGKTIVSSNLVKSAIFGEDANFGRIITAIGYSGCEIDPNCTYVQLNQIPVVDKGMAVLFDEQAMSNTLTHENVTIDVQLGLGNAAATAYGCDLSYDYVRINASYRT

SEQ ID NO: 2625 - DNA, 762 bp, Staphylococcus aureus
atgaaatttattgtcattaaaattggtggcagtacacttagtgacatgcatccatcaattattaacaacattaagcatttacgatcaaacaacatctaccccattatcgttcatggcggtggcccatttattaatgaagcattatcaaaccagcaaatcgagccacactttgttaatggcctaagagtgactgataaagcaaccatgaccattactaaacacacgctcattgcagacgttaacactgcattagtagctcaatttaaccagcaccaatgttctgcaataggcttatgtggtttggatgcacagctgtttgaaattacatcttttgatcaacaatatggatatgtcggtgttccgaccgctttaaataaggatgctttacagtatttatgtactaaatttgtacctatcatcaattcgattggtttcaataaccatgatggagaattttacaatattaatgctgacacgcttgcctattttattgcatcatcattaaaagcgcctatttatgtattaagtaatattgcaggtgtactcatcaatgatgttgttatacctcaattgccattagtcgatattcatcaatatattgaacatggtgatatttatggaggtatgattcccaaagtgctagatgccaaaaatgcgattgaaaatggctgtcctaaagttatcattgcatcaggaaacaagccaaatatcattgaatctatttacaataatgattttgttggcacaacaatccttaattca

SEQ ID NO: 2626 - protein, 254 aa, Staphylococcus aureus
  MISC_FEATURE (1)..(254): hypothetical protein
MKFIVIKIGGSTLSDMHPSIINNIKHLRSNNIYPIIVHGGGPFINEALSNQQIEPHFVNGLRVTDKATMTITKHTLIADVNTALVAQFNQHQCSAIGLCGLDAQLFEITSFDQQYGYVGVPTALNKDALQYLCTKFVPIINSIGFNNHDGEFYNINADTLAYFIASSLKAPIYVLSNIAGVLINDVVIPQLPLVDIHQYIEHGDIYGGMIPKVLDAKNAIENGCPKVIIASGNKPNIIESIYNNDFVGTTILNS

SEQ ID NO: 2627 - DNA, 492 bp, Staphylococcus aureus
ttgacgaaacgacaaatgggtatattcatttatgctggaattatcggtggcttgttatctggaattgtaaaattaggttgggaggtcatgtttccacctcgcacaccagaacgtaatgcaacgaacccacctcaagagttattgcaacaattaggatttagtagtgagtttacgcatcaaacatatacattttcaaatatggaattgccttgggtaagctttattgtccactttagtttttctatcgtcattgcaattatttactgcatattagttaaaaaatacgcttacttagcaatgggacaaggtgctgtttttggtattgctatttgggtattattccaccttatcattatgccaatcatgcatactgtacctgctgtgtgggatcaaccattccaagagcatctgtcagaattctttggccatatcgtctggatgatgacaattgaattagtgcgacaacattttgtctatcgctataaattaaat

SEQ ID NO: 2628 - protein, 164 aa, Staphylococcus aureus
  MISC_FEATURE (1)..(164): conserved hypothetical
LTKRQMGIFIYAGIIGGLLSGIVKLGWEVMFPPRTPERNATNPPQELLQQLGFSSEFTHQTYTFSNMELPWVSFIVHFSFSIVIAIIYCILVKKYAYLAMGQGAVFGIAIWVLFHLIIMPIMHTVPAVWDQPFQEHLSEFFGHIVWMMTIELVRQHFVYRYKLN

SEQ ID NO: 2629 - DNA, 642 bp, Staphylococcus aureus
atgacagtatttgtaatgcaattacagagtaacttgaaaagtattgaagaattaatatcacaaagtcgttggtcatataaaaaaccgcgtacagtcaactatagatacaatcaagataaactcatgcacagattgggagatattttagtgcaatatggaattcaacatgacacaggtttattaccacatgaatggcattatcacatttcgccacgaggtaaggcagatattgttcaacacaatcgtgatggacagcccatctatgtgagcttatcatatagttatccttatatcgtgtgtgttgtcgataaagaaccagttggtattgatatcgaaaagatatcacaacgtttagactggcgtacgttagtgacgtgtttctctacaaacgaagcacatcaaatatgtagtttaaatgatttttatcaaatatggacacaaaaagaaagttttacaaaattgattggtgaaggtttaatcaaaggattggacatttatgatatgacacaatcacacttttatcaatcacgtgaagtgaagttcaaacaatttatttttgatcagtttatggtacaggtatgtttcttaggacaggcaccctggggttataaaaaagtgtctgtatttcagttattgagtagt

SEQ ID NO: 2630 - protein, 214 aa, Staphylococcus aureus
  MISC_FEATURE (1)..(214): conserved hypothetical
MTVFVMQLQSNLKSIEELISQSRWSYKKPRTVNYRYNQDKLMHRLGDILVQYGIQHDTGLLPHEWHYHISPRGKADIVQHNRDGQPIYVSLSYSYPYIVCVVDKEPVGIDIEKISQRLDWRTLVTCFSTNEAHQICSLNDFYQIWTQKESFTKLIGEGLIKGLDIYDMTQSHFYQSREVKFKQFIFDQFMVQVCFLGQAPWGYKKVSVFQLLSS

SEQ ID NO: 2631 - DNA, 7191 bp, Staphylococcus aureus
atgaaagaaggactttttatgattatgggtaatttgagatttcaacaggaatattttcgtatatacaaaaataatacagaatcaacgacacaccgtaatgcgtattgggttaaactcgctaaaaatgttgaagctactaaaatgatgtatgcattatcgacaattgtgcaacaacatgcatctataagacatttttttgatgttactaccgatgacaatttaacaatgatacttcatgaatttctgccttttattgagataaaacaagttccatcttcttccgcaaactatgatttagaagctttttttaagcaagaattaagtacttaccattttaatgattcacctttattcaaagttaaattgtttcagttcgctgatgctgcatatatactattagattttcatgtgtccattttcgatgatagtcaaattgatatttttcttgatgatttatgcaatgcatatcgtggcaatactgttattaacaatactcgacagcatgcacatataaatagaaatgatgataaagacaatcaagatgcatcgcatatagcattagactcaaactattttcggttagagaataactctgacatccatattgatagttattttccaattaagcatccatttgaacaagctttatatcaaacgtatttgattgatgatatgacatcaatagatatggcatcgttggctgttagtgtgtatttagctaatcatataatgagtcaacaacatgatgtcacattaggtatacatgtaccatcacatttaccaaatgatttacacggaaatattgtgccgttaacgttaacaatcgatgcaaaagatgtatgtcaacgttttacaacagattttaataaatgtgtgttgcaaaatatgtcgcaattacagtgcgcgaagtcttcgctttcactagagactatttttcattgttatcatcatatgatgtcttgttgtaatgatgttattgaggatgtacatcaaatacatgatgcacatacatctttagcggatattgaaatttttccacatcaacacgggttcaaaattatatataacagtgcagcatatgatttgctctcaatcgagacgctgagtgacttagttcgaaatatttatttgcaaattactgaagaaaatggaaataaacgaacaactgtagatgaacttaatttgatgacagaacgtgatattcaattatatgacgatatcaatttaagtttgcctgagatagatgatgcgcaaacagttgttaccttatttgagcaacaagttgaagcaacgccgaatcatgtcgctgtgcaatttgacggagtgtttataacatatcaaacattgaatgcacgcgcgaatgatttagcacaccgtttgagaaaccagtatggtgttgaacctaatgatcgtgtcgctgtcatagctgaaaaaagtattgagatgataatagcgatgataggtgtgttgaaagctggtggggcttacgtgccaattgatccgaactatccaagtgatcgtcaggagtacattttaaaagatgtaacgcctaaagttgtaataacgtaccaagctttatatgaaaatggtaaacaaaatattaatcacattgatttgaataagatagcgtggaaaaatattgataatctttctaaatgtaacacgttagaagatcatgcttatgttatttacacgtcggggacaactggtaaccctaaagggacactaattccgcaccgaggtattgttcgcttggtccatcaaaatcattatgtaccattaaatgaagagacgacgattttgttatcaggaactatagcctttgatgctgcaacatttgaaatatatggtgcattgctcaatggtggaaagctgattgttgctaaaaaagaacaattattaaatccaatagcggtagaacaattaatcaatgaaaatgacgttaatactatgtggttaacctcctcattatttaatcagattgctagtgaacgaatagaagtattggtaccgttaaagtatttattaattggtggagaagtattgaatgctaagtgggtggatttgcttaatcaaaaaccgaagcatcctcaaattattaatggttatggaccaactgaaaatacaacatttacaacgacgtataatatacctaacaaagttccaaatcgtattcctattggtaaaccgattctgggtactcatgtttatatcatgcaaggcgagcgtcggtgtggcgttggtattcctggagaattatgtacaagtggctttgggttagctgcaggttatttaaatcagccagaattgacagcagataaatttatcaaagattcaaatataaatcagctgatgtatagaagtggtgatatcgttcgtttgttacccgatggcaacatagattatttatatcgaaaggacaaacaagttaagattcgagggtttaggattgagttgtcagaggttgagcatgcgctcgagcgtatacaaggtattaataaagcagttgttattgttcaaaatcatgatcaagatcagtatatcgttgcttattatgaagcgatgcatacattatcacataataagattaaatcacaattacgtatgaccttaccggagtacatgataccagttaatttcatgcatattgagcaaattcctattactattaatgggaaattagataagaaggcattgcctatcatggactatgtcgatacggatgcctatgtagcaccgagtacagataccgaacacttgctatgccaaatttttgcagatattttacatgtgaatcaagtaggtattcatgataatttctttgaattaggtggccattcattaaaagcaacgttagtggtgaatcggatagaggcatctactgggaaacgattacaaattggtgatttattacaaaagccaactgtatttgaactagcacaagcgattgctaaggttcaagaacaaaactatgaagtgattccagaaactatagttaaagatgattatgtgctgagctctgcacaaaagcgtatgtatttattatggaaatcaaaccataaagatacggtgtataacgtaccttttttatggcggttatcatcagaacttaatgtagctcaattgcgacaagcagtgcagcgtttgatagcgcgacatgagattttacgaacacaatatattgttgtagatgatgaggttcgacaacgtattgtggcagatgttgcagttgactttgaagaagttaacacgcattttacggatgaacaagaaatcatgcgccaatttgtagcaccttttaatttggaaaagccaagtcaaattagagtgagatacattagaagtcccttacatgcatacctctttatagatacgcatcatatcattaatgacggtatgagtaatatacaattaatgaatgatcttaacgcactttatcaacataaattattgttaccacttaaattgcaatataaagactatagtgagtggatgtcgcatcgtgatatgacgaaacatagacaatattggttatctcaattcaaagatgaagtacctattttaagcttaccgacagactatgttagaccaaatattaaaacgacaaatggagcaatgatgtcatttacaatgaatcaacaaatgagacagctacttcaaaagtatgtagaaaagcatcaaattactgattttatgttctttatgagtgtggtcatgacgttgttaagtagatatgctcgaaaagatgatgttgttgtcggtagtgtgatgagtgcgcgtatgcataaaggcacggagcaaatgctaggcatgtttgctaatacgttggtatatagagggcaaccgtcacctgataaaatgtggacacagtttttacaagaggttaaggaaatgagtttggaggcatacgagcatcaagaatacccattcgaatgtttagtaaatgacttagatcaatcacatgatgcctcacggaatccattatttgatgtcatgttagtactacaaaacaatgaaacgaatcatgctcattttgggcatagtaaattaacacacattcaacccaaatcagtgacggcgaaatttgatttatctttcatcattgaagaagatcgcgatgactatacaatcaatatcgagtataataccgatttatatcactcagaaacagttcgtcacatgggtaatcaatgtatgattatgattgattatattttgaagcatcaagatacactacaaatttgtgatataccaaacggcacggaggaacttctaaattgggtcaatacgcatgttaacgatcgaatgcttaatgtcccgggaaataaatctatcataagttactttaatgaagttgtctcacgacaaggtaatcatgttgcgctagtcatgaatgatttgacaatgacgtatgaaacattacgcaactatgtggatgccattgcgcacatgctcctatcaaatggtgtgggcaatggtcaacgggttgccttgtttacagaacgtagttttgaaatgattgcggcgatgttggcgacagttaaagtaggtgcatcttatatacctatcgatattgattttccgaataaacgacaaggtgcaattttggaggatgctaaagtaactgcagtcatgtcttacggcgttgaaattgaaacgacattaccagtcattcaattggaaaatgctaaaggctttgttgaatcaaaggaaaatgaacaatatgatgatttacatggcaatcaacttgaaaacacagcgatgttagataatgagatgtatgctatttacacatctggtacgaccgggatgcctaaaggggttgccatacgacaacgaaatttgttgaatttagtgcatgcatggtcaactgaattgcaattaggcgacaatgaagtatttttgcaacatgcaaatattgtttttgatgcatcagttatggagatttattgttgtttgttaaatggtcatacgcttgtgattccagatagagaggaacgtgttaatccagaacagttacaacaactcattaataagcatcgtgtgacggttgcgtcgattccgttacagatgtgtagtgttatggaagacttttatattgaaaagttgattacaggcggggcaactagtacggcatcctttgttaaatatattgagaagcattgtggcacgtatttcaatgcctatggaccatctgagtcaacagtcatcacatcgtattggtcacatcattgtggtgatttgatacctgagacgattccaattggcaaacccttatctaacatccaagtgtatattatgtcagatggtttgttatgcggtattggtatgccaggcgagttgtgtattgcaggtgatagtttagcgataggatatattaatcgtccagaattaatggctgataaatggcaaaataatccatttggtaaaggaaagttgtatcatagtggtgatttagcacgttatacatctgatggtcaaattgaatttttaggaagaatagataaacaagtgaaagttaacgggtaccgtattgaacttgatgaaattgaaaatgcaatattagctattcgtggtatatctgattgtgttgtaacagtaagtcactttgatacgcatgatatattgaatgcttattatgtcggagagcaacaagtggaacaggatttgaagcaatatttaaatgatcagctgcctaagtatatgattcctaagactataacgcatatcgattgtatgccattaaccacgaatgacaaggtggatactacgcgtttgccaaatccatcacctatacaacagtctaataaagtgtatagcgaaccctctaatgaaattgagcagacatttgttgatgtatttggagaggtattgaaacaaaatgatgtcggtgttgacgatgatttctttgaacttggtggtaactcattagaggcgatgttagttgtctcgcatttaaaacgatttggccatcatatttcaatgcagacattataccaatataaaaccgtgcgacagattgttaattatatgtaccaaaatcaacaatcattagttgcattaccggataatctttcggaattacaaaagattgttatgtctcgttataacttgggtattttagaggatagtctaagtcatcgacctctaggaaatacactattgactggcgcgacaggttttttaggtgcttatctgattgaagtactacaaggatacagtcatcgcatttattgtttcatacgtgctgataatgaggaaatagcatggtataagttgatgacgaatttaaatgattatttttcagaagagacggttgaaataatgttatcaaacattgaagtcattgttggtgatttcgagtgtatggatgatgttgttttaccagaaaacatggatacgattattcatgcaggtgctcgtacagatcactttggtgatgatgatgaatttgaaaaagtaaatgttcaaggtactgttgatgtcatacgtttggcacaacaacatcatgcaaggttaatatatgtgtctacgataagtgtgggaacttattttgatatagacacagaagatgtgacattttcagaagcggatgtctataaagggcaactactaacatcaccatatacacggagcaaattttatagtgaattaaaagtattagaagctgtaaataatggcttagatggtcggattgtacgtgttggtaatttgacgaatccttacaatggaagatggcatatgagaaatataaagactaaccgtttttcaatggtaatgaatgatttgttacaactggattgtatcggggttagcatggctgaaatgcctgtagatttttcttttgtggatacgactgcaagacaaattgtcgcattagcacaggtcaacacaccacaaatcatttaccatgtgctatcacctaataaaatgccggtgaaatctttgttagaatgcgttaagcgcaaagaaattgaactcgtcagcgatgaatcatttaatgaaattttacagaaacaagacatgtacgaaacgattggattaactagtgttgaccgtgaacaacaactagcaatgatagatacaacattaacattaaaaataatgaatcacatcagtgaaaaatggccaacgataactaacaattggctgtatcattgggcacaatatatcaaaacaatattcaataag

SEQ ID NO: 2632 - protein, 2397 aa, Staphylococcus aureus
  MISC_FEATURE (1)..(2397): hypothetical protein
MKEGLFMIMGNLRFQQEYFRIYKNNTESTTHRNAYWVKLAKNVEATKMMYALSTIVQQHASIRHFFDVTTDDNLTMILHEFLPFIEIKQVPSSSANYDLEAFFKQELSTYHFNDSPLFKVKLFQFADAAYILLDFHVSIFDDSQIDIFLDDLCNAYRGNTVINNTRQHAHINRNDDKDNQDASHIALDSNYFRLENNSDIHIDSYFPIKHPFEQALYQTYLIDDMTSIDMASLAVSVYLANHIMSQQHDVTLGIHVPSHLPNDLHGNIVPLTLTIDAKDVCQRFTTDFNKCVLQNMSQLQCAKSSLSLETIFHCYHHMMSCCNDVIEDVHQIHDAHTSLADIEIFPHQHGFKIIYNSAAYDLLSIETLSDLVRNIYLQITEENGNKRTTVDELNLMTERDIQLYDDINLSLPEIDDAQTVVTLFEQQVEATPNHVAVQFDGVFITYQTLNARANDLAHRLRNQYGVEPNDRVAVIAEKSIEMIIAMIGVLKAGGAYVPIDPNYPSDRQEYILKDVTPKVVITYQALYENGKQNINHIDLNKIAWKNIDNLSKCNTLEDHAYVIYTSGTTGNPKGTLIPHRGIVRLVHQNHYVPLNEETTILLSGTIAFDAATFEIYGALLNGGKLIVAKKEQLLNPIAVEQLINENDVNTMWLTSSLFNQIASERIEVLVPLKYLLIGGEVLNAKWVDLLNQKPKHPQIINGYGPTENTTFTTTYNIPNKVPNRIPIGKPILGTHVYIMQGERRCGVGIPGELCTSGFGLAAGYLNQPELTADKFIKDSNINQLMYRSGDIVRLLPDGNIDYLYRKDKQVKIRGFRIELSEVEHALERIQGINKAVVIVQNHDQDQYIVAYYEAMHTLSHNKIKSQLRMTLPEYMIPVNFMHIEQIPITINGKLDKKALPIMDYVDTDAYVAPSTDTEHLLCQIFADILHVNQVGIHDNFFELGGHSLKATLVVNRIEASTGKRLQIGDLLQKPTVFELAQAIAKVQEQNYEVIPETIVKDDYVLSSAQKRMYLLWKSNHKDTVYNVPFLWRLSSELNVAQLRQAVQRLIARHEILRTQYIVVDDEVRQRIVADVAVDFEEVNTHFTDEQEIMRQFVAPFNLEKPSQIRVRYIRSPLHAYLFIDTHHIINDGMSNIQLMNDLNALYQHKLLLPLKLQYKDYSEWMSHRDMTKHRQYWLSQFKDEVPILSLPTDYVRPNIKTTNGAMMSFTMNQQMRQLLQKYVEKHQITDFMFFMSVVMTLLSRYARKDDVVVGSVMSARMHKGTEQMLGMFANTLVYRGQPSPDKMWTQFLQEVKEMSLEAYEHQEYPFECLVNDLDQSHDASRNPLFDVMLVLQNNETNHAHFGHSKLTHIQPKSVTAKFDLSFIIEEDRDDYTINIEYNTDLYHSETVRHMGNQCMIMIDYILKHQDTLQICDIPNGTEELLNWVNTHVNDRMLNVPGNKSIISYFNEVVSRQGNHVALVMNDLTMTYETLRNYVDAIAHMLLSNGVGNGQRVALFTERSFEMIAAMLATVKVGASYIPIDIDFPNKRQGAILEDAKVTAVMSYGVEIETTLPVIQLENAKGFVESKENEQYDDLHGNQLENTAMLDNEMYAIYTSGTTGMPKGVAIRQRNLLNLVHAWSTELQLGDNEVFLQHANIVFDASVMEIYCCLLNGHTLVIPDREERVNPEQLQQLINKHRVTVASIPLQMCSVMEDFYIEKLITGGATSTASFVKYIEKHCGTYFNAYGPSESTVITSYWSHHCGDLIPETIPIGKPLSNIQVYIMSDGLLCGIGMPGELCIAGDSLAIGYINRPELMADKWQNNPFGKGKLYHSGDLARYTSDGQIEFLGRIDKQVKVNGYRIELDEIENAILAIRGISDCVVTVSHFDTHDILNAYYVGEQQVEQDLKQYLNDQLPKYMIPKTITHIDCMPLTTNDKVDTTRLPNPSPIQQSNKVYSEPSNEIEQTFVDVFGEVLKQNDVGVDDDFFELGGNSLEAMLVVSHLKRFGHHISMQTLYQYKTVRQIVNYMYQNQQSLVALPDNLSELQKIVMSRYNLGILEDSLSHRPLGNTLLTGATGFLGAYLIEVLQGYSHRIYCFIRADNEEIAWYKLMTNLNDYFSEETVEIMLSNIEVIVGDFECMDDVVLPENMDTIIHAGARTDHFGDDDEFEKVNVQGTVDVIRLAQQHHARLIYVSTISVGTYFDIDTEDVTFSEADVYKGQLLTSPYTRSKFYSELKVLEAVNNGLDGRIVRVGNLTNPYNGRWHMRNIKTNRFSMVMNDLLQLDCIGVSMAEMPVDFSFVDTTARQIVALAQVNTPQIIYHVLSPNKMPVKSLLECVKRKEIELVSDESFNEILQKQDMYETIGLTSVDREQQLAMIDTTLTLKIMNHISEKWPTITNNWLYHWAQYIKTIFNK

SEQ ID NO: 2633 - DNA, 1248 bp, Staphylococcus aureus
atgaaacgcttaagtacgactttgaaagtacgattgattagcaattttttacagctaattattacgacagcatttataccgtttatagcactatatttaacagatatgttaagtcaatcaattgtcggtatatatcttgttggtttagtggttctaaaatttccattgtccattatatctggttaccttattgagatatttccgaaaaagttgctagtacttatttatcaagcgacgatggtgataatgcttgtgttcatgggcgtatttgggtcacatcaattgtggcaaattattggtttttgtgttgcatatgccatatttacaatcgtttggggattacaatttccagttatggacacattaattatggatgcaattaccgaagacgtggaacattatatttacaagattagctattggatgacaaacttatcggtagctattggggcattgttaggtggcttgatgtatggctacagtatgttactacttttcttaatagcagcttgtatatttttaattgtactctttattttatatatttggttacctcaagaccgaaatcaagtaaagcaaagtgatgacaagaggcatgcaagtcgttatcaaaaattacaaataatgaatatatttcgcagttataaattagttttgaaagaccgtaattatatgttattgatttcggggttcagtatcatcatgatgggtgaattttcaatctcctcatatattgctattagactaaaggatcagtttgaaacaataagtataggttcatatgatattacaggtgctaagatgttagcaatcttgctaatgattaatacggtcgtcgtcattttactcacgtattcaatctcgaaagttgtattgaaaatagattttaaaaaagctttaatcactggtttgctgatttatattgttggctatagtggtctaacctatcttaatcagtttggcttattagttgtttttatgataattgcgactgtaggtgaaattatttattcgcctatagtttcagaacaacgctttaaaattattcctaaagctaaaagaggaacatatagtgcagttaatgcattaggtattcatttttcagaaacactagctaggttagggattgtgttgggtgttttcttaacgtcattacaaatgggactgtatatgtttatcgttttaacaattggtgctagcatgcttgttgctggtgtatttgggggacaaaaacaagtgaatacaaat

SEQ ID NO: 2634 - protein, 416 aa, Staphylococcus aureus
  MISC_FEATURE (1)..(416): hypothetical protein
MKRLSTTLKVRLISNFLQLIITTAFIPFIALYLTDMLSQSIVGIYLVGLVVLKFPLSIISGYLIEIFPKKLLVLIYQATMVIMLVFMGVFGSHQLWQIIGFCVAYAIFTIVWGLQFPVMDTLIMDAITEDVEHYIYKISYWMTNLSVAIGALLGGLMYGYSMLLLFLIAACIFLIVLFILYIWLPQDRNQVKQSDDKRHASRYQKLQIMNIFRSYKLVLKDRNYMLLISGFSIIMMGEFSISSYIAIRLKDQFETISIGSYDITGAKMLAILLMINTVVVILLTYSISKVVLKIDFKKALITGLLIYIVGYSGLTYLNQFGLLVVFMIIATVGEIIYSPIVSEQRFKIIPKAKRGTYSAVNALGIHFSETLARLGIVLGVFLTSLQMGLYMFIVLTIGASMLVAGVFGGQKQVNTN

SEQ ID NO: 2635 - DNA, 1029 bp, Staphylococcus aureus
atggatatgaaaatcgtagcattatttccagaagcagtagaaggtcaagaaaatcaattacttaatactaaaaaagcattaggattaaaaacatttttagaggaaagaggacatgagttcattatattagcagataatggtgaagacttagataaacatttaccagatatggatgtgattattagtgcgccattttatcctgcatatatgactcgtgaacgtattgaaaaagcaccgaacttgaaattagcaattacagcaggtgtaggatctgaccatgtagatttagcggcagcaagtgaacacaatattggtgtcgttgaagttacaggaagtaatacagttagtgtggcagaacatgcggttatggatttattaatacttcttagaaactatgaagaaggtcatcgtcaatcagtagaaggtgaatggaacttgtctcaagtaggtaatcatgcgcatgaattacaacacaaaacaattggtatttttggatttggtcgaattggacaacttgttgctgaaagattagcgccatttaatgtaacattacaacactatgatccaatcaatcaacaagaccataaattgtctaaatttgtaagctttgatgaacttgtttcaacaagtgatgcgattacaattcatgcaccattaacaccagaaactgataacttatttgataaagatgttttaagtcgtatgaaaaaacacagttatttagtgaatactgcacgtggtaaaattgtaaatcgcgatgcgttagttgaagcgttagcatccgagcatttacaaggatatgctggtgatgtttggtatccacaacctgcacctgctgatcatccatggagaacaatgcctagaaatgctatgacggttcactattcaggtatgactttagaagcacaaaaacgtattgaagatggagttaaagatattttagagcgtttcttcaatcatgaacctttccaagataaagatattattgttgcaagtggtcgtattgctagtaaaagttatacagctaaa

SEQ ID NO: 2636 - protein, 343 aa, Staphylococcus aureus
  MISC_FEATURE (1)..(343): NAD-dependent formate
MDMKIVALFPEAVEGQENQLLNTKKALGLKTFLEERGHEFIILADNGEDLDKHLPDMDVIISAPFYPAYMTRERIEKAPNLKLAITAGVGSDHVDLAAASEHNIGVVEVTGSNTVSVAEHAVMDLLILLRNYEEGHRQSVEGEWNLSQVGNHAHELQHKTIGIFGFGRIGQLVAERLAPFNVTLQHYDPINQQDHKLSKFVSFDELVSTSDAITIHAPLTPETDNLFDKDVLSRMKKHSYLVNTARGKIVNRDALVEALASEHLQGYAGDVWYPQPAPADHPWRTMPRNAMTVHYSGMTLEAQKRIEDGVKDILERFFNHEPFQDKDIIVASGRIASKSYTAK

SEQ ID NO: 2637 - DNA, 357 bp, Staphylococcus aureus
gtgaatactatagatacgcatactaaagaacaacaattctcgaatctagtaagatcttatcgtaaagaatacgtgggtaaaggacccaatagtattcgagtgtcgtttaaagataattgggcgattgcacatatgacaggtgttttgagtaaagttgagagtttttacctaaacgacaaacgcaatgaatcgatgctccattatacacgcacagagaagattaaacagatgtataaagaaatagatgtaaatgagatggaaagtcttgtaggcgctaagtttgtaaaattatttacagatattgatttgaatgatgatgaagtcatttcaatatttgttttcgataagtcaatagaa

SEQ ID NO: 2638 - protein, 119 aa, Staphylococcus aureus
  MISC_FEATURE (1)..(119): conserved hypothetical
VNTIDTHTKEQQFSNLVRSYRKEYVGKGPNSIRVSFKDNWAIAHMTGVLSKVESFYLNDKRNESMLHYTRTEKIKQMYKEIDVNEMESLVGAKFVKLFTDIDLNDDEVISIFVFDKSIE

SEQ ID NO: 2639 - DNA, 1035 bp, Staphylococcus aureus
atgatgatgactttagaaacgcttatcaaagaacaattagatcctcatttagtagaagttgatgaagggacgtattatccgagaacatttattcagcaattatttgtagatggttatttcggtgaggcggcattgagaaaaaatgctgaagtaatcgaagctgtatcgcagtcttgtttgacaacaggattttgtttatggtgccaattagctttttcaacgtatttagaaaatgccacgcagccacatttaaataatgacttacaacagcaattgttatctggagaaatattaggtgctaccggattgtctaatccgatgaagtcatttaatgatttagaaaagttgaaccttgaacacacttatgttgatggacaattggttgtcagtggacgtatgccagctgtaagtaatattcaagaagaccattattttggtgcgatttcgaaacatgaatcatcagatgaatttgtcatgttcattctacgtgccaatcaagatggtatcactcttgttgaaaaaaccaattttttaggagtcaacgggtcagcaacgtatcaaatcacattgaatcaagtcgtagtgccacaatcacaaattatcacgcatgatgcgaagcagtttgcggcaactattcgcccgcaatttattgcttaccaaattccaataggattaggctcaattaaaagttctttagagttaattgatgcattttcaaatgtgcaaaacggaataaatcaatatttagagtatgatgttgaagcttttaaaaaacgttatcgtcaacttagagaggaatattatgcaatattagatgacggtaacttaacttcacatttaaatgaattaatatcattgaagaaggacatcggctatttattgttagatgtaaatcaagcttctgttgtcaatggtggttctagagcgtacacaccatattcgccacaagttcgcaagttaaaagaaggattcttcttcgcagcattgacaccgacattaagacatttaggtaaacttgaagcagagttgaagggg

SEQ ID NO: 2640 - protein, 345 aa, Staphylococcus aureus
  MISC_FEATURE (1)..(345): hypothetical protein
MMMTLETLIKEQLDPHLVEVDEGTYYPRTFIQQLFVDGYFGEAALRKNAEVIEAVSQSCLTTGFCLWCQLAFSTYLENATQPHLNNDLQQQLLSGEILGATGLSNPMKSFNDLEKLNLEHTYVDGQLVVSGRMPAVSNIQEDHYFGAISKHESSDEFVMFILRANQDGITLVEKTNFLGVNGSATYQITLNQVVVPQSQIITHDAKQFAATIRPQFIAYQIPIGLGSIKSSLELIDAFSNVQNGINQYLEYDVEAFKKRYRQLREEYYAILDDGNLTSHLNELISLKKDIGYLLLDVNQASVVNGGSRAYTPYSPQVRKLKEGFFFAALTPTLRHLGKLEAELKG

SEQ ID NO: 2641 - DNA, 759 bp, Staphylococcus aureus
atgacacgtcccacaaataacaaatttatattacctattatcacatttattattttcttaggcatttgggaaatggtcattattattgggcattaccaacctgtattgttaccgggtcctgctcttgtaggaaaaagtatatggtctttcattgttactggagaaattttccaacatttagcaattagtttatggagatttgtagcgggctttgttgtcgcattgttggttgctattccattgggcttcttgcttggaaggaatcgttggctatacaacgctatcgaaccgctatttcaattgattaggccgatatctccgatagcatgggcaccatttgttgttctatggtttggtattggtagtttgccagcgattgcgattatttttatcgctgcttttttcccaattgtgttcaatactattaaaggcgttagagacattgaacctcaatatttaaaaatagcagcaaatttaaatttaactgggtggtcattgtatcgcaatatattatttcccggggcatttaaacaaatcatggctgggatacatatggcggtaggaacaagttggatatttttagtttctggtgaaatgattggtgcacaatcgggattaggttttttaatcgttgatgcacgaaatatgttgaacttagaagatgttttagcagcaatattctttatcggattatttggttttattattgatcgattcattagttatattgagcagtttatacttagaagatttggtgaa

SEQ ID NO: 2642 - protein, 253 aa, Staphylococcus aureus
  MISC_FEATURE (1)..(253): hypothetical protein
MTRPTNNKFILPIITFIIFLGIWEMVIIIGHYQPVLLPGPALVGKSIWSFIVTGEIFQHLAISLWRFVAGFVVALLVAIPLGFLLGRNRWLYNAIEPLFQLIRPISPIAWAPFVVLWFGIGSLPAIAIIFIAAFFPIVFNTIKGVRDIEPQYLKIAANLNLTGWSLYRNILFPGAFKQIMAGIHMAVGTSWIFLVSGEMIGAQSGLGFLIVDARNMLNLEDVLAAIFFIGLFGFIIDRFISYIEQFILRRFGE

SEQ ID NO: 2643 - DNA, 978 bp, Staphylococcus aureus
gtgacgatgaaaaggttaagcataatcgtcatcattggaatctttataattacaggatgtgattggcaaaggacgtctaaagaacggtctaaaaatgcccaaaatcagcaagtgattaaaattggatatttgccgattacacattcagctaatttgatgatgactaaaaaattattatcacaatacaatcatccgaaatataaactagaattagttaaattcaataattggccagatttaatggacgcattaaacagtggtcgtattgatggtgcatcaactttaatagagctagcgatgaaatcaaaacagaagggctcaaatataaaggctgtggcattgggccatcatgaaggcaatgtcattatgggacaaaaaggtatgcacttaaatgaatttaataataatggcgatgattaccattttggtataccacatcgttattcaacacattatcttttacttgaggaattacgtaaacaattaaagattaaaccggggcattttagctatcatgaaatgtcgccagcagaaatgccagccgcattgagtgaacacagaattacagggtattctgtagccgaaccattcggtgcactgggtgaaaagttaggcaaaggtaagactttgaaacatggtgatgacgttatacctgatgcgtattgctgtgtgctagtactgagaggggaattgcttgatcaacacaaggatgtagcgcaagcatttgtacaagattataaaaagtctggctttaaaatgaatgatcgcaagcaaagtgtagacattatgacgcatcattttaaacaaagtcgtgacgttttaacacagtcagcggcatggacatcctatggtgatttaacaattaagccatccggctatcaagaaattacgacattggtaaaacaacatcatttgtttaatccacctgcatatgatgactttgttgaaccgtcattgtataaggaggcatcgcgttca

SEQ ID NO: 2644 - protein, 326 aa, Staphylococcus aureus
  MISC_FEATURE (1)..(326): hypothetical protein
VTMKRLSIIVIIGIFIITGCDWQRTSKERSKNAQNQQVIKIGYLPITHSANLMMTKKLLSQYNHPKYKLELVKFNNWPDLMDALNSGRIDGASTLIELAMKSKQKGSNIKAVALGHHEGNVIMGQKGMHLNEFNNNGDDYHFGIPHRYSTHYLLLEELRKQLKIKPGHFSYHEMSPAEMPAALSEHRITGYSVAEPFGALGEKLGKGKTLKHGDDVIPDAYCCVLVLRGELLDQHKDVAQAFVQDYKKSGFKMNDRKQSVDIMTHHFKQSRDVLTQSAAWTSYGDLTIKPSGYQEITTLVKQHHLFNPPAYDDFVEPSLYKEASRS

SEQ ID NO: 2645 - DNA, 738 bp, Staphylococcus aureus
atgattaaaattcaacaattacaacatcactttggatcacataaagtaattcataactttaatttggacattagcaagggagaaatagtcactttcatagggaaaagtggttgcggaaagtctactttactcaatattatcggtggatttattcatccatcgtctggtcgtgtcattattgataacgaaattaaacaacagccatctccagattgtttaatgctatttcaacatcataatttgctgccatggaaaacgattaatgacaacattaggattggattacaacagaaaattagtgatgaagagattaacgcacagcttaaattagttgatttagaagacaggggaaagcattttcccgagcaactgtccgggggtatgaaacaacgtgtggcactatgtcgagcgcatgtgcataagcctaacgttatattgatggatgagccattaggtgcattagatgcatttacacgttataaacttcaggatcaactagtgcaactaaaacataaaacgcaatcaactattattttagtgacgcatgacattgatgaagctatttatctttccgaccgcattgttctgttaggtgaagggtgcaatattatttctcaatatgaaattacagcatcacatccacgcagtcgtaatgatagccacctacttaagattcgtaatgaaattatggaaacatttgcattgaatcatcatcaagttgaacctgaatattattta

SEQ ID NO: 2646 - protein, 246 aa, Staphylococcus aureus
  MISC_FEATURE (1)..(246): hypothetical protein
MIKIQQLQHHFGSHKVIHNFNLDISKGEIVTFIGKSGCGKSTLLNIIGGFIHPSSGRVIIDNEIKQQPSPDCLMLFQHHNLLPWKTINDNIRIGLQQKISDEEINAQLKLVDLEDRGKHFPEQLSGGMKQRVALCRAHVHKPNVILMDEPLGALDAFTRYKLQDQLVQLKHKTQSTIILVTHDIDEAIYLSDRIVLLGEGCNIISQYEITASHPRSRNDSHLLKIRNEIMETFALNHHQVEPEYYL

SEQ ID NO: 2647 - DNA, 510 bp, Staphylococcus aureus
atgacattatttttattagaagctaacaatcttgattttgcatcaacgaaagaagaactagaagcaaaggcagcatcactatctacgaagacaattccaacattaattgaagtacaagctactgaaaatttaactcatggttattttattgtggaagcaaatgacgaagcagaagctaaacaatttttaacagaagcagatattagtattcaattagtcaaagaagtacgcttagttggtaaagatttagatgaagttaaaaatggtgatgcacatgttgattaccttgtaacttggaacattccggaaggcattacgatggatcaatatttagcacgtaaaaagaaaaattctgttcattatgaagaagtgccagaagttgaatttaaacgcacatatgtatgtgaagatatgtctaaatgtatttgtttatacaacgcacctgatgaagaagcggtacgtcgcgcgcgcaaagcagttgatacaccgattgatggcatcgaaaaactt

SEQ ID NO: 2648 - protein, 170 aa, Staphylococcus aureus
  MISC_FEATURE (1)..(170): hypothetical protein
MTLFLLEANNLDFASTKEELEAKAASLSTKTIPTLIEVQATENLTHGYFIVEANDEAEAKQFLTEADISIQLVKEVRLVGKDLDEVKNGDAHVDYLVTWNIPEGITMDQYLARKKKNSVHYEEVPEVEFKRTYVCEDMSKCICLYNAPDEEAVRRARKAVDTPIDGIEKL

SEQ ID NO: 2649 - DNA, 3165 bp, Staphylococcus aureus
gtgataaaaaagctattacaattttctttagggaataagtttgctatctttttaatggttgttttagttgtcttgggcggtgtatatgcgagtgctaaattgaaattagaattactaccaaatgtacaaaatccagttatttcagttacaacaacaatgccgggtgcaacgccacaaagtacccaagatgaaataagtagtaaaattgacaatcaagtaagatcattggcatatgtgaaaaatgttaaaacgcaatccatacaaaatgcttcaattgtaacagttgaatatgaaaataatacagatatggataaagcagaagaacagcttaaaaaagaaatcgataaaattaaatttaaagatgaagttggtcaaccagaattaagacgtaattcgatggatgcttttccggttttagcatattcattttcaaataaagagaatgacttgaaaaaagtaacgaaagtactgaatgaacaattaataccaaaattgcaaacggtagatggtgtgcaaaatgcgcaattaaatgggcagacgaaccgtgaaatcacccttaaatttaagcaaaatgaacttgaaaaatatgggttgactgctgatgatgtagaaaactatctaaaaacggcaacaagaacaacgccacttggattgttccaatttggtgataaagataaatcaattgttgttgatggtcaatatcaatctgttgatgcttttaaaaacataaatattccattaacgttggcaggaggacaagggcaatctcaatcccaaagtgacaataaacaaaattcagccatgtcagacgttaatcaggcatcaccacagcaaaattcaaaagcgtcagcaccaaataatataagtggtatgccgacagcgaaactaggagatttagctgatattacagttggtgatgtgcgtacttctatttctaaaacgaatggaaaggatgcggttaatctacaaataactaaagctcaagatgccaatacagttcaagtagccaaagatgtacaacgtaaaattgatacattcgttgatgaaaataaagattttaatgtcacaaaaacaatggatactgcaaagcctgttgagaaatcactttatacgatggttgaaaaagcatcattaggtacaatcgtggcaattatagttattttgctgtttttaagaaacattcgtacgacggcaatttctattatatcgattccgttatcacttcttatggcgcttattgctctgaaattgagtgatgtttcattgaatatactaacgttaggtgcattaacagtagcgattggacgtgtgatagacgattcgattgtagttgttgaaaatatttatcgacgcttaacagattcagaagaacaactaaaaggtgaaaatttaattatcagtgcgacaactgaagtatttaaaccaataatgtcatcgacactagttactattatcgtcttcttaccacttgtgtttgtatcaggttcagtaggcgaaatgtttagaccttttgcattggctattgcatttagtttattagcatcgttattagtgtcaattacactcgttccagcgttggcagctacactatttaaaaaaggcgttaaacgtcgtaataaacaacatcaagaaggattaggtgttgttagtacaacttataaaaaagtattacattggtcattaaatcataagtggattgtaattatattaagtacattaattttggttgcaactattgtatttggaggaccgagactaggcactagctttatttcagcaggtgacgataaatttttagctattacttatacaccgaagcctggtgaaacggagcaagcagtgttgaatcatgcgaaagatgttgaaaaatatttaaaacagaaaaagcatgtaaaaacaattcaatactcagttggcggtagtagtccagtagatccaacgggtagtacaaatagtatggcaatcatggttgaatatgataatgacacgcctaattttgatgtagaagcggataaggttattaaacatgcagatggctttaaacatcctggagagtggaaaaatcaagatttaggaacaggtgcaggtaataaatctgtagaggttactgtaaaaggtccatcaatggatgccataaaatcaactgtaaaagatattgaacagaaaatgaaacaggttaaaggactagccaatgtcaaatctgatttatcgcaaacatatgatcagtatgaaattaaagtcgatcaaaataaagcggcagaaaatggtatttctgcaagtcaacttgcaatgcacttgaatgaaaacttaccagaaaaaacagttacgactgttaaagaaaatggtaaaactgttgatgttaaagtcaaacaaaataagcaaacagactggtcagaagataagttgaataatataactttgaaaaagccgactggtggtacgattaaattgggagatatcgctacgttagttaaaacaacgacaccaagtaaattgacgcaagaacaaggagattatgcaacgacggtatctgctaaagtaacaaataaagatgtgggtggcacaacacgacaagtgatgtctaaaataaataatttggataaaccgaataatgtaaaggttaatatcggtggtgcatcagatgatattaacaatgcaatgacacaattagcctttgcaatgttagctgcaatcattatcgtatatttaatcctagttattacatttaaaggtggcctagcaccatttacaattttattctctttaccatttacagttatcggtgtaattattgcactattaatcacaggagaaacaatatcagtaccaagtttaattggtatgctaatgttaattggaatcgtagtaacaaatgccattgtgttaatagaccgtgttattaataatgagcaacagggcatggagatgaaagaagcattaatcgaagcaggcggtactagaattagaccgatattaatgacggcgattgcaacaattggtgcattagttcctttgttatttggtcaagatagctcgattcttatttcgaaaggattagctgctacagttattggtggtttaatttcatcaactttattaacacttgtagttgtaccagtaatatatgaaattctctttactttaaaaaaacgattcactaaacga

SEQ ID NO: 2650 - protein, 1055 aa, Staphylococcus aureus
  MISC_FEATURE (1)..(1055): hypothetical protein
VIKKLLQFSLGNKFAIFLMVVLVVLGGVYASAKLKLELLPNVQNPVISVTTTMPGATPQSTQDEISSKIDNQVRSLAYVKNVKTQSIQNASIVTVEYENNTDMDKAEEQLKKEIDKIKFKDEVGQPELRRNSMDAFPVLAYSFSNKENDLKKVTKVLNEQLIPKLQTVDGVQNAQLNGQTNREITLKFKQNELEKYGLTADDVENYLKTATRTTPLGLFQFGDKDKSIVVDGQYQSVDAFKNINIPLTLAGGQGQSQSQSDNKQNSAMSDVNQASPQQNSKASAPNNISGMPTAKLGDLADITVGDVRTSISKTNGKDAVNLQITKAQDANTVQVAKDVQRKIDTFVDENKDFNVTKTMDTAKPVEKSLYTMVEKASLGTIVAIIVILLFLRNIRTTAISIISIPLSLLMALIALKLSDVSLNILTLGALTVAIGRVIDDSIVVVENIYRRLTDSEEQLKGENLIISATTEVFKPIMSSTLVTIIVFLPLVFVSGSVGEMFRPFALAIAFSLLASLLVSITLVPALAATLFKKGVKRRNKQHQEGLGVVSTTYKKVLHWSLNHKWIVIILSTLILVATIVFGGPRLGTSFISAGDDKFLAITYTPKPGETEQAVLNHAKDVEKYLKQKKHVKTIQYSVGGSSPVDPTGSTNSMAIMVEYDNDTPNFDVEADKVIKHADGFKHPGEWKNQDLGTGAGNKSVEVTVKGPSMDAIKSTVKDIEQKMKQVKGLANVKSDLSQTYDQYEIKVDQNKAAENGISASQLAMHLNENLPEKTVTTVKENGKTVDVKVKQNKQTDWSEDKLNNITLKKPTGGTIKLGDIATLVKTTTPSKLTQEQGDYATTVSAKVTNKDVGGTTRQVMSKINNLDKPNNVKVNIGGASDDINNAMTQLAFAMLAAIIIVYLILVITFKGGLAPFTILFSLPFTVIGVIIALLITGETISVPSLIGMLMLIGIVVTNAIVLIDRVINNEQQGMEMKEALIEAGGTRIRPILMTAIATIGALVPLLFGQDSSILISKGLAATVIGGLISSTLLTLVVVPVIYEILFTLKKRFTKR

SEQ ID NO: 2651 - DNA, 201 bp, Staphylococcus aureus
atggataaagaatctgtcgtagcaagtttagctagaaacaaaaagattgctgtagaaacaatggccggtcaaaggtacatcatagaacgcattttacatacaaatgatgaaaaacatattcatattttgaaacctaaagatgtcgtgttagatgtagatagcatcaaagaaattgacgaaaatcatttaaatgatgcaaca

SEQ ID NO: 2652 - protein, 67 aa, Staphylococcus aureus
  MISC_FEATURE (1)..(67): hypothetical protein
MDKESVVASLARNKKIAVETMAGQRYIIERILHTNDEKHIHILKPKDVVLDVDSIKEIDENHLNDAT

SEQ ID NO: 2653 - DNA, 957 bp, Staphylococcus aureus
atgaatgggaaaaaggcgaatacgataaacagatacaaatattttcatcatgtcaatcatcaaaaaattcaacaaagttctaaaaagacgctgtgggcatcactaatcatcacattgttatttacagtgattgaatttgtcggaggtttagtatctaattcattggcattactgtcagattcatttcatatgcttagtgatgtattagcacttggtttatctatgttggccatttattttgcaagtaaaaagccgactgcacgatacacatttggatatttaagatttgagatattagctgcatttttaaatggtttagcattaattgtaatttcaatctggattttatatgaagctattgtacgtattatttatccgcaaccaattgaaagtggcattatgtttatgattgctagtattggtttactcgtcaatattattttgactgttatccttgtaaggtctttaaaacaagaagacaatatcaatattcaaagtgcattatggcatttcatgggagacttattgaactctattggtgtcatcgttgcagttgtattgatttactttacaggatggcgcatcatcgacccaatcattagtattgtaatttcactcatcattttacgtggtggttataaaattacgcgtaatgcgtggttaattttaatggaaagtgtgcctcaacatttggatactgatcaaattatggcagatattaaaaacatagatggcatattagatgtacatgaatttcatttgtggagtattacaacagagcattattcattaagtgcccatgttgtgttagataaaaaatatgagggtgatgattatcaagcgattgatcaagtatcatcattgttgaaagaaaaatatggcattgcacattcaacgttgcaaattgaaaacttgcaattgaatccattagatgagccatacttcgacaaattaaca

SEQ ID NO: 2654 - protein, 319 aa, Staphylococcus aureus
  MISC_FEATURE (1)..(319): hypothetical protein
MNGKKANTINRYKYFHHVNHQKIQQSSKKTLWASLIITLLFTVIEFVGGLVSNSLALLSDSFHMLSDVLALGLSMLAIYFASKKPTARYTFGYLRFEILAAFLNGLALIVISIWILYEAIVRIIYPQPIESGIMFMIASIGLLVNIILTVILVRSLKQEDNINIQSALWHFMGDLLNSIGVIVAVVLIYFTGWRIIDPIISIVISLIILRGGYKITRNAWLILMESVPQHLDTDQIMADIKNIDGILDVHEFHLWSITTEHYSLSAHVVLDKKYEGDDYQAIDQVSSLLKEKYGIAHSTLQIENLQLNPLDEPYFDKLT

SEQ ID NO: 2655 - DNA, 1485 bp, Staphylococcus aureus
atggcagtaaacgttcgagattatattgcagagaattatggtttatttatcaatggggaatttgttaaaggtagcagtgacgaaacaatcgaagtgactaatccagcaactggagaaacactatcacatattacaagagcaaaagataaagatgtcgatcatgcagtcaaagtggcgcaagaggcatttgaatcatggtcattaacttctaaatcagaacgtgcacaaatgttgcgtgatattggtgataaattaatggcacaaaaagataaaattgcaatgattgaaacattaaataatggtaaaccgattcgtgagacaacagcaattgatattccatttgctgcaagacatttccattatttcgcaagtgttattgaaacagaagaaggtacagtgaatgatatcgataaagacacaatgagtatcgtacgacatgagccgattggcgtcgtaggtgctgttgttgcttggaacttcccaatgctattagctgcatggaagattgcgccagccattgctgcaggtaatacaattgtgattcaaccttcgtcttcaacaccattaagtttattggaagttgctaaaattttccaagaggtattacctaaaggtgttgtcaatatactaacgggtaaaggttcagaatcaggtaatgcaattttcaatcatgatggtgtagataaattatcatttacgggctcaactgatgtaggttatcaagttgccgaagctgcagcaaaacatctagtacccgctacattagagcttggtggtaaaagcgccaatatcatattagatgatgctaatttagaccttgcagttgaaggtattcagttaggtattttattcaaccaaggtgaagtatgtagtgcaggttctcgattattagttcatgaaaaaatttatgatcaattggtgccacgtttacaagaggcattttcaaatattaaagttggaaatccacaagatgaagctacacaaatgggtagtcaaactggtaaggatcaattagataaaattcaatcatatattgatgcagcaaaagaatcagatgcacaaattttagcaggcggtcatcgcttaactgaaaatggattagataaagggttcttctttgagccgacattaattgctgtgccagacaatcatcacaaattagcacaagaagaaatatttggaccagtgttaacagtgattaaagtgaaggacgatcaagaagcaattgatatagctaatgattctgagtatggtttagcaggcggtgtattttctcaaaatatcacacgtgcattaaatattgctaaagctgtacgtacaggacgtatttggattaacacttacaaccaagtaccagaaggcgcaccatttggtggttataaaaaatcaggtatcggtcgagaaacttataaaggtgcgttaagtaactatcaacaagttaaaaatatttatattgatacaagcaatgctttaaaaggtttgtac

SEQ ID NO: 2656 - protein, 495 aa, Staphylococcus aureus
  MISC_FEATURE (1)..(495): aldehyde dehydrogenase
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGNPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 2657 - DNA, 381 bp, Staphylococcus aureus
atgcgacttattttaatcgtcattggcttaatatttacagcgcttggtattgcaggtgccgtattacctttactgccaacgaccccttttttactcgtagcagttttttgctttgctcgaagttcagatcgcttttacaattggcttattaatcaaaaaatttataaagaatatgtagaaaacttttatttacatcgaggctacacgctacaacagaaaattaaaattttaattagcttatacattgtaataggtttttcaatttatatggtggatgttcttgcagtccgtgtaggattaatcataatggttatcatacaaaccgctgtactctttacatttgtaaaaacattacccaaatcaaatcataaaatagaggag

SEQ ID NO: 2658 - protein, 127 aa, Staphylococcus aureus
  MISC_FEATURE (1)..(127): conserved hypothetical
MRLILIVIGLIFTALGIAGAVLPLLPTTPFLLVAVFCFARSSDRFYNWLINQKIYKEYVENFYLHRGYTLQQKIKILISLYIVIGFSIYMVDVLAVRVGLIIMVIIQTAVLFTFVKTLPKSNHKIEE

SEQ ID NO: 2659 - DNA, 330 bp, Staphylococcus aureus
ttgcccatgtttatggcagaaaatagattacaattacaaaaaggcagtgcggaagaaacgattgaacgtttttacaatagacaaggtattgaaactattgaaggcttccaacaaatgtttgtcactaaaacattaaataccgaggatacagacgaagttaaaatcttaactatttgggaatctgaagatagctttaataattggttgaattccgatgtatttaaagaagctcataaaaatgtacgtttaaaaagtgatgacgatggacagcaaagtccaatattatcaaataaagtattcaaatatgatattggctaccactatcaaaaa

SEQ ID NO: 2660 - protein, 110 aa, Staphylococcus aureus
  MISC_FEATURE (1)..(110): conserved hypothetical
LPMFMAENRLQLQKGSAEETIERFYNRQGIETIEGFQQMFVTKTLNTEDTDEVKILTIWESEDSFNNWLNSDVFKEAHKNVRLKSDDDGQQSPILSNKVFKYDIGYHYQK

SEQ ID NO: 2661 - DNA, 1173 bp, Staphylococcus aureus
atgtgtttgaacttcagagaggataatgttatgaaaaaaattatggttattttcggtacgagacccgaagcaataaaaatggcaccattagtaaaagaaattgatcataatgggaactttgaagcgaacattgtgattacagcacaacatagagatatgttagatagtgtgttaagtatatttgatattcaagctgatcatgatttaaatattatgcaagatcaacaaacattagcaggccttacggcgaatgcacttgctaaacttgatagcatcattaatgaggaacaaccggatatgattttagtacatggtgatactacaacgacttttgtaggaagtttggcagcattttatcatcaaattccggtcggacatgtagaagctggacttcgaacacatcagaaatactcaccatttcctgaagagttaaatcgagtcatggtaagtaatattgctgaattgaattttgcgccaacagtaattgcagctaaaaatttactttttgaaaacaaagacaaagagcgtatctttattactggaaatacagttattgacgcattgtcaacaacagttcaaaatgattttgtttcaacgattattaataaacataaaggcaagaaagttgttttactaacagcgcatcgtcgtgaaaatattggggaaccgatgcatcagatttttaaagcagtaagagatttggcagatgaatataaagatgttgtcttcatttatccaatgcatcgtaatctaaaggtaagagcgattgccgaaaaatatttatctgggagaaatcggattgaattaattgagccattagatgcgattgagttccataattttacaaatcaatcgtacctcgtgctgacagattctggtggtattcaagaggaggctcctacatttggaaaacctgtgttggtattaaggaatcatacagagcgtcccgaaggcgttgaggcgggaacatcgagagtaattggcacagattatgacaatattgttcgaaatgtgaaacaattgattgaggatgatgaagcgtatcaacgtatgagtcaagcgaataatccatatggtgatggacaagcatcacgacgtatttgtgaagcaatagaatattattttggattgcgcacagacaagccggatgaattcgtacctttacgtcacaaa

SEQ ID NO: 2662 - protein, 391 aa, Staphylococcus aureus
  MISC_FEATURE (1)..(391): capsular polysaccharide
MCLNFREDNVMKKIMVIFGTRPEAIKMAPLVKEIDHNGNFEANIVITAQHRDMLDSVLSIFDIQADHDLNIMQDQQTLAGLTANALAKLDSIINEEQPDMILVHGDTTTTFVGSLAAFYHQIPVGHVEAGLRTHQKYSPFPEELNRVMVSNIAELNFAPTVIAAKNLLFENKDKERIFITGNTVIDALSTTVQNDFVSTIINKHKGKKVVLLTAHRRENIGEPMHQIFKAVRDLADEYKDVVFIYPMHRNLKVRAIAEKYLSGRNRIELIEPLDAIEFHNFTNQSYLVLTDSGGIQEEAPTFGKPVLVLRNHTERPEGVEAGTSRVIGTDYDNIVRNVKQLIEDDEAYQRMSQANNPYGDGQASRRICEAIEYYFGLRTDKPDEFVPLRHK

SEQ ID NO: 2663 - DNA, 1260 bp, Staphylococcus aureus
atgaagttaacagtagttggcttaggttatattggtttaccaacatcaattatgtttgcaaaacatggcgtcgatgtgcttggtgttgatattaatcagcaaacgattgataagttacaaagtggtcaaattagtattgaagaacctggattacaagaggtttatgaagaggtactgtcatcgggaaaattgaaggtatctacaacgccagatgcatctgatgtttttatcattgccgttccgacgccgaataatgatgatcagtaccggtcatgtgacatttcgctagttatgcgtgcattagatagtattttatcatttttagaaaaaggaaataccattattgtagagtcgacaattgcgcctaaaacgatggatgattttgtaaaaccagtcattgaaaatttagggtttacaataggtgaagatatttatttagtgcattgtccagaacgtgtactgccaggaaaaattttagaagaattagttcataacaatcgtatcattggcggtgtgactgaagcttgtattgaagcgggtaaacgtgtctatcgcacattcgttcagggagaaatgattgaaacagatgcacgtactgctgaaatgagtaagctaatggaaaacacatatagagacgtgaacattgctttagctaatgaattaacaaaaatttgcaataacttaaatattaatgtattagatgtgattgaaatggcaaacaaacatccgcgtgttaacatccatcagcctggtccaggtgtaggcggtcattgtttagctgttgatccgtactttattattgctaaagaccctgaaaatgcaaagttaattcaaactggacgtgaaattaataattcaatgccggcctatgttgttgatacaacgaagcaaatcatcaaagtgttgagcgggaataaagtcacagtatttggtttaacttataaaggtgatgttgatgatataagagaatcaccagcatttgatatttatgagctattaaatcaagaaccagacatagaagtatgtgcttatgatccacatgttgaattagattttgtggaacatgatatgtcacatgctgtcaaagacgcatcgctagtattgattttaagtgaccactcagaatttaaaaatttatcggacagtcattttgataaaatgaagcataaagtgatttttgatacaaaaaatgttgtgaaatcatcatttgaagatgtatcgtattataattatggcaatatatttaattttatcgacaaa

SEQ ID NO: 2664 - protein, 420 aa, Staphylococcus aureus
  MISC_FEATURE (1)..(420): capsular polysaccharide
MKLTVVGLGYIGLPTSIMFAKHGVDVLGVDINQQTIDKLQSGQISIEEPGLQEVYEEVLSSGKLKVSTTPDASDVFIIAVPTPNNDDQYRSCDISLVMRALDSILSFLEKGNTIIVESTIAPKTMDDFVKPVIENLGFTIGEDIYLVHCPERVLPGKILEELVHNNRIIGGVTEACIEAGKRVYRTFVQGEMIETDARTAEMSKLMENTYRDVNIALANELTKICNNLNINVLDVIEMANKHPRVNIHQPGPGVGGHCLAVDPYFIIAKDPENAKLIQTGREINNSMPAYVVDTTKQIIKVLSGNKVTVFGLTYKGDVDDIRESPAFDIYELLNQEPDIEVCAYDPHVELDFVEHDMSHAVKDASLVLILSDHSEFKNLSDSHFDKMKHKVIFDTKNVVKSSFEDVSYYNYGNIFNFIDK

SEQ ID NO: 2665 - DNA, 885 bp, Staphylococcus aureus
atgagaaaaaatattttaattacaggcgtacatggatatatcggtaatgctttaaaagataagcttattgaacaaggacatcaagtagatcaaattaatgttaggaatcaattatggaagtcgacctcgttcaaagattatgatgttttaattcatacagcagctttggttcacaacaattcacctcaagcaaggctatctgattatatgcaagtgaatatgttgctgacgaaacaattggcacaaaaggctaaagctgaagacgttaaacaatttatttttatgagtactatggcagtttatggaaaagaaggtcatgttggtaaatcagatcaagttgatacacaaacaccaatgaaccctacgaccaactatggtatttccaaaaagttcgctgaacaagcattacaagaattgattagtgattcgtttaaagtagcaattgtgagaccaccaatgatttatggtgcacattgcccaggaaatttccaacggttaatgcaattgtcaaagcgattgccaatcattcccaatattaacaatcagcgcagtgcattatatattaaacatctgacagcatttattgatcaattaatatcattagaagtgacaggtgtgtaccatcctcaagatagtttttactttgatacatcgtcagtaatgtatgaaatacgtcgccaatcacatcgtaaaacggtattgatcaacatgccttcaatgctaaataagtattttaataagttgtcggtctttagaaaattattcggcaatttaatatacagcaatacgttatatgaaaataataatgcacttgaaattattcctggaaaaatgtcacttgttattgcggacatcatggatgaaacgacaaccaaagataaggca

SEQ ID NO: 2666 - protein, 295 aa, Staphylococcus aureus
  MISC_FEATURE (1)..(295): capsular polysaccharide
MRKNILITGVHGYIGNALKDKLIEQGHQVDQINVRNQLWKSTSFKDYDVLIHTAALVHNNSPQARLSDYMQVNMLLTKQLAQKAKAEDVKQFIFMSTMAVYGKEGHVGKSDQVDTQTPMNPTTNYGISKKFAEQALQELISDSFKVAIVRPPMIYGAHCPGNFQRLMQLSKRLPIIPNINNQRSALYIKHLTAFIDQLISLEVTGVYHPQDSFYFDTSSVMYEIRRQSHRKTVLINMPSMLNKYFNKLSVFRKLFGNLIYSNTLYENNNALEIIPGKMSLVIADIMDETTTKDKA

SEQ ID NO: 2667 - DNA, 555 bp, Staphylococcus aureus
atgaagcgattattcgatgtagtgagttcaatatatggtttagtagttttaagtccgattctgttaattacagcattactaattaaaatggaatcacctggaccagccattttcaaacaaaaaagaccgacgattaataatgaattgtttaatatttataagtttagatcaatgaaaatagacacacctaatgttgcaactgatttaatggattcaacatcgtatataacaaagacagggaaggtcattcgtaagacctctattgatgaattgccacaattattgaatgttttaaaaggagaaatgtcaattgtaggtcctagaccagcgctttataatcaatacgaattaatcgaaaaacgtacaaaagcgaacgtgcatacgattagaccaggtgtgacaggactagctcaagtgatggggagagatgatatcactgatgatcaaaaagtagcgtatgatcattattacttaacacatcaatctatgatgcttgatatgtatatcatatataaaacaattaaaaatatcgttacttcagaaggtgtgcatcac

SEQ ID NO: 2668 - protein, 185 aa, Staphylococcus aureus
  MISC_FEATURE (1)..(185): capsular polysaccharide
MKRLFDVVSSIYGLVVLSPILLITALLIKMESPGPAIFKQKRPTINNELFNIYKFRSMKIDTPNVATDLMDSTSYITKTGKVIRKTSIDELPQLLNVLKGEMSIVGPRPALYNQYELIEKRTKANVHTIRPGVTGLAQVMGRDDITDDQKVAYDHYYLTHQSMMLDMYIIYKTIKNIVTSEGVHH

SEQ ID NO: 2669 - DNA, 1263 bp, Staphylococcus aureus
atggaaaagatgcatatcactaatcaggaacatgacgcatttgttaaatcccacccaaatggagatttattacaattaacgaaatgggcagaaacaaagaaattaactggatggtacgcgcgaagaatcgctgtaggtcgtgacggtgaagttcagggtgttgcgcagttactttttaaaaaagtacctaaattaccttatacgctatgttatatttcgcgtggttttgttgttgattatagtaataaagaagcgttaaatgcattgttagacagtgcaaaagaaattgctaaagctgagaaagcgtatgcaattaaaatcgatcctgatgttgaagttgataaaggtacagatgctttgcaaaatttgaaagcgcttggttttaaacataaaggatttaaagaaggtttatcaaaagactacatccaaccacgtatgactatgattacaccaattgataaaaatgatgatgagttattaaatagttttgaacgccgaaatcgttcaaaagtgcgcttggctttaaagcgaggtacgacagtagaacgatctgatagagaaggtttaaaaacatttgctgagttaatgaaaatcactggggaacgcgatggcttcttaacgcgtgatattagttactttgaaaatatttatgatgcgttgcatgaagatggagatgctgaactatttttagtaaagttggatccaaaagaaaatatagcgaaagtaaatcaagaattgaatgaacttcatgccgaaattgctaaatggcagcagaagatgaaaacatctgaaaagcaagctaaaaaagcgcaaaatatgattaatgatgcgcaaaataaaattgctaaaaatgaagatttaaaacgagacctagaagctttagaaaaggaacatcctgaaggtatttatctttctggtgcactattaatgtttgctggctcaaaatcatattacttatatggtgcgtcttctaatgaatttagagattttttaccaaatcatcatatgcagtatacgatgatgaagtatgcacgtgaacatggtgcaacaacttacgatttcggtggtacagataatgatccagataaagactcagaacattatggattatgggcatttaaaaaagtgtggggaacatacttaagtgaaaagattggtgaatttgattatgtattgaatcagccattgtaccaattaattgagcaagttaaaccgcgtttaacaaaagctaaaattaaaatatctcgtaaattaaaacgaaaa

SEQ ID NO: 2670 - protein, 421 aa, Staphylococcus aureus
  MISC_FEATURE (1)..(421): FmhB protein
MEKMHITNQEHDAFVKSHPNGDLLQLTKWAETKKLTGWYARRIAVGRDGEVQGVAQLLFKKVPKLPYTLCYISRGFVVDYSNKEALNALLDSAKEIAKAEKAYAIKIDPDVEVDKGTDALQNLKALGFKHKGFKEGLSKDYIQPRMTMITPIDKNDDELLNSFERRNRSKVRLALKRGTTVERSDREGLKTFAELMKITGERDGFLTRDISYFENIYDALHEDGDAELFLVKLDPKENIAKVNQELNELHAEIAKWQQKMKTSEKQAKKAQNMINDAQNKIAKNEDLKRDLEALEKEHPEGIYLSGALLMFAGSKSYYLYGASSNEFRDFLPNHHMQYTMMKYAREHGATTYDFGGTDNDPDKDSEHYGLWAFKKVWGTYLSEKIGEFDYVLNQPLYQLIEQVKPRLTKAKIKISRKLKRK

SEQ ID NO: 2671 - DNA, 1203 bp, Staphylococcus aureus
atgagtgaaaaaaagattttgattttatgtcagtatttttatccggaatatgtatcttctgcgacgttaccaactcaattggcggaagatttaattgcgaatcacattaatgtcgatgtcatgtgtggatggccatatgaatatagtaatcataaacaggtttctaaaaccgagatgcatcgtggtattcgcattcgacgtctcaagtattcgaggtttaataacaaaagtaaggttggaaggatcatcaatttctttagtttattttcaaaattcgtgattaatatacctaaaatgttgaaatatgatcagattcttgtttactctaatccaccaatcttgccattaataccagacgttttacacagactgcttaagaaaaaatattcttttgtggtgtatgatatagcacctgataatgcgattaagacaggtgcaactcgtccaggtagcatgattgataagctgatgcgttacattaatagacatgtctacaagaatgctgaaaatgtcattgtccttggtacggaaatgaaaaactacttactaaatcatcaaatttctaaaaatgctgacaatatccatgtgattcctaactggtatgacatgcgtcaattacaagacaatcgtatctataatgacacatttaaagcttaccgtgagcaatacgacaaaattttattgtatagcggtaatatggggcagttacaggatatggagacacttatctcatttttaaaattaaataaggatcagtctcaaacgttaacaatactttgtggtcatggtaagaaatttgcagatgtcaaaacggcaatagaagaccatcgtattgaaaatgttaaaatgtttgagtttttaacaggtacagactatgctgacgtattaaaaattgcggatgtatgtattgcatcgctgattaaagaaggcgtcggtttaggcgtgccgagcaagaattatggctatcttgcagctaagaaagcgttggtactcatcatggataagcaatctgatatcgttcaacatgttgaacaatatgatgcgggtatccaaattgataatggcgatgcacatgccatttataacttcatcaacactcactcgagtaaggaattgcacgagatgggtgagcgcgcacatcaactgtttaaagataaatatacgagagaaattaatactatgaagtattacaatctgttgaag

SEQ ID NO: 2672 - protein, 401 aa, Staphylococcus aureus
  MISC_FEATURE (1)..(401): capsular polysaccharide
MSEKKILILCQYFYPEYVSSATLPTQLAEDLIANHINVDVMCGWPYEYSNHKQVSKTEMHRGIRIRRLKYSRFNNKSKVGRIINFFSLFSKFVINIPKMLKYDQILVYSNPPILPLIPDVLHRLLKKKYSFVVYDIAPDNAIKTGATRPGSMIDKLMRYINRHVYKNAENVIVLGTEMKNYLLNHQISKNADNIHVIPNWYDMRQLQDNRIYNDTFKAYREQYDKILLYSGNMGQLQDMETLISFLKLNKDQSQTLTILCGHGKKFADVKTAIEDHRIENVKMFEFLTGTDYADVLKIADVCIASLIKEGVGLGVPSKNYGYLAAKKALVLIMDKQSDIVQHVEQYDAGIQIDNGDAHAIYNFINTHSSKELHEMGERAHQLFKDKYTREINTMKYYNLLK

SEQ ID NO: 2673 - DNA, 1254 bp, Staphylococcus aureus
gtgaattttggtttgtgttgttctattttattacaaaaggacggcgtcatcatggctaagaaagtttttattatggatagcgtaaagacaataattggtacgttgcttatagctttaggattacaatttttagcttatccaattattaatcaacgagtaggtaatgaagcgttcggttctattttaacgatttatacaataataacaatcacgagtgttgtattaggcaatacgcttaacaatatacgattgattaatatgaatctatacaaatccaatcattactactggaaatttgcatcgatacttttaatctcaattctgattgagagtatagctttaattattgtatttctttacttttttaatttgaacatcatcgatattatctttttaattctacttaatattttaatgtgtttaaggatttatctgaatgtattttttaggatgactttaaaatataatcagattttgtatattgctcttattcaatttttaggtttgctgataggactatttctatattatttaacccaaaactggattgtttgttttattaccagtgaattgtttgcaacgatatatacattggttaaattacggggattaactataggcgagtatcaaagtgaagataataatgtggtaaaagattatgtgatgctactgagtacaaatagccttaataatttgaatctctatttagatagattaatcttattaccaattataggtggaacagctgtaactatatcatttctttcaacatttattgggaaaatgttagctacatttctatatccgattaataatgtagtactttcatatatttctgtaaatgaaagtgacaatataaagaagcaatatttgaaaactaatctaattgctatagctgccctatgtttagtcatgattatatgttatccaattacaataattattgtctctttactgtataacattgattcaagtttatattcgaagtttattattttaggtaatataggtgttttattcaatgcagtgagtattatgatccaaactttaaatacaaaacacgcatcaataacattacaagcgaattatatgacgcttcacacgattacatttatattcataactattttaatgacaattgcgtttggtctaaatggattcttttggacaacgctgttcagcaacattattaagtatgtgattttaaatattataggtttaaagtctaaattcattaataaaaaggacgtcgat

SEQ ID NO: 2674 - protein, 418 aa, Staphylococcus aureus
  MISC_FEATURE (1)..(418): capsular polysaccharide
VNFGLCCSILLQKDGVIMAKKVFIMDSVKTIIGTLLIALGLQFLAYPIINQRVGNEAFGSILTIYTIITITSVVLGNTLNNIRLINMNLYKSNHYYWKFASILLISILIESIALIIVFLYFFNLNIIDIIFLILLNILMCLRIYLNVFFRMTLKYNQILYIALIQFLGLLIGLFLYYLTQNWIVCFITSELFATIYTLVKLRGLTIGEYQSEDNNVVKDYVMLLSTNSLNNLNLYLDRLILLPIIGGTAVTISFLSTFIGKMLATFLYPINNVVLSYISVNESDNIKKQYLKTNLIAIAALCLVMIICYPITIIIVSLLYNIDSSLYSKFIILGNIGVLFNAVSIMIQTLNTKHASITLQANYMTLHTITFIFITILMTIAFGLNGFFWTTLFSNIIKYVILNIIGLKSKFINKKDVD

SEQ ID NO: 2675 - DNA, 1164 bp, Staphylococcus aureus
atgaaattttttgtactttgtgcaattatcagcatgaacatatttatagtaatctctacatttactaaagaagtattagggttccctatagagccggtgtattactcaaccatggttggtatagcattaattactacggtgtttgctatttataagataattgtcacccaagaaattccgcgagggttaatattattaattgctatatgtttgctttatctagctttttattatttttcaccagataaggaagagaaactagctaaaaataatattctattctttttaacatgggcagttccagcggcaattagtggtatttatattaaatatataaacaaggctacggtagaaagattttttaaattagtatttttcatattttctgtttcatttatttttgtaattttaataccaaaacttacaggtgagatacctagctatatcaattttggacttatgaactatcaaaacgcttcgtacctttcagcatttactgccggattaggcatttatttcattatgaaaggttcagttaaacataagtggatatatgttctatttacaataattgatatccctattgtgtttataccaggagggcgtggaggtgctattttattaattctttacggcttatttgcatttatacttattacgtttaaaagaggaatacctatcgcagtaaaaagcattatgtatatttttgcattaagcatatctagtgtattgatttactttctttttacaaaaggttcgaatactagaacattttcatatctacaaggtggaacacttaatttagaaggtacttctggaagaggaccgatttatgaaaaaggtatttactttattcaacaaagttcgttattaggctatgggccatttaactattataaactaatcggaaatataccacataacatcattattgagttgattctatcatttggcttattagggttttttatcataatgatttgcattttgctactagtttataaaatgattaggaactatgatccaaacactatagatttactcgttatgtttatagcaatctatccaatcacattattaatgtttagttcaaattatttagttgtaagtgaattttggtttgtgttgttctattttattacaaaaggacggcgtcatcatggc

SEQ ID NO: 2676 - protein, 388 aa, Staphylococcus aureus
  MISC_FEATURE (1)..(388): capsular polysaccharide
MKFFVLCAIISMNIFIVISTFTKEVLGFPIEPVYYSTMVGIALITTVFAIYKIIVTQEIPRGLILLIAICLLYLAFYYFSPDKEEKLAKNNILFFLTWAVPAAISGIYIKYINKATVERFFKLVFFIFSVSFIFVILIPKLTGEIPSYINFGLMNYQNASYLSAFTAGLGIYFIMKGSVKHKWIYVLFTIIDIPIVFIPGGRGGAILLILYGLFAFILITFKRGIPIAVKSIMYIFALSISSVLIYFLFTKGSNTRTFSYLQGGTLNLEGTSGRGPIYEKGIYFIQQSSLLGYGPFNYYKLIGNIPHNIIIELILSFGLLGFFIIMICILLLVYKMIRNYDPNTIDLLVMFIAIYPITLLMFSSNYLVVSEFWFVLFYFITKGRRHHG

SEQ ID NO: 2677 - DNA, 1107 bp, Staphylococcus aureus
atgagaattttaaatattgtatcgagtaatattgttcaagacccaagggtacttaaacaaatagaaacaattaaaggcgttacggatgattataaaattgttggaatgaataattcacaagctactaataagcgattggaaaatttagattgtaattatcgtttgttaggtagcaaggtagatccaaaaaatattctttctaaattaattaagcgtataagatttgcaacaggtgttatccgagaaattaaagcttataaacctgacgtgattcatgcaaatgatttcgacgtattattaatggtctatttaagcaattataaaaaagctaatattgtttatgatgcgcatgaaatatatgcgaaaaatgcctttattaataaagttccacttatttcaaagtttgtagaaagtatagaaaaacacatagtaaaacatcgtgttaatgccttcgtaacagtaagtcatgcagcaaaagaatattatcaatctaaaggatataagaaggaagcgaatgttattacgaatgcacctattttaaatgatagcagagaatttaaagaaatcgaaaactttaaagaaattgtatatcaaggtcaaattgtaatggacagaggatatgaagagtttattattgcttcatcagcttttaaacaaaatgctccttcattcataattcgagggtttggtccgcatgaagaagtgataaaagaactgattagttataacccggaaaatattaggttggataaaccagttgaagtaaaagaattggttgataagttagcagaaagtaatgttggtgttgtcttgacgaaaccagtatctattaattttgaatatacagtatctaataaaatttttgaatgtatacatgctggtttaccagtaattttatctcctgtcaaagagcatatttatctcaatgaaaaatataaatttggcattgttctaaaggaagttacgccgttagaaattgaaaaggcggttagaaaattaagagataatcacgatttgtttaatcatttacgtcaaaatgcaattaaggcgtctaaaattttgaattggcaaatagagagtgaacggttagtagaattatataaattt

SEQ ID NO: 2678 - protein, 369 aa, Staphylococcus aureus
  MISC_FEATURE (1)..(369): capsular polysaccharide
MRILNIVSSNIVQDPRVLKQIETIKGVTDDYKIVGMNNSQATNKRLENLDCNYRLLGSKVDPKNILSKLIKRIRFATGVIREIKAYKPDVIHANDFDVLLMVYLSNYKKANIVYDAHEIYAKNAFINKVPLISKFVESIEKHIVKHRVNAFVTVSHAAKEYYQSKGYKKEANVITNAPILNDSREFKEIENFKEIVYQGQIVMDRGYEEFIIASSAFKQNAPSFIIRGFGPHEEVIKELISYNPENIRLDKPVEVKELVDKLAESNVGVVLTKPVSINFEYTVSNKIFECIHAGLPVILSPVKEHIYLNEKYKFGIVLKEVTPLEIEKAVRKLRDNHDLFNHLRQNAIKASKILNWQIESERLVELYKF

SEQ ID NO: 2679 - DNA, 639 bp, Staphylococcus aureus
ttggaggaaatgacgatgaggatagcgattgaaaagataattggtttgctgaaaaaccagtcctctaaagaatcgaatgttaagattcatcgcttggcgtatattacaaactcaaaatttgatggcaataactatatagatagatggtgtaaaatcaggaattctcacattggtgaatacagttatattggatttggtagtgattttaataatgtagaagtaggaagatattgttcgatatcttcggatgtaaaaattgggttaggaaaacatcctacacacttttttagctcatcaccgattttttattctaataataatccatttaacataaagcaaaagtttatagactttaatgaccaaccaagccgtacaacaattaaaaatgatgtgtggattggtgcaaatgtaattattatggatggtttaacaataaatactggtgcagtcatagcagccggctcagttgttactaaaaatgtaggagcatatgaggttgttggtggtgttcctgcaaaagtgattaagaagcgatttgacaataaaacaattgaaaaacttttggaaagcaagtggtgggagaaaacgcctgacaaactaaaaggattttcggttgaatatttaaataaaaaggatact

SEQ ID NO: 2680 - protein, 213 aa, Staphylococcus aureus
  MISC_FEATURE (1)..(213): capsular polysaccharide
LEEMTMRIAIEKIIGLLKNQSSKESNVKIHRLAYITNSKFDGNNYIDRWCKIRNSHIGEYSYIGFGSDFNNVEVGRYCSISSDVKIGLGKHPTHFFSSSPIFYSNNNPFNIKQKFIDFNDQPSRTTIKNDVWIGANVIIMDGLTINTGAVIAAGSVVTKNVGAYEVVGGVPAKVIKKRFDNKTIEKLLESKWWEKTPDKLKGFSVEYLNKKDT

SEQ ID NO: 2681 - DNA, 1122 bp, Staphylococcus aureus
atggaaaaactgaaattaatgacaatagttggtacaaggcctgaaatcattcgtttatcatcaacgattaaagcatgtgatcaatattttaatcagatattagtacacactggtcaaaattatgattatacattgaatcaaattttctttgatgatttggaattaagacaaccggaccactacttagaggcagttggaagtaaccttggagaaacgatggggaatattattgcgaagacatatgatgttttattacgcgaacaaccagatgcacttttaattcttggtgatacaaatagttgtttagcagcagtatctgctaaacgattaaagattcctgtgttccacatggaagcgggtaatagatgctttgatcagaatgtacctgaagaaatcaatcgtaaaattgttgaccatgtcagtgatgtgaatctaccttatacggaacatagcagacgttatttattagatgaaggcttcaataaagcgaatatctttgtgacaggatcaccgatgacagaagtgatagaagcgcatcgagataaaattaatcacagtgacgttttaaataaactaggattagaaccgcaacaatacattttagtatctgcgcatagagaagagaatatcgataatgaaaagaattttaaatcattaatgaatgcgataaatgatattgccaaaaagtataaaatgcctgtgatttattcaacgcatccaagaagttggaagaaaattgaagaaagtaaatttgaatttgatccattagttaaacagttaaagccatttggtttctttgattataatgcattgcaaaaagatgcatttgttgtgctatcagatagtggaacattgtcagaagagtcgtctattttgaagttccctggtgtccttattcgaacttccacagaaagaccggaagtactagataaaggtacggttattgtaggtggtattacctataacaatctaatccaatccgttgaactagcaagagagatgcaaaacaataacgaaccgatgattgatgctattgattataaagacactaacgtttcgacaaaggtagttaaaattattcaaagctataaagatattatcaatcgaaatacttggaggaaa

SEQ ID NO: 2682 - protein, 374 aa, Staphylococcus aureus
  MISC_FEATURE (1)..(374): capsular polysaccharide
MEKLKLMTIVGTRPEIIRLSSTIKACDQYFNQILVHTGQNYDYTLNQIFFDDLELRQPDHYLEAVGSNLGETMGNIIAKTYDVLLREQPDALLILGDTNSCLAAVSAKRLKIPVFHMEAGNRCFDQNVPEEINRKIVDHVSDVNLPYTEHSRRYLLDEGFNKANIFVTGSPMTEVIEAHRDKINHSDVLNKLGLEPQQYILVSAHREENIDNEKNFKSLMNAINDIAKKYKMPVIYSTHPRSWKKIEESKFEFDPLVKQLKPFGFFDYNALQKDAFVVLSDSGTLSEESSILKFPGVLIRTSTERPEVLDKGTVIVGGITYNNLIQSVELAREMQNNNEPMIDAIDYKDTNVSTKVVKIIQSYKDIINRNTWRK

SEQ ID NO: 2683 - DNA, 1113 bp, Staphylococcus aureus
ttgacgttgaatattgtaattacaggagcaaaaggttttgtaggaaaaaacttgaaagcagatttaacttcaacgacagatcatcatattttcgaagtacatcgacaaactaaagaggaagaattagagtcagcattgttgaaagcagactttgtcgtgcatttagcgggtgttaatcgacctgaacatgacaaagaattcagcttaggaaacgtgagttatttagatcatgtacttgatatattaactagaaatacgaaaaagccagcgatattattatcgtcttcaatacaagcaacacaagataatccttatggtgagagtaagttgcaaggggaacagctattaagagagtatgccgaagagtatggcaatacggtttatatttatcgctggccaaatttattcggcaagtggtgtaagccgaattataactcagtgatagcaacattttgttacaaaattgcacgtaacgaagagattcaagttaatgatcggaatgttgaactaacgctaaactacgtggatgatatcgtcgctgaaataaagcgtgctattgaaggaactccaacgattgaaaatggtgtacctacagtaccaaacgtatttaaagtgacattgggagaaattgtagatttattatacaagttcaaacagtcacgtctcgatcgaacattgccgaaattagataacttgtttgaaaaagatttgtatagtacgtatttaagctatctacctagtacagactttagttatcccttacttatgaatgtggatgataggggttcttttacagaatttataaaaacaccggatcgtggtcaagtttctgtaaatatttctaaaccaggtattactaaaggtaatcactggcatcatactaaaaacgaaaaatttctagtcgtatcaggtaaaggggtaattcgttttagacatgttaatgatgatgaaatcattgaatattatgtttctggcgacaaattagaagttgtagacataccagtaggatacacacataatattgaaaatttaggcgacacagatatggtaactattatgtgggtgaatgaaatgtttgatccaaatcagccagatacgtatttcttggaggta

SEQ ID NO: 2684 - protein, 371 aa, Staphylococcus aureus
  MISC_FEATURE (1)..(371): capsular polysaccharide
LTLNIVITGAKGFVGKNLKADLTSTTDHHIFEVHRQTKEEELESALLKADFVVHLAGVNRPEHDKEFSLGNVSYLDHVLDILTRNTKKPAILLSSSIQATQDNPYGESKLQGEQLLREYAEEYGNTVYIYRWPNLFGKWCKPNYNSVIATFCYKIARNEEIQVNDRNVELTLNYVDDIVAEIKRAIEGTPTIENGVPTVPNVFKVTLGEIVDLLYKFKQSRLDRTLPKLDNLFEKDLYSTYLSYLPSTDFSYPLLMNVDDRGSFTEFIKTPDRGQVSVNISKPGITKGNHWHHTKNEKFLVVSGKGVIRFRHVNDDEIIEYYVSGDKLEVVDIPVGYTHNIENLGDTDMVTIMWVNEMFDPNQPDTYFLEV

SEQ ID NO: 2685 - DNA, 1116 bp, Staphylococcus aureus
atgaagttgaagcgattattcaagacatcgtcaatgactttagtaaagaaaaaattattaactatgccaatggcaaaaagggagataattatgttcgatgacaaaattttattaattactgggggcacaggatcattcggtaatgctgttatgaaacagtttttagattctaatattaaagaaattcgtattttttcacgcgatgagaaaaaacaagatgacattcgaaaaaaatataataattcaaaattaaagttctacattggtgatgtgcgtgatagtcaaagtgtagaaacagcaatgcgagatgttgattacgtattccatgcagcagctttaaaacaagtgccgtcatgtgaattctttccagttgaggcagtgaagacaaatattattggtacagaaaatgtcttacaaagtgctattcatcaaaatgttaaaaaagtcatatgtttatctacagataaggcagcgtatcctattaatgctaggggtatttcaaaagcaatgatggaaaaagtattcgtagccaaatcaagaaatattcgtagtgaacaaacgcttatttgtggtacaagatacggtaatgtgatggcttcaagaggatcagtaatacctttgtttatcgacaaaatcaaagctggagaacctttaacgattacagatcctgatatgacaagatttttaatgagcttagaagatgcggtagaactagttgttcatgcatttaagcatgcagagacaggagatattatggttcaaaaagcaccaagctcaacggtaggggatcttgcgaccgcattattagaattgtttgaagctgataatgcaattgaaatcattggtacgcgacatggagagaaaaaagcagaaacattgttgacgagagaagaatacgcacaatgtgaagatatgggtgattattttagagtgccggcagactccagagatttaaattatagtaattatgttgaaaccggtaacgaaaagattacgcaatcttatgaatataactccgataatacacatattttaacggtggaagagataaaagaaaaacttttaacactagaatatgttagaaacgaattgaatgattataaagcttcaatgaga

SEQ ID NO: 2686 - protein, 372 aa, Staphylococcus aureus
  MISC_FEATURE (1)..(372): capsular polysaccharide
MKLKRLFKTSSMTLVKKKLLTMPMAKREIIMFDDKILLITGGTGSFGNAVMKQFLDSNIKEIRIFSRDEKKQDDIRKKYNNSKLKFYIGDVRDSQSVETAMRDVDYVFHAAALKQVPSCEFFPVEAVKTNIIGTENVLQSAIHQNVKKVICLSTDKAAYPINARGISKAMMEKVFVAKSRNIRSEQTLICGTRYGNVMASRGSVIPLFIDKIKAGEPLTITDPDMTRFLMSLEDAVELVVHAFKHAETGDIMVQKAPSSTVGDLATALLELFEADNAIEIIGTRHGEKKAETLLTREEYAQCEDMGDYFRVPADSRDLNYSNYVETGNEKITQSYEYNSDNTHILTVEEIKEKLLTLEYVRNELNDYKASMR

SEQ ID NO: 2687 - DNA, 1914 bp, Staphylococcus aureus
ttgttgatgataaaaaaattcctaaacgaatgccacaacaagattataaacagaaaagatggtttgggttataaacagcaaatgaggggttttatggcacatttatctgtgaaattgcggcttttaatactagcattaatcgattcactgatagtgacattttcagtattcgtaagttattacattttagaaccgtatttcaaaacatattctgtcaaattattaatattggcagctatatcactattcatatcgcatcatatttcagcatttatttttaatatgtatcatcgagcgtgggaatatgccagtgtgagtgaattgattttaattgttaaagctgtgacgacatctatcgttattacgatggtggtcgtgacaattgttacaggcaatagaccgttttttagattgtatttaattacttggatgatgcacttgattttaataggtggctcaaggttattttggcgtatttatcggaaataccttggaggtaagtcatttaataagaagccaactttagttgttggtgctggtcaagcaggttcaatgctgattagacaaatgttgaaaagtgacgaaatgaaacttgaaccggtattagcagtcgatgatgacgaacataaacgcaatatcacaattactgagggtgtaaaagtccaaggtaaaattgcggatattccagaactagtgaggaaatataagattaaaaaaatcatcattgcaattccaactattggtcaagagcgtttgaaagaaattaataatatttgccatatggatggcgttgagttattgaaaatgccaaatatagaagacgtcatgtctggtgagttagaagtgaaccaacttaaaaaagttgaagtagaagatttactaggcagagatcctgttgaattagatatggatatgatatcaaatgaattgacgaataaaactattttagttacgggtgcaggtggttcaataggatcagaaatttgtagacaagtttgtaatttctatccagaacgtattattctacttggccatggtgaaaacagtatttatttaatcaatcgtgaattgcgaaatcgcttcggaaaaaatgttgatatcgttcctattatagcggatgtgcaaaatagagcgcgtatgtttgaaattatggaaacgtataaaccatacgcagtttatcatgcagcagcacacaagcacgtgccgttaatggaagacaaccctgaagaagcagtacgtaataatattttaggtacgaaaaatactgctgaagctgctaaaaatgcagaggtaaagaaattcgttatgatttctacggataaagccgttaatccgcctaatgtcatgggagcttcaaagcgaattgcagaaatgattattcaaagtttaaatgatgaaacgcatcgaacaaattttgttgcagtgagatttggtaatgtacttggatcgagaggatctgtgattccacttttcaaaagtcaaattgaagaaggtgggccagttactgtgacacatcctgaaatgacacgttactttatgacaattcctgaagcttctagactagttttgcaggcaggggcattagcagaaggtggcgaagtatttgtgctagatatgggagaaccagtgaaaattgtagatttggcacgtaatttaattaagctaagtggtaaaaaagaagacgacatacgcattacttatacagggattagacccggcgaaaaaatgtttgaagagcttatgaataaagatgaggttcatcctgaacaagtatttgaaaaaatttatcgtggcaaagtacaacatatgaaatgtaatgaagttgaagcgattattcaagacatcgtcaatgactttagtaaagaaaaaattattaactatgccaatggcaaaaagggagataattatgttcga

SEQ ID NO: 2688 - protein, 638 aa, Staphylococcus aureus
  MISC_FEATURE (1)..(638): capsular polysaccharide
LLMIKKFLNECHNKIINRKDGLGYKQQMRGFMAHLSVKLRLLILALIDSLIVTFSVFVSYYILEPYFKTYSVKLLILAAISLFISHHISAFIFNMYHRAWEYASVSELILIVKAVTTSIVITMVVVTIVTGNRPFFRLYLITWMMHLILIGGSRLFWRIYRKYLGGKSFNKKPTLVVGAGQAGSMLIRQMLKSDEMKLEPVLAVDDDEHKRNITITEGVKVQGKIADIPELVRKYKIKKIIIAIPTIGQERLKEINNICHMDGVELLKMPNIEDVMSGELEVNQLKKVEVEDLLGRDPVELDMDMISNELTNKTILVTGAGGSIGSEICRQVCNFYPERIILLGHGENSIYLINRELRNRFGKNVDIVPIIADVQNRARMFEIMETYKPYAVYHAAAHKHVPLMEDNPEEAVRNNILGTKNTAEAAKNAEVKKFVMISTDKAVNPPNVMGASKRIAEMIIQSLNDETHRTNFVAVRFGNVLGSRGSVIPLFKSQIEEGGPVTVTHPEMTRYFMTIPEASRLVLQAGALAEGGEVFVLDMGEPVKIVDLARNLIKLSGKKEDDIRITYTGIRPGEKMFEELMNKDEVHPEQVFEKIYRGKVQHMKCNEVEAIIQDIVNDFSKEKIINYANGKKGDNYVR

SEQ ID NO: 2689 - DNA, 762 bp, Staphylococcus aureus
atgatattgaaatttgatcacatcattcattatatagatcagttagatcggtttagttttccaggagatgttataaaattacattcaggtgggtatcatcataaatatggaacattcaataaattaggttatatcaatgaaaattatattgagctactagatgtagaaaataatgaaaagttgaaaaagatggcaaaaacgatagaaggcggagtcgcttttgctactcaaattgttcaagagaagtatgagcaaggctttaaaaatatttgtttgcgtacaaatgatatagaggcagttaaaaataaactacaaagtgagcaggttgaagtagtagggccgattcaaatggaaagagatacacataaagatggtaaggtaaagtggcaattgctttatataatgaatcaggatgatgatgaaattaagccaccattttttattcaatgggaagaaagtgattccatgcgtactaaaaaattgcaaaaatattttcaaaaacaattttcaattgaaactgttattgtgaaaagtaaaaaccgatcacaaacagtatcgaattggttgaaatggtttgatatggacattgtagaagagaatgaccattacacagatttgattttaaaaaatgatgatatttattttagaattgaagatggtaaagtttcaaaatatcattcggttatcataaaagacgcacaagcaacttcaccatattcaatttttatcagaggtgctatttatcgctttgaaccattagta

SEQ ID NO: 2690 - protein, 254 aa, Staphylococcus aureus
  MISC_FEATURE (1)..(254): hypothetical protein
MILKFDHIIHYIDQLDRFSFPGDVIKLHSGGYHHKYGTFNKLGYINENYIELLDVENNEKLKKMAKTIEGGVAFATQIVQEKYEQGFKNICLRTNDIEAVKNKLQSEQVEVVGPIQMERDTHKDGKVKWQLLYIMNQDDDEIKPPFFIQWEESDSMRTKKLQKYFQKQFSIETVIVKSKNRSQTVSNWLKWFDMDIVEENDHYTDLILKNDDIYFRIEDGKVSKYHSVIIKDAQATSPYSIFIRGAIYRFEPLV

SEQ ID NO: 2691 - DNA, 438 bp, Staphylococcus aureus
atgctatcacaagaatttttcaatagttttataacaatatatcgcccctatttaaaattagccgagccgattttagaaaaacacaatatatattatggccaatggttaatcttacgcgatatcgctaaacatcagcccactactctcattgaaatttcacatagacgtgcaattgaaaagcctactgcaagaaaaactttaaaagctctaatagaaaatgaccttataacagtagaaaacagtttagaggataaacgacaaaagtttttaactttaacacctaaagggcatgaattatatgagattgtttgtcttgatgtacaaaagctccaacaagcagtagttgccaaaacaaacatttcgcaagatcaaatgcaagaaaccataaatgtgatgaatcaaattcatgaaatattattaaaggaggcacacaatgac

SEQ ID NO: 2692 - protein, 146 aa, Staphylococcus aureus
  MISC_FEATURE (1)..(146): hypothetical protein
MLSQEFFNSFITIYRPYLKLAEPILEKHNIYYGQWLILRDIAKHQPTTLIEISHRRAIEKPTARKTLKALIENDLITVENSLEDKRQKFLTLTPKGHELYEIVCLDVQKLQQAVVAKTNISQDQMQETINVMNQIHEILLKEAHND

SEQ ID NO: 2693 - DNA, 762 bp, Staphylococcus aureus
atgattgatattcataaccatatattgcctaatatcgatgacggtccgacaaatgaaacagagatgatggatcttttaaaacaagcgacaacacaaggtgttacagaaatcattgtaacatcacatcacttacatcctcgatataccacacctatagaaaaagtgaaatcatgtttaaaccatattgaaagcttagaggaagtacaagcactaaatctaaagttttattatggtcaggaaataagaattaccgatcaaatccttaatgatattgatcgaaaagttattaacggtattaatgattcacgctatttactaatagaatttccatcaaatgaagttccacactatactgatcaattatttttcgaattacagagtaaaggctttgtaccgattattgcacatccagagcggaataaagcaataagtcaaaaccttgacatactatacgatttaattaacaaaggtgctttaagtcaagtgacaacggcgtcattagcgggtatttccggtaaaaaaattagaaaattagcaattcaaatgattgaaaacaatctgacacatttcatcggttcagatgcgcataacacagaaatcagaccgttcttaatgaaagacttatttaatgataagaaattacgtgattattatgaagatatgaacggatttattagtaatgcgaagttagttgttgatgataaaaaaattcctaaacgaatgccacaacaagattataaacagaaaagatggtttgggtta

SEQ ID NO: 2694 - protein, 254 aa, Staphylococcus aureus
  MISC_FEATURE (1)..(254): capsular polysaccharide
MIDIHNHILPNIDDGPTNETEMMDLLKQATTQGVTEIIVTSHHLHPRYTTPIEKVKSCLNHIESLEEVQALNLKFYYGQEIRITDQILNDIDRKVINGINDSRYLLIEFPSNEVPHYTDQLFFELQSKGFVPIIAHPERNKAISQNLDILYDLINKGALSQVTTASLAGISGKKIRKLAIQMIENNLTHFIGSDAHNTEIRPFLMKDLFNDKKLRDYYEDMNGFISNAKLVVDDKKIPKRMPQQDYKQKRWFGL

SEQ ID NO: 2695 - DNA, 693 bp, Staphylococcus aureus
ttgctacttatgtcaaaaaaggaaaatacgacaacaacactatttgtatatgaaaaaccaaaatcaacaattagtgaaaagtttcgaggtatacgttcaaacatcatgttttcaaaagcaaatggtgaagtaaagcgcttattggttacttctgaaaagcctggtgcaggtaaaagtacagttgtatcgaatgtagcgattacttatgcacaagcaggctataagacattagttattgatggcgatatgcgtaagccaacacaaaactatatttttaatgagcaaaataataatggactatcaagcttaatcattggtcgaacgactatgtcagaagcaattacgtcgacagaaattgaaaatttagatttgctaacagctggccctgtacctccaaatccatctgagttaattgggtctgaaaggttcaaagaattagttgatctgtttaataaacgttacgacattattattgtcgatacaccgccagttaatactgtgactgatgcacaactatatgcgcgtgctattaaagatagtctgttagtaattgatagtgaaaaaaatgataaaaatgaagttaaaaaagcaaaagcacttatggaaaaagcaggcagtaacattctaggtgtcattttgaacaagacaaaggtcgataaatcttctagttattatcactattatggagatgaa

SEQ ID NO: 2696 - protein, 231 aa, Staphylococcus aureus
  MISC_FEATURE (1)..(231): capsular polysaccharide
LLLMSKKENTTTTLFVYEKPKSTISEKFRGIRSNIMFSKANGEVKRLLVTSEKPGAGKSTVVSNVAITYAQAGYKTLVIDGDMRKPTQNYIFNEQNNNGLSSLIIGRTTMSEAITSTEIENLDLLTAGPVPPNPSELIGSERFKELVDLFNKRYDIIIVDTPPVNTVTDAQLYARAIKDSLLVIDSEKNDKNEVKKAKALMEKAGSNILGVILNKTKVDKSSSYYHYYGDE

SEQ ID NO: 2697 - DNA, 666 bp, Staphylococcus aureus
atggaaagtacattagaattaacaaaaattaaagaagtattacaaaaaaacttgaagattttaattattttaccgctattatttttaattattagcgctattgttacatttttcgtcttatcacctaaatatcaagctaatactcaaattttagtgaatcaaactaagggtgacaatcctcagtttatggcgcaagaggttcaaagtaatattcaacttgtaaatacgtataaagaaattgttaaaagtcctagaattttagatgaggtgtcaaaggacttaaatgataagtattcaccatctaaattgtcgagtatgttgacaattacaaaccaagaaaatacgcaacttatcaacatccaagttaaaagtggtcataaacaagattcggaaaaaattgcgaatagcttcgctaaagttacaagtaaacaaattccgaagattatgagtgtggataacgtatcaattttatctaaagcagacggtacagcagttaaagtcgcaccaaaaactgtagtgaatctaatcggtgcattctttttaggattagttgtcgcgcttatatatatcttcttcaaagtaattttcgataagcgaattaaagatgaagaagatgtagagaaagaattaggattgcctgtattgggttcaattcaaaaatttaat

SEQ ID NO: 2698 - protein, 222 aa, Staphylococcus aureus
  MISC_FEATURE (1)..(222): capsular polysaccharide
MESTLELTKIKEVLQKNLKILIILPLLFLIISAIVTFFVLSPKYQANTQILVNQTKGDNPQFMAQEVQSNIQLVNTYKEIVKSPRILDEVSKDLNDKYSPSKLSSMLTITNQENTQLINIQVKSGHKQDSEKIANSFAKVTSKQIPKIMSVDNVSILSKADGTAVKVAPKTVVNLIGAFFLGLVVALIYIFFKVIFDKRIKDEEDVEKELGLPVLGSIQKFN

SEQ ID NO: 2699 - DNA, 2613 bp, Staphylococcus aureus
ttgtatatgttaactatacctgaaaaagaaaatcgtggatcgaaagaacaagaagtggcaattatgattgatgctctagctgacaaagggaaaaaagcattagaagcattatctaaaaagtcacaagaagaaattgatcatattgttcatcaaatgagcttagcagctgttgatcaacatatggtgctagcaaaattagcacatgaagaaactggaagaggtatatacgaagataaagcgattaaaaatttatacgcttctgaatatatatggaattcaataaaagacaataagacagtagggattattggtgaagataaagaaaaaggattaacgtatgtagcggaaccaattggtgttatttgtggtgttacgccaacaacaaatcctacgtcgacaactatttttaaagcgatgattgcaattaagacaggaaatccaatcatttttgcattccatccaagtgcacaagaatcgtcgaagcgtgcagcagaagttgtattagaagcggcaatgaaggcaggtgcacctaaagatattattcagtggattgaagtgccttctatcgaagcaacaaaacaattaatgaatcacaaaggtattgcattagttctagcaacaggtggttcgggcatggttaagtctgcatattcaactggcaaaccggcattaggtgtgggaccaggtaacgtgccgtcttacattgaaaaaacagcacacattaaacgtgcagtaaatgatatcattggttcaaaaacatttgataatggtatgatttgtgcttctgaacaagttgtagtcattgataaagaaatttataaagatgttactaatgaatttaaagcacatcaagcatactttgttaaaaaagatgaattacaacgcttagaaaatgcaattatgaatgaacaaaaaacaggtattaagcctgatattgtcggtaaatctgcagttgaaatagctgaattagcaggtatacctgtccccgaaaatacaaaacttatcatagccgaaattagcggtgtaggttcagactatccgttatctcgtgaaaaattatctccagtattagccttagtaaaagcccaatctacaaaacaagcatttcaaatttgtgaagacacactacattttggtggattaggacacacagccgttatccatacagaagatgaaacattacaaaaagattttggactaagaatgaaagcttgtcgtgtacttgtaaatacaccatcagcggttggaggtattggtgatatgtataacgaattgattccgtctttaacattaggttgtggttcctacggtagaaactcaatttcacataatgttagtgcgacagatttattaaacattaaaacgattgctaaacgacgtaataatactcaaattttcaaggtgcctgctcaaatttattttgaagaaaatgcaatcatgagtctaacaacaatggacaagattgaaaaagtgatgattgtctgtgaccctggtatggtagaattcggttatacaaaaacagttgagaatgtattaagacaaaaaacggaacagcctcaaataaaaatatttagcgaagtcgaaccgaacccatcaactaatacagtatataaaggtctggaaatgatggttgatttccaaccggatacaatcattgcacttggtggtggttcagcgatggatgctgcaaaagcaatgtggatgttctttgaacaccctgagacatcattcttcggtgctaaacaaaagttcctagacatcggtaaacgtacttataaaataggcatgcctgaaaatgcgacgttcatttgtatccctacgacatcaggtacaggttcagaagtaacaccatttgcagttatcacagatagtgaaacaaatgtaaaatatccgttggctgattttgctttaacacctgacgttgcaattattgaccctcaatttgtgatgagtgtgccaaaaagcgttacagcagatacaggaatggatgtactaacgcatgcaatggaatcatatgtatctgtaatggcttcagactacacaagaggtttgagtctacaagcgattaaattgacgttcgaatatttaaaatcatctgttgaaaagggtgataaagtttcaagagagaaaatgcataacgcatcaactttggctggtatggcatttgcaaatgcattcttaggcattgcacactcaattgcgcataaaattggtggcgaatatggtattccgcatggtagagcgaatgcgatattactaccgcatattatccgttataatgccaaagacccgcaaaaacatgcattattccctaaatatgagttcttcagagcagatacagattatgcagatattgccaaattcttaggattaaaaggtaatacgacagaagcactcgtagaatcattagctaaagctgtctacgaattaggtcaatcagtcggaattgaaatgaatttgaaatcacaaggtgtgtctgaagaagaattaaatgagtcaattgatagaatggcagagctcgcatttgaagatcaatgtacaactgctaatcctaaagaagcactaatcagtgaaatcaaagatatcattcaaacatcatatgattataagcaa

SEQ ID NO: 2700 - protein, 871 aa, Staphylococcus aureus
  MISC_FEATURE (1)..(871): alcohol-acetaldehyde
LYMLTIPEKENRGSKEQEVAIMIDALADKGKKALEALSKKSQEEIDHIVHQMSLAAVDQHMVLAKLAHEETGRGIYEDKAIKNLYASEYIWNSIKDNKTVGIIGEDKEKGLTYVAEPIGVICGVTPTTNPTSTTIFKAMIAIKTGNPIIFAFHPSAQESSKRAAEVVLEAAMKAGAPKDIIQWIEVPSIEATKQLMNHKGIALVLATGGSGMVKSAYSTGKPALGVGPGNVPSYIEKTAHIKRAVNDIIGSKTFDNGMICASEQVVVIDKEIYKDVTNEFKAHQAYFVKKDELQRLENAIMNEQKTGIKPDIVGKSAVEIAELAGIPVPENTKLIIAEISGVGSDYPLSREKLSPVLALVKAQSTKQAFQICEDTLHFGGLGHTAVIHTEDETLQKDFGLRMKACRVLVNTPSAVGGIGDMYNELIPSLTLGCGSYGRNSISHNVSATDLLNIKTIAKRRNNTQIFKVPAQIYFEENAIMSLTTMDKIEKVMIVCDPGMVEFGYTKTVENVLRQKTEQPQIKIFSEVEPNPSTNTVYKGLEMMVDFQPDTIIALGGGSAMDAAKAMWMFFEHPETSFFGAKQKFLDIGKRTYKIGMPENATFICIPTTSGTGSEVTPFAVITDSETNVKYPLADFALTPDVAIIDPQFVMSVPKSVTADTGMDVLTHAMESYVSVMASDYTRGLSLQAIKLTFEYLKSSVEKGDKVSREKMHNASTLAGMAFANAFLGIAHSIAHKIGGEYGIPHGRANAILLPHIIRYNAKDPQKHALFPKYEFFRADTDYADIAKFLGLKGNTTEALVESLAKAVYELGQSVGIEMNLKSQGVSEEELNESIDRMAELAFEDQCTTANPKEALISEIKDIIQTSYDYKQ

SEQ ID NO: 2701 - DNA, 219 bp, Staphylococcus aureus
atgatatttgatagacatgctaacttaaagtatagatatggaaatagaaagttttggtgtaaaggattttatgtggatacagtaggtagaaataaaaaagtgattgaaaattatattcgtaatcaattacaagaggatatcgttgcagatgaaatttcaatggaagaatatttagatcctttcactggagagaaaaataaaaaaagaaagaaaaaagag

SEQ ID NO: 2702 - protein, 73 aa, Staphylococcus aureus
MIFDRHANLKYRYGNRKFWCKGFYVDTVGRNKKVIENYIRNQLQEDIVADEISMEEYLDPFTGEKNKKRKKKE

SEQ ID NO: 2703 - DNA, 102 bp, Staphylococcus aureus
atgatattaataatgtacaaaaaatataaatcaaatcgacatccttataaaacatcagaaccactaaaaacaaaaaagcacaaaataaaattaaatttaaaa

SEQ ID NO: 2704 - protein, 34 aa, Staphylococcus aureus
MILIMYKKYKSNRHPYKTSEPLKTKKHKIKLNLK

SEQ ID NO: 2705 - DNA, 264 bp, Staphylococcus aureus
atggttgattgttggaaagattgttttgatgatttgcatattttaaaaccgaatttaaaaatgattgaaaatatacaagaacgagcaatgcttcatttattaactcacgaagaagaggaatggggaaatttagaaagacgtactaaaaataaatatagagataagttgaaaaatatagcgtctattgatttgacagatttaatgaaaatatctttaagaggaaatgaaaaccaattgcaaaaacaaatcgacttttggttgaat

SEQ ID NO: 2706 - protein, 88 aa, Staphylococcus aureus
MVDCWKDCFDDLHILKPNLKMIENIQERAMLHLLTHEEEEWGNLERRTKNKYRDKLKNIASIDLTDLMKISLRGNENQLQKQIDFWLN

SEQ ID NO: 2707 - DNA, 543 bp, Staphylococcus aureus
atgtcactagctattccaaaattgtcttttgacgctataacgattgttgggaatcttagcatgtctaacgcagagagactttcacattttatgagtactaatcctgaaattcggctttgggatattttacaaacaaactttaaagctaaagctcttaaagaaaaagtttatattgaatatgacaaaataaaagcaactctttggaatagacgtagtatgcgcgttgaatttaatcctaataagctttcgcatgatgaagtgctttggttaaaacaaaatatcatcagttatttggacgatgttagttttacgagattagatttggcttttgattttgaatttgatttaaatgactattatgcattgtcagataagtcggtaaagaaaactatattttatggacgtaatgtaaaaccagaaacaaaatattttggtgtgcgtaatagtgataggtttattcggatttataataaaaacaagaacgtaaagataatgcagatgttgaaattgattcaacatttctatggcgtgtggaaattgaat

SEQ ID NO: 2708 - protein, 181 aa, Staphylococcus aureus
MSLAIPKLSFDAITIVGNLSMSNAERLSHFMSTNPEIRLWDILQTNFKAKALKEKVYIEYDKIKATLWNRRSMRVEFNPNKLSHDEVLWLKQNIISYLDDVSFTRLDLAFDFEFDLNDYYALSDKSVKKTIFYGRNVKPETKYFGVRNSDRFIRIYNKNKNVKIMQMLKLIQHFYGVWKLN

SEQ ID NO: 2709 - DNA, 201 bp, Staphylococcus aureus
gtgattgaaatgtcacgtcctgtcaaaatgaatagtttattaaagttgtattttgatagaaatttactgacaccacaaaaattattgaattatttaaaagttgatgaaacatttttgaatcatctagcaggtattaatttaaaactctttaaggattatgttaatgaaaatagagaatataatataacgaatctatataaa

SEQ ID NO: 2710 - protein, 67 aa, Staphylococcus aureus
  MISC_FEATURE (1)..(67): hypothetical protein
VIEMSRPVKMNSLLKLYFDRNLLTPQKLLNYLKVDETFLNHLAGINLKLFKDYVNENREYNITNLYK

SEQ ID NO: 2711 - DNA, 1539 bp, Staphylococcus aureus
gtgaggatgtcaaacatagcattttatgtcgtgagtgacgtacatggttatattttcccaacagattttacgagtagaaatcaatatcaacctatgggattgttactagcgaatcatgttatagaacaagacagaaggcagtatgaccaaagttttaaaatagataatggtgattttttgcaagggtcaccattttgtaattacttaatcgcgcatagcggcagtagccagcctttagttgatttttataatcgaatggcattcgactttggtacgcttggtaatcatgaatttaattatggattaccatacttaaaagacactttacgcagactcaattatccagttttgtgcgctaatatatatgaaaatgatagtacattgactgataacggtgtgaagtattttcaggttggagatcaaactgttggtgtgataggtttaacgacacaatttattccccattgggaacaaccagagcatattcagtcacttacgtttcatagtgcttttgaaatacttcaacaatacttacctgaaatgaagcgacatgcagatatcattgtggtttgttaccatggtggatttgaaaaggatttagaaagtggtacgccgaccgaagtattaacgggtgaaaatgaaggatatgccatgttagaagcgttttctaaagatatagatatctttattacgggtcaccaacatcgacaaattgctgaaaggtttaagcaaacggctgtgattcaacctggtacgagaggtacaactgtaggcagagtagtcttgagtactgatgaatatgaaaatctatccgttgaatcatgtgaattacttcctgttatagatgattccacatttactattgatgaagatgaccaacatttacgaaagcagttagaggactggttagattacgaaattactacattgccatatgatatgacgattaatcatgcatttgaggcacgtgtggcaccgcatccttttacaaattttatgaattacgctttattagaaaaaagtgacgcagatgttgcctgtacagctttgtttgattctgctagtggtttcaagcaagtcgtgacgatgcgagatgttattaacaattacccatttccaaatacatttaaagttttagctgtaagtggtgccaaacttaaagaagccattgaacgatcagcagaatattttgacgtgaaaaatgatgaagttagtgtgagcgcagacttccttgaacccaaaccacaacactttaattatgatatatatggtggcgtaagttataccattcatgttggaagaccaaagggacaacgtgtgagcaatatgatgattcaaggtcacgcagttgatttaaagcagacatatacaatttgtgtaaataattatcgtgcagtaggcggtggtcagtatgatatgtatatcgacgcgccagttgtaaaagatattcaagttgaaggcgcacaattacttattgattttttatcaaataataatttgatgcgcatcccgcaagttgttgattttaaagttgaaaag

SEQ ID NO: 2712 - protein, 513 aa, Staphylococcus aureus
  MISC_FEATURE (1)..(513): hypothetical protein
VRMSNIAFYVVSDVHGYIFPTDFTSRNQYQPMGLLLANHVIEQDRRQYDQSFKIDNGDFLQGSPFCNYLIAHSGSSQPLVDFYNRMAFDFGTLGNHEFNYGLPYLKDTLRRLNYPVLCANIYENDSTLTDNGVKYFQVGDQTVGVIGLTTQFIPHWEQPEHIQSLTFHSAFEILQQYLPEMKRHADIIVVCYHGGFEKDLESGTPTEVLTGENEGYAMLEAFSKDIDIFITGHQHRQIAERFKQTAVIQPGTRGTTVGRVVLSTDEYENLSVESCELLPVIDDSTFTIDEDDQHLRKQLEDWLDYEITTLPYDMTINHAFEARVAPHPFTNFMNYALLEKSDADVACTALFDSASGFKQVVTMRDVINNYPFPNTFKVLAVSGAKLKEAIERSAEYFDVKNDEVSVSADFLEPKPQHFNYDIYGGVSYTIHVGRPKGQRVSNMMIQGHAVDLKQTYTICVNNYRAVGGGQYDMYIDAPVVKDIQVEGAQLLIDFLSNNNLMRIPQVVDFKVEK

SEQ ID NO: 2713 - DNA, 1209 bp, Staphylococcus aureus
atgactaatcaaggctcattaaataaatcacctattttcaccaaaagttttacaattaactttttagtcaactttatcgtatacctatgcatgtatttgttacttgtagttattgctggctatagtaagcaagctttcgacgcttccgattcattagccggattagttgtaggactatttattgtcgggtctttaattggtcgatttgctacaggtaaatttgtaaatcaaatcggacctaaacgattattatttattggtttaattgctttaattatcacgcaattactttattttattgatggatctttagcttttttaatctttgtacgtctcataaacggtatcgcaactgcagttgtgacaactgcaacaggtactattgcggcatacgttacccctgttaatagaaaaagtgaaggcatcagtttattttccttaagtttagtattaggtacagcgattggcccatttctaggcatgttacttattacaaaatacgcaattgacttactgtttattatttgtgtcatattaggcatactcggactcattatctcattatttataaaagttgatttcgaagtaacaaataacaaaactgaaactaatgtcattgataaaccaagatttagtattcatcaatttattgcaaaagaggccattcctgttgctgtaattatgcttttaattggcgttacctatgcgtccatcctaacttatttacaagcatttgctttagagcgacacctagtcactgcagcaagctatttctttatttgctatgctatagcatcgttaattactagacctattgctggtagattgatggatgataaaaatgaaaatattattgtctacccagcatttatcatgcttttcctttcatttgtatgcttaatttcaagctatcaaagctggttaatattacttgctggtgcttgcctaggtttagggtatggaaatttatcatctgcaatgcaatctattgcgataaaagtctcacccccgattaaatatggtatcgcgacatctactttttacgttggtctagatgcaggtgtcggcttcggtccatcattccttgggttatttactcatatgttttcatatagtgaaatcttcggctttatggccgctttagcaatcattactatgcttgtttacttcttaattcatggacgtcatgtaactagaaatgccatgaac

SEQ ID NO: 2714 - protein, 403 aa, Staphylococcus aureus
  MISC_FEATURE (1)..(403): hypothetical protein
MTNQGSLNKSPIFTKSFTINFLVNFIVYLCMYLLLVVIAGYSKQAFDASDSLAGLVVGLFIVGSLIGRFATGKFVNQIGPKRLLFIGLIALIITQLLYFIDGSLAFLIFVRLINGIATAVVTTATGTIAAYVTPVNRKSEGISLFSLSLVLGTAIGPFLGMLLITKYAIDLLFIICVILGILGLIISLFIKVDFEVTNNKTETNVIDKPRFSIHQFIAKEAIPVAVIMLLIGVTYASILTYLQAFALERHLVTAASYFFICYAIASLITRPIAGRLMDDKNENIIVYPAFIMLFLSFVCLISSYQSWLILLAGACLGLGYGNLSSAMQSIAIKVSPPIKYGIATSTFYVGLDAGVGFGPSFLGLFTHMFSYSEIFGFMAALAIITMLVYFLIHGRHVTRNAMN

SEQ ID NO: 2715 - DNA, 1542 bp, Staphylococcus aureus
atgaaaaaaatatataagtcattaactgtctctgcaattgttgcaacggtatcattaagtgctttaccgcaatctttagctataacgcatgaatcgcaacctacaaagcaacagcgaacggtattattcgatcgttctcatggtcaaacagctggtgctgcagattgggttagtgatggtgcattttcagattatgcggattcaatacaaaaacaaggttatgacgttaaagctattgatggtcattcgaacataacagaagcaagtttgaaaagttccaaaatatttgtaattcctgaggctaacattcctttcaaagaatcagaacaggcagcaattgttaaatatgtgaaacaaggtggcaatgttgtctttatttcagatcattacaatgctgaccgaaatttaaatcgtattgattcatcggaggcaatgaatggttatcgacgtggagcatatgaagatatgtcgaaaggtatgaatgcagaagaaaaaagttctactgcaatgcaaggtgtgaaaagttcagattggttatctacaaactttggcgtacgttttcgatataatgcactaggtgatttaaatacgagcaatattgtttcttcaaaagaaagtttcggtattactgaaggtgtgaaatctgtctctatgcatgccggatcgacattagcaattactaatccagagaaagcaaaaggtattgtgtatacaccagaacaattgccagcgaaaagtaaatggtcacatgctgtagatcaaggtatttataatgggggcggtaaagcagaaggcccctatgtagcaatttctaaagttggaaaaggtaaagcagcatttatcggtgattcatcacttgtggaagatagttcgcccaaatatgtaagagaagataatggagaaaagaagaaaacatatgatggttttaaagaacaagacaacggtaagctattaaataatataacggcttggatgtctaaagataatgatgggaaatcacttaaggcgagtagcctaacattagatacaaagactaagttgcttgattttgaacgaccagagcgttcaactgagcctgaaaaagagccatggtcacaaccgccgagtggttataaatggtatgatccaacaacatttaaagcaggtagttatggcagcgaaaaaggcgcagatcctcagccaaacacaccagatgatcatacaccaccaaatcagaacgaaaaagtaacatttgatatcccgcaaaatgtttctgtaaatgagccatttgaaatgacaatacatttaaaaggatttgaagcaaatcaaacacttgaaaatcttagagttggtatttacaaagaaggcggacgtcaaatcggacaattttcaagtaaagataacgattataacccaccaggttacagtactttgccaacagttaaagcagatgaaaacggaaatgtcacaattaaggtcaatgctaaagtacttgaaagtatggaaggttcaaagattcgtttaaaactcggtgacaaaaccttgattacaacagacttcaaa

SEQ ID NO: 2716 - protein, 514 aa, Staphylococcus aureus
  MISC_FEATURE (1)..(514): hypothetical protein
MKKIYKSLTVSAIVATVSLSALPQSLAITHESQPTKQQRTVLFDRSHGQTAGAADWVSDGAFSDYADSIQKQGYDVKAIDGHSNITEASLKSSKIFVIPEANIPFKESEQAAIVKYVKQGGNVVFISDHYNADRNLNRIDSSEAMNGYRRGAYEDMSKGMNAEEKSSTAMQGVKSSDWLSTNFGVRFRYNALGDLNTSNIVSSKESFGITEGVKSVSMHAGSTLAITNPEKAKGIVYTPEQLPAKSKWSHAVDQGIYNGGGKAEGPYVAISKVGKGKAAFIGDSSLVEDSSPKYVREDNGEKKKTYDGFKEQDNGKLLNNITAWMSKDNDGKSLKASSLTLDTKTKLLDFERPERSTEPEKEPWSQPPSGYKWYDPTTFKAGSYGSEKGADPQPNTPDDHTPPNQNEKVTFDIPQNVSVNEPFEMTIHLKGFEANQTLENLRVGIYKEGGRQIGQFSSKDNDYNPPGYSTLPTVKADENGNVTIKVNAKVLESMEGSKIRLKLGDKTLITTDFK

SEQ ID NO: 2717 - DNA, 954 bp, Staphylococcus aureus
atgaaaaattttaagtgtttatttgtattaatgttagcagtcattgtttttgcagcagcatgtggaaactcaagttctttagataatcaaaagaacgctagtaatgattcggattctaaatcaggaggatacaaacctaaagaattaaccgttcaatttgtaccttcgcaaaatgctggaacattagaagctaaagcaaaaccattagaaaaattactatctaaagaattagggattccagttaaagtgtctgtatcaactaactacaatacaattgttgaagctatgaagtctaaaaaagttgatgttggtttcttaccaccaacggcatacacattagcacatgatcaaaaagcagctgatttattattacaagcacaacgtttcggtgtaaaagaagatggttcagcaagtaaagaacttgtagatagttataaatcagaaattcttgttaaaaaagactcaaaaattaaaagcttgaaagatttaaaaggtaagaaaattgccttacaagatgtaacatcaactgctggatatacattcccacttgcgatgttaaaaaacgaagcaggtattaatgcaactaaagatatgaaaattgtgaatgttaaaggtcatgaccaagcagttatctcattattaaatggagatgtagatgctgcggctgtatttaacgatgcacgtaatactgtgaaaaaagaccaaccaaatgtatttaaagacacacgaattttaaaattaacacaagctattccgaatgacacaatttctgtaagaccagatatggataaagattttcaagaaaaattgaaaaaagcttttatagacattgctaaatcaaaagaaggtcacaaaattattagcgaagtttattcacatgaaggatacacagaaacgaaagattcaaatttcgacattgtaagagagtacgaaaaattagttaaagatatgaaa

SEQ ID NO: 2718 - protein, 318 aa, Staphylococcus aureus
  MISC_FEATURE (1)..(318): hypothetical protein
MKNFKCLFVLMLAVIVFAAACGNSSSLDNQKNASNDSDSKSGGYKPKELTVQFVPSQNAGTLEAKAKPLEKLLSKELGIPVKVSVSTNYNTIVEAMKSKKVDVGFLPPTAYTLAHDQKAADLLLQAQRFGVKEDGSASKELVDSYKSEILVKKDSKIKSLKDLKGKKIALQDVTSTAGYTFPLAMLKNEAGINATKDMKIVNVKGHDQAVISLLNGDVDAAAVFNDARNTVKKDQPNVFKDTRILKLTQAIPNDTISVRPDMDKDFQEKLKKAFIDIAKSKEGHKIISEVYSHEGYTETKDSNFDIVREYEKLVKDMK

SEQ ID NO: 2719 - DNA, 780 bp, Staphylococcus aureus
gtgtcaaacatgagtcaaatcgaatttaaaaacgtcagtaaagtctatcctaacggtcatgtaggcttgaaaaatattaacttaaatattgaaaaaggtgaatttgcagttattgtcggactatctggtgctgggaaatccacgttattaagatctgtaaatcgtttgcatgatatcacgtcaggtgaaattttcatccaaggtaaatcaatcactaaagcccatggtaaagcattattagaaatgcgccgaaatataggtatgattttccaacattttaatttagttaaacggtcaagtgtattacgaaatgtactaagtggacgtgtaggttatcaccctacttggaaaatggtattaggtttattcccaaaagaagacaaaattaaggcaatggatgcactagaacgcgtcaatatcttagataaatataatcaacgctctgatgaattatcaggtggccaacaacaacgtatatctattgcacgtgcgctatgccaagaatctgaaattattcttgcagatgaaccagttgcttcattagacccattaactacgaaacaggttatggatgatttaagaaaaatcaaccaagaattaggcatcacaattttaattaatttacattttgttgacttggcaaaagaatatggcacacgcatcattggtttacgtgatggtgaagttgtctatgatggtcctgcatctgaagcaacagatgacgtatttagtgaaatatatggacgtacaattaaagaagatgaaaagctaggagtgaac

SEQ ID NO: 2720 - protein, 260 aa, Staphylococcus aureus
  MISC_FEATURE (1)..(260): hypothetical protein
VSNMSQIEFKNVSKVYPNGHVGLKNINLNIEKGEFAVIVGLSGAGKSTLLRSVNRLHDITSGEIFIQGKSITKAHGKALLEMRRNIGMIFQHFNLVKRSSVLRNVLSGRVGYHPTWKMVLGLFPKEDKIKAMDALERVNILDKYNQRSDELSGGQQQRISIARALCQESEIILADEPVASLDPLTTKQVMDDLRKINQELGITILINLHFVDLAKEYGTRIIGLRDGEVVYDGPASEATDDVFSEIYGRTIKEDEKLGVN

SEQ ID NO: 2721 - DNA, 798 bp, Staphylococcus aureus
atgcctttagaaatacctacaaagtatgactcccttttaaagaaaaaggtttctttaaaaacgagttttaccttcatgttaatcattgtgcttatcatttggagcttcatttatacgggatttaattttggagatttaatgataggaatacctcaaataggtgatctattcaaacaaatgattccacctgatttcgagtatttacaacaaattacaacgccaatgttagataccattcgaatggctatcgtaagtacagtattaggtagcatcgtttcaataccaattgcgttattatgtgctagcaatatcgttcatcaaaagtggatttcaataccctcgcgctttattttaaatatagttcgtactattccagatttgttattagcagcaatctttgtggctgtatttggaatcggtcaaattccagggatattagcactgtttattttaactatctgtattattggaaaattattatatgaatcattggaaacgatagatccaggtccaatggaagcaatgacggctgttggcgctaataaaataaaatggattgttttcggtgttgtaccacaagccatatcgtcatttatgtcatacgtattatatgcatttgaagtaaatatacgtgcttcagctgtgcttggattagtcggcgctggcggtattggattgttttatgatcaaacacttggtttatttcaatatccaaaaacagcaacgattattttatttactttagttatcgtcgtcgtcattgattacatcagtacgaaagtgagggcacatctcgca

SEQ ID NO: 2722 - protein, 266 aa, Staphylococcus aureus
  MISC_FEATURE (1)..(266): hypothetical protein
MPLEIPTKYDSLLKKKVSLKTSFTFMLIIVLIIWSFIYTGFNFGDLMIGIPQIGDLFKQMIPPDFEYLQQITTPMLDTIRMAIVSTVLGSIVSIPIALLCASNIVHQKWISIPSRFILNIVRTIPDLLLAAIFVAVFGIGQIPGILALFILTICIIGKLLYESLETIDPGPMEAMTAVGANKIKWIVFGVVPQAISSFMSYVLYAFEVNIRASAVLGLVGAGGIGLFYDQTLGLFQYPKTATIILFTLVIVVVIDYISTKVRAHLA

SEQ ID NO: 2723 - DNA, 813 bp, Staphylococcus aureus
atgacacaggaaatagcaaaatataatgttcacacaaaagcacacaaacgaaaattgattaaaagatggcttattgcaattgtcgtcttagctattatcatctgggcatttgcaggtgtaccaagtttagaacttaaaagtaaatcattagaaatcttaaaatccatattcagcggattattccatcctgatatcagctatatctatataccagatggcgaagacttattacgtggtttacttgaaacctttgcgatagccgttgtaggtactttcatcgccgcaattatctgtattccattagcatttctaggtgcaaataatatggtaaagctacgcccagtttcaggtgttagcaaatttattttaagtgttatacgtgtcttcccagaaattgtaatggcacttatatttatcaaagctgttggcccaggttcattttcaggtgtattagctttaggtatccattccgtaggtatgcttgggaaacttttagctgaagatattgaaggtctagatttcagtgctgtagaatcattaaaggccagtggtgcgaataagattaaaacactcgtatttgcagtcataccacaaattatgcctgcctttctatcactcatactttatcgctttgaactaaacttacgttcagcttctatactggggctaattggggctggtggtatcgggacaccactcatatttgccattcaaacacgttcttgggaccgtgtaggtattatattaatcggtttagtactaatggtcgcaattgtcgatttaatttccggttcaatccgaaaacgtattgtt

SEQ ID NO: 2724 - protein, 271 aa, Staphylococcus aureus
  MISC_FEATURE (1)..(271): hypothetical protein
MTQEIAKYNVHTKAHKRKLIKRWLIAIVVLAIIIWAFAGVPSLELKSKSLEILKSIFSGLFHPDISYIYIPDGEDLLRGLLETFAIAVVGTFIAAIICIPLAFLGANNMVKLRPVSGVSKFILSVIRVFPEIVMALIFIKAVGPGSFSGVLALGIHSVGMLGKLLAEDIEGLDFSAVESLKASGANKIKTLVFAVIPQIMPAFLSLILYRFELNLRSASILGLIGAGGIGTPLIFAIQTRSWDRVGIILIGLVLMVAIVDLISGSIRKRIV

SEQ ID NO: 2725 - DNA, 1191 bp, Staphylococcus aureus
ttgggagtgatagctatgacaagaccatttaatcgtgtacatttaatcgtaatggattcagtaggtattggtgaagcgccagacgcagctgattttaaagatgaaggttcacatactttaagacataccttagaaggtttcgatcaaactttaccaaaccttgaaaagttaggtctagggaacatcgataaattaccagtagtaaatgcagttgaacaaccagaagcatactatactaaattgagtgaagcttcagttggtaaagatacaatgactggtcactgggaaattatgggattaaatattatgcaaccttttaaagtataccctaatggattccctgaagagttaattcaacaaattgaagaaatgacaggtcgtaaagttgttgctaacaaaccggcatcgggtacgcaaattatcgatgagtggggcgagcaccaaatgaaaactggtgacttaattgtttatacaagtgcagacccagtattgcaaattgctgcacatgaagacattatcccattagaagagttatatgatatttgtgaaaaggttcgtgagttgacaaaagaccctaaatatttaattggtcgtattatcgcacgtccatatgttggtgaaccaggaaactttacacgtacatctaatcgacatgactatgcgttaaaaccttttggtaaaactgtcttagatcatttgaaagacggtggttatgatgttattgccatcggtaaaattaatgacatttatgatggtgaaggtgtaacagaagcggttcgtacgaagagtaacatggacggtatggatcaattgatgaaaattgttaagaaagatttcacaggtattagcttcttaaacttagtagactttgatgcattatacggtcatcgtcgtgataaaccaggttatgcacaagcaattaaagatttcgatgatcgcttgccagaactgtttagcaacttaaaagaagacgatttagtaattattacagcagaccatggtaatgacccgacagcgccaggtacggaccatacgagagaatatatcccagtaattatgtacagtccgaaatttaaaggtggtcatgcactagaaagtgatactacattcagttctatcggtgcaactatagcagataatttcaacgtaacattaccagagttcggtaaaagttatttaaaggaattgaaa

SEQ ID NO: 2726 - protein, 397 aa, Staphylococcus aureus
  MISC_FEATURE (1)..(397): phosphopentomutase
LGVIAMTRPFNRVHLIVMDSVGIGEAPDAADFKDEGSHTLRHTLEGFDQTLPNLEKLGLGNIDKLPVVNAVEQPEAYYTKLSEASVGKDTMTGHWEIMGLNIMQPFKVYPNGFPEELIQQIEEMTGRKVVANKPASGTQIIDEWGEHQMKTGDLIVYTSADPVLQIAAHEDIIPLEELYDICEKVRELTKDPKYLIGRIIARPYVGEPGNFTRTSNRHDYALKPFGKTVLDHLKDGGYDVIAIGKINDIYDGEGVTEAVRTKSNMDGMDQLMKIVKKDFTGISFLNLVDFDALYGHRRDKPGYAQAIKDFDDRLPELFSNLKEDDLVIITADHGNDPTAPGTDHTREYIPVIMYSPKFKGGHALESDTTFSSIGATIADNFNVTLPEFGKSYLKELK

SEQ ID NO: 2727 - DNA, 660 bp, Staphylococcus aureus
atgaaatttgagaaatatatagatcacactttattgaagcctgagtcaacacgtacgcaaatcgatcaaatcatcgatgaagcgaaagcatacaattttaaatctgtatgtgtgaatccaacacatgttaaatatgcagcagagcgactagctgattcagaggtgctcgtttgtacggtaataggattcccattaggtgcgtcgacaactgcaacgaaagcatttgaaacagaagatgcaattcaaaatggtgcagatgaaattgacatggtcatcaacatcggcgcattaaaagatggacgttttgatgatgtacaacaagacattgaagcagtggttaaagctgcgaaaggtcacacagtaaaagtgattattgagacggtattgttggaccatgacgaaattgtaaaagcgagtgaattaacaaaagcggctggtgcggacttcgttaaaacttcaacaggttttgcaggtggcggtgcgactgcagaagacgttaaattaatgaaagatacagtaggtgctgatgtagaagtaaaagcatcaggtggcgtacgtaatttagaagatttcaataaaatggttgaagcaggtgcgacacgtattggtgcgagcgcaggtgttcaaattatgcaaggtttagaagcagattcagattac

SEQ ID NO: 2728 - protein, 220 aa, Staphylococcus aureus
  MISC_FEATURE (1)..(220): deoxyribose-phosphate
MKFEKYIDHTLLKPESTRTQIDQIIDEAKAYNFKSVCVNPTHVKYAAERLADSEVLVCTVIGFPLGASTTATKAFETEDAIQNGADEIDMVINIGALKDGRFDDVQQDIEAVVKAAKGHTVKVIIETVLLDHDEIVKASELTKAAGADFVKTSTGFAGGGATAEDVKLMKDTVGADVEVKASGGVRNLEDFNKMVEAGATRIGASAGVQIMQGLEADSDY

SEQ ID NO: 2729 - DNA, 1356 bp, Staphylococcus aureus
atgattatgaatgttgaatattctaaaataaagaaagcagtacctattttattattcttatttgtattcagtttggttatagacaactcatttaaattgatttctgtagccattgctgatgacttaaacatatctgtaacgacagtaagttggcaagcgacattagccggtttagtaattggtattggcgctgtagtatacgcttcattatctgatgccattagtatacgcacactatttatttatggcgtgatattaatcattatcggatcaattattggttacattttccaacatcaattcccattacttttagttggacgtattattcaaactgccggtttagctgctgcagagacattatatgtgatatatgttgcaaagtatctttctaaagaggaccagaagacttaccttggcttaagtacgagcagttattccttgtcattagttatcggtacattatcaggtggatttatttctacgtatttacactggacaaatatgtttttaattgcattaatcgtagtatttacgttgccattcctatttaaattattaccaaaagaaaataatacgaataaagctcatttagattttgttggcttaattctagtggcaactattgctacaacagtcatgctgtttattacgaactttaattggttatatatgattggtgccttaattgcgattatcgtttttgcgctatatattaaaaatgcgcaacgtccattagtaaataaatcatttttccaaaataaacgttatgcttcatttttatttatagtatttgtaatgtatgctatccaattgggttatatttttacgttcccattcataatggagcaaatttatcatctgcaactagacacaacatcactgttattagtaccgggttatatagtagcagtcattgttggtgcactaagtggtaaaatcggcgaatatctgaattcaaaacaagcgattatcacagcaattattttaatagcactgagcttgattttacctgcatttgcagtaggtaatcacatttcaatcttcgtcatttctatgatattctttgcaggtagctttgctttaatgtatgcacctttacttaacgaagccattaaaacaatagatcttaatatgacaggtgtggctattggtttttataatttaattattaatgtggcggtatctgtaggtattgcgattgctgcggctctaatcgattttaaagcattaaatttcccaggcaatgatgcattaagttcacatttcggtattattttaattattttaggtttaatgagtattgtcggattagttttattcgtcagcttaaatcgttggacacaatctgaaaaa

SEQ ID NO: 2730 - protein, 452 aa, Staphylococcus aureus
  MISC_FEATURE (1)..(452): hypothetical protein
MIMNVEYSKIKKAVPILLFLFVFSLVIDNSFKLISVAIADDLNISVTTVSWQATLAGLVIGIGAVVYASLSDAISIRTLFIYGVILIIIGSIIGYIFQHQFPLLLVGRIIQTAGLAAAETLYVIYVAKYLSKEDQKTYLGLSTSSYSLSLVIGTLSGGFISTYLHWTNMFLIALIVVFTLPFLFKLLPKENNTNKAHLDFVGLILVATIATTVMLFITNFNWLYMIGALIAIIVFALYIKNAQRPLVNKSFFQNKRYASFLFIVFVMYAIQLGYIFTFPFIMEQIYHLQLDTTSLLLVPGYIVAVIVGALSGKIGEYLNSKQAIITAIILIALSLILPAFAVGNHISIFVISMIFFAGSFALMYAPLLNEAIKTIDLNMTGVAIGFYNLIINVAVSVGIAIAAALIDFKALNFPGNDALSSHFGIILIILGLMSIVGLVLFVSLNRWTQSEK

SEQ ID NO: 2731 - DNA, 789 bp, Staphylococcus aureus
ttgaaagcgcttttaaaaaatattattatatacatggttagacaaatagacaaatcactatacaaatattgggaggaatattttatgaaatcaacaccacacattaaaccaatgaatgacgtcgaaattgcagaaacggttctattgccaggagatccgttaagagctaagttcattgcagaaacttatttggatgatgtggaacagttcaatacagtgcgaaacatgtttggttttaccggaacatataaaggtaaaaaagtttctgtcatgggttcaggtatgggtatgccatctattggcatttactcttatgaattaattcatacatttggttgtaaaaaattaattcgcgttggctcttgtggcgcgatgcaagaaaacattgatttatatgatgtgattattgcacaaggtgcctctactgattcaaattacgttcaacaatatcaattaccaggtcattttgcgccaattgcttcttatcaattattagaaaaagcagttgaaacagcacgtgacaaaggtgtacgtcatcatgtaggtaatgtgttatcaagtgatattttctataacgcggatacaacagcgagtgaacgttggatgcgtatgggtattttaggtgtagaaatggaatcagctgcattatacatgaatgcaatttacgctggtgtcgaagcattaggtgtgttcacagtgagcgatcatttaattcatgaaacgtcaacaacacctgaggaaagggaacgtgcatttacagatatgattgaaattgcactgtcattggtg

SEQ ID NO: 2732 - protein, 263 aa, Staphylococcus aureus
  MISC_FEATURE (1)..(263): purine nucleoside
LKALLKNIIIYMVRQIDKSLYKYWEEYFMKSTPHIKPMNDVEIAETVLLPGDPLRAKFIAETYLDDVEQFNTVRNMFGFTGTYKGKKVSVMGSGMGMPSIGIYSYELIHTFGCKKLIRVGSCGAMQENIDLYDVIIAQGASTDSNYVQQYQLPGHFAPIASYQLLEKAVETARDKGVRHHVGNVLSSDIFYNADTTASERWMRMGILGVEMESAALYMNAIYAGVEALGVFTVSDHLIHETSTTPEERERAFTDMIEIALSLV

SEQ ID NO: 2733 - DNA, 753 bp, Staphylococcus aureus
atggaggttgtctacgtgacgcaaacacaaccaaaatttttaacgatttataatacgttatataaagaaattcaaataggaaaatatccgagtggccatgcattacctactgaaaaggaactttgtgcgcgctttgatgtcagtcgtatgactttgcgccaagctataaaattgttagccgaagatggcatcgtagagagtacaagagggaagggacactttgttattccacaaacaaatgcccaacacgcttcaagtatggatcaatttaagcatccacttgatcaaatattgctagctcgcgtatctatgtcatcaattaattatcgtgttgatttagaaagtgaatatacaaatcatttgtttgcaaaccatccttctgccgtcattgcaatggaacgctattatcaaaaaaaggacaatcattctaagcaagctgatgcattttgctttacctttataccgttaaatgtcattgacacatttaaagtgaatacacaaaacgaagacgacatgaagacattcgttgagcaaacgatttatagcaatgcatatcaatcagatttaaaaatgtctattaccaaagcgccccacttcaaaaatcatagtcacgtgtttgatggtgatacacattgttggctgattattgaaacactgtacgcacaaacaccttatccaattatgattaataagtggtatattccacaggaaatatctgaattaacactgacacgtataagacaatcggattat

SEQ ID NO: 2734 - protein, 251 aa, Staphylococcus aureus
  MISC_FEATURE (1)..(251): hypothetical protein
MEVVYVTQTQPKFLTIYNTLYKEIQIGKYPSGHALPTEKELCARFDVSRMTLRQAIKLLAEDGIVESTRGKGHFVIPQTNAQHASSMDQFKHPLDQILLARVSMSSINYRVDLESEYTNHLFANHPSAVIAMERYYQKKDNHSKQADAFCFTFIPLNVIDTFKVNTQNEDDMKTFVEQTIYSNAYQSDLKMSITKAPHFKNHSHVFDGDTHCWLIIETLYAQTPYPIMINKWYIPQEISELTLTRIRQSDY

SEQ ID NO: 2735 - DNA, 231 bp, Staphylococcus aureus
atgaaccaacagccacacatgcaacaaggtcatatgcaatcatcaaaccatcaaatgatgagtccaaaagcaaatatgcattcatcaaatcatcaaatgaaccaaagtaacaaaaaagttttaccagctgctggtgaaagtatgacatcaagtattcttactgcaagtattgccgcactactattagtatctgggttattcttagcatttagacgacgttcaacaaataaa

SEQ ID NO: 2736 - protein, 77 aa, Staphylococcus aureus
  MISC_FEATURE (1)..(77): hypothetical protein
MNQQPHMQQGHMQSSNHQMMSPKANMHSSNHQMNQSNKKVLPAAGESMTSSILTASIAALLLVSGLFLAFRRRSTNK

SEQ ID NO: 2737 - DNA, 597 bp, Staphylococcus aureus
atgaaaaaattagcaacagtaggttctttaattgtaacaagcactttagtattctcaagtatgccttttcaaaatgcgcatgccgacacaacttcaatgaatgtgtcgaataaacaaagccaaaatgtacaaaatcatcgtccttatggcggagtagtaccacaaggaatgacgcaagcacaatatactgaattagagaaagctttaccccaattaagcgctggcagtaatatgcaagactataatatgaaattgtatgatgcgacgcaaaatattgctgataaatacaatgtgataattacaactaatgtaggggtatttaaaccacatgctgttagagatatgaatggccatgcgttacctttaacaaaagatggcaatttttatcaaacgaatgtagatgcaaatggtgttaatcatggtggtagtgaaatggtgcaaaataaaacaggtcatatgagtcaacaaggccatatgaatcagaacacacatgaaccaacagccacacatgcaacaaggtcatatgcaatcatcaaaccatcaaatgatgagtccaaaagcaaatatgcattcatcaaatcatcaaatgaaccaaag

SEQ ID NO: 2738 - protein, 199 aa, Staphylococcus aureus
  MISC_FEATURE (1)..(199): hypothetical protein
MKKLATVGSLIVTSTLVFSSMPFQNAHADTTSMNVSNKQSQNVQNHRPYGGVVPQGMTQAQYTELEKALPQLSAGSNMQDYNMKLYDATQNIADKYNVIITTNVGVFKPHAVRDMNGHALPLTKDGNFYQTNVDANGVNHGGSEMVQNKTGHMSQQGHMNQNTHEPTATHATRSYAIIKPSNDESKSKYAFIKSSNEPK

SEQ ID NO: 2739 - DNA, 597 bp, Staphylococcus aureus
atggcatttaaattaccaaatttaccatatgcatatgatgcattggaaccatatatagatcaaagaacaatggagtttcatcacgacaaacatcacaatacgtacgtgacgaaattaaacgcaacagttgaaggaacagagttagagcatcaatcactagcggatatgattgctaacttagacaaggtaccggaagcgatgaggatgtcagtccgtaataatggcggtggtcattttaaccattcattattctgggaaatactatcacctaattctgaagaaaaaggtggcgtaatagatgacatcaaagcgcagtggggcactttagatgaatttaaaaatgaatttgcaaataaagcaacaacattatttggatcaggttggacttggttagttgttaatgatggcaaattagaaattgtgacaacgccaaaccaagataatccattaacagaaggcaaaacaccaatcttactatttgatgtttgggagcatgcctactatctgaaatatcaaaataaacgtccagactatatgactgcattttggaacattgttaactggaaaaaagttgatgaattataccaagcagcaaaa

SEQ ID NO: 2740 - protein, 199 aa, Staphylococcus aureus
  MISC_FEATURE (1)..(199): superoxide dismutase
MAFKLPNLPYAYDALEPYIDQRTMEFHHDKHHNTYVTKLNATVEGTELEHQSLADMIANLDKVPEAMRMSVRNNGGGHFNHSLFWEILSPNSEEKGGVIDDIKAQWGTLDEFKNEFANKATTLFGSGWTWLVVNDGKLEIVTTPNQDNPLTEGKTPILLFDVWEHAYYLKYQNKRPDYMTAFWNIVNWKKVDELYQAAK

SEQ ID NO: 2741 - DNA, 1461 bp, Staphylococcus aureus
ttgttcaatatgaaaagatggaaagggatcgtaatgaagagtgattcactaaaagaaaatattatttatcaagggctataccaattgattagaacgatgacaccactgattacaatacccattatttcacgtgcatttggtcccagtggtgtgggtattgtttcattttctttcaatatcgtgcaatactttttgatgattgcaagtgttggcgttcagttatattttaatagagttatcgcgaagtccgttaacgacaaacggcaattgtcacagcagttttgggatatctttgtcagtaaattatttttagcgttaacagtttttgcgatgtatatggtcgtaattactatatttattgatgattactatcttattttcctactacaaggaatctatattataggtgcagcactcgatatttcatggttttatgctggaactgaaaagtttaaaattcctagcctcagtaatattgttgcgtctggtattgtattaagtgtagttgttatttttgtcaaagatcaatcagatttatcattgtatgtatttactattgctattgtgacggtattaaaccaattacctttgtttatctatttaaaacgatacattagctttgtttcggttaattggatacacgtctggcaattgtttcgttcgtcattagcatacttattaccaaatggacagctcaacttatatactagtatttcttgcgttgttcttggtttagtaggtacataccaacaagttggtatcttttctaacgcatttaatattttaacggtcgcaatcataatgattaatacatttgatcttgtaatgattccgcgtattaccaaaatgtctatccagcaatcacatagtttaactaaaacgttagctaataatatgaatattcaattgatattaacaatacctatggtctttggtttaattgcaattatgccatcattttatttatggttctttggtgaggaattcgcatcaactgtcccattgatgaccattttagcgatacttgtattaatcattcctttaaatatgttgataagcaggcaatatttattaatagtgaataaaataagattatataatgcgtcaattactattggtgcagtgataaacctagtattatgtattattttgatatatttttatggaatttacggtgctgctattgcgcgtttaattacagagtttttcttgctcatttggcgatttattgatattactaaaatcaatgtgaagttgaatattgtaagtacgattcaatgtgtcattgctgctgttatgatgtttattgtgcttggtgtggtcaatcattatttgccccctacaatgtacgctacgctgctattaattgcgattggtatagtagtttatcttttattaatgatgactatgaaaaatcaatacgtatggcaaatattgaggcatcttcgacataaaacaatt

SEQ ID NO: 2742 - protein, 487 aa, Staphylococcus aureus
  MISC_FEATURE (1)..(487): hypothetical protein
LFNMKRWKGIVMKSDSLKENIIYQGLYQLIRTMTPLITIPIISRAFGPSGVGIVSFSFNIVQYFLMIASVGVQLYFNRVIAKSVNDKRQLSQQFWDIFVSKLFLALTVFAMYMVVITIFIDDYYLIFLLQGIYIIGAALDISWFYAGTEKFKIPSLSNIVASGIVLSVVVIFVKDQSDLSLYVFTIAIVTVLNQLPLFIYLKRYISFVSVNWIHVWQLFRSSLAYLLPNGQLNLYTSISCVVLGLVGTYQQVGIFSNAFNILTVAIIMINTFDLVMIPRITKMSIQQSHSLTKTLANNMNIQLILTIPMVFGLIAIMPSFYLWFFGEEFASTVPLMTILAILVLIIPLNMLISRQYLLIVNKIRLYNASITIGAVINLVLCIILIYFYGIYGAAIARLITEFFLLIWRFIDITKINVKLNIVSTIQCVIAAVMMFIVLGVVNHYLPPTMYATLLLIAIGIVVYLLLMMTMKNQYVWQILRHLRHKTI

SEQ ID NO: 2743 - DNA, 1236 bp, Staphylococcus aureus
atggaaaatcaacacaatagtaaattactaacattgttacttatcggtttagcggtttttattcagcaatcttcggttattgccggtgtgaatgtttctatagctgactttatcacattactaatattagtttatttactgtttttcgctaaccatttattaaaggcaaatcattttttacagtttttcattattttgtatacatatcgtatgattattacgctttgtttgctattttttgatgatttgatatttattacggttaaggaagttcttgcatctacagttaaatatgcatttgtagtcatttatttctatttagggatgatcatctttaagttaggtaatagcaaaaaagtgatcgttacctcttatattataagcagtgtgactataggtctattttgtattatagctggtttgaacaagtcccctttactaatgaaattgttatattttgatgaaatacgttcaaaaggattaatgaatgaccctaactatttcgcgatgacacagattattacattggtacttgcttacaagtatattcataattacatattcaaggtccttgcatgtggtattttgctatggtctttaactacaacggggtctaagactgcgtttatcatattaatcgtcttagccatttatttctttattaaaaagttatttagtagaaatgcggtaagtgttgtgagtatgtcagtgattatgctgatattactttgttttaccttttataatatcaactactatttattccaattaagcgaccttgatgccttaccgtcattagatcgaatggcgtctatttttgaagagggctttgcatcattaaatgatagtgggtctgagcgaagtgttgtatggataaatgccatttcagtaattaaatatacactaggttttggtgtcggattagtggattatgtacatattggctcgcaaattaatggtattttacttgttgcccataatacatatttgcagatctttgcggaatggggcattttattcggtgcattatttatcatatttatgctttatttactgtttgaattatttagatttaacatttctgggaaaaatgtaacagcaattgttgtaatgttgacgatgctgatttactttttaacagtatcatttaataactcaagatatgtcgcttttattttaggaattatcgtctttattgttcaatatgaaaagatggaaagggatcgtaatgaagag

SEQ ID NO: 2744 - protein, 412 aa, Staphylococcus aureus
  MISC_FEATURE (1)..(412): hypothetical protein
MENQHNSKLLTLLLIGLAVFIQQSSVIAGVNVSIADFITLLILVYLLFFANHLLKANHFLQFFIILYTYRMIITLCLLFFDDLIFITVKEVLASTVKYAFVVIYFYLGMIIFKLGNSKKVIVTSYIISSVTIGLFCIIAGLNKSPLLMKLLYFDEIRSKGLMNDPNYFAMTQIITLVLAYKYIHNYIFKVLACGILLWSLTTTGSKTAFIILIVLAIYFFIKKLFSRNAVSVVSMSVIMLILLCFTFYNINYYLFQLSDLDALPSLDRMASIFEEGFASLNDSGSERSVVWINAISVIKYTLGFGVGLVDYVHIGSQINGILLVAHNTYLQIFAEWGILFGALFIIFMLYLLFELFRFNISGKNVTAIVVMLTMLIYFLTVSFNNSRYVAFILGIIVFIVQYEKMERDRNEE

SEQ ID NO: 2745 - DNA, 1164 bp, Staphylococcus aureus
ttgaaaattatatattgtattactaaagcagacaatggtggtgcacaaacacatctcattcaactcgccaaccatttttgcgtacacaatgatgtttatgtcattgtaggcaatcatggaccaatgattgaacaactagatgcaagagttaatgtaattattatcgaacatttagtaggtccaattgactttaaacaagatattttagctgtcaaagtgttagcacagttattctcgaaaattaaacctgatgttatccatttacattcttccaaagctggaacggtcggacgaattgcgaagttcatttcgaaatcgaaagacacacgtatagtttttactgcacatggatgggcttttacagagggtgttaaaccagctaaaaaatttctatatttagttatcgaaaaattaatgtcacttattacagatagcattatttgtgtttcagatttcgataaacagttagcgttaaaatatcgatttaatcgattgaaattaaccacaatacataatggtattgcagatgttcccgctgttaagcaaacgctaaaaagccaatcacataacaatattggcgaagtagttggaatgttgcctaataaacaagatttacagattaatgccccgacaaagcatcaatttgttatgattgcaagatttgcttatccaaaattgccacaaaatctaatcgcggcaatagagatattgaaattacataacagtaatcatgcgcattttacatttataggcgatggacctacattaaatgattgtcagcaacaagttgtacaagctgggttagaaaatgatgtcacatttttgggcaatgtcattaatgcgagtcatttattatcacaatacgatacgtttattttaataagtaagcatgaaggtttgccaattagcattatagaagctatggctacaggtttgcctgttatagccagtcatgttggcggtatttcagaattagtagctgataatggtatatgtatgatgaacaaccaacccgaaactattgctaaagtcctggaaaaatatttaatagacagtgattacatcaaaatgagtaatcaatctagaaaacgttatttagaatgttttactgaggagaaaatgattaaagaagtggaagacgtttataatggaaaatcaacacaa

SEQ ID NO: 2746 - protein, 388 aa, Staphylococcus aureus
  MISC_FEATURE (1)..(388): hypothetical protein
LKIIYCITKADNGGAQTHLIQLANHFCVHNDVYVIVGNHGPMIEQLDARVNVIIIEHLVGPIDFKQDILAVKVLAQLFSKIKPDVIHLHSSKAGTVGRIAKFISKSKDTRIVFTAHGWAFTEGVKPAKKFLYLVIEKLMSLITDSIICVSDFDKQLALKYRFNRLKLTTIHNGIADVPAVKQTLKSQSHNNIGEVVGMLPNKQDLQINAPTKHQFVMIARFAYPKLPQNLIAAIEILKLHNSNHAHFTFIGDGPTLNDCQQQVVQAGLENDVTFLGNVINASHLLSQYDTFILISKHEGLPISIIEAMATGLPVIASHVGGISELVADNGICMMNNQPETIAKVLEKYLIDSDYIKMSNQSRKRYLECFTEEKMIKEVEDVYNGKSTQ

SEQ ID NO: 2747 - DNA, 690 bp, Staphylococcus aureus
ttgaagaagttacagctaaagaagtggaaatgtcgtgaaaatgacattgaagctgtccataataataagggttatgcctatcaaagaaaattagacaaactagaagaagtgagaaaaagctattacccaattaaacgtgcgattgacttaattttaagcattgttttattatttttaactttaccgattatggttatattcgccattgctatcgtcatagattcgccaggaaaccctatttatagtcaggttagagttgggaagatgggtaaattaattaaaatatacaaattacgttcgatgtgcaaaaacgcagagaaaaacggtgcgcaatgggctgataaagatgatgatcgtataacaaatgtcgggaagtttattcgtaaaacacgcattgatgaattaccacaactaattaatgttgttaaaggggaaatgagttttattggaccacgcccggaacgtccggaatttgtagaattatttagttcagaagtgataggtttcgagcaaagatgtcttgttacaccagggttaacaggacttgcgcaaattcaaggtggatatgacttaacaccgcaacaaaaactgaaatatgacatgaaatatatacataaaggtagtttaatgatggaactatatatatcaattagaacattgatggttgttattacaggggaaggctcaagg

SEQ ID NO: 2748 - protein, 230 aa, Staphylococcus aureus
  MISC_FEATURE (1)..(230): hypothetical protein
LKKLQLKKWKCRENDIEAVHNNKGYAYQRKLDKLEEVRKSYYPIKRAIDLILSIVLLFLTLPIMVIFAIAIVIDSPGNPIYSQVRVGKMGKLIKIYKLRSMCKNAEKNGAQWADKDDDRITNVGKFIRKTRIDELPQLINVVKGEMSFIGPRPERPEFVELFSSEVIGFEQRCLVTPGLTGLAQIQGGYDLTPQQKLKYDMKYIHKGSLMMELYISIRTLMVVITGEGSR

SEQ ID NO: 2749 - DNA, 978 bp, Staphylococcus aureus
gtggaagatttggaaagagttttgataactggtggggctggttttattgggtcgcatttagtagatgatttacaacaagattatgatgtttatgttctagataactatagaacaggtaaacgagaaaatattaaaagtttggctgacgatcatgtgtttgaattagatattcgtgaatatgatgcagttgaacaaatcatgaagacatatcaatttgattatgttattcatttagcagcattagttagtgttgctgagtcggttgagaaacctatcttatctcaagaaataaacgtcgtagcaacattaagattgttagaaatcattaaaaaatataataatcatataaaacgttttatctttgcttcgtcagcagctgtttatggtgatcttcctgatttgcctaaaagtgatcaatcattaatcttaccattatcaccatatgcaatagataaatattacggcgaacggacgacattaaattattgttcgttatataacataccaacagcggttgttaaattttttaatgtatttgggccaagacaggatcctaagtcacaatattcaggtgtgatttcaaagatgttcgattcatttgagcataacaagccatttacattttttggtgacggactgcaaactagagattttgtatatgtatatgatgttgttcaatctgtacgcttaattatggaacacaaagatgcaattggacacggttataacattggtacaggcacttttactaatttattagaggtttatcgtattattggtgaattatatggaaaatcagtcgagcatgaatttaaagaagcacgaaaaggagatattaagcattcttatgcagatatttctaacttaaaggcattaggatttgttcctaaatatacagtagaaacaggtttaaaggattactttaattttgaggtagataatattgaagaagttacagctaaagaagtggaaatgtcg

SEQ ID NO: 2750 - protein, 326 aa, Staphylococcus aureus
  MISC_FEATURE (1)..(326): hypothetical protein
VEDLERVLITGGAGFIGSHLVDDLQQDYDVYVLDNYRTGKRENIKSLADDHVFELDIREYDAVEQIMKTYQFDYVIHLAALVSVAESVEKPILSQEINVVATLRLLEIIKKYNNHIKRFIFASSAAVYGDLPDLPKSDQSLILPLSPYAIDKYYGERTTLNYCSLYNIPTAVVKFFNVFGPRQDPKSQYSGVISKMFDSFEHNKPFTFFGDGLQTRDFVYVYDVVQSVRLIMEHKDAIGHGYNIGTGTFTNLLEVYRIIGELYGKSVEHEFKEARKGDIKHSYADISNLKALGFVPKYTVETGLKDYFNFEVDNIEEVTAKEVEMS

SEQ ID NO: 2751 - DNA, 120 bp, Staphylococcus aureus
atgcatcagttgaaagcattattagtattaacacacccaagatattataaaacatcacaaaaacaccactatctaatttatctcaataaaaattcacaaagttatctcattttattttta

SEQ ID NO: 2752 - protein, 40 aa, Staphylococcus aureus
MHQLKALLVLTHPRYYKTSQKHHYLIYLNKNSQSYLILFL

SEQ ID NO: 2753 - DNA, 348 bp, Staphylococcus aureus
atgagtaataaagttcaacgttttatagaagcagaaagggagttaagtcagttaaagcactggttaaaaacaacacataagatttcaattgaagaatttgtagtcctttttaaagtgtatgaagctgaaaagattagcggtaaagaattgagggatacattacattttgaaatgctatgggatacaagtaaaatcgatgtgattatccgtaaaatctataaaaaagagcttatttctaaattgcgttctgaaacggatgaaagacaagtattctatttctatagtacttctcaaaagaaattgttagataaaattactaaagaaatagaagtgttaagcgttacaaac

SEQ ID NO: 2754 - protein, 116 aa, Staphylococcus aureus
  MISC_FEATURE (1)..(116): hypothetical protein
MSNKVQRFIEAERELSQLKHWLKTTHKISIEEFVVLFKVYEAEKISGKELRDTLHFEMLWDTSKIDVIIRKIYKKELISKLRSETDERQVFYFYSTSQKKLLDKITKEIEVLSVTN

SEQ ID NO: 2755 - DNA, 1242 bp, Staphylococcus aureus
atgcaagttgttattgcattagtgttaggtgttgtcgtaggacttttattatatggacaagaaaacgtagcaaattacattaaaccatttggtgacgtatttttaaatttaattaaaatgatcgttataccagttgtattttgctcactagcgctttctatttcgaacgttggggaatcgaaaactgtagggcgttatggctggaaaacaattttatactttgaaattattacaacaatcgcaataggtttagggattatcttcggtaacctatttaaaccaggtgctggattagacccaacaaaattacctaaaggtgatatttctaaatatcaatcaactgcacatgcagcagaacaatctacatatggaaatcattttattgataccattgtacatattattccgacaaacttttttgaagctttaaataagggtgaattattacctattatcttcttcgcagtattctttggattaggattagctgctgtaggtaaaaaagcagaaccagttaaagaatttttaagcggatcgcttgaagctgtgttctggatgattaataaaattttaaaattagcaccacttggagtgtttgcattcatttgtactacaattattacatttggtgcatccgcattattaccactattaaaattagtattagttgttgtctttgcaatggtgttctttgtattcgctatactaggactagttgcatggatgtgtggtattaatatcatgaatattattagaatcttgaaaagtgaattgcttttagcattttctacatcaagttcggaagctgtacttcctgtaatgatgaagaaaatggaaaacttcggttctccaaaagaaattacttcttttgttataccaattggttatacgtttaacttagatggatcagcactttatcaatctattgcagcattattcgttgcacagatgtatggaatgcacttaacattatcagagcaaattgtgttgatgttaacattaatgattacgtctaaaggtatggcggcagtaccaggaacttcaatcgttgttttattaacaacattaggtgccatgggcttaccggcacaaggtttagcattaattattggtgttgaccgtatcttagatatggtacgtacatgtgtaaacgttattggtaatgcattatcaacaatcgttatagctaaatgggaaaacgtatatgacaaagcaaaaggtcaagaatatttaaaatcaatt

SEQ ID NO: 2756 - protein, 414 aa, Staphylococcus aureus
  MISC_FEATURE (1)..(141): proton/sodium-glutamate
MQVVIALVLGVVVGLLLYGQENVANYIKPFGDVFLNLIKMIVIPVVFCSLALSISNVGESKTVGRYGWKTILYFEIITTIAIGLGIIFGNLFKPGAGLDPTKLPKGDISKYQSTAHAAEQSTYGNHFIDTIVHIIPTNFFEALNKGELLPIIFFAVFFGLGLAAVGKKAEPVKEFLSGSLEAVFWMINKILKLAPLGVFAFICTTIITFGASALLPLLKLVLVVVFAMVFFVFAILGLVAWMCGINIMNIIRILKSELLLAFSTSSSEAVLPVMMKKMENFGSPKEITSFVIPIGYTFNLDGSALYQSIAALFVAQMYGMHLTLSEQIVLMLTLMITSKGMAAVPGTSIVVLLTTLGAMGLPAQGLALIIGVDRILDMVRTCVNVIGNALSTIVIAKWENVYDKAKGQEYLKSI

SEQ ID NO: 2757 - DNA, 168 bp, Staphylococcus aureus
ttgtttagatttatatcttttggacaacttgttgtttattcgacaacatttatacctaaaaaagatatattacaactcaatggcatggagtgtgacatcaatgttaaagaaccactaaagatttattatgtagtgattcttaagagtgggatagaaatgatattctca

SEQ ID NO: 2758 - protein, 56 aa, Staphylococcus aureus
LFRFISFGQLVVYSTTFIPKKDILQLNGMECDINVKEPLKIYYVVILKSGIEMIFS

SEQ ID NO: 2759 - DNA, 783 bp, Staphylococcus aureus
gtgatctttatgacaaacaacaaagtagcattagtaactggcggagcacaagggattggttttaaaattgcagaacgtttagtggaagatggtttcaaagtagcagttgttgatttcaatgaagaaggggcaaaagcagctgcacttaaattatcaagtgatggtacaaaagctattgctatcaaagcagatgtatcaaaccgtgatgatgtatttaacgcagtaagacaaactgccgcgcaatttggcgatttccatgtcatggttaacaatgccggccttggaccaacaacaccaatcgatacaattactgaagaacagtttaaaacagtatatggcgtgaacgttgcaggtgtgctatggggtattcaagccgcacatgaacaatttaaaaaattcaatcatggcggtaaaattatcaatgcaacatctcaagcaggcgttgagggtaacccaggcttgtctttatattgcagtacaaaattcgcagtgcgaggtttaacacaagtagccgcacaagatttagcgtctgaaggtattactgtgaatgcattcgcacctggtatcgttcaaacaccaatgatggaaagtatcgcagtggcaacagccgaagaagcaggtaaacctgaagcatggggttgggaacaatttacaagtcagattgctttgggcagagtttctcaaccagaagatgtttcaaatgtagtgagcttcttagctggtaaagactctgattacattactggacaaacaattattgtagatggtggtatgagattccgt

SEQ ID NO: 2760 - protein, 261 aa, Staphylococcus aureus
  MISC_FEATURE (1)..(261): acetoin(diacetyl)reductase
VIFMTNNKVALVTGGAQGIGFKIAERLVEDGFKVAVVDFNEEGAKAAALKLSSDGTKAIAIKADVSNRDDVFNAVRQTAAQFGDFHVMVNNAGLGPTTPIDTITEEQFKTVYGVNVAGVLWGIQAAHEQFKKFNHGGKIINATSQAGVEGNPGLSLYCSTKFAVRGLTQVAAQDLASEGITVNAFAPGIVQTPMMESIAVATAEEAGKPEAWGWEQFTSQIALGRVSQPEDVSNVVSFLAGKDSDYITGQTIIVDGGMRFR

SEQ ID NO: 2761 - DNA, 624 bp, Staphylococcus aureus
atggaaaaaaatgtagaaaaatcattcataaagataggtttatattttcaaatagcttatatagtactcatggctataactttatgtgggtttgtaatttgctatggactaattttcggccttttctatttattatcaggtagcagagctgattatttaatagtaacaatagttatatcggcaataatttctatatttgtaattatactttcaatcgtacctgtcatcgtattggcatctgacttatttaaagaaaggatttcaaaaggtgtcatattaattgtattggctattatcgctttagtattatgcaactttgtatctgcaatactctggtttgtttcagccatatctattttaggtagaaaaaaattagtagctgcagcagatactaccactattcaaaaaagtaaagggaacgcaaatcaagcatcacataaagacacgtgtaaaaaggaacttgatagtcaagacatgatggaacatcctgaggttaaaaatcccacgactaaaaaccttgaaggatttaacgaagaaatacataaagatgaagctacaactaaagttgtcagtgataacacggaaccgcctattgaatcaaaagaccatgtctcgaaaaaagat

SEQ ID NO: 2762 - protein, 208 aa, Staphylococcus aureus
  MISC_FEATURE (1)..(208): hypothetical protein
MEKNVEKSFIKIGLYFQIAYIVLMAITLCGFVICYGLIFGLFYLLSGSRADYLIVTIVISAIISIFVIILSIVPVIVLASDLFKERISKGVILIVLAIIALVLCNFVSAILWFVSAISILGRKKLVAAADTTTIQKSKGNANQASHKDTCKKELDSQDMMEHPEVKNPTTKNLEGFNEEIHKDEATTKVVSDNTEPPIESKDHVSKKD

SEQ ID NO: 2763 - DNA, 411 bp, Staphylococcus aureus
atgagtatgagctcaattataggaaaaatagcaatttggataggcatcgtagctcaaatatattttagtgtcgtttttgttaggatgatatctattaatattgctggaggatctgattacgaaacaatttttttattaggattaatattggctcttttcactgttttaccaaccatctttactgcgatttatatggaaagttactctgtaatcggaggtgcactttttattgtttatgctattattgcactgtgtttatataatttcctttcgtcaattttatggctgattggtggtattttgctgatttggaataaatactcaaaagatgaatcgacagacgaaaatgaaaaagttgatattgaaagtacagagaatcaatttgaatctaaagataaaatcactaaagaa

SEQ ID NO: 2764 - protein, 137 aa, Staphylococcus aureus
MSMSSIIGKIAIWIGIVAQIYFSVVFVRMISINIAGGSDYETIFLLGLILALFTVLPTIFTAIYMESYSVIGGALFIVYAIIALCLYNFLSSILWLIGGILLIWNKYSKDESTDENEKVDIESTENQFESKDKITKE

SEQ ID NO: 2765 - DNA, 762 bp, Staphylococcus aureus
ttgaatcatattcatgaacatttaaaattggtaccagtagataagattgatcttcacgaaacattcgaacctttaagattggaaaaaacgaaaagtagtattgaagcagatgattttatacgtcatcctattttagtgacagcgatgcaacatggtagatatatggttatagatggtgtgcatcggtatacaagtttgaaagcgttaggatgtaagaaagttccagtgcaagaaatccatgaaacacaatattcaattagtacatggcaacataaagttccatttggtgtgtggtgggaaacgttacaacaagaacatcgcttgccatggactactgagacaagacaagaagcgccatttattacaatgtgtcatggtgatacagaacaatatttgtatacaaaagatttaggcgaagcacattttcaagtatgggaaaaggttgtcgcaagttatagtggttgttgttctgtagagagaattgcacaaggtacatatccttgtctttctcaacaagatgtactcatgaagtatcagccattgagttataaggaaattgaagcggttgttcataaaggggaaactgtgccagcaggtgtgacacgctttaatatttcaggacgatgtcttaatcttcaagtaccactggcattacttaaacaagatgatgatgttgaacaactgcgcaattggaagcagtttttagcagataagtttgccaatatgagatgctatactgaaaaagtatacttggtggagcaa

SEQ ID NO: 2766 - protein, 254 aa, Staphylococcus aureus
  MISC_FEATURE (1)..(254): hypothetical protein
LNHIHEHLKLVPVDKIDLHETFEPLRLEKTKSSIEADDFIRHPILVTAMQHGRYMVIDGVHRYTSLKALGCKKVPVQEIHETQYSISTWQHKVPFGVWWETLQQEHRLPWTTETRQEAPFITMCHGDTEQYLYTKDLGEAHFQVWEKVVASYSGCCSVERIAQGTYPCLSQQDVLMKYQPLSYKEIEAVVHKGETVPAGVTRFNISGRCLNLQVPLALLKQDDDVEQLRNWKQFLADKFANMRCYTEKVYLVEQ

SEQ ID NO: 2767 - DNA, 1200 bp, Staphylococcus aureus
atgcgtatagttcaacctgttattgaacaattaaaagcacaatctcatccagtttgtcattatatctatgatttagtcggactggaacatcatttgcaacatattacatcgtcattgccgagtaattgtcaaatgtactatgcaatgaaagcaaatagtgaacgaaaaatcctagatacaattagtcagtatgttgaaggattcgaagttgcatctcaaggtgaaatagcaaaaggtcttgcttttaaaccagcaaatcatattatttttggtggccctggtaagacagacgaggaactaagatatgcagtaagtgaaggtgttcagcgtattcatgttgaaagtatgcatgaattacaacggctaaatgccatcttagaagatgaagataagacacaacacattttattgcgtgttaatttagcaggaccatttcccaatgcaacgttgcatatggcaggacgcccaacacaatttggtatttctgaagacgaagttgatgatgtcattgaagctgcgctcgcaatgccaaagattcatctagatggatttcattttcattctatttctaacaatttagactcgaatttacatgtcgatgtagtgaaactttattttaaaaaagcaaaggcatggtctgaaaaacatcgatttccactcaaacatatcaatcttggtggtggcataggcgttaactatgcagatttaactaaccaatttgaatgggataattttgtagaacgttttaaaacacttatcgttgagcaagaaatggaagatgtgacattgaactttgaatgtgggcgctttattgtggcacatattggttactatgtgacagaagtgctagacattaagaaagtacatggtgcttggtatgccatattaagaggaggtacgcaacaatttagactgccggtatcttggcaacataaccatccttttgacatttatcgctataaggacaatccatattcatttgaaaaagtttcaatttcgagacaggacacaacgttagtcggtcaattatgtacaccgaaagatgtctttgctagagaagtacagatagacgcaatcagtacaggcgacgttattgttttcaaatatgcaggtgcatacggatggtctatttcacatcacgatttcttaagccatccacatcctgaatttatttatttaacacaaacaaaggaggatgaa

SEQ ID NO: 2768 - protein, 400 aa, Staphylococcus aureus
  MISC_FEATURE (1)..(400): hypothetical protein
MRIVQPVIEQLKAQSHPVCHYIYDLVGLEHHLQHITSSLPSNCQMYYAMKANSERKILDTISQYVEGFEVASQGEIAKGLAFKPANHIIFGGPGKTDEELRYAVSEGVQRIHVESMHELQRLNAILEDEDKTQHILLRVNLAGPFPNATLHMAGRPTQFGISEDEVDDVIEAALAMPKIHLDGFHFHSISNNLDSNLHVDVVKLYFKKAKAWSEKHRFPLKHINLGGGIGVNYADLTNQFEWDNFVERFKTLIVEQEMEDVTLNFECGRFIVAHIGYYVTEVLDIKKVHGAWYAILRGGTQQFRLPVSWQHNHPFDIYRYKDNPYSFEKVSISRQDTTLVGQLCTPKDVFAREVQIDAISTGDVIVFKYAGAYGWSISHHDFLSHPHPEFIYLTQTKEDE

SEQ ID NO: 2769 - DNA, 777 bp, Staphylococcus aureus
atgatgcaacaactatctctgaaacatagattaaacaatggtgattcagtttatggcatttttaattctataccggacccattgatgatcgaggttatcgcagcaagcgggtatgactttgttgtgattgatacagaacacgtggcgattaatgatgagacactagcgcatttaattcgtgcagctgaagcagcgcatattataccaattgtacgtgtcactgcagtgatagatagagatatcattaaagtgttggatatgggtgcgagaggtattattgtgccacacgttaaagatcgtgagacagttgagcatattgtgaaattaagtcgttattacccgcaaggattaagaagtttgaatggtggtcgcatggcaagatttggacgtacaccattacttgatgcaatggagatggctaatgagcatattatggtgattgccatgatagaagatgttgaaggggttatggccattgacgatatagcacaagtcgaaggtttagacatgatagtcgaaggtgccgcagatttatcgcagtcacttggcataccatggcaaacgcgtgatgatcaagtaacatcacatgttcaacatatttttgaagttgtgaatgcacatggtaaacatttttgtgcattaccacgtgaagatgaagatattgcaaaatggcaggcacaaggtgtacaaacatttattttaggtgatgatcgcggaaaaatatatcgccatttaagtgcatctctagcgacgtctaaacagaaaggggatgaaggc

SEQ ID NO: 2770 - protein, 259 aa, Staphylococcus aureus
  MISC_FEATURE (1)..(259): hypothetical protein
MMQQLSLKHRLNNGDSVYGIFNSIPDPLMIEVIAASGYDFVVIDTEHVAINDETLAHLIRAAEAAHIIPIVRVTAVIDRDIIKVLDMGARGIIVPHVKDRETVEHIVKLSRYYPQGLRSLNGGRMARFGRTPLLDAMEMANEHIMVIAMIEDVEGVMAIDDIAQVEGLDMIVEGAADLSQSLGIPWQTRDDQVTSHVQHIFEVVNAHGKHFCALPREDEDIAKWQAQGVQTFILGDDRGKIYRHLSASLATSKQKGDEG

SEQ ID NO: 2771 - DNA, 1848 bp, Staphylococcus aureus
atgattgtggtgcaaaccctatttatacacatataccaaatccaatttgtcataacaaggaggtatcgtattgtgaatcaaacaattcttaatcgtgtaaagactagagtgatgcaccaactggtatcatcacttatttatgagaatattgttgtgtataaagcgtcatatcaagacggtgtcggtcattttacaatagaaggacatgattcagagtatcgttttactgctgaaaagacacatagctttgatcgtatacgtatcacatcaccaattgagcgtgtcgtaggagatgaggcagatacaacaacagactatacacaattattgagagaggttgtatttacatttcctaaaaatgatgaaaagctagaacaatttattgtcgagttattacagacagaattaaaagatacgcaaagtatgcagtatcgagaatcaaacccaccagcaacacctgagacatttaacgactatgaattttatgcgatggaagggcatcagtatcatccaagttacaaatcacgtttaggatttacgttgagtgataatttgaaatttggtcctgattttgtaccaaacgttaaactgcagtggttagctatcgacaaagataaagtagaaacgacggtatcaagaaatgttgtagttaacgaaatgttacgtcaacaagttggcgataagacttatgaacattttgtacagcaaattgaagcatctggcaaacatgtaaatgatgttgagatgatacctgtacacccatggcagtttgaacatgtcatccaagttgatttggctgaagaaaggcttaatggcacagtactatggttaggggaaagtgatgagctatatcaccctcaacaatcgattcgtacgatgtcgccaatagacacgacaaaatattatttaaaggtaccaataagtataacgaacacttcaacgaaacgagtgttggcgcctcatacaattgaaaatgcagcgcaaattacggattggttaaagcagatacagcaacaagatatgtatttaaaagatgaattaaagacagtttttctaggggaagtcttaggacagtcttatttaaatacacaactttcgccttataaacaaactcaagtttatggtgcgttaggtgttatatggcgtgaaaatatatatcatatgttaatcgatgaagaggatgcgataccatttaatgcactttatgcaagtgataaggatggtgtaccattcattgaaaattggattaaacaatatggttctgaagcttggacaaagcaatttttagctgtagcgattcgtccaatgattcatatgctttattatcacggtattgcctttgaatcgcatgcacaaaatatgatgctcattcatgaaaatggttggcctacacgtattgccttaaaagatttccatgatggtgttcgttttaagcgtgagcatttaagtgaagctgcttcacacctgacattaaagccaatgccagaagcacataaaaaagtgaatagtaattcatttattgaaacagatgacgaacgtttagtacgcgactttttacatgatgcatttttctttattaatatcgccgaaatcatcttatttattgaaaagcaatatggtatcgatgaggagctgcaatggcaatgggttaaaggcatcatcgaggcgtatcaagaagcatttccagagttgaataactatcaacatttcgatttgtttgaacctacgattcaagttgaaaagttaacgacacgtcgattattaagtgactccgagttaagaattcatcatgttacaaatccattaggtgtaggaggtatcaatgatgcaacaactatctctgaaaca

SEQ ID NO: 2772 - protein, 616 aa, Staphylococcus aureus
  MISC_FEATURE (1)..(616): hypothetical protein
MIVVQTLFIHIYQIQFVITRRYRIVNQTILNRVKTRVMHQLVSSLIYENIVVYKASYQDGVGHFTIEGHDSEYRFTAEKTHSFDRIRITSPIERVVGDEADTTTDYTQLLREVVFTFPKNDEKLEQFIVELLQTELKDTQSMQYRESNPPATPETFNDYEFYAMEGHQYHPSYKSRLGFTLSDNLKFGPDFVPNVKLQWLAIDKDKVETTVSRNVVVNEMLRQQVGDKTYEHFVQQIEASGKHVNDVEMIPVHPWQFEHVIQVDLAEERLNGTVLWLGESDELYHPQQSIRTMSPIDTTKYYLKVPISITNTSTKRVLAPHTIENAAQITDWLKQIQQQDMYLKDELKTVFLGEVLGQSYLNTQLSPYKQTQVYGALGVIWRENIYHMLIDEEDAIPFNALYASDKDGVPFIENWIKQYGSEAWTKQFLAVAIRPMIHMLYYHGIAFESHAQNMMLIHENGWPTRIALKDFHDGVRFKREHLSEAASHLTLKPMPEAHKKVNSNSFIETDDERLVRDFLHDAFFFINIAEIILFIEKQYGIDEELQWQWVKGIIEAYQEAFPELNNYQHFDLFEPTIQVEKLTTRRLLSDSELRIHHVTNPLGVGGINDATTISET

SEQ ID NO: 2773 - DNA, 1734 bp, Staphylococcus aureus
gtgcaaaataaagaattaatacaacatgcagcgtatgcggctatcgaacgcattttaaatgaatattttagagaagaaaatttatatcaagtaccacctcaaaatcatcaatggtctatacaattatcagagctcgaaactttaacgggtgaatttcgctattggtctgcgatggggcatcatatgtatcatccagaggtatggcttatcgatggaaaaagtaaaaaaataacaacttataaagaagcaattgcgcgtattttgcaacatatggctcaaagtgcagataatcaaacggcagtgcaacaacatatggcgcaaattatgtctgacatcgataatagcattcatcgcacggcacgttatttgcaaagtaacacaatagactacgtagaggatcgttatatcgtttcagaacaatctttatacttaggtcatccatttcatccgactcctaagagtgcaagtgggttttcagaagcagatttagagaaatatgcacccgaatgtcatacatcattccaattgcattatttagctgtgcatcaagatgttctgctcacgcgctatgtagaaggtaaagaagatcaggttgagaaagtgttgtatcaattagcagacatagatatatcagagatacccaaagattttattttattaccaacacatccttatcaaatcaatgtgttgcgacagcatccacagtatatgcaatatagtgaacaaggtttaataaaagaccttggcgtttccggtgattcagtgtacccgacgtcttcggttagaactgtattttcaaaagcattaaacatttatttaaaattaccgatacacgttaaaatcactaattttatacgtacgaatgaccttgaacagattgaacggacaattgatgccgcgcaagttatcgcatcagtcaaagatgaggttgaaacaccccattttaaattgatgtttgaagaaggatatcgtgcattgttaccgaatccattagggcaaacagttgaacctgaaatggatttattaacaaatagtgccatgattgttcgtgaagggataccgaattaccatgctgataaagatattcatgtattggcgtcattatttgaaacgatgcctgattcaccgatgtctaagttatcacaagtgattgagcaaagtggtttagcaccagaagcatggcttgaatgttatttgaatcgtacattattgccgatattaaagctgtttagtaacacaggcattagtctagaagcacatgtacaaaatacattaattgaattaaaagatggcatacccgacgtatgctttgtcagagatcttgaaggcatttgtctatctagaacgattgctactgaaaaacagcttgtgccaaatgttgtggcagcatcaagccctgttgtatatgcacatgatgaagcatggcatcgtcttaaatattacgttgtagtaaatcacttaggacatttagtatcaactattggtaaagcgactagaaatgaagttgtgttatggcaacttgtagcgcatcgtcttatgacttggaaaaaagaatacgcgaataacgcagtatttgttgactgtgtagaagatttatatcaaacgccgaccattgcggctaaagcgaatttgatgagtaaattgaatgattgtggtgcaaaccctatttatacacatataccaaatccaatttgtcataacaaggaggtatcgtattgtgaatcaaacaattct

SEQ ID NO: 2774 - protein, 578 aa, Staphylococcus aureus
  MISC_FEATURE (1)..(578): hypothetical protein
VQNKELIQHAAYAAIERILNEYFREENLYQVPPQNHQWSIQLSELETLTGEFRYWSAMGHHMYHPEVWLIDGKSKKITTYKEAIARILQHMAQSADNQTAVQQHMAQIMSDIDNSIHRTARYLQSNTIDYVEDRYIVSEQSLYLGHPFHPTPKSASGFSEADLEKYAPECHTSFQLHYLAVHQDVLLTRYVEGKEDQVEKVLYQLADIDISEIPKDFILLPTHPYQINVLRQHPQYMQYSEQGLIKDLGVSGDSVYPTSSVRTVFSKALNIYLKLPIHVKITNFIRTNDLEQIERTIDAAQVIASVKDEVETPHFKLMFEEGYRALLPNPLGQTVEPEMDLLTNSAMIVREGIPNYHADKDIHVLASLFETMPDSPMSKLSQVIEQSGLAPEAWLECYLNRTLLPILKLFSNTGISLEAHVQNTLIELKDGIPDVCFVRDLEGICLSRTIATEKQLVPNVVAASSPVVYAHDEAWHRLKYYVVVNHLGHLVSTIGKATRNEVVLWQLVAHRLMTWKKEYANNAVFVDCVEDLYQTPTIAAKANLMSKLNDCGANPIYTHIPNPICHNKEVSYCESNNS

SEQ ID NO: 2775 - DNA, 1254 bp, Staphylococcus aureus
atgattaatcagtctatatggcgcagtaactttcgcattttatggctcagtcagtttatagcgattgctggactgacagtacttgtgccattattgccaatttatatggcatcactacaaaatctatcagtcgtagaaatacagttgtggagtggtatagcgattgctgctccagctgtaacgacgatgatagcttcgccgatatgggggaagctaggtgataagatcagccgaaaatggatggtgttaagagcgttacttggtttggcggtatgcttatttttaatggcattgtgtacgacaccattacagtttgtacttgtgaggttattgcagggactatttggtggtgttgttgatgcatcaagtgcgtttgcgagtgcagaggcgccagctgaagatcgtggaaaggtattaggaagactgcaaagttcagtcagcgcagggtctcttgtggggccattaattggcggtgttacagcttcgatattaggttttagtgcgttactgatgagtattgccgttattacttttattgtctgtattttcggtgcattaaaattgattgaaacgacacatatgccaaaatcacaaacaccaaatattaataaaggtattcgccgttcatttcaatgtctattatgcacacaacaaacatgtcgatttattatcgttggcgttttagcaaactttgctatgtatggcatgctaactgcattatcaccacttgcttcatcagtgaatcatacagcgatagatgaccgtagtgtgattggatttttacagtccgcattttggacggcttcgatattaagcgcgcctttatggggacgctttaatgataaatcatatgttaaatcagtatatatatttgccacgattgcatgtggttgtagtgcgatactgcaaggtttagcgacgaatatagagtttttaatggctgcaagaatacttcaaggattaacatatagtgcattgattcaaagtgtcatgtttgttgtcgtgaatgcgtgtcatcaacaacttaaaggcacatttgttggaacgacgaacagtatgttagttgttggtcaaattattggcagtcttagtggcgctgccattacaagttatactacaccagctactacgtttatcgttatgggcgtagtatttgcagtaagtagtttatttttaatttgttcaaccatcactaatcaaatcaacgatcacacattaatgaaattatgggagttgaaacaaaaaagtgcaaaa

SEQ ID NO: 2776 - protein, 418 aa, Staphylococcus aureus
  MISC_FEATURE (1)..(418): hypothetical protein
MINQSIWRSNFRILWLSQFIAIAGLTVLVPLLPIYMASLQNLSVVEIQLWSGIAIAAPAVTTMIASPIWGKLGDKISRKWMVLRALLGLAVCLFLMALCTTPLQFVLVRLLQGLFGGVVDASSAFASAEAPAEDRGKVLGRLQSSVSAGSLVGPLIGGVTASILGFSALLMSIAVITFIVCIFGALKLIETTHMPKSQTPNINKGIRRSFQCLLCTQQTCRFIIVGVLANFAMYGMLTALSPLASSVNHTAIDDRSVIGFLQSAFWTASILSAPLWGRFNDKSYVKSVYIFATIACGCSAILQGLATNIEFLMAARILQGLTYSALIQSVMFVVVNACHQQLKGTFVGTTNSMLVVGQIIGSLSGAAITSYTTPATTFIVMGVVFAVSSLFLICSTITNQINDHTLMKLWELKQKSAK

SEQ ID NO: 2777 - DNA, 1752 bp, Staphylococcus aureus
ttgcagaatcatacagcagtcaatacagcacaagcgataatattaagagatttagttgatgcattattatttgaagatatagccggaattgtatcgaatagtgagattactaaagaaaacggacaaacgcttttgatatacgaacgtgaaacacaacaaataaagatacctgtttattttagtgctttaaatatgtttcgttacgaaagttcacaaccaattacgatagagggaagggtgtctaagcaacctttaacggcagctgaattttggcaaacaattgctaatatgaattgtgatctaagtcatgaatgggaagtggctcgcgttgaagaaggactgactactgctgccacacagcttgctaaacaattatcagaattagatttagcgtcacatccttttgtgatgtcagagcagtttgcaagtttaaaagatcgtccatttcatccattagctaaagaaaaaagaggattaagagaagcggattatcaagtgtatcaagctgaattaaatcaatcatttcctttaatggttgcagcagttaaaaagacacatatgattcatggcgatactgcaaatatcgatgaattagaaaatttgacagtacctataaaagaacaagcgacagacatgttaaatgatcaagggttatcaatagatgactatgtactatttccggtacatccttggcaatatcagcatattctgccgaacgtctttgcgaaagagattagtgaaaagttggttgtactattaccgttaaaatttggagattatctgtcgtcttcaagtatgcgttcattaattgatattggcgcaccgtataaccatgtcaaagtaccatttgcaatgcagtcattaggcgcattaaggctaacgcctacgcgttacatgaaaaacggagaacaagcagaacaattattacgtcagcttatagaaaaagatgaagcactagctaagtatgtcatggtttgtgatgaaacagcttggtggtcatatatgggtcaagataatgatattttcaaagatcaattaggtcatctaactgttcagctaagaaagtatcccgaagtgctagccaaaaatgatacgcaacagctagtgtcaatggcagcactcgcggcaaatgatcgcactttatatcaaatgatttgtggaaaagataatatttctaaaaatgatgtcatgacgttatttgaagatatcgcgcaagtctttttaaaggtaacactatcatttatgcaatacggcgcattaccagagttgcatggtcaaaatatattgttgtcatttgaagatggacgtgtacaaaaatgcgtgttacgtgatcatgatactgtcagaatttataaaccatggctaacagcacatcagctttcattgccgaagtatgtcgtcagagaagatacacctaatacgctaattaatgaggatttggaaacattctttgcttattttcaaacattagctgtatcggtaaatctatatgccattattgatgcaattcaagatttatttggtgtaagtgagcatgaacttatgtcgttgttaaaacaaattttaaaaaatgaagtggcaactatttcctgggttacaactgatcagctagctgtcagacacattttatttgataaacagacgtggccattcaaacaaattttattaccattgctatatcaacgtgatagtggtggaggtagtatgccttcaggtttaactaccgtaccaaatccaatggtgacatatgat

SEQ ID NO: 2778 - protein, 584 aa, Staphylococcus aureus
  MISC_FEATURE (1)..(584): conserved hypothetical
LQNHTAVNTAQAIILRDLVDALLFEDIAGIVSNSEITKENGQTLLIYERETQQIKIPVYFSALNMFRYESSQPITIEGRVSKQPLTAAEFWQTIANMNCDLSHEWEVARVEEGLTTAATQLAKQLSELDLASHPFVMSEQFASLKDRPFHPLAKEKRGLREADYQVYQAELNQSFPLMVAAVKKTHMIHGDTANIDELENLTVPIKEQATDMLNDQGLSIDDYVLFPVHPWQYQHILPNVFAKEISEKLVVLLPLKFGDYLSSSSMRSLIDIGAPYNHVKVPFAMQSLGALRLTPTRYMKNGEQAEQLLRQLIEKDEALAKYVMVCDETAWWSYMGQDNDIFKDQLGHLTVQLRKYPEVLAKNDTQQLVSMAALAANDRTLYQMICGKDNISKNDVMTLFEDIAQVFLKVTLSFMQYGALPELHGQNILLSFEDGRVQKCVLRDHDTVRIYKPWLTAHQLSLPKYVVREDTPNTLINEDLETFFAYFQTLAVSVNLYAIIDAIQDLFGVSEHELMSLLKQILKNEVATISWVTTDQLAVRHILFDKQTWPFKQILLPLLYQRDSGGGSMPSGLTTVPNPMVTYD

SEQ ID NO: 2779 - DNA, 1008 bp, Staphylococcus aureus
atgaatagagagatgttgtatttaaatagatcagatattgaacaagcgggaggtaatcattcacaagtttatgtggacgcattaacagaagcattaacagcccatgcgcacaatgattttgtacaaccgcttaagccgtatttaagacaggatcctgaaaatggacacatcgcagatcgaattattgcaatgccaagtcatatcggtggtgaacacgcaatttcaggtattaagtggataggtagtaagcacgacaatccatcgaaacgtaatatggagcgtgcaagtggcgtcattattttgaatgatccagaaacgaattatccaattgcagttatggaagcaagtttaattagtagtatgcgtactgcagcagtttcagtgattgcagcaaagcatttggctaaaaaaggatttaaagacttaacaatcattggatgcgggctaatcggagacaagcaattacaaagtatgttagagcaattcgatcatattgaacgcgtgtttgtttacgatcaattctctgaagcatgtgcacgctttgttgatagatggcaacaacagcgtccggaaattaattttattgcgacagaaaatgctaaagaagcagtatcaaatggtgaagtagtcattacatgtaccgtaacggatcaaccatacattgaatatgattggttacaaaagggtgcatttattagcaacatttctatcatggatgtgcataaagaagtctttattaaagctgacaaagtcgtagtagatgactggtcacaatgtaatcgagaaaagaaaactattaaccaattggtgttagaaggtaaattcagcaaagaagctcttcatgctgaactaggacaacttgtgacaggtgacataccaggacgtgaagacgatgatgagatcatattacttaatccgatgggtatggctatcgaagatatttcaagtgcttattttatttatcaacaggcacaacaacaaaatattgggacaacattgaacctatat

SEQ ID NO: 2780 - protein, 336 aa, Staphylococcus aureus
  MISC_FEATURE (1)..(336): hypothetical protein
MNREMLYLNRSDIEQAGGNHSQVYVDALTEALTAHAHNDFVQPLKPYLRQDPENGHIADRIIAMPSHIGGEHAISGIKWIGSKHDNPSKRNMERASGVIILNDPETNYPIAVMEASLISSMRTAAVSVIAAKHLAKKGFKDLTIIGCGLIGDKQLQSMLEQFDHIERVFVYDQFSEACARFVDRWQQQRPEINFIATENAKEAVSNGEVVITCTVTDQPYIEYDWLQKGAFISNISIMDVHKEVFIKADKVVVDDWSQCNREKKTINQLVLEGKFSKEALHAELGQLVTGDIPGREDDDEIILLNPMGMAIEDISSAYFIYQQAQQQNIGTTLNLY

SEQ ID NO: 2781 - DNA, 978 bp, Staphylococcus aureus
ttgattgaaaaaagtcaagcatgtcacgattcattgttagattctgtagggcaaacacctatggttcaacttcatcaactatttccgaaacatgaagtgtttgcaaagttagagtatatgaatcctggaggcagcatgaaagatcgacctgccaagtacatcattgaacatggtattaaacatggtttaatcactgagaatacacatttaattgaaagtacttctggtaatttaggcattgcgttggcaatgatagctaaaatcaagggattaaaactcacgtgtgttgttgatcctaaaatatcaccaacaaatttgaaaattattaaaagttatggtgccaatgtagaaatggttgaagaacctgatgcacatgggggttatttaatgactcgtattgcaaaggtgcaagaactgttagccactattgacgatgcatattggattaatcaatatgcgaatgagttaaattggcaatcccattatcatggtgcaggcacagagattgttgaaacaattaagcaacctatagattattttgtcgcgccagtcagcacgacaggtagcattatgggtatgagtagaaaaataaaagaagtgcatccaaacgcacaaattgttgctgttgatgcgaaagggtcagtcatttttggtgacaaacctattaatagagaattacctggtatcggtgctagtcgtgtacccgaaatattgaatagatcagaaattaatcaagtgatccatgtagatgattatcaatctgctttgggctgtcgaaaactgattgattatgaaggcatatttgccggaggttcaacaggttcgattattgcagcgattgagcagttgataacgtcaattgaagaaggtgcaacaattgtcacgattttaccagatcgaggcgatcgttacttagatttagtttattcagatacatggttagaaaaaatgaaatcaagacaaggagttaaatcagaa

SEQ ID NO: 2782 - protein, 326 aa, Staphylococcus aureus
  MISC_FEATURE (1)..(326): hypothetical protein
LIEKSQACHDSLLDSVGQTPMVQLHQLFPKHEVFAKLEYMNPGGSMKDRPAKYIIEHGIKHGLITENTHLIESTSGNLGIALAMIAKIKGLKLTCVVDPKISPTNLKIIKSYGANVEMVEEPDAHGGYLMTRIAKVQELLATIDDAYWINQYANELNWQSHYHGAGTEIVETIKQPIDYFVAPVSTTGSIMGMSRKIKEVHPNAQIVAVDAKGSVIFGDKPINRELPGIGASRVPEILNRSEINQVIHVDDYQSALGCRKLIDYEGIFAGGSTGSIIAAIEQLITSIEEGATIVTILPDRGDRYLDLVYSDTWLEKMKSRQGVKSE

SEQ ID NO: 2783 - DNA, 1542 bp, Staphylococcus aureus
gtgtcactgaagggctttattgttgtacaatttgaagtgagtaacatatcaaatctaaggaggtacattatgaattttaaattaaataacacactaagcaacgaaataaatacattgattattggtataccagaacatttaaatcagttagagcgcattagttttaatcatatcgatattacagaatcacttgaaagactaaaacatcaacatattattggtagtaaagttgggaagatttatacaactgcatttgatgtacaagatcaaacatatcgtttaattacagttggtttaggaaacttaaagacacgtagttatcaagatatgttgaaaatatggggacatcttttccaatacataaagtcagaacacattgaagatacgtatttacttatggattcatttatttcaaaatatgatcagttatcagatgtattaatggcatgcggtattcaaagtgagcgtgcaacatatgaattcgatcattataaatcaagtaagaaggcaccgtttaagacgaatttaaaccttattagtgaatcattaattgaattagattttattcatgagggtatcagtattggccaatccattaatttggcaagagactttagtaatatgccaccgaatgtattaacaccacaaacatttgcagaagatattgttaatcattttaaaaatacaaaggtcaaagtagatgttaaagattatgacactttagtttctgaaggattcggacttttacaagcagtaggtaaaggtagtaagcataaaccgagattagtaaccatcacatataatggcaaagacaaagatgaagcaccaattgccttagttggtaaaggtataacgtatgattctggtggttatagtattaaaacgaagaatggcatggctacaatgaagtttgacatgtgtggcgctgcgaatgtcgttggtatcattgaagcggctagtcgtttacaactgcctgtaaatattgtcggagtgcttgcgtgtgctgaaaatatgataaatgaagcatcaatgaagccagatgatgtatttacagcattaagtggtgaaactgtagaagtaatgaatacagacgctgaaggtagattagtccttgcagatgctgtgttttatgcaaatcaatatcagcctagtgtgattatggactttgctacattaacgggtgcagcaattgttgcactaggcgatgataaagctgctgcatttgaatcgaatagtaaagtgatattaaacgatatattacaaataagttctgaagtcgatgaaatggtatttgaattaccgattactgcaaccgaacgtgcaagtattaaacacagtgatatcgctgatttagttaaccatacgaatggacaaggtaaagcgctatttgcggcaagttttgtaacacattttagtggtcaaacacctcacattcatttcgatattgcaggtccagcaacgactaataaagcttcatataatggtccaaaagggccaacaggatttatgattccgacgatagtacaatggttaaaacaacaa

SEQ ID NO: 2784 - protein, 514 aa, Staphylococcus aureus
  MISC_FEATURE (1)..(514): probable cytosol
VSLKGFIVVQFEVSNISNLRRYIMNFKLNNTLSNEINTLIIGIPEHLNQLERISFNHIDITESLERLKHQHIIGSKVGKIYTTAFDVQDQTYRLITVGLGNLKTRSYQDMLKIWGHLFQYIKSEHIEDTYLLMDSFISKYDQLSDVLMACGIQSERATYEFDHYKSSKKAPFKTNLNLISESLIELDFIHEGISIGQSINLARDFSNMPPNVLTPQTFAEDIVNHFKNTKVKVDVKDYDTLVSEGFGLLQAVGKGSKHKPRLVTITYNGKDKDEAPIALVGKGITYDSGGYSIKTKNGMATMKFDMCGAANVVGIIEAASRLQLPVNIVGVLACAENMINEASMKPDDVFTALSGETVEVMNTDAEGRLVLADAVFYANQYQPSVIMDFATLTGAAIVALGDDKAAAFESNSKVILNDILQISSEVDEMVFELPITATERASIKHSDIADLVNHTNGQGKALFAASFVTHFSGQTPHIHFDIAGPATTNKASYNGPKGPTGFMIPTIVQWLKQQ

SEQ ID NO: 2785 - DNA, 1206 bp, Staphylococcus aureus
atggctcaagatcgtaaaaaagtacttgtacttggtgctggttatgcaggtttacaaactgtaactaaattgcaaaaagcgatatcaacagaagaagcagaaattacgcttattaataaaaatgaatatcactatgaagcaacatggttacatgaagcatcagcaggtacactaaactatgaagatgtattatatcctgtggaaagtgtcttgaagaaagacaaagtgaactttgttcaagcagaagtaacaaaaattgaccgtgatgctaaaaaggtagaaacaaatcaaggtatttatgactttgatattttagtagtagcattaggtttcgttagtgaaacattcggcatcgaaggtatgaaagatcatgctttccaaattgaaaatgttatcacagcacgtgaattatcacgtcatatcgaagacaaatttgctaactatgcagcatcaaaagaaaaagatgataacgatttatctatcttagttggtggtgctggattcactggtgttgaattcttaggtgaattaacagacagaattcctgaattatgtagcaaatatggtgtggatcaaaataaagttaaaatcacttgtgttgaagcagcacctaaaatgttaccaatgttctcagaagaattagttaaccacgcagttagctacttagaagaccgcggtgttgaatttaaaattgctacaccaatcgttgcttgtaacgaaaaaggttttgtagttgaagtagatggtgaaaaacaacaattaaatgcaggtacttcagtatgggcagctggtgtacgtggtagtaaattaatggaagaatcatttgaaggcgttaaacgtggacgtatcgttacaaagcaagatttaacaatcaatggttacgacaacatttttgttattggtgactgttcagcgtttatcccagctggagaagaacgtccattaccaactacagcacaaattgcaatgcaacaaggtgaaagtgttgctaaaaacattaaacgcatcttaaacggtgaatcaactgaagaattcgaatacgttgatcgtggaactgtttgttctttaggttcacatgacggtgtaggtatggtatttggtaaacctatcgctggtaaaaaagcagcattcatgaaaaaagtgattgatacacgtgcggtattcaaaatcggtggtatcggtttagcattcaaaaaaggtaaattc

SEQ ID NO: 2786 - protein, 402 aa, Staphylococcus aureus
  MISC_FEATURE (1)..(402): hypothetical protein
MAQDRKKVLVLGAGYAGLQTVTKLQKAISTEEAEITLINKNEYHYEATWLHEASAGTLNYEDVLYPVESVLKKDKVNFVQAEVTKIDRDAKKVETNQGIYDFDILVVALGFVSETFGIEGMKDHAFQIENVITARELSRHIEDKFANYAASKEKDDNDLSILVGGAGFTGVEFLGELTDRIPELCSKYGVDQNKVKITCVEAAPKMLPMFSEELVNHAVSYLEDRGVEFKIATPIVACNEKGFVVEVDGEKQQLNAGTSVWAAGVRGSKLMEESFEGVKRGRIVTKQDLTINGYDNIFVIGDCSAFIPAGEERPLPTTAQIAMQQGESVAKNIKRILNGESTEEFEYVDRGTVCSLGSHDGVGMVFGKPIAGKKAAFMKKVIDTRAVFKIGGIGLAFKKGKF

SEQ ID NO: 2787 - DNA, 357 bp, Staphylococcus aureus
atgccaacagttatattaacagaagcagctgcttacgaagtaaaagatatgcttaaagcaaatgaaatgccagatggctatttaaaaattaaagtgaatggtggcgggtgcactgggttaacatacggtatgggtgcagaagaagcgcctggggaaaatgatgaagtcttagaatactttggattaaaagtattagtagacaaaaaagatgcacccgtattaaatggtacgactattgattttaagcaatcattaatgggtggcggtttccaaatcgacaatcctaatgcaattgcttcatgtggctgtggtagttcatttagaactgcaaaagttgcaggtaatcctgaaaattgc

SEQ ID NO: 2788 - protein, 119 aa, Staphylococcus aureus
  MISC_FEATURE (1)..(119): conserved hypothetical
MPTVILTEAAAYEVKDMLKANEMPDGYLKIKVNGGGCTGLTYGMGAEEAPGENDEVLEYFGLKVLVDKKDAPVLNGTTIDFKQSLMGGGFQIDNPNAIASCGCGSSFRTAKVAGNPENC

SEQ ID NO: 2789 - DNA, 234 bp, Staphylococcus aureus
atgaatccgatcgtagaattttgtctctctaacatggcaaaaggtggagattatgtttttaatcaactggaaaatgacccagatgtcgatgtgttagagtatggttgcctgacacattgtggtatatgttcagccgggttgtatgctttagtaaatggtgatattgttgaaggtgattcgccggaagaattattacaaaatatatatgcacatataaaagaaacttggattttt

SEQ ID NO: 2790 - protein, 78 aa, Staphylococcus aureus
  MISC_FEATURE (1)..(78): conserved hypothetical
MNPIVEFCLSNMAKGGDYVFNQLENDPDVDVLEYGCLTHCGICSAGLYALVNGDIVEGDSPEELLQNIYAHIKETWIF

SEQ ID NO: 2791 - DNA, 1062 bp, Staphylococcus aureus
atgaaaaacttagttttgttaggcggcggatatggtaatatgcgtatcatgtcacgcattttaactacttctttaccacaagattatacagtcacattagttgatcgtatgccatttcatggattgaaaccagaattttatgctttagctgcgggcacgaaatcagataaagatgttcgtatgaaattccctaatcatccacaagtgaatacagtttatggtgaaattaacgacatagatttagatgctcaaattgtctcagtcggtaattctaaaattgattatgatgagctaatcattggtttaggatgtgaagataaatatcataacgttccaggagccgaagaatatacacatagtattcaaacactctcaaaggctcgggatactttccatagtattagtgaactaccagaaggtgctaaagtcggtatcgttggtgctggattaagcggcatagaacttgccagcgaattaagagaaagtagatcagacttggaaatatatctttatgaccgtgggccgcgaattttaagaaattttccagaaaaattaagtaagtatgttgcgaaatggttcgccaaaaataatgttaccgttgttccaaattcaaatattaataaagttgaacctggtaaaatatataactgtgatgaacctaaagatattgatttagttgtatggacagcaggaattcaacctgttgaagttgttcgtaacttgccgattgatataaatagtaatggacgcgtgatagttaaccagtatcatcaagtaccaacatatcgtaacgtctatgtagttggtgattgtgctgatttaccacatgcgccaagtgctcagttagccgaagttcaaggtgatcaaattgccgatgtgcttaaaaagcaatggctaaatgaaccattacctgacaaaatgccggaactaaaggtacaaggtatcgttgggtcattaggagataagcaaggttttgcatatatcatggaccgcactgtaacaggacgactcgcttctattttaaaatccggcgtactttggttatataaatatcataatggt

SEQ ID NO: 2792 - protein, 354 aa, Staphylococcus aureus
  MISC_FEATURE (1)..(354): hypothetical protein
MKNLVLLGGGYGNMRIMSRILTTSLPQDYTVTLVDRMPFHGLKPEFYALAAGTKSDKDVRMKFPNHPQVNTVYGEINDIDLDAQIVSVGNSKIDYDELIIGLGCEDKYHNVPGAEEYTHSIQTLSKARDTFHSISELPEGAKVGIVGAGLSGIELASELRESRSDLEIYLYDRGPRILRNFPEKLSKYVAKWFAKNNVTVVPNSNINKVEPGKIYNCDEPKDIDLVVWTAGIQPVEVVRNLPIDINSNGRVIVNQYHQVPTYRNVYVVGDCADLPHAPSAQLAEVQGDQIADVLKKQWLNEPLPDKMPELKVQGIVGSLGDKQGFAYIMDRTVTGRLASILKSGVLWLYKYHNG

SEQ ID NO: 2793 - DNA, 336 bp, Staphylococcus aureus
atgggggataaatatatggagcacgtgagtgtggtagtttatggggcagatgttatatgtgcaagttgcgttaatgcgccaacatcgaaagatatttatgactggctacagccgctattaaaaagaaaatacccaaatatatcatttaaatatacgtatatagatattacaaaagataatgacaacttaacagatcatgatttacaatttattgaaagaatagaacaagatgaactattttatccattaattacaatgaacgatgaatatgtagcagatggttatatacaaacaaagcaaatcactcgatttatagaccaaaagcttgtgaatgaa

SEQ ID NO: 2794 - protein, 112 aa, Staphylococcus aureus
  MISC_FEATURE (1)..(112): conserved hypothetical
MGDKYMEHVSVVVYGADVICASCVNAPTSKDIYDWLQPLLKRKYPNISFKYTYIDITKDNDNLTDHDLQFIERIEQDELFYPLITMNDEYVADGYIQTKQITRFIDQKLVNE

SEQ ID NO: 2795 - DNA, 240 bp, Staphylococcus aureus
atgcctactgaagatacaacgatgtttgatcaagtagcagaagttattgaacgtcttcgtccatttttattacgtgatggtggcgactgctcattgattgacgtggaagacggtattgttaaattacaattacatggtgcatgtggtacatgcccaagttctacaatcactcttaaagctggtattgagcgtgcattacacgaagaagtgcctggtgtaatagaagtagaacaagtattc

SEQ ID NO: 2796 - protein, 80 aa, Staphylococcus aureus
  MISC_FEATURE (1)..(80): hypothetical protein
MPTEDTTMFDQVAEVIERLRPFLLRDGGDCSLIDVEDGIVKLQLHGACGTCPSSTITLKAGIERALHEEVPGVIEVEQVF

SEQ ID NO: 2797 - DNA, 1173 bp, Staphylococcus aureus
atgaaattaaaaccttttttacccattttaattagtggagcggtattcattgtctttctattattacctgctagttggtttacaggattagtaaatgaaaagactgtagaagataatagaacttcattgacagatcaagtactaaaaggcacactcattcaagataagttatacgaatcaaacaagtattatcctatatacggctctagtgaattaggtaaagatgacccatttaatcctgcaattgcattaaataagcataacgccaacaaaaaagcattcttattaggtgctggtggttctacagacttaattaacgcagttgaacttgcatcacagtatgataaattaaaaggtaagaaattaacatttattatttcaccacaatggtttacaaaccatggtttaacgaatcaaaactttgatgctcgtatgtctcaaactcaaattaatcaaatgttccagcagaaaaacatgtctactgaattaaaacgtcgttatgcacaacgtttattacagtttccacatgtacacaataaagaatacttgaaatcttatgctaaaaaccctaaagaaactaaagatagttatatttctggttttaaagagaatcaattgattaaaatagaagcgattaaatcattgtttgcaatggataaatctccattagaacatgttaaacctgctacaaaaccagacgcttcttgggatgagatgaaacaaaaagcagttgaaattggtaaagctgatactacatcgaataaatttggtattagagatcaatactggaaattaattcaagaaagtaagcgtaaagttagacgtgactacgaattcaatgttaattctccagaattccaagatttagaattacttgtaaaaacaatgcgtgctgctggtgcagatgttcaatatgtaagtattccatcaaacggtgtatggtatgaccacattggtatcgataaagaacgtcgtcaagcagtttataaaaaaatccattctactgttgtagataatggtggtaaaatttacgatatgactgataaagattatgaaaaatatgttatcagtgatgccgtacacatcggttggaaaggttgggtttatatggatgagcaaattgcgaaacatatgaaaggtgaaccacaacctgaagtagataaacctaaaaat

SEQ ID NO: 2798 - protein, 391 aa, Staphylococcus aureus
  MISC_FEATURE (1)..(391): poly (glycerophosphate
MKLKPFLPILISGAVFIVFLLLPASWFTGLVNEKTVEDNRTSLTDQVLKGTLIQDKLYESNKYYPIYGSSELGKDDPFNPAIALNKHNANKKAFLLGAGGSTDLINAVELASQYDKLKGKKLTFIISPQWFTNHGLTNQNFDARMSQTQINQMFQQKNMSTELKRRYAQRLLQFPHVHNKEYLKSYAKNPKETKDSYISGFKENQLIKIEAIKSLFAMDKSPLEHVKPATKPDASWDEMKQKAVEIGKADTTSNKFGIRDQYWKLIQESKRKVRRDYEFNVNSPEFQDLELLVKTMRAAGADVQYVSIPSNGVWYDHIGIDKERRQAVYKKIHSTVVDNGGKIYDMTDKDYEKYVISDAVHIGWKGWVYMDEQIAKHMKGEPQPEVDKPKN

SEQ ID NO: 2799 - DNA, 141 bp, Staphylococcus aureus
atgtgcaagttggcggggccccaacatagagaatttcaaaaagaaattctacagacaatgcaagttggggaacggggccccaacacagaaggtgacgaaaagtcagcatacaataatgtgcaagttggcggggccccaaca

SEQ ID NO: 2800 - protein, 47 aa, Staphylococcus aureus
MCKLAGPQHREFQKEILQTMQVGERGPNTEGDEKSAYNNVQVGGAPT

SEQ ID NO: 2801 - DNA, 234 bp, Staphylococcus aureus
atggaatttagagaacaagtattaaatttattagcagaagtagcagaaaatgatattgtaaaagaaaatccagacgtagaaatttttgaagaaggtattattgattctttccaaacagttggattattattagagattcaaaataaacttgatatcgaagtatctattatggactttgatagagatgagtgggcaacaccaaataaaatcgttgaagcattagaagagttacga

SEQ ID NO: 2802 - protein, 78 aa, Staphylococcus aureus
  MISC_FEATURE (1)..(78): D-alanyl carrier protein
MEFREQVLNLLAEVAENDIVKENPDVEIFEEGIIDSFQTVGLLLEIQNKLDIEVSIMDFDRDEWATPNKIVEALEELR

SEQ ID NO: 2803 - DNA, 1212 bp, Staphylococcus aureus
atgattccatatggtgattttacattcttcttaattgctttaattgcattattaccagtcattatacttggatttttaggtaagcgaagttacatttataatggcgtagttacagcatttatgattgtgttaatcttttcttctgataaacataatctgtttgaccaaaagtatttaagtgttcaattaattagttttattatttacgtcgtatggcaagttttattgataatgttttattatcattcaaaaccaaaaaataattcattttcaaaatttgtaactgtaatggttttatcaatattgccattagcacttgtgaaagtgttacaaagtacatggttaggtggacatcagattcacttccatgaaagtaaattaattgaatttgttggtttcttaggaatttcttatgttacattcaaaagtgtgcagttaattatggaaattcgtgatggttctatcaaagaaattaaagtatggaaattaattcaatttatttcattcttcccaacgatttcatctggaccaatcgatcgttacaaacgtttcgttaaagacgataaaaaagtaccaacaggcaatgaatatcgtgaattagtattaaaagcaattcacatgattatgcttggtttcttgtataaatatattgttgcttactttattaacacatatgcaatcatgccgttacaattagacttacatggctttgtcaatttgtggttatatatgtacgcatacagcttatatttattctttgactttgcaggttatagtttatttgcgatagcatttagttatttattcggtattaaaacaccaccaaacttcgataaacctttcaaagcgaaaaatattaaagatttctggaatagatggcatatgacattatcattctggttcagagattgtatttacatgagatctttattctacatgtctcgtaaaaaattattgaagagtcaatttgcaatgtctaacgtggcattcttaatcaacttcttcataatgggaatttggcatggtatcgaagtgtattacattgtttatggtttataccatgcagcattgtttataggttatggctattatgaacgttggcgtaagaaacatccgccacgttggcaaaatggtttcacaacagcacttagcattgtgattacattccactttgtaacatttggctttttaatcttctcaggtaaacttata

SEQ ID NO: 2804 - protein, 404 aa, Staphylococcus aureus
  MISC_FEATURE (1)..(404): DltB membrane protein
MIPYGDFTFFLIALIALLPVIILGFLGKRSYIYNGVVTAFMIVLIFSSDKHNLFDQKYLSVQLISFIIYVVWQVLLIMFYYHSKPKNNSFSKFVTVMVLSILPLALVKVLQSTWLGGHQIHFHESKLIEFVGFLGISYVTFKSVQLIMEIRDGSIKEIKVWKLIQFISFFPTISSGPIDRYKRFVKDDKKVPTGNEYRELVLKAIHMIMLGFLYKYIVAYFINTYAIMPLQLDLHGFVNLWLYMYAYSLYLFFDFAGYSLFAIAFSYLFGIKTPPNFDKPFKAKNIKDFWNRWHMTLSFWFRDCIYMRSLFYMSRKKLLKSQFAMSNVAFLINFFIMGIWHGIEVYYIVYGLYHAALFIGYGYYERWRKKHPPRWQNGFTTALSIVITFHFVTFGFLIFSGKLI

SEQ ID NO: 2805 - DNA, 1455 bp, Staphylococcus aureus
atgacagatattattaacaagctgcaagcgtttgcggatgcaaatccacaaagcattgctgttagacacacaactgatgaattaacttatcaacagttaatggatgagtctagtaaattagcacatcgattacaaggtagtaagaaaccgatgattttattcggtcacatgtcaccatatatgattgttgggatgattggtgccattaaagcaggatgtggatatgtacctgtagacacttcaattcctgaagaccgtattaaaatgattattaacaaggttcaaccagagtttgtatttaatacgactgatgaatcatttgaaagtttagaaggcgaagtatttacaatagaagatattaaaacatctcaagacccagtaatttttgatagtcagattaaagataacgacacagtatacacaatctttacatctggttctactggggaacctaaaggtgttcaaattgaatatgcaagtttagttcaatttactgagtggatgttagaacttaataaatcaggaaatgaacaacaatggcttaaccaagcgccattttcatttgatttatctgtaatggctatttatccatgtttagcatcaggcggtacattaaatcttgtagataaaaacatgattaataaacctaaattattaaatgaaatgctaacagcaacaccgattaacatttgggtatcaacaccatcatttatggaaatgtgtttattattaccaacgcttaatgaagaacaatatggtagtcttaacgaattcttcttctgtggtgaaattctacctcacagagcagcaaaagcgttagtaaaccgtttcccaagtgcgacgatttacaacacatatggtccaactgaagctacggtagcagttacaagtattcaaattacacaagaaatcttagatcaatatccgacattacctgttggcgttgaaagaccaggcgcaagattatctactacagatgaaggtgaacttgttatcgaaggtcaaagtgtaagtttaggatacttaaaaaatgaccaaaaaacagctgaagtatttaatttcgatgacggtattcgtacatatcacactggtgataaagcgaagtttgaaaatggtcaatggttcattcaaggtcgtattgatttccaaatcaaattgaatggctacagaatggaattagaagaaattgaaacacaattacgccagtctgagttcgtaaaagaagcgattgttgtacctgtatataaaaatgataaagttattcatttaattggtgcaattgtgccaacgactgaagttacggacaatgcagaaatgactaaaaatattaaaaatgacttgaaatcacgcttaccagagtatatgattcctagaaagtttgaatggatggaacaattgccattgacttcaaatggtaaaattgacagaaagaaaattgcagaggtaattaacgga

SEQ ID NO: 2806 - protein, 485 aa, Staphylococcus aureus
  MISC_FEATURE (1)..(485): D-alanine-D-alanyl carrier
MTDIINKLQAFADANPQSIAVRHTTDELTYQQLMDESSKLAHRLQGSKKPMILFGHMSPYMIVGMIGAIKAGCGYVPVDTSIPEDRIKMIINKVQPEFVFNTTDESFESLEGEVFTIEDIKTSQDPVIFDSQIKDNDTVYTIFTSGSTGEPKGVQIEYASLVQFTEWMLELNKSGNEQQWLNQAPFSFDLSVMAIYPCLASGGTLNLVDKNMINKPKLLNEMLTATPINIWVSTPSFMEMCLLLPTLNEEQYGSLNEFFFCGEILPHRAAKALVNRFPSATIYNTYGPTEATVAVTSIQITQEILDQYPTLPVGVERPGARLSTTDEGELVIEGQSVSLGYLKNDQKTAEVFNFDDGIRTYHTGDKAKFENGQWFIQGRIDFQIKLNGYRMELEEIETQLRQSEFVKEAIVVPVYKNDKVIHLIGAIVPTTEVTDNAEMTKNIKNDLKSRLPEYMIPRKFEWMEQLPLTSNGKIDRKKIAEVING

SEQ ID NO: 2807 - DNA, 201 bp, Staphylococcus aureus
ttgaacggtctttataaaggcgtttttactaagaactttaagaggtgcaatatgaaatctaaaagtaaacagccacctaataaatatgttgaagcattcaaaccatatttattaacactattgtatttggcaatatttattactttatatttaatttatggcagtggcgacacacacaataacttcatttataatgagttc

SEQ ID NO: 2808 - protein, 67 aa, Staphylococcus aureus
  MISC_FEATURE (1)..(67): hypothetical protein
LNGLYKGVFTKNFKRCNMKSKSKQPPNKYVEAFKPYLLTLLYLAIFITLYLIYGSGDTHNNFIYNEF

SEQ ID NO: 2809 - DNA, 108 bp, Staphylococcus aureus
gtgatgacaaccaattactatgttgaatctataaaattaaaattgaatttcattatgaatatcgatataatgaattgtaaaaaacaaattttaaaacgtattttatat

SEQ ID NO: 2810 - protein, 36 aa, Staphylococcus aureus
VMTTNYYVESIKLKLNFIMNIDIMNCKKQILKRILY

SEQ ID NO: 2811 - DNA, 957 bp, Staphylococcus aureus
ttggtaaaaatagttgtttcgaggaaaattccagataaattttatcaacaattaagtaaacttggtgacgttgttatgtggcaaaaatcattagtgcctatgcctaaagatcaatttgtgacagcacttcgtgacgcagatgcttgttttattacattaagtgaacagatcgatgcagaaattttagcgcaatcaccaaatttaaaagtaattgcgaatatggctgtaggatatgacaacatcgatgttgaaagtgcaacagcgaataacgtggttgtcacgaatacaccaaatgtacttactgaaacaactgcagaattaggatttacattaatgcttgctatagcacgccgtattgtagaagctgaaaaatatgtagaagcagatgcatggcaaagctggggtccttatttattgtcaggtaaagatgtcttcaattcaactattggaatatatggtatgggagatattggtaaagcttttgcaagaaggttgcaagggtttaatactaatattctttatcataatcgatcaagacataaagatgcagaggcggactttaatgcaacatatgtttcttttgaaacgttgttagcagaaagtgattttatcatctgtacagcgccacttacaaaagaaacacatcataaatttaatgctgaagcatttgaacaaatgaaaaatgatgcaatttttattaatatcggtagaggacaaattgtagatgaaacagcattaatcgatgcactagacaataaagaaattttagcatgtggtttagatgtattagcaaatgaaccgattgatcatacacatccattaatgggacgtgataatgttctgattacaccacacattggtagcgcatcagtaacaacacgggacaatatgattcaattatgtattaataatatagaagcggttatgacaaatcaggtaccacatactccagtaaat

SEQ ID NO: 2812 - protein, 319 aa, Staphylococcus aureus
  MISC_FEATURE (1)..(319): hypothetical protein
LVKIVVSRKIPDKFYQQLSKLGDVVMWQKSLVPMPKDQFVTALRDADACFITLSEQIDAEILAQSPNLKVIANMAVGYDNIDVESATANNVVVTNTPNVLTETTAELGFTLMLAIARRIVEAEKYVEADAWQSWGPYLLSGKDVFNSTIGIYGMGDIGKAFARRLQGFNTNILYHNRSRHKDAEADFNATYVSFETLLAESDFIICTAPLTKETHHKFNAEAFEQMKNDAIFINIGRGQIVDETALIDALDNKEILACGLDVLANEPIDHTHPLMGRDNVLITPHIGSASVTTRDNMIQLCINNIEAVMTNQVPHTPVN

SEQ ID NO: 2813 - DNA, 777 bp, Staphylococcus aureus
atgaaacagtataaagcgtatttaatcgatttagatggcacaatgtatatgggaacagatgagattgatggagcaaaacaattcatcgattatttaaatgtaaaaggcattcctcatttatacgtaactaataattcaacaaaaacacctgagcaagtaactgaaaaattacgtgaaatgcacattgatgctaaaccagaagaggttgtaacgtcagcgttagccactgctgattatatttcagaacaatcaccaggagcatcagtatatatgttaggtgggagtggtttaaatactgcgttaaccgaagcgggacttgtcattaaaaatgacgagcatgttgattatgtagttattggacttgacgaacaagttacatatgaaaagcttgcgattgcaacgttaggtgtaagaaatggtgcaacatttatttctacaaatcctgatgtatcaattcctaaagagcgtggtttattacctggtaatggtgctattacaagtgttgtaagtgtatcgacaggtgtatcgccacaatttattggtaaaccagaaccgattattatggttaaagcattagaaattttaggattagataaatccgaagttgctatggtaggcgatttgtacgataccgatattatgtctggtattaacgtaggtatggatacgattcatgtacaaacaggtgtatctacgttagaagatgtgcaaaataaaaatgtgccaccaacgtattcttttaaagatttaaatgaagcaatagctgaattagaaaaa

SEQ ID NO: 2814 - protein, 259 aa, Staphylococcus aureus
  MISC_FEATURE (1)..(259): hypothetical protein
MKQYKAYLIDLDGTMYMGTDEIDGAKQFIDYLNVKGIPHLYVTNNSTKTPEQVTEKLREMHIDAKPEEVVTSALATADYISEQSPGASVYMLGGSGLNTALTEAGLVIKNDEHVDYVVIGLDEQVTYEKLAIATLGVRNGATFISTNPDVSIPKERGLLPGNGAITSVVSVSTGVSPQFIGKPEPIIMVKALEILGLDKSEVAMVGDLYDTDIMSGINVGMDTIHVQTGVSTLEDVQNKNVPPTYSFKDLNEAIAELEK

SEQ ID NO: 2815 - DNA, 432 bp, Staphylococcus aureus
atgtattttgtagacaaagataaactaactcagaaattagcctatttacaagcattaactgatgattatcatgagagcaagcacaatcattatgcatttgaacgcattgctcaaatgttgatagaatcatcggtagatatagggaatatgattatcgatgcatttattttaagggatcctggtaattataaagatgtgattgatatattagaactagaaaatgttattactaaagaaacacagcaggcgattaataaaactgtcggtattcgtaaacaatttacatatgattacacagccttagatattaagattatcatgccaatgtttgatgacgcattaccttattacaaacaatttattacagaagtaacgatatttttacatcaagaaaatgtaccagtaacagcttttggtaaaggagaaaatcaa

SEQ ID NO: 2816 - protein, 144 aa, Staphylococcus aureus
  MISC_FEATURE (1)..(144): conserved hypothetical
MYFVDKDKLTQKLAYLQALTDDYHESKHNHYAFERIAQMLIESSVDIGNMIIDAFILRDPGNYKDVIDILELENVITKETQQAINKTVGIRKQFTYDYTALDIKIIMPMFDDALPYYKQFITEVTIFLHQENVPVTAFGKGENQ

SEQ ID NO: 2817 - DNA, 264 bp, Staphylococcus aureus
atgattgatatgtatttatatgatgacaacgaagagagtcaagttcagtttgttggttttgttggcgagcatagtcgatatgatttgatgttagtccatacaaatagacattatggtaagacactcgtacttaatatgcaaacaaataaattcggtattatcggtactgatgatttaaaagaagaaggctatatcgctcatattttaggtgtaaatgctgaagaaggcgatgaaattactgagtatttaaatgaagtcattcat

SEQ ID NO: 2818 - protein, 88 aa, Staphylococcus aureus
  MISC_FEATURE (1)..(88): conserved hypothetical
MIDMYLYDDNEESQVQFVGFVGEHSRYDLMLVHTNRHYGKTLVLNMQTNKFGIIGTDDLKEEGYIAHILGVNAEEGDEITEYLNEVIH

SEQ ID NO: 2819 - DNA, 390 bp, Staphylococcus aureus
gtgaagaatttgataaaagtagatcaacattactttgaattaatagaaaattatcgcgaatgttttaatgaagaacaatttattgctaggtattcagatattttagataaatatgattacatagttggtgactatggttacgatcaattacgattaaaaggtttttacaaagattctaataaaaaagcagagatgagtaaacgtttttcaaatattcaagattacatatttgaatattgtaactttggttgtccttactttgtattaagacatttgtctaaacaagaggttaaaaagttaatcgaagaagttcatccgtctgatgtgatagatgacgacaataaacttcaagatgtgaagattaagccaaccattcaagatactgaacat

SEQ ID NO: 2820 - protein, 130 aa, Staphylococcus aureus
  MISC_FEATURE (1)..(130): conserved hypothetical
VKNLIKVDQHYFELIENYRECFNEEQFIARYSDILDKYDYIVGDYGYDQLRLKGFYKDSNKKAEMSKRFSNIQDYIFEYCNFGCPYFVLRHLSKQEVKKLIEEVHPSDVIDDDNKLQDVKIKPTIQDTEH

SEQ ID NO: 2821 - DNA, 1020 bp, Staphylococcus aureus
atggtagaacaaataaaagataaactaggacgtcccatccgtgacttacggttatctgtgacagatcggtgtaactttaggtgtgattattgcatgcctaaagaggtatttggagatgatttcgtatttttacctaaaaatgaacttttaacgtttgatgaaatggctagaatcgctaaggtatatgcagaattaggtgtaaaaaaaatacgcattacaggtggagaaccattgatgcgacgggatttagatgtacttatagctaaattaaatcaaatcgatggtattgaagatattggtttgactacaaatggtttgttattaaaaaagcatggacaaaagttatatgatgctgggctgcgcagaattaatgtcagtttggatgctattgatgatacgctatttcaatcaatcaataatcgtaatattaaagcgactacgattttagaacaaattgattacgcgacgtctattggtttgaatgtaaaagtaaatgttgttatacaaaaaggtattaacgatgatcaaatcataccaatgcttgaatattttaaagataaacatatagagattcgatttatagaatttatggatgttggtaatgataatggatgggatttcagtaaagttgtaactaaagatgaaatgcttacaatgatagagcagcactttgaaatcgatcctgtagaaccaaaatattttggggaagtagcaaaatattatcgccataaggataatggtgttcaatttggtttgattacaagtgtttcacaatcattttgttctacatgtacacgcgcaaggctgtcatcagatgggaagttttacggatgtttatttgcaactgtcgatggatttaacgttaaagcgtttattcgttctggcgtgaccgacgaagaattaaaagaacaatttaaagctttatggcaaataagagatgatcgatattcagatgagagaactgctcaaacagttgccaatcgtcaacgtaaaaagataaacatgaattatattggtggt

SEQ ID NO: 2822 - protein, 340 aa, Staphylococcus aureus
  MISC_FEATURE (1)..(340): molybdenum cofactor
MVEQIKDKLGRPIRDLRLSVTDRCNFRCDYCMPKEVFGDDFVFLPKNELLTFDEMARIAKVYAELGVKKIRITGGEPLMRRDLDVLIAKLNQIDGIEDIGLTTNGLLLKKHGQKLYDAGLRRINVSLDAIDDTLFQSINNRNIKATTILEQIDYATSIGLNVKVNVVIQKGINDDQIIPMLEYFKDKHIEIRFIEFMDVGNDNGWDFSKVVTKDEMLTMIEQHFEIDPVEPKYFGEVAKYYRHKDNGVQFGLITSVSQSFCSTCTRARLSSDGKFYGCLFATVDGFNVKAFIRSGVTDEELKEQFKALWQIRDDRYSDERTAQTVANRQRKKINMNYIGG

SEQ ID NO: 2823 - DNA, 969 bp, Staphylococcus aureus
atgaatttcgatataatgtttaaagatacacttaacaggagggtatgtgttgttatggcgacaaaaaacgaggaaatattacgtaaaccggattggttgaaaataaaattaaataccaacgaaaactatacaggacttaagaagatgatgagggaaaaaaatcttaatactgtatgtgaagaagctaaatgtcctaatatacatgaatgttggggtgcacgtcgtacagcgacatttatgattttaggtgccgtatgtacaagagcttgtcgtttttgtgcggttaagacaggtttacctaatgaacttgatttaaatgagcctgaacgtgtagctgaatcagttgaattaatgaatttgaaacacgttgttatcactgctgttgcgcgtgatgatttaagagatgctggttcaaatgtttatgctgagacagtacgtaaagttagagaaagaaatccatttacaacgattgaaattttaccatcagatatgggcggggactatgatgcgttagaaacattaatggcgtcaagacctgacattttaaaccataatattgaaactgttcgtcgcttaacaccgagagttcgtgcgcgtgcgacttacgacagaacattagagtttttacgtcgttcaaaagaattacaaccggatatcccaactaaatcaagtattatggttggattaggtgaaactatagaagaaatttatgaaacgatggatgatttacgtgcgaatgatgtagatattttaacgattggtcaatatttacaaccttcacgtaaacatttaaaggttcaaaaatattacacgcctttagagtttggtaaattaagaaaagtggcaatggataaagggtttaaacattgccaagctggacctttagtacgtagttcttatcatgcggatgagcaagtaaatgaagctgctaaagaaaagcaacgccaaggtgaggcacagttaaatagt

SEQ ID NO: 2824 - protein, 323 aa, Staphylococcus aureus
  MISC_FEATURE (1)..(323): lipoic acid synthetase
MNFDIMFKDTLNRRVCVVMATKNEEILRKPDWLKIKLNTNENYTGLKKMMREKNLNTVCEEAKCPNIHECWGARRTATFMILGAVCTRACRFCAVKTGLPNELDLNEPERVAESVELMNLKHVVITAVARDDLRDAGSNVYAETVRKVRERNPFTTIEILPSDMGGDYDALETLMASRPDILNHNIETVRRLTPRVRARATYDRTLEFLRRSKELQPDIPTKSSIMVGLGETIEEIYETMDDLRANDVDILTIGQYLQPSRKHLKVQKYYTPLEFGKLRKVAMDKGFKHCQAGPLVRSSYHADEQVNEAAKEKQRQGEAQLNS

SEQ ID NO: 2825 - DNA, 1317 bp, Staphylococcus aureus
ttgaggcttacaatttatcatacgaacgatattcatagtcatttacatgaatacgaacgcattaaagcatatatggcagaacatcggccacgacttaatcatccttctttatatgttgatctaggtgatcatgtagatttatccgcacctataactgaagcaactttaggtaaaaagaatgtggcattactaaatgaagcaaaatgtgatgttgcaacaatcggtaataatgaagggatgaccatttcatacgaagctttaaatcacctttacgacgaagcaaaatttatagtgacatgtagcaatgttatagatgaatcaggtcatttaccaaataatatcgtttcttcttatattaaggacatagacggtgtgaaaatactattcgttgcagcgacagcaccttttaccccattttatcgtgcactaaattggattgttaccgatccacttgaatctataaaagaagaaattgaacttcaacgaggtaaatttgatgtattaatcgtgctaagtcattgtggcattttcttcgatgaaacattatgccaagaattgcctgaaattgatgtcatttttggtagtcatacgcatcattattttgaacatggtgaaatcaataatggtgtactgatggcggcagctggaaagtatggtaattatcttggagaggttaatttaacttttgaggcacataaagtagtacataaaactgcaaagattattcctttagaaacattacctgaagttgaaacttcatttgaagaagaaggaaaaacgttaatgtccaattcagtaattcaacatccagtagtgcttaagcgtagtatgaatcacataactgaagctgcatacttattagctcaaagtgtttgtgagtatacacatgcacaatgtgccatcatcaatgctggcttactcgttaaagatattgtaaaagatgaagtgacagaatatgacattcatcaaatgttaccgcatccgattaatatggtaagggttagactttttggtgtgaaattaaaagagattatagctaaaagtaataaacaagaatatatgtatgaacatgcacaaggtttgggtttcagagggaatatatttggaggatatattctttataatttagggtacattcattctacagggcgttactatctgaatggagaagaaatcgaagacgacaaagaatatgtactaggtacgatagatatgtatacgttcggtcgttatttcccaacattgaaagaattaccaaaagagtatttaatgccagagtttttaagagatatatttaaagaaaaattattggaatat

SEQ ID NO: 2826 - protein, 439 aa, Staphylococcus aureus
  MISC_FEATURE (1)..(439): conserved hypothetical
LRLTIYHTNDIHSHLHEYERIKAYMAEHRPRLNHPSLYVDLGDHVDLSAPITEATLGKKNVALLNEAKCDVATIGNNEGMTISYEALNHLYDEAKFIVTCSNVIDESGHLPNNIVSSYIKDIDGVKILFVAATAPFTPFYRALNWIVTDPLESIKEEIELQRGKFDVLIVLSHCGIFFDETLCQELPEIDVIFGSHTHHYFEHGEINNGVLMAAAGKYGNYLGEVNLTFEAHKVVHKTAKIIPLETLPEVETSFEEEGKTLMSNSVIQHPVVLKRSMNHITEAAYLLAQSVCEYTHAQCAIINAGLLVKDIVKDEVTEYDIHQMLPHPINMVRVRLFGVKLKEIIAKSNKQEYMYEHAQGLGFRGNIFGGYILYNLGYIHSTGRYYLNGEEIEDDKEYVLGTIDMYTFGRYFPTLKELPKEYLMPEFLRDIFKEKLLEY

SEQ ID NO: 2827 - DNA, 825 bp, Staphylococcus aureus
atgttattaacaattacattattagttttaatcggaggtttgtcagcgattatagggtctatcgtaggcattggaggcggtattattatcgttccaacaatggtttacctcggtgttgaacatggattactacataatattacaacacaagtagcgatagggacgtcttcagtcattctaattgtgacaggactttcttcatcacttggatatttaaaaacaaaacaagttgatattaaaaatggttccatctttttatttggactattaccaggttcattgcttgggtccttcattagtagatatttaacatttgagtcatttaatttatattttggtatctttttaattttcgtagccattttattaatggtaagaaataagattaaaccgtttaaaattttcgataaacccaagtatgaaaagacttatgtagacgctaaaggtaaaacatatcattatagtgttccaccattgtttgcttttattacaacgtttttaattggtatattgacaggtttatttggtattggaggtggcgcactaatgacgccactaatgcttattgtatttagatttccacctcatgtagctgttggaacaagtatgatgatgattttcttttcaagtgtcatgagttctatagggcacattgctcaaggtcacgtagcttggggttatgcaatcattttaattatttctagttattttggtgcgaaaatcggtgtcaaagtgaatcaatcaattaagtcagatacggtagtaacattattgagaacagtaatgttgttaatgggtatatatttaattattcgtgcgttgatt

SEQ ID NO: 2828 - protein, 275 aa, Staphylococcus aureus
  MISC_FEATURE (1)..(275): conserved hypothetical
MLLTITLLVLIGGLSAIIGSIVGIGGGIIIVPTMVYLGVEHGLLHNITTQVAIGTSSVILIVTGLSSSLGYLKTKQVDIKNGSIFLFGLLPGSLLGSFISRYLTFESFNLYFGIFLIFVAILLMVRNKIKPFKIFDKPKYEKTYVDAKGKTYHYSVPPLFAFITTFLIGILTGLFGIGGGALMTPLMLIVFRFPPHVAVGTSMMMIFFSSVMSSIGHIAQGHVAWGYAIILIISSYFGAKIGVKVNQSIKSDTVVTLLRTVMLLMGIYLIIRALI

SEQ ID NO: 2829 - DNA, 867 bp, Staphylococcus aureus
atgatgacattggtgatatatatgataaacatcggattaacaggttggggtgatcactattcattatatgaagatttagaacgccaaaccgataaacttaaaacatatgctggacattttccggttgtcgaattagatgcgacatactatgcgatacaaccggaaagaaatatattgaaatggataaaagaaacgcctgatacatttgaatttgtggtcaaaattcatcaagcactcacattgcatgcagactacaaaacatttgcagatacaaggcaagaactatttgatcaatttaagaatatgttagagcccttacatacacagaaaaaattagcaatggtattggttcaatttccgccatggtttgactgcaatgcacaaaatatcaaatatattttgtatgtaagacagcaattacaagcatttccaatgtgtgtagaatttaggcatcaatcatggtttagtgatgcatttaaagaacaaacattggcatttttaacagaacatcaaatcattcatgcagtagttgatgaaccacaagtgaaagatggcagtgtacctttagtcaatcgaatcacaaatgaaattgcgtttgtacgttatcatggacgtaatcattacggttggactaagaaagatatgtcagatcaagaatggcgcgatgtacgctatttatatgattataatgagcaagaattaatagacttggcacaaaaggcacaaatattagcacaaaaagctaagaaagtttacgtcatatttaacaataattctggtggtcatgcagcaaataatgccaaaacatatcagcgattattgaatatagaatatgaagggttagcaccacaacaattaaaattattt

SEQ ID NO: 2830 - protein, 289 aa, Staphylococcus aureus
  MISC_FEATURE (1)..(289): conserved hypothetical
MMTLVIYMINIGLTGWGDHYSLYEDLERQTDKLKTYAGHFPVVELDATYYAIQPERNILKWIKETPDTFEFVVKIHQALTLHADYKTFADTRQELFDQFKNMLEPLHTQKKLAMVLVQFPPWFDCNAQNIKYILYVRQQLQAFPMCVEFRHQSWFSDAFKEQTLAFLTEHQIIHAVVDEPQVKDGSVPLVNRITNEIAFVRYHGRNHYGWTKKDMSDQEWRDVRYLYDYNEQELIDLAQKAQILAQKAKKVYVIFNNNSGGHAANNAKTYQRLLNIEYEGLAPQQLKLF

SEQ ID NO: 2831 - DNA, 96 bp, Staphylococcus aureus
ttgcgtttctattttaccaatttaatcaaacgaaaacatcaagctgaagatcgccgaaagattttaatcaagcaaaaacatcaaactaaagttcgc

SEQ ID NO: 2832 - protein, 32 aa, Staphylococcus aureus
LRFYFTNLIKRKHQAEDRRKILIKQKHQTKVR

SEQ ID NO: 2833 - DNA, 132 bp, Staphylococcus aureus
atggcaagcactaaaataatgtttgggggtgcttgtgcttttgtggattgcggtcgattatttatattgcatgatttgattaatttgattgattatattggacatgatggtgttggcgggatgcgttgttgc

SEQ ID NO: 2834 - protein, 44 aa, Staphylococcus aureus
MASTKIMFGGACAFVDCGRLFILHDLINLIDYIGHDGVGGMRCC

SEQ ID NO: 2835 - DNA, 1170 bp, Staphylococcus aureus
ttgaagatgagatggataaaaaggaaaaagaaaaactttctcaacagcaaattcaatttcaacaacggaaaaatcgcaacgtatctatataaggagcgaacagctatgtggaataagaatcgacttactcaaatgttaagtattgaatatccaattatacaagcaggtatggcaggaagtacgacaccgaaattagttgcatcagtaagtaacagtggtgggttaggcacaataggcgcaggttactttaatacgcagcaattggaagatgaaatagattatgtacgccaattaacgtcaaattcttttggcgtaaatgtctttgtaccaagtcaacaatcatataccagtagtcaaattgaaaatatgaatgcatggttaaaaccttatcgacgcgcattacatttagaagagccggttgtaaaaattaccgaagaacaacaatttaagtgtcatattgatacgataattaaaaagcaagtgcctgtatgttgttttacttttggaattccaagcgaacagattataagcaggttgaaagcagcgaatgtcaaacttataggtacagcaacaagtgttgatgaagctattgcgaatgaaaaagcgggtatggatgctatcgttgctcaaggtagtgaagcaggtggacatcgtggttcatttttaaaacctaaaaatcaattacctatggttggaacaatatctttagtgccacaaattgtagatgtcgtttcaattccggtcattgccgctggtggaattatggatggtagaggagttttggcaagtattgtcttaggtgcagaaggggtacaaatgggcaccgcatttttaacatcacaagacagtaatgcatcagaactactgcgagatgcaattataaatagtaaagaaacagatacagtcattacaaaagcgtttagtggaaagcttgcacgcggtatcaacaataggtttatcgaagaaatgtcccaatacgaaggcgatatcccagattatccaatacaaaatgagctaacaagtagcataagaaaagccgcagcaaacatcggcgacaaagagttaatacatatgtggagtggacaaagcccgcgactagcaacaacgcatcccgccaacaccatcatgtccaatataatcaatcaaattaatcaaatcatgcaatataaa

SEQ ID NO: 2836 - protein, 390 aa, Staphylococcus aureus
  MISC_FEATURE (1)..(390): hypothetical protein
LKMRWIKRKKKNFLNSKFNFNNGKIATYLYKERTAMWNKNRLTQMLSIEYPIIQAGMAGSTTPKLVASVSNSGGLGTIGAGYFNTQQLEDEIDYVRQLTSNSFGVNVFVPSQQSYTSSQIENMNAWLKPYRRALHLEEPVVKITEEQQFKCHIDTIIKKQVPVCCFTFGIPSEQIISRLKAANVKLIGTATSVDEAIANEKAGMDAIVAQGSEAGGHRGSFLKPKNQLPMVGTISLVPQIVDVVSIPVIAAGGIMDGRGVLASIVLGAEGVQMGTAFLTSQDSNASELLRDAIINSKETDTVITKAFSGKLARGINNRFIEEMSQYEGDIPDYPIQNELTSSIRKAAANIGDKELIHMWSGQSPRLATTHPANTIMSNIINQINQIMQYK

SEQ ID NO: 2837 - DNA, 1038 bp, Staphylococcus aureus
gtgatcattgccataattatattgatatttatttcgtttttcttttcaggaagcgagacggcattaacggctgccaataaaacaaaatttaaaactgaagctgacaaaggtgataaaaaagcaaaaggcattgtaaagttacttgaaaaaccaagtgagtttattacaacgattctaattgggaataatgtcgcgaatattttattaccaacacttgttacaattatggctttacgttgggggattagcgttggtattgcatcagctgttttaacagttgttatcattttgatctccgaagtgattcccaagtctgtcgctgcaacatttccagataaaataacaaggcttgtatatccaattattaatatttgtgtcattgtgttccgtcctatcacattacttttaaataagttgacggacagtattaatcgaagtttatctaagggccaacctcaagaacatcaattttcaaaagaagaatttaaaacaatgttagcaattgctggacatgaaggtgctttaaatgaaattgagacgagtaggttggaaggtgtcattaattttgaaaatttaaaagtaaaagatgtagatacaacacctagaattaatgtgacggcatttgcttcaaatgcgacatacgaagaagtttatgaaacggttatgaataagccatacactagatatccagtgtacgagggagatattgataacattattggggtgtttcattctaaatatctgttggcttggagtaataaaaaagaaaatcaaattacaaactattcagctaagccattatttgtgaatgaacacaataaagctgaatgggtattacgtaagatgactatttctagaaaacatttagcaattgtgttggacgaatttggtggtactgaagcgatagtgtcacatgaagacttaattgaagaattattaggtatggaaattgaagatgagatggataaaaaggaaaaagaaaaactttctcaacagcaaattcaatttcaacaacggaaaaatcgcaacgtatctata

SEQ ID NO: 2838 - protein, 346 aa, Staphylococcus aureus
  MISC_FEATURE (1)..(346): hypothetical protein
VIIAIIILIFISFFFSGSETALTAANKTKFKTEADKGDKKAKGIVKLLEKPSEFITTILIGNNVANILLPTLVTIMALRWGISVGIASAVLTVVIILISEVIPKSVAATFPDKITRLVYPIINICVIVFRPITLLLNKLTDSINRSLSKGQPQEHQFSKEEFKTMLAIAGHEGALNEIETSRLEGVINFENLKVKDVDTTPRINVTAFASNATYEEVYETVMNKPYTRYPVYEGDIDNIIGVFHSKYLLAWSNKKENQITNYSAKPLFVNEHNKAEWVLRKMTISRKHLAIVLDEFGGTEAIVSHEDLIEELLGMEIEDEMDKKEKEKLSQQQIQFQQRKNRNVSI

SEQ ID NO: 2839 - DNA, 312 bp, Staphylococcus aureus
atgtattttgttttagcaatatttacaataatcagtgccagtgtaagtttaggttattcaattcaagcatgtgcatctagccataatataaatgcatattatgcacttagtcgaagcttacctttatttttattagctattttttctttagtcattcatagtgctatatttttgataactatatccattgcaatgatcttagttcaatttttagatgcgattgttggttataaaagtgaagatgtctttaaaacttatggtccattagcaacatctgtagtgaacttaatattattaatagttttcttattt

SEQ ID NO: 2840 - protein, 104 aa, Staphylococcus aureus
  MISC_FEATURE (1)..(104): hypothetical protein
MYFVLAIFTIISASVSLGYSIQACASSHNINAYYALSRSLPLFLLAIFSLVIHSAIFLITISIAMILVQFLDAIVGYKSEDVFKTYGPLATSVVNLILLIVFLF

SEQ ID NO: 2841 - DNA, 135 bp, Staphylococcus aureus
ttgatggtggataaagcgacaacacaaatacaacatgattgtggcattagagtgctggtctttattaaattaattgaaagctacatcaaatattctttagataattcgatattagttcgattaagattcgttgta

SEQ ID NO: 2842 - protein, 45 aa, Staphylococcus aureus
LMVDKATTQIQHDCGIRVLVFIKLIESYIKYSLDNSILVRLRFVV

SEQ ID NO: 2843 - DNA, 597 bp, Staphylococcus aureus
atgaaagcaataattcttgcaggtggtcattcagtgcgatttggtaagcccaaagcttttgcggaagtgaacggtgagaccttttatagtagagtaattaagacattagaatcaacaaatatgttcaatgaaattattattagtacaaatgcgcaattggcaacgcaatttaaatatccaaatgttgttatagatgatgagaatcataatgataaaggtccattagcaggaatttatacaatcatgaagcaacatcctgaagaagaattgttttttgtcgtttctgttgatacaccaatgattactggtaaagctgtaagcacgttgtatcagtttttagtttctcatcttattgaaaatcatttagatgtcgcagcttttaaagaagatggacgttttattccaacaattgcattttatagtccgaatgcattaggcgctataactaaagcactacattctgataattacagttttaaaaatgtatatcatgaattatcaacggattatttggatgtaagggatgtagatgcgccctcatattggtacaaaaatataaattatcagcatgatttggacgctttaattcaaaaattg

SEQ ID NO: 2844 - protein, 199 aa, Staphylococcus aureus
  MISC_FEATURE (1)..(199): molybdopterin-guanine
MKAIILAGGHSVRFGKPKAFAEVNGETFYSRVIKTLESTNMFNEIIISTNAQLATQFKYPNVVIDDENHNDKGPLAGIYTIMKQHPEEELFFVVSVDTPMITGKAVSTLYQFLVSHLIENHLDVAAFKEDGRFIPTIAFYSPNALGAITKALHSDNYSFKNVYHELSTDYLDVRDVDAPSYWYKNINYQHDLDALIQKL

SEQ ID NO: 2845 - DNA, 1404 bp, Staphylococcus aureus
gtgattgaaatggctaaaaaagcacctgatgttggggattataaatatggattccacgacgatgatgtgtccattttcagatcagaacgtggtttaactgagaatatcgttagagaaatttctaacatgaaaaatgagccggaatggatgttagatttccgtcttaaatcattaaaattgttttataaaatgccaatgcctcaatggggtggcgacttatcagaattgaatttcgatgacattacttactatgtaaagccttcagaacaagctgaacgttcatgggatgaagtgccagaagaaattaaaagaactttcgataaattaggaattcctgaagctgaacaaaaatatttagctggtgtttctgctcaatatgaatctgaagttgtttaccataatatggaaaaagaacttgaagaaaaaggtattatctttaaagatacagatagtgctttacaagaaaatgaagaattattcaaaaaatactttgcttctgtagtacctgcagcagataacaaatttgcggcgttaaactcagcagtatggtcaggtggttcgttcatttatgtacctaaaaatatcaaactagatacgccactacaagcttatttccgtattaactctgagaacatgggtcaatttgaacgtacattaatcattgctgatgaaggtgcttctgtacattacgtagaaggttgtactgcaccagtttatacaactagttctttacactctgctgttgtggaaatcattgtgcataaagatgcgcacgttcgttatactacgattcaaaactgggcgaacaatgtatacaatttagttacaaaacgtacttttgtttatgaaaacggaaatatggaatgggtagatggtaacttaggttctaagttaacgatgaaatatccaaactgtgttcttttaggtgaaggtgcaaaaggtagtacattatctattgcatttgctggtaaaggacaagttcaagatgccggtgctaaaatgattcataaagcacctaatacatcttctacaattgtttctaaatctatttctaaaaatggtggtaaagttatttatcgcggtattgttcattttggacgtaaagcaaaaggtgctcgttcaaatattgaatgtgatacattaatcttagataacgaatcaacatcagatacaattccatataacgaagtattcaacgatcaaatatcattagaacatgaagccaaggtttcaaaagtttctgaagaacaattattctatctaatgagtcgtggtatttctgaagaagaagcgacagaaatgattgttatgggattcatcgaaccatttacaaaagaacttccaatggaatacgcggtcgaaatgaaccgtttaatcaagttcgaaatggaaggtagtattgga

SEQ ID NO: 2846 - protein, 468 aa, Staphylococcus aureus
  MISC_FEATURE (1)..(468): conserved hypothetical
VIEMAKKAPDVGDYKYGFHDDDVSIFRSERGLTENIVREISNMKNEPEWMLDFRLKSLKLFYKMPMPQWGGDLSELNFDDITYYVKPSEQAERSWDEVPEEIKRTFDKLGIPEAEQKYLAGVSAQYESEVVYHNMEKELEEKGIIFKDTDSALQENEELFKKYFASVVPAADNKFAALNSAVWSGGSFIYVPKNIKLDTPLQAYFRINSENMGQFERTLIIADEGASVHYVEGCTAPVYTTSSLHSAVVEIIVHKDAHVRYTTIQNWANNVYNLVTKRTFVYENGNMEWVDGNLGSKLTMKYPNCVLLGEGAKGSTLSIAFAGKGQVQDAGAKMIHKAPNTSSTIVSKSISKNGGKVIYRGIVHFGRKAKGARSNIECDTLILDNESTSDTIPYNEVFNDQISLEHEAKVSKVSEEQLFYLMSRGISEEEATEMIVMGFIEPFTKELPMEYAVEMNRLIKFEMEGSIG

SEQ ID NO: 2847 - DNA, 462 bp, Staphylococcus aureus
atgaattttaataatctagatcaattatatagatctgtcattatggatcattataaaaatcctagaaataaaggtgtattagataacgggtctatgacagtagatatgaataacccgacatgcggtgaccgtatacgactaacatttgatatagaagacggcattataaaagatgctaagtttgaaggtgaaggttgttcgatttcaatggcaagtgcatcgatgatgacacaagctgttaaaggtcattcacttggagaagcaatgcaaatgagccaagaatttacgaaaatgatgcttggtgaagactatgtgattacagaagaaatgggagatattgaagcattgcaaggtgtatctcaattcccagctcgtattaaatgtgccacattagcttggaaagcattggaaaaaggtactgttgctaaagaaggtaaagcagaaggtacgactgaagaagaa

SEQ ID NO: 2848 - protein, 154 aa, Staphylococcus aureus
  MISC_FEATURE (1)..(154): hypothetical protein
MNFNNLDQLYRSVIMDHYKNPRNKGVLDNGSMTVDMNNPTCGDRIRLTFDIEDGIIKDAKFEGEGCSISMASASMMTQAVKGHSLGEAMQMSQEFTKMMLGEDYVITEEMGDIEALQGVSQFPARIKCATLAWKALEKGTVAKEGKAEGTTEEE

SEQ ID NO: 2849 - DNA, 1248 bp, Staphylococcus aureus
gtgaatgaagtggccgaacactcatttgacgttaatgaagtaatcaaggattttccgatattagatcaaaaagtcaatggcaaacgtttagcatatcttgattcaacagcgacaagtcaaacgcctgtgcaagtgttaaatgttttagaagattactacaagcgttataattcaaacgttcatcgtggtgttcatacattaggatcattggcaactgatggttatgaaaatgcccgtgaaaccgttcgtcgttttattaatgcgaagtattttgaagaaatcatttttacacgcggaacaactgcgtcgattaaccttgtagcacatagctatggtgatgcaaatgttgaagagggcgatgaaattgttgtcactgaaatggaacatcatgccaatattgttccttggcaacagttagcaaagcgtaaaaatgcgacattgaaatttataccaatgacagctgacggtgaattaaacatcgaggatattaagcaaacgattaatgataaaacaaagatcgttgctattgcacatatatctaatgtgctcggtacaattaatgatgttaaaaccattgcagaaatagctcatcaacatggtgcaattatcagtgttgatggggcgcaagcagcaccacatatgaaacttgatatgcaagaaatgaatgctgatttttatagttttagtggtcataaaatgcttggaccaacaggtattggcgtattatttggtaaacgtgagttactacaaaaaatggaaccgattgagttcggtggcgacatgattgattttgtaagtaagtatgatgcaacatgggctgatttacctactaaatttgaggcgggtactccattaattgctcaagcaattgggcttgcagaagctattcgctatttagaacgcataggttttgatgcaattcataaatatgaacaagaattaacgatatatgcttatgagcaaatgtctgcaattgaaggaattgaaatttatggcccgccaaaggatcgtcgtgcaggtgtaataacgtttaatttacaagatgtacatccacacgatgttgctacagccgtagatacagaaggtgtagcggttagagctgggcatcattgtgcgcaaccgttaatgaaatggttaaatgtgtcttcaacagctagagcgagtttttatatatacaacacgaaagaagacgttgatcagttaataaatgccttgaaacaaacgaaggagtttttctcttatgaattt

SEQ ID NO: 2850 - protein, 416 aa, Staphylococcus aureus
  MISC_FEATURE (1)..(416): aminotransferase NifS
VNEVAEHSFDVNEVIKDFPILDQKVNGKRLAYLDSTATSQTPVQVLNVLEDYYKRYNSNVHRGVHTLGSLATDGYENARETVRRFINAKYFEEIIFTRGTTASINLVAHSYGDANVEEGDEIVVTEMEHHANIVPWQQLAKRKNATLKFIPMTADGELNIEDIKQTINDKTKIVAIAHISNVLGTINDVKTIAEIAHQHGAIISVDGAQAAPHMKLDMQEMNADFYSFSGHKMLGPTGIGVLFGKRELLQKMEPIEFGGDMIDFVSKYDATWADLPTKFEAGTPLIAQAIGLAEAIRYLERIGFDAIHKYEQELTIYAYEQMSAIEGIEIYGPPKDRRAGVITFNLQDVHPHDVATAVDTEGVAVRAGHHCAQPLMKWLNVSSTARASFYIYNTKEDVDQLINALKQTKEFFSYEF

SEQ ID NO: 2851 - DNA, 135 bp, Staphylococcus aureus
atgagtgttcggccacttcattcacgacctttcttaaataaaaatcctaatcatttaaatactgacgttgtattagtcttataccaatatcgacagtctatatctattacaaacttttattttcaaaatattatt

SEQ ID NO: 2852 - protein, 45 aa, Staphylococcus aureus
MSVRPLHSRPFLNKNPNHLNTDVVLVLYQYRQSISITNFYFQNII

SEQ ID NO: 2853 - DNA, 1305 bp, Staphylococcus aureus
atgacaactgatattttgaacatttctgaagaacaacttgttgattattctaaagcccacaatgaaccttcttggatgacagaattacgtaaaaaagctttgaaattaacagaaactttagaaatgccaaaacctgataaaacaaaattaagaaaatgggattttgattcttttaaacaacacgatgtaaaaggtgatgtttatcaatctttatcacaattacctgagtcagtaagagaaattattgacgtagatcattctaaaaacttagtaattcaacataataatacgattgcgtacacacaagttgatgataatgcatcgaaagatggcgttatcgttgaaggtttagcagacgctcttatgaaccatagtgatttagtacaaaagtactttatgaaagatgcagtaacagtagatgaacatcgtatcacagcgctacacacggcattagttaatggtggcgtatttgtttatgttcctaaaaatgtagttgtagaacatccagtacaatacgttgtgttgcacgacgacgaaaatgcaagcttttataaccatgttatcatcgttactgaagaaagcgccgaagtcacatatgttgaaaattacttatcaaatgcatctggtgaaggaaatcaattaaatattatttctgaagtgattgctggtgcaaattcaaatatcacatatggctcagtggactatatggataaaggctttacaggtcatatcattcgacgtggtattactgaagcggatgcctcaattaattgggcactaggtttaatgaatgagggtagccaaattattgataatacaacaaatttatttggtgatcgttcaacaagttcacttaaatcagtagttgtaggtacaggcgaacaaaaaattaatctaacatctaaaatcgtacaatatggtaaagaaacagatggttatatccttaaacatggtgttatgaaagaacatgcatcgtctgtatttaatggtatcggctacattaagcatggtggaactaaatcaattgctaatcaggaatcacgtgtattaatgttatctgaacatgctcgtggtgacgcgaatcctattttattaattgatgaagatgatgtacaagctggtcatgctgcatcagtaggtcgtgttgatccagatcaactttactatttaatgagtcgtggtatttctcaaagagaagcggaacgtcttgttatacatggtttcttagatccagtagtacgtgaattacctatcgaagacgttaaacgtcaattgagagaagtaattgaacgcaaagtttctaaa

SEQ ID NO: 2854 - protein, 435 aa, Staphylococcus aureus
  MISC_FEATURE (1)..(435): conserved hypothetical
MTTDILNISEEQLVDYSKAHNEPSWMTELRKKALKLTETLEMPKPDKTKLRKWDFDSFKQHDVKGDVYQSLSQLPESVREIIDVDHSKNLVIQHNNTIAYTQVDDNASKDGVIVEGLADALMNHSDLVQKYFMKDAVTVDEHRITALHTALVNGGVFVYVPKNVVVEHPVQYVVLHDDENASFYNHVIIVTEESAEVTYVENYLSNASGEGNQLNIISEVIAGANSNITYGSVDYMDKGFTGHIIRRGITEADASINWALGLMNEGSQIIDNTTNLFGDRSTSSLKSVVVGTGEQKINLTSKIVQYGKETDGYILKHGVMKEHASSVFNGIGYIKHGGTKSIANQESRVLMLSEHARGDANPILLIDEDDVQAGHAASVGRVDPDQLYYLMSRGISQREAERLVIHGFLDPVVRELPIEDVKRQLREVIERKVSK

SEQ ID NO: 2855 - DNA, 759 bp, Staphylococcus aureus
atggcatcaacattagaaatcaaagacctacatgtgtctattgaggataaagaaatcttaaaaggtgttaacttgacaattaacactgatgaaatacatgcgattatgggaccaaacgggacaggtaaatcaactttatcatctgcaattatgggacacccaagctatgaagtaactaaaggagaagtacttttagacggtgtaaatattttagaattagaagttgatgaaagagcaaaagcaggattattcttggcaatgcaatatccatcagaaattacaggtgttacaaatgctgatttcatgcgttcagcaatcaatgcgaaacgtgaagaaggacaagaaatcaacttaatgcaatttattaagaaattagataaaaacatggattttctagacatagataaagacatggcacaacgttatttaaatgaaggtttctcaggtggagagaagaaacgtaacgaaatcttacaattaatgatgttagaacctaagtttgcaatcttagatgaaatcgattcagggttagacatcgatgcattaaaagttgtatctaaaggtattaaccaaatgcgtggggaaaactttggtgcattaatgattacacactatcaacgattattaaattacattactcctgataaagtacatgtaatgtatgctggtaaagtcgttaaatctggtggtccagaattagcaaaacgtcttgaagaagaaggatatgaatgggttaaagaagagttcggttcagctgaa

SEQ ID NO: 2856 - protein, 253 aa, Staphylococcus aureus
  MISC_FEATURE (1)..(253): ABC transporter ATP-binding
MASTLEIKDLHVSIEDKEILKGVNLTINTDEIHAIMGPNGTGKSTLSSAIMGHPSYEVTKGEVLLDGVNILELEVDERAKAGLFLAMQYPSEITGVTNADFMRSAINAKREEGQEINLMQFIKKLDKNMDFLDIDKDMAQRYLNEGFSGGEKKRNEILQLMMLEPKFAILDEIDSGLDIDALKVVSKGINQMRGENFGALMITHYQRLLNYITPDKVHVMYAGKVVKSGGPELAKRLEEEGYEWVKEEFGSAE

SEQ ID NO: 2857 - DNA, 849 bp, Staphylococcus aureus
atgcaacaatttaaatggattaatattctaaaaggttttgctatgggaacgagtgacttggtacctggtgttagcggtgggactatcgcattattgttaggtatttacaatcaatttatcgcttcaattagcggcatattctcacgacgtttttggccaagttttacatttttaatccccattataattggaatgttactggcaatgggatcactaagtaatctttttaattatttattaagccaacaccatattccaactatgtttttctttggtggattaatcattggtatcgttccatatttattgaaaatttctaactataaaacgtcatttacaactaaacattacatgatggttatagctggtatcgctatcttaattgttattacattaatgaataatggtgataaacatgctggagaaacacttactctatcaactagtcttattattaaatattttattgcaggtatgtgtgcatctagtgctatgttactcccaggtatttcagggtcatttatgttattagtatttggcgtctatggtacggtcatgctagcaatatctgaagttgttaaacttaactttgcaggtcttcctatattacttgcagtcggatttggcgtgcttgctggattcattatttcaagcaaaattatccagtatttcctaacacatcataaactaatgacttttgcattaatcattggttttgttgttggctccctctttgcagtatttccaggtttaccaactaatatcgtgatgtggttcgtttcattagtagtatttatcatcggttttattgtaagtttgactttaggtcgaattaccgctgaaaatgaa

SEQ ID NO: 2858 - protein, 283 aa, Staphylococcus aureus
  MISC_FEATURE (1)..(283): conserved hypothetical
MQQFKWINILKGFAMGTSDLVPGVSGGTIALLLGIYNQFIASISGIFSRRFWPSFTFLIPIIIGMLLAMGSLSNLFNYLLSQHHIPTMFFFGGLIIGIVPYLLKISNYKTSFTTKHYMMVIAGIAILIVITLMNNGDKHAGETLTLSTSLIIKYFIAGMCASSAMLLPGISGSFMLLVFGVYGTVMLAISEVVKLNFAGLPILLAVGFGVLAGFIISSKIIQYFLTHHKLMTFALIIGFVVGSLFAVFPGLPTNIVMWFVSLVVFIIGFIVSLTLGRITAENE

SEQ ID NO: 2859 - DNA, 192 bp, Staphylococcus aureus
atggcagacgaaagtaaatttgaacaagcaaaaggtaatgttaaagaaacagtaggtaatgttactgataataaaaatttagaaaacgaaggtaaagaagataaagcttctggtaaagcgaaagaattcgttgaaaatgcaaaagaaaaagcaactgattttattgataaagtaaaaggtaacaaaggcgag

SEQ ID NO: 2860 - protein, 64 aa, Staphylococcus aureus
  MISC_FEATURE (1)..(64): conserved hypothetical
MADESKFEQAKGNVKETVGNVTDNKNLENEGKEDKASGKAKEFVENAKEKATDFIDKVKGNKGE

SEQ ID NO: 2861 - DNA, 819 bp, Staphylococcus aureus
atgaaaaaattatttggtcttattttagtattaacatttgcagttgtattagcagcttgcggtaatggaaacaaaagtggcagtgacgacaagaaaataacagtaggtgcttcaccagcaccacatgatgaaattttagaaaaagcaaaaccattattagagaaaaaaggttatgaactagatattaaaacaattaacgattacactacacctaataaattactagacaaaggtgaaattgacgcaaactatttccaacatacaccatatttaaacacagagaaaaaggataaaggttacaaaatcgtaagtgccggtgatgttcacttagaacctatggctgtatactctaaaaagtataaaagtttaaaagaattaccaaaaggtgcaacagtctatgtgtctaataatccagctgaacaaggacgtttcttaaaattcttcgttgatgcaggtttaattaaaatcaaaaaaggcgtaaaaattgaagatgctaagtttagtgatattacagagaataaaaaagatattaagtttaataataaacaatcagcagaattcttacctaaaatttatcaaaatgaagacgctgatgctgttatcattaattcgaactttgcaatcgaacaaaaactaaatcctaaaaaagattctattgctgtagaaagtgcgaaagataatccttatgcaaacttaattgctgttaaagaaggacatcaagatgataagaaaatcaaagcattaattgaagtattacaatctaaagatattcaagacttcattaatgaaaaatacaatggtgcagttattcctgctaaa

SEQ ID NO: 2862 - protein, 273 aa, Staphylococcus aureus
  MISC_FEATURE (1)..(273): conserved hypothetical
MKKLFGLILVLTFAVVLAACGNGNKSGSDDKKITVGASPAPHDEILEKAKPLLEKKGYELDIKTINDYTTPNKLLDKGEIDANYFQHTPYLNTEKKDKGYKIVSAGDVHLEPMAVYSKKYKSLKELPKGATVYVSNNPAEQGRFLKFFVDAGLIKIKKGVKIEDAKFSDITENKKDIKFNNKQSAEFLPKIYQNEDADAVIINSNFAIEQKLNPKKDSIAVESAKDNPYANLIAVKEGHQDDKKIKALIEVLQSKDIQDFINEKYNGAVIPAK

SEQ ID NO: 2863 - DNA, 693 bp, Staphylococcus aureus
atgggtaaatcatttagtgaaattataaatgaaatgattacaatgcctaatattcagtggccagaagtttggactgcaatagtcgaaacactatacatgacagtcgtctcaactatatttgcatttatacttggtcttattttaggtgtgttattattcttgtctgctaaaggtaagtctatcggtgcaaggttattttattctatcgtttctttcattgttaacttatttagagcgataccatttattattttaattttattattaattccatttacaagtttgatacttggaacgataagtggtccgacaggtgcgttaccagccttgatcattggcgcagcaccgttttatgcaaggctcgtagaaattgcttttaaagaaattgataaaggtgtcatcgaagcggcttggtcaatgggcgctaatacttggacagtaattcgtaaagtccttttacctgaagctatgccagcgctagtgtctggcattacagttacagcaatcgctttagttggttcaacagcagttgcaggtgtaattggtgccggtggtttaggaaatttagcatacttaacaggtttcactcgaaatcaaaatgatgtcattttagtatcaacagtttttattttaattattgtatttataatccaattcattggggattggcttacaaataaacttgataaacga

SEQ ID NO: 2864 - protein, 231 aa, Staphylococcus aureus
  MISC_FEATURE (1)..(231): conserved hypothetical
MGKSFSEIINEMITMPNIQWPEVWTAIVETLYMTVVSTIFAFILGLILGVLLFLSAKGKSIGARLFYSIVSFIVNLFRAIPFIILILLLIPFTSLILGTISGPTGALPALIIGAAPFYARLVEIAFKEIDKGVIEAAWSMGANTWTVIRKVLLPEAMPALVSGITVTAIALVGSTAVAGVIGAGGLGNLAYLTGFTRNQNDVILVSTVFILIIVFIIQFIGDWLTNKLDKR

SEQ ID NO: 2865 - DNA, 231 bp, Staphylococcus aureus
atgaaggtactttacttcgcagaaattaaagatatattacaaaaagcacaggaagatattgtgcttgaacaagcattgactgtacaacaatttgaagatttattgtttgaacgttatccgcaaatcaataataaaaagtttcaagttgctgtaaatgaggaatttgtacaaaaatcggatttcattcaacctaatgatactgttgcattaattccaccggttagtggaggt

SEQ ID NO: 2866 - protein, 77 aa, Staphylococcus aureus
  MISC_FEATURE (1)..(77): probable molybdopterin
MKVLYFAEIKDILQKAQEDIVLEQALTVQQFEDLLFERYPQINNKKFQVAVNEEFVQKSDFIQPNDTVALIPPVSGG

SEQ ID NO: 2867 - DNA, 1023 bp, Staphylococcus aureus
gtgattgaattaaaagaagttgttaaagaatatcggactaaaaataaagaagtccttgctgtagatcacgttaatttatcgattcgagcaggatcgatttatggcgtcattggtttttctggagcaggaaaaagtactttgattcgaatgtttaatcatttagaagcgcctacatcaggtgaagttattatagatggagaccatataggtcaattgtccaaaaatggattaagagcaaaaagacaaaaagtaagtatgatcttccaacattttaatttgttatggtcaaggactgtgttaaaaaatattatgtttccgcttgaaattgcaggtgtccctagaaggagagctaagcaaaaagcattagaacttgtcgaactcgtcggtttaaaaggtagagaaaaggcttatccatcagagttatcaggtggacaaaagcaacgtgttgggattgcacgagcgttagctaatgatccaacggtcttgctttgtgatgaggcaacaagtgcacttgatccgcaaacaacagatgaaattttagatctactactaaaaattagagaacaacaaaatttaacaattgtactaattacgcatgaaatgcatgtcattcgtcgtatttgtgatgaagttgcagttatggaaagtggtaaagtgatagaacaaggaccggtgacacaggtttttgaaaatccgcaacacactgtgacaaaacgatttgtgaaagacgatttaaatgatgatttcgaaacatctttaacagaattagagccattagaaaaagatgcatatatcgttagattagttttcgctggttcaacaacaaccgagcctattgtatcgagtctatcaactgcctatgatattaaaattaatattttagaagcaaatattaaaaatacaaaaaatggaacagtcggctttttagttctgcatattccatatatttcaagtgtagatttcggaaaattcgaaaaagagttaattgagcgacaagttaaaatggaggtgttaagacatggg

SEQ ID NO: 2868 - protein, 341 aa, Staphylococcus aureus
  MISC_FEATURE (1)..(341): ABC transporter ATP-binding
VIELKEVVKEYRTKNKEVLAVDHVNLSIRAGSIYGVIGFSGAGKSTLIRMFNHLEAPTSGEVIIDGDHIGQLSKNGLRAKRQKVSMIFQHFNLLWSRTVLKNIMFPLEIAGVPRRRAKQKALELVELVGLKGREKAYPSELSGGQKQRVGIARALANDPTVLLCDEATSALDPQTTDEILDLLLKIREQQNLTIVLITHEMHVIRRICDEVAVMESGKVIEQGPVTQVFENPQHTVTKRFVKDDLNDDFETSLTELEPLEKDAYIVRLVFAGSTTTEPIVSSLSTAYDIKINILEANIKNTKNGTVGFLVLHIPYISSVDFGKFEKELIERQVKMEVLRHG

SEQ ID NO: 2869 - DNA, 294 bp, Staphylococcus aureus
atgaataattcattagacatcaaagatgtaactacattttatgaggaagacaaacatttaatctttggttatacaccaacgtgtggtacttgtaaggtttcagaaagaatgttagacattgctaatgaaatattgcagttaccattattgaaaatagatttaaacttttatcctcagttttgtaaagatatgcaaatcatgtctacgccgattttattgttgatgaataaagataaagaagtaaaacgaatttatgcatttaaatcggtgactgatttgttagaaaatttaaaa

SEQ ID NO: 2870 - protein, 98 aa, Staphylococcus aureus
  MISC_FEATURE (1)..(98): hypothetical protein
MNNSLDIKDVTTFYEEDKHLIFGYTPTCGTCKVSERMLDIANEILQLPLLKIDLNFYPQFCKDMQIMSTPILLLMNKDKEVKRIYAFKSVTDLLENLK

SEQ ID NO: 2871 - DNA, 393 bp, Staphylococcus aureus
gtgatgatgatggctattgtaaataaagtgataattgttgaaggaaaatctgataaaaaaagggtgcaacaggttattgcagaaccagtcaatattatttgtactcatggaacaatgagtatagataagcttgatgatatgatagaatcactgtatgataaacaagtttttgtattagccgattctgatgacgaaggagatcgaattagaaattggtttaaacgttatttgagtgaaagtgaacatatatttattgataaaacttactgtcaagttgcgaattgccccaaacaatatttggcgcatgtactttcaaaacatggctttacttgtaagaaagaaacacctcttttaccgaatataaataatgaaaggttagttttagtaaatgaa

SEQ ID NO: 2872 - protein, 131 aa, Staphylococcus aureus
  MISC_FEATURE (1)..(131): conserved hypothetical
VMMMAIVNKVIIVEGKSDKKRVQQVIAEPVNIICTHGTMSIDKLDDMIESLYDKQVFVLADSDDEGDRIRNWFKRYLSESEHIFIDKTYCQVANCPKQYLAHVLSKHGFTCKKETPLLPNINNERLVLVNE

SEQ ID NO: 2873 - DNA, 891 bp, Staphylococcus aureus
ttgggggaagttaatatgctaaacattcaagacgttagtcatctttctaaaaaggagcaaaaagcatataaccgtttcgtagaatctgtagaaaacggtaatttaccagtactaccatgtattgaaatggatctaaaagagatgcaagaagaaacattaaaccagagtaagattggtggaatgccatttttaaaatcttttaaagatataccattagatgaaaataatgtaccaatggtattgctagcacagattaatttggatgatcttccagaacaacaagaattatttcctgtaaaagaagggatattgcagttttggattagttcagaagatcaaatgtatggaatgtctgaaaatttaaagggaaacaatataaactcaaggcttgtttatataaaagagccaattacagatttatcactcgaaaatattcaagcgcatttgaagtcattagatgctgataatgaggatatcccgttcagtggagcattttctatagaatttagattgtcgaaacaaactattacatgtactgattataagtacgatgaggacgtgcttgcattgtggaataaagtcaatccatccttcgcgctaaaatcaatgtttggtggttatgatgaattgatggaacctgtgtgtaacacatttactgctaaggaaccatttaatcaacttggtggttatccatattttgaccaaatagatccaagaacgaacgatcaagaactgaaaatgtatgatagagtcttactgcaaattgattctacaagagatggtaattcttcgattatatggggtgatttaggtattgccaatatcttagtgaaatctactgaccttgaggctatgaagtttgatgattacatgtattcatgggattgcagc

SEQ ID NO: 2874 - protein, 297 aa, Staphylococcus aureus
  MISC_FEATURE (1)..(297): conserved hypothetical
LGEVNMLNIQDVSHLSKKEQKAYNRFVESVENGNLPVLPCIEMDLKEMQEETLNQSKIGGMPFLKSFKDIPLDENNVPMVLLAQINLDDLPEQQELFPVKEGILQFWISSEDQMYGMSENLKGNNINSRLVYIKEPITDLSLENIQAHLKSLDADNEDIPFSGAFSIEFRLSKQTITCTDYKYDEDVLALWNKVNPSFALKSMFGGYDELMEPVCNTFTAKEPFNQLGGYPYFDQIDPRTNDQELKMYDRVLLQIDSTRDGNSSIIWGDLGIANILVKSTDLEAMKFDDYMYSWDCS

SEQ ID NO: 2875 - DNA, 111 bp, Staphylococcus aureus
atgaaagaaaaattattaggtactattatttggagtattgctacattttattattcaagaatgatggaaataatgaatttagctattttaaaaataaaaattgggggaagt

SEQ ID NO: 2876 - protein, 37 aa, Staphylococcus aureus
MKEKLLGTIIWSIATFYYSRMMEIMNLAILKIKIGGS

SEQ ID NO: 2877 - DNA, 378 bp, Staphylococcus aureus
ttggcagtaccaaatgaattgaaatattcaaaagagcatgaatgggttaaagttgaaggtaatgtagcaataattggaatcacagaatacgcacaaagcgagttaggtgatattgttttcgttgaattaccagaaacagatgatgaaattaatgaaggggatacgtttggtagcgtagaatcagttaaaactgtatcagaattatatgcaccaatctctggtaaagtagttgaagtcaacgaagaactagaagatagtcccgaatttgtaaatgaatctccatacgaaaaagcatggatggtaaaagtagaaattagtgatgaaagtcagattgaagctttattaacagctgaaaaatattcagaaatgattggtgaa

SEQ ID NO: 2878 - protein, 126 aa, Staphylococcus aureus
  MISC_FEATURE (1)..(126): glycine cleavage system
LAVPNELKYSKEHEWVKVEGNVAIIGITEYAQSELGDIVFVELPETDDEINEGDTFGSVESVKTVSELYAPISGKVVEVNEELEDSPEFVNESPYEKAWMVKVEISDESQIEALLTAEKYSEMIGE

SEQ ID NO: 2879 - DNA, 354 bp, Staphylococcus aureus
atgattaaattttaccaatataagaattgtacaacttgtaaaaaggcagcaaagtttttagatgaatatggcgtaagttatgaaccaattgatatcgttcaacatacacctacaataaatgaatttaaaacaataattgcaaatacaggcgtagaaattaataaattgtttaatacacacggcgcgaaatatcgtgagcttgatttgaaaaataaattacaaactttatcagatgatgaaaagttagagttgttatcatctgatggtatgttagtaaagcgtcctctagcagtaatgggcgataagataacattaggatttaaagaagatcaatataaagagacttggttagcg

SEQ ID NO: 2880 - protein, 118 aa, Staphylococcus aureus
  MISC_FEATURE (1)..(118): hypothetical protein
MIKFYQYKNCTTCKKAAKFLDEYGVSYEPIDIVQHTPTINEFKTIIANTGVEINKLFNTHGAKYRELDLKNKLQTLSDDEKLELLSSDGMLVKRPLAVMGDKITLGFKEDQYKETWLA

SEQ ID NO: 2881 - DNA, 318 bp, Staphylococcus aureus
atgcaatcaatcaaaagtaatgaatcatttaaatctgtaattaatagcgatacacctgtaattgttaaatttgaggcaggatggtgcccagactgtcgtgctatggatttatggattgacccaatcgtagaacaatataatgattaccaatggtatactgttaatcgtgatgaattagaagatgtagttgttgaaaatgaagttatgggtatccctagcttgctagtatttaaaaacggcgataaaattgcacaccttcattcagcaaatgctaagtcacctgaacaagttgaatcatttttagcagaaacttttaaa

SEQ ID NO: 2882 - protein, 106 aa, Staphylococcus aureus
  MISC_FEATURE (1)..(106): hypothetical protein
MQSIKSNESFKSVINSDTPVIVKFEAGWCPDCRAMDLWIDPIVEQYNDYQWYTVNRDELEDVVVENEVMGIPSLLVFKNGDKIAHLHSANAKSPEQVESFLAETFK

SEQ ID NO: 2883 - DNA, 537 bp, Staphylococcus aureus
atggaattacaacaagcaatagctaatagaagaagtgtgaaaaaatttaaaagagatatgcacatagatgacgcattgctatatcaagcaattgagaaagctgctgatgctccaaatcacggaatgagggaaccatggagagttgtgcatgttccgaaagacagattaggagatatgagtaaggatatttctaaatttgcatttcctaatgaattagataagcaacaatgtcattatgatgcagttacgaaactaggtggcatgttattgcttattttaaaaacagatccaagacaacgtcaaaatgatgaaaactactttgcatttggtgcatatgcacaaaatcttatgttgttactttatgaagcgggaataggtacatgttggaaatcgccattatatatctatgatcctaaagtaagaaaaacacttggtataaagaaagatgaagttcttgctggattcttatatttaacggatttagaagaagatatgcctaaagcaccacgtaaaaatagaaacttaattacattatat

SEQ ID NO: 2884 - protein, 179 aa, Staphylococcus aureus
  MISC_FEATURE (1)..(179): conserved hypothetical
MELQQAIANRRSVKKFKRDMHIDDALLYQAIEKAADAPNHGMREPWRVVHVPKDRLGDMSKDISKFAFPNELDKQQCHYDAVTKLGGMLLLILKTDPRQRQNDENYFAFGAYAQNLMLLLYEAGIGTCWKSPLYIYDPKVRKTLGIKKDEVLAGFLYLTDLEEDMPKAPRKNRNLITLY

SEQ ID NO: 2885 - DNA, 714 bp, Staphylococcus aureus
atgacacatgtggaagtagtagcgactatcgcgccacaattatctatcgaagaaactttaattcaaaaaattaatcatcgtattgatgcaatagacgtattagaattacgaattgatcaaattgaaaatgtcacagttgatcaagtggcagaaatgattacaaagctgaaggttatgcaagattcattcaaattattagttacgtatcgtacaaagttacaaggtggctatgggcaatttacaaatgactcgtatcttaatttaatatcagacttagcaaatatcaatggcatagatatgattgatatagaatggcaagcagatattgacattgaaaaacatcaacgaatcattacacatttgcaacagtataataaagaggtggttatatcacatcataatttcgaaagtacgcctccattagatgaattgcaatttatattttttaaaatgcaaaaattcaacccagaatacgttaaattagcagtaatgccacataataaaaatgatgtgttaaatttattgcaggcaatgtctacattttcagatactatggactgcaaagttgttggtatttcaatgtctaaacttggactaataagtagaacggctcaaggcgtttttggtggtgcgttgacttatggttgtatcggagtaccacaagctccaggacagattgatgttactgatttaaaagcacaagtgactttatac

SEQ ID NO: 2886 - protein, 238 aa, Staphylococcus aureus
  MISC_FEATURE (1)..(238): hypothetical protein
MTHVEVVATIAPQLSIEETLIQKINHRIDAIDVLELRIDQIENVTVDQVAEMITKLKVMQDSFKLLVTYRTKLQGGYGQFTNDSYLNLISDLANINGIDMIDIEWQADIDIEKHQRIITHLQQYNKEVVISHHNFESTPPLDELQFIFFKMQKFNPEYVKLAVMPHNKNDVLNLLQAMSTFSDTMDCKVVGISMSKLGLISRTAQGVFGGALTYGCIGVPQAPGQIDVTDLKAQVTLY

SEQ ID NO: 2887 - DNA, 420 bp, Staphylococcus aureus
atggcaatacattatgaaactaaagcgacgaatgttggcggacgtaaaggacatgtttatactgatgatcgagcattagatattgatatcgttccgcctgctcaagcagatggtaaagctactaaccccgaacaattatttgcagcaggttatgcatcttgcttcaacggtgctttcgacctaattttaaagcaaaacaaagtgcgtgatgctcatccagaagtaacactaacagtgagactagaagatgattcagactcagaaagtcctaaattaagtgtttcaattgatgcgacaattaaaaatgttatatctcaagaagaagctgaaaaatatttacaaatggctcatgaattttgtccatattcaaaagcgactcaaggaaatattaatgtcgatttaaatgtaaatgttgtagat

SEQ ID NO: 2888 - protein, 140 aa, Staphylococcus aureus
  MISC_FEATURE (1)..(140): hypothetical protein
MAIHYETKATNVGGRKGHVYTDDRALDIDIVPPAQADGKATNPEQLFAAGYASCFNGAFDLILKQNKVRDAHPEVTLTVRLEDDSDSESPKLSVSIDATIKNVISQEEAEKYLQMAHEFCPYSKATQGNINVDLNVNVVD

SEQ ID NO: 2889 - DNA, 492 bp, Staphylococcus aureus
atgattgaaattaaaacattaacgaataatgattttaatgagtataagagacttgtttcgacagtcaatgaagaattcactcaagattcacattatagtcaaacaatgactgacaccttaatacatgacattttaaatcaaggttcaccgaaatgtattgtatttggctgttatgaaaacgaaacacttatcgcaacagctgccttagaacaaattcgatacgttggaaaagaacataaatcattaattaaatacaactttgttactaataacgataaatcgattaatagcgagctcattaatttcattattaattatgcacggcagaacaattacgaatctttacttacatcaattgtgtcaaacaacataggtgctaaagttttctatagtgcactaggattcgacattcttggttttgagaaaaatgcaattaaaatcggaaatacctatttcgatgaacattggcttttttatgatttgattaataag

SEQ ID NO: 2890 - protein, 164 aa, Staphylococcus aureus
  MISC_FEATURE (1)..(164): hypothetical protein
MIEIKTLTNNDFNEYKRLVSTVNEEFTQDSHYSQTMTDTLIHDILNQGSPKCIVFGCYENETLIATAALEQIRYVGKEHKSLIKYNFVTNNDKSINSELINFIINYARQNNYESLLTSIVSNNIGAKVFYSALGFDILGFEKNAIKIGNTYFDEHWLFYDLINK

SEQ ID NO: 2891 - DNA, 615 bp, Staphylococcus aureus
atggtaaccgcaattattcatggatttatcttagcgattggtctaattttacctttaggtgcacaaaatgtatttatttttaaccaaggagctaatcaaccaaaatatagatatgtattgcctgcaataattacagccgggttgtcagacagcttacttattattattgcagtggtaggagtatctatcattattatgtctttacctgtacttcaagcaattatttatatagttggtttaattttcttgatgtatatggcttggaccatttggcatgataaaccctcaacagatggagaaactcaaattatgtctccaatgaaacaagtaagttttgctttatcagtttcattactcaatccacatgctattttagatacaattggagtaattggtagtagtgctgcattatatagtggcagcaataaaattgcgtttacaatcgcttgtattagcgtttcatggttatggttctttttactcgcaattttaggaaaaatggttggatcaattgataaaaccggaaaattattaacaataatcaataaaatatcaagcataataattattattgttgctctgatgatattacaaaaacttattcaattattattc

SEQ ID NO: 2892 - protein, 205 aa, Staphylococcus aureus
  MISC_FEATURE (1)..(205): conserved hypothetical
MVTAIIHGFILAIGLILPLGAQNVFIFNQGANQPKYRYVLPAIITAGLSDSLLIIIAVVGVSIIIMSLPVLQAIIYIVGLIFLMYMAWTIWHDKPSTDGETQIMSPMKQVSFALSVSLLNPHAILDTIGVIGSSAALYSGSNKIAFTIACISVSWLWFFLLAILGKMVGSIDKTGKLLTIINKISSIIIIIVALMILQKLIQLLF

SEQ ID NO: 2893 - DNA, 588 bp, Staphylococcus aureus
gtgttattgttggctaaaacgttatatttaatgcgccacggacaaactttgtttaattttaagggactaattcagggatttggagattcgccgctaacagaacttggaattgctcaagctcaaaaggcacgtagttattatgaaactaaggggataaacttcgatttatatgcatcatcaacgcaagaacgcgcaagtgacacacttgaaaatgttgcacctaaccaatcgtatcaacgttttaagggactgaaggaatggcattttggaatatttgaaggtgagtcagtctatctatttgataatctatacaagcctgaggacttattcggagatcgaattgttcctttcaaaggagaggcaaggcaacaagttgaagaacgcattgtgaaaactttacatgacattatgtctcaaacaaagaataatgcattagtcgtgagtcatggaacaataatgggagtatttttaagatattgccttaaactagatgaagcattaaagcataatatcggtaattgtaatatcctgaaatttgaatatgacaatggaacatttaaatttgttgagttaattgatccaaattta

SEQ ID NO: 2894 - protein, 196 aa, Staphylococcus aureus
  MISC_FEATURE (1)..(196): hypothetical protein
VLLLAKTLYLMRHGQTLFNFKGLIQGFGDSPLTELGIAQAQKARSYYETKGINFDLYASSTQERASDTLENVAPNQSYQRFKGLKEWHFGIFEGESVYLFDNLYKPEDLFGDRIVPFKGEARQQVEERIVKTLHDIMSQTKNNALVVSHGTIMGVFLRYCLKLDEALKHNIGNCNILKFEYDNGTFKFVELIDPNL

SEQ ID NO: 2895 - DNA, 240 bp, Staphylococcus aureus
gtgtttatggataatcataatcaatgtaattatgtgaatccacaaaatgtttcacttgactgggaatgttttataattagtaaaagtgaaatgttgttagatggtgtaccaaatgaacttatcaacacttggttagataaagacattattacaccattttcgataagaaatgatgaaataaactttaaaacaaaagatatttgggatgcactaatacatcataattggtactactcaaat

SEQ ID NO: 2896 - protein, 80 aa, Staphylococcus aureus
  MISC_FEATURE (1)..(80): hypothetical protein
VFMDNHNQCNYVNPQNVSLDWECFIISKSEMLLDGVPNELINTWLDKDIITPFSIRNDEINFKTKDIWDALIHHNWYYSN

SEQ ID NO: 2897 - DNA, 201 bp, Staphylococcus aureus
atgacgttttacaatttcatcatgggttttcaaaatgataacacaccatttggtatattggccgaacacgttagtgaagataaagcattccctcgattagaagaaagacaccaagtaattagagcatatgtgatgtctaattacacagatcatcaattaattgaaactacaaatagagctattagcttatatatggcaaat

SEQ ID NO: 2898 - protein, 67 aa, Staphylococcus aureus
  MISC_FEATURE (1)..(67): hypothetical protein
MTFYNFIMGFQNDNTPFGILAEHVSEDKAFPRLEERHQVIRAYVMSNYTDHQLIETTNRAISLYMAN

SEQ ID NO: 2899 - DNA, 567 bp, Staphylococcus aureus
gtgaactatattaaacgaacgataattttacttatattattcgttgtcgtatccccaataaactcaccaaaaacaattgcagataataagtattcagaaattcaagatgacaaattccaattacaacctggtgatattattgttacaaaaggccctgtcatgtggggattttttggtcattgtagtatcgcgattgatgataaaacgattttacaaattgaggggcctggcgacaaaccaactacacaatccttcgaatcttttaaatataattatgcaagtggcaaaaatgattggatgaaagtttatcgttgcagctatcctggtgcaggtaaaaaagcggctgaatgggttaagaaaaactatgagaatacaaatcatcgttatctagttacattaaatttgaacagcaaaaaatttacgtattgtactaaaattatctaccaagcttataaatttggtgtaagtgaaaaatcagttaaaagttatggactacatattatttcaccctatgcaattaaagataattttatagatccatacaaactaaggcttgttaaagcttat

SEQ ID NO: 2900 - protein, 189 aa, Staphylococcus aureus
  MISC_FEATURE (1)..(189): conserved hypothetical
VNYIKRTIILLILFVVVSPINSPKTIADNKYSEIQDDKFQLQPGDIIVTKGPVMWGFFGHCSIAIDDKTILQIEGPGDKPTTQSFESFKYNYASGKNDWMKVYRCSYPGAGKKAAEWVKKNYENTNHRYLVTLNLNSKKFTYCTKIIYQAYKFGVSEKSVKSYGLHIISPYAIKDNFIDPYKLRLVKAY

SEQ ID NO: 2901 - DNA, 282 bp, Staphylococcus aureus
ttgaatgaactaactaaagaacaaaagtatacaatagctaaattttacaaattatatattgaacgttcgaataaaggagaaacagaaacagtcgctaacttttttggcgatgctaaagatgcacgtgaaaactatttttgcgatcgtgattatcaagacttcttaactaactgccaaattttaattcaaaacaaatacttaactggtgaagttttggacgataacatttacaatatttctattttaaacaagacatttattgaattcgaacaaaattttggt

SEQ ID NO: 2902 - protein, 94 aa, Staphylococcus aureus
  MISC_FEATURE (1)..(94): hypothetical protein
LNELTKEQKYTIAKFYKLYIERSNKGETETVANFFGDAKDARENYFCDRDYQDFLTNCQILIQNKYLTGEVLDDNIYNISILNKTFIEFEQNFG

SEQ ID NO: 2903 - DNA, 216 bp, Staphylococcus aureus
atgagtgaatggcatattaataatcaatctacaaaaccttttttaatacaacaagcggaaaagcaattgtctattgttaaaccgttgcctaatggtagcttccaaatactcacagaaataaatttggagaatggcaatattagtaacatcgatcattctttacttgtttcagtagaccccaaagcattagaaataagtatatttgacgctgtaaat

SEQ ID NO: 2904 - protein, 72 aa, Staphylococcus aureus
  MISC_FEATURE (1)..(72): hypothetical protein
MSEWHINNQSTKPFLIQQAEKQLSIVKPLPNGSFQILTEINLENGNISNIDHSLLVSVDPKALEISIFDAVN

SEQ ID NO: 2905 - DNA, 198 bp, Staphylococcus aureus
atgaataacggtacagttaaatggtttaatgcagaaaaaggttttggtttcatcgaaagagaagatggtagcgacgtattcgtacacttctcagcaatcgctgaagatggatacaaatcattagaagaaggccaaaaagttgaattcgacatcgttgaaggcgaccgtggcgagcaagctgcaaacgtagttaaaatg

SEQ ID NO: 2906 - protein, 66 aa, Staphylococcus aureus
  MISC_FEATURE (1)..(66): cold-shock protein C
MNNGTVKWFNAEKGFGFIEREDGSDVFVHFSAIAEDGYKSLEEGQKVEFDIVEGDRGEQAANVVKM

SEQ ID NO: 2907 - DNA, 444 bp, Staphylococcus aureus
atgaaacaatttgaaatcgtgacagaaccgatacaaacagaacaatatcgtgaattcactataaatgaatatcaaggtgcagtagttgtttttaccggtcatgttcgcgaatggactaaaggcgtcaaaacggaatatttagaatatgaagcgtatattccaatggctgaaaagaaattggcacaaattggagatgaaataaatgaaaaatggcctggaacgataacgagtattgttcatagaatagggccattacaaatttcagatatcgctgtattaattgcggtttcttcaccgcatcgtaaagatgcctatcgagcaaatgaatatgcaattgagcgtataaaagaaattgttccgatttggaaaaaagaaatttgggaagatggttcaaaatggcaagggcatcaaaaagggaattatgaagaagcaaagagggaggaa

SEQ ID NO: 2908 - protein, 148 aa, Staphylococcus aureus
  MISC_FEATURE (1)..(148): molybdopterin converting
MKQFEIVTEPIQTEQYREFTINEYQGAVVVFTGHVREWTKGVKTEYLEYEAYIPMAEKKLAQIGDEINEKWPGTITSIVHRIGPLQISDIAVLIAVSSPHRKDAYRANEYAIERIKEIVPIWKKEIWEDGSKWQGHQKGNYEEAKREE

SEQ ID NO: 2909 - DNA, 693 bp, Staphylococcus aureus
gtgttagttatgacagaatacttattaagtgctggcatatgtatggcaatcgtttcaatattacttatagggatggctatcagtaatgtttcgaaagggcaatacgcaaagaggtttttctatttcgctactagttgtttagtgttaactttagttgtagtttcaagtctaagtagctcagcaaatgcatcacaaacagataatggcgtaaatagaagtggttctgaagatccaacagtatatagtgcaacttcaactaaaaaattacataaagaacctgcgacattaattaaagcgattgatggtgatacggttaaattaatgtacaaaggtcaaccaatgacattcagactattattggttgatacacctgaaacaaagcatcctaaaaaaggtgtagagaaatatggtcctgaagcaagtgcatttacgaaaaaaatggtagaaaatgcaaagaaaattgaagtcgagtttgacaaaggtcaaagaactgataaatatggacgtggcttagcgtatatttatgctgatggaaaaatggtaaacgaagctttagttcgtcaaggcttggctaaagttgcttatgtttataaacctaacaatacacatgaacaacttttaagaaaaagtgaagcacaagcaaaaaaagagaaattaaatatttggagcgaagacaacgctgattcaggtcaa

SEQ ID NO: 2910 - protein, 231 aa, Staphylococcus aureus
  MISC_FEATURE (1)..(231): staphylococcal nuclease
VLVMTEYLLSAGICMAIVSILLIGMAISNVSKGQYAKRFFYFATSCLVLTLVVVSSLSSSANASQTDNGVNRSGSEDPTVYSATSTKKLHKEPATLIKAIDGDTVKLMYKGQPMTFRLLLVDTPETKHPKKGVEKYGPEASAFTKKMVENAKKIEVEFDKGQRTDKYGRGLAYIYADGKMVNEALVRQGLAKVAYVYKPNNTHEQLLRKSEAQAKKEKLNIWSEDNADSGQ

SEQ ID NO: 2911 - DNA, 468 bp, Staphylococcus aureus
atgaaaaggaaagtattagtactaacaatgggtgtaatttgtgcaactcaattatggcattctaatcacgcaaacgcattagtaacagagagtggcgcaaatgatactaagcaatttactgaaattgtatcggaagagaaagttataacagttgaacatgctcaaattaatatttttcaatctaatagcaattcaaacttgatggagttcaacatattaacaatgggcggtaaatcaggagctatggttggttatagtgaaattgactcatcacatttcacagaccgtgacaaacgcgttattagacgtgatcatgttaaagaagcacaaagcttagtagagaactataaagatacacaaagtgctgatgctaggatgaaagccaaacaaaaagttaacacattaagcaaaccgcatcaaaactatttcaataaacaaattgataaggtttataatggattacaacgc

SEQ ID NO: 2912 - protein, 156 aa, Staphylococcus aureus
  MISC_FEATURE (1)..(156): hypothetical protein
MKRKVLVLTMGVICATQLWHSNHANALVTESGANDTKQFTEIVSEEKVITVEHAQINIFQSNSNSNLMEFNILTMGGKSGAMVGYSEIDSSHFTDRDKRVIRRDHVKEAQSLVENYKDTQSADARMKAKQKVNTLSKPHQNYFNKQIDKVYNGLQR

SEQ ID NO: 2913 - DNA, 966 bp, Staphylococcus aureus
atgaattcaaatcacgctaaagcatcagtgacagagagtgttgacaaaaaatttgtagttccagaatcaggaattaataaaattattccagcttacgatgaatttaagaattcgccaaaagtaaatgttagtaatttaactgacaataaaaactttgtagcttctgaagataaattgaataagattgcagattcatcggcagctagtaaaattgtagataaaaactttgtcgtaccagaatcaaagttaggaaacattgtgccagagtacaaagaaatcaataatcgcgtgaatgtagcaacaaacaatccagcttcacaacaagttgataagcattttgttgctaaaggcccagaagtaaatagatttattacgcaaaacaaagtaaaccaccacttcattactacgcaaacccactacaagaaagttattacttcatacaaatcaacacatgtacataaacatgtaaatcatgcaaaggattctattaataaacactttattgttaaaccatcagaatcgcctagatatacacatccatctcaatctttaattatcaagcatcattttgcagttcctggatatcacgcgcataaatttgttacaccagggcatgctagcattaaaattaatcacttttgtgttgtgccacaaataaatagtttcaaggtaattccaccatatggtcacaattcacatcgtatgcatgtaccaagtttccaaaataacacaacagcaacacatcaaaatgctaaagtaaataaagcatatgactataaatacttctattcttataaagtagttaaaggtgtgaagaaatatttctcattttcacaatcaaatggttataaaattgggaaaccatcattaaatatcaaaaatgtaaattatcaatatgctgttccaagttatagccctacacactacgttcctgaatttaagggtagcttaccagcaccacgagta

SEQ ID NO: 2914 - protein, 322 aa, Staphylococcus aureus
  MISC_FEATURE (1)..(322): extracellular ECM and
MNSNHAKASVTESVDKKFVVPESGINKIIPAYDEFKNSPKVNVSNLTDNKNFVASEDKLNKIADSSAASKIVDKNFVVPESKLGNIVPEYKEINNRVNVATNNPASQQVDKHFVAKGPEVNRFITQNKVNHHFITTQTHYKKVITSYKSTHVHKHVNHAKDSINKHFIVKPSESPRYTHPSQSLIIKHHFAVPGYHAHKFVTPGHASIKINHFCVVPQINSFKVIPPYGHNSHRMHVPSFQNNTTATHQNAKVNKAYDYKYFYSYKVVKGVKKYFSFSQSNGYKIGKPSLNIKNVNYQYAVPSYSPTHYVPEFKGSLPAPRV

SEQ ID NO: 2915 - DNA, 111 bp, Staphylococcus aureus
ttggttataatattgagtctatataaaggagaaataacagatgaaaaagaaattattagttttaactatgagcacgctatttgctacacaaattatgaattcaaatcacgc

SEQ ID NO: 2916 - protein, 37 aa, Staphylococcus aureus
LVIILSLYKGEITDEKEIISFNYEHAICYTNYEFKSR

SEQ ID NO: 2917 - DNA, 1407 bp, Staphylococcus aureus
ttgaaactgactaataataaaaataaatctagaacagtagaagagtataagaaaagcttggatgatttaatatggtcctttccaaacttagataatgaaagatttgataatcctgaatataaagaagctatgaaaaaatatcaacagagatttatggctgaagatgaggctttgaagaaattttttagtgaagagaaaaaaataaaaaatggaaatactgataatttagattatctaggattatctcatgaaagatatgaaagtgtatttaatactttgaaaaaacaaagtgaggagttcttaaaagaaattgaagatataaaaaaagataaccctgaattgaaagactttaatgaagaggagcaattaaagtgcgacttagaattaaacaaattagaaaatcagatattaatgttaggtaaaacattttatcaaaactatagagatgatgttgaaagtttatatagtaagttagatttaattatgggatataaagatgaagaaagagcaaataaaaaagcagttaacaaaaggatgttagaaaataaaaaagaagacttagaaaccataattgatgaattttttagtgatatagataaaacaagacctaataatattcctgttttagaagatgaaaaacaagaagagaaaaatcataaaaatatggctcaattaaaatctgacactgaagcagcaaaaagtgatgaatcaaaaagaagcaagagaagtaaaagaagtttaaatactcaaaatcacaaacctgcatctcaagaagtttctgaacaacaaaaagctgaatatgataaaagagcagaagaaagaaaagcgagatttttggataatcaaaaaattaagaaaacacctgtagtgtcattagaatatgattttgagcataaacaacgtattgacaacgaaaacgacaagaaacttgtggtttctgcaccaacaaagaaaccaacatcaccgactacatatactgaaacaacgacacaggtaccaatgcctacagttgagcgtcaaactcagcaacaaattatttataatgcaccaaaacaattggctggattaaatggtgaaagtcatgatttcacaacaacgcatcaatcaccaacaacttcaaatcacacgcataataatgttgttgaatttgaagaaacgtctgctttacctggtagaaaatcaggatcactggttggtataagtcaaattgattcttctcatctaactgaacgtgagaagcgtgtaattaagcgtgaacacgttagagaagctcaaaagttagttgataattataaagatacacatagttataaagaccgaataaatgcacaacaaaaagtaaatactttaagtgaaggtcatcaaaaacgttttaataaacaaatcaataaagtatataatggcaaa

SEQ ID NO: 2918 - protein, 469 aa, Staphylococcus aureus
  MISC_FEATURE (1)..(469): hypothetical protein
LKLTNNKNKSRTVEEYKKSLDDLIWSFPNLDNERFDNPEYKEAMKKYQQRFMAEDEALKKFFSEEKKIKNGNTDNLDYLGLSHERYESVFNTLKKQSEEFLKEIEDIKKDNPELKDFNEEEQLKCDLELNKLENQILMLGKTFYQNYRDDVESLYSKLDLIMGYKDEERANKKAVNKRMLENKKEDLETIIDEFFSDIDKTRPNNIPVLEDEKQEEKNHKNMAQLKSDTEAAKSDESKRSKRSKRSLNTQNHKPASQEVSEQQKAEYDKRAEERKARFLDNQKIKKTPVVSLEYDFEHKQRIDNENDKKLVVSAPTKKPTSPTTYTETTTQVPMPTVERQTQQQIIYNAPKQLAGLNGESHDFTTTHQSPTTSNHTHNNVVEFEETSALPGRKSGSLVGISQIDSSHLTEREKRVIKREHVREAQKLVDNYKDTHSYKDRINAQQKVNTLSEGHQKRFNKQINKVYNGK

SEQ ID NO: 2919 - DNA, 117 bp, Staphylococcus aureus
ttgaaaaataaattgctagttttatcattgggagcattatgtgtatcacaaatttgggaaagtaatcgtgcgagtgcagtggtttctggggagaagaatccatatgtatctagtcgt

SEQ ID NO: 2920 - protein, 39 aa, Staphylococcus aureus
  MISC_FEATURE (1)..(39): hypothetical protein
LKNKLLVLSLGALCVSQIWESNRASAVVSGEKNPYVSSR

SEQ ID NO: 2921 - DNA, 2781 bp, Staphylococcus aureus
atgaatatgaagaaaaaagaaaaacacgcaattcggaaaaaatcgattggcgtggcttcagtgcttgtaggtacgttaatcggttttggactactcagcagtaaagaagcagatgcaagtgaaaatagtgttacgcaatctgatagcgcaagtaacgaaagcaaaagtaatgattcaagtagcgttagtgctgcacctaaaacagacgacacaaacgtgagtgatactaaaacatcgtcaaacactaataatggcgaaacgagtgtggcgcaaaatccagcacaacaggaaacgacacaatcatcatcaacaaatgcaactacggaagaaacgccggtaactggtgaagctactactacgacaacgaatcaagctaatacaccggcaacaactcaatcaagcaatacaaatgcggaggaattagtgaatcaaacaagtaatgaaacgacttctaatgatactaatacagtatcatctgtaaattcacctcaaaattctacaaatgcggaaaatgtttcaacaacgcaagatacttcaactgaagcaacaccttcaaacaatgaatcagctccacagagtacagatgcaagtaataaagatgtagttaatcaagcggttaatacaagtgcgcctagaatgagagcatttagtttagcggcagtagctgcagatgcaccggtagctggcacagatattacgaatcagttgacgaatgtgacagttggtattgactctggtacgactgtgtatccgcaccaagcaggttatgtcaaactgaattatggtttttcagtgcctaattctgctgttaaaggtgacacattcaaaataactgtacctaaagaattaaacttaaatggtgtaacttcaactgctaaagtgccaccaattatggctggagatcaagtattggcaaatggtgtaatcgatagtgatggtaatgttatttatacatttacagactatgtaaatactaaagatgatgtaaaagcaactttgaccatgcccgcttatattgaccctgaaaatgttaaaaagacaggtaatgtgacattggctactggcataggtagtacaacagcaaacaaaacagtattagtagattatgaaaaatatggtaagttttataacttatctattaaaggtacaattgaccaaatcgataaaacaaataatacgtatcgtcagacaatttatgtcaatccaagtggagataacgttattgcgccggttttaacaggtaatttaaaaccaaatacggatagtaatgcattaatagatcagcaaaatacaagtattaaagtatataaagtagataatgcagctgatttatctgaaagttactttgtgaatccagaaaactttgaggatgtcactaatagtgtgaatattacattcccaaatccaaatcaatataaagtagagtttaatacgcctgatgatcaaattacaacaccgtatatagtagttgttaatggtcatattgatccgaatagcaaaggtgatttagctttacgttcaactttatatgggtataactcgaatataatttggcgctctatgtcatgggacaacgaagtagcatttaataacggatcaggttctggtgacggtatcgataaaccagttgttcctgaacaacctgatgagcctggtgaaattgaaccaattccagaggattcagattctgacccaggttcagattctggcagcgattctaattcagatagcggttcagattcgggtagtgattctacatcagatagtggttcagattcagcgagtgattcagattcagcaagtgattcagactcagcgagtgattcagattcagcaagcgattccgactcagcgagcgattccgactcagacaatgactcggattcagatagcgattctgactcagacagtgactcagattccgacagtgactcagattcagatagcgattctgactcagacagtgactcggattcagatagcgattcagattcagatagcgattcagattccgacagtgattccgactcagacagcgattctgactccgacagtgattccgactcagacagcgattcagattccgacagtgattccgactcagatagcgattccgactcagatagcgactcagattcagacagcgattcagattcagacagcgattcagattcagatagcgattcagattccgacagtgactcagattccgacagtgactcggattcagatagcgattcagattccgacagtgactcagattccgacagtgactcagactcagacagtgattcggattcagcgagtgattcggattcagatagtgattccgactccgacagtgactcggattcagatagcgactcagactcggatagcgactcggattcagatagcgattcggactcagatagcgattcagaatcagacagcgattcagattcagacagcgactcagacagtgactcagattcagatagtgactcggattcagcgagtgattcagactcaggtagtgactccgattcatcaagtgattccgactcagaaagtgattcaaatagcgattccgagtcagtttctaacaataatgtagttccgcctaattcacctaaaaatggtactaatgcttctaataaaaatgaggctaaagatagtaaagaaccattaccagatacaggttctgaagatgaagcaaatacgtcactaatttggggattattagcatcaataggttcattactacttttcagaagaaaaaaagaaaataaagataagaaa

SEQ ID NO: 2922 - protein, 927 aa, Staphylococcus aureus
  MISC_FEATURE (1)..(927): fibrinogen-binding protein
MNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPVAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSDSDSDSDSDSDSDSDSDSASDSDSGSDSDSSSDSDSESDSNSDSESVSNNNVVPPNSPKNGTNASNKNEAKDSKEPLPDTGSEDEANTSLIWGLLASIGSLLLFRRKKENKDKK

SEQ ID NO: 2923 - DNA, 528 bp, Staphylococcus aureus
atgcaaattagacaaatacatcaacatgactttgctcaagtggaccagttaattagaacggcatttgaaaatagtgaacatggttatggtaatgaatcagagctagtagaccaaattcgtctaagtgatacgtatgacaataccttagaattagtagctgttcttcaaaatgaagttgtagggcacggtttactaagtgaagtttatcttgataacgaggcacaacgggaaattggattagtgttagcacctgtatctgttgatattcatcatcaaaataaaggtattgggaagcgattgattcaagcattagaacgagaagcaatattaaaaggatataattttatcagtgtattaggatggccgacgtattatgccaatctaggatatcaacgcgcaagtatgtacgacatttatccaccatatgatggtataccagacgaagcgtttttaattaaagaattaaaagtgaacagtttagcgggaaaaacaggtaccataaattacacatctgcttttgaaaaaata

SEQ ID NO: 2924 - protein, 176 aa, Staphylococcus aureus
  MISC_FEATURE (1)..(176): conserved hypothetical
MQIRQIHQHDFAQVDQLIRTAFENSEHGYGNESELVDQIRLSDTYDNTLELVAVLQNEVVGHGLLSEVYLDNEAQREIGLVLAPVSVDIHHQNKGIGKRLIQALEREAILKGYNFISVLGWPTYYANLGYQRASMYDIYPPYDGIPDEAFLIKELKVNSLAGKTGTINYTSAFEKI

SEQ ID NO: 2925 - DNA, 519 bp, Staphylococcus aureus
atgattaacattatttcagctataggatctattggaacatttattatggctttattttattttgtatcagtttcagttcaactttatcaaatgaaaattagctttctgccagctttaggttttaaccaaattttattagaaagggaggaggatcaacttaatataatgaattcggcaacagaagagcatcatcataaagattatattaaactatataatttaggtggcggtgctgctaaaaaaattgcaatagaggttttattggggaaggataaagtcattcagaaaaaatacgtgcatattttacctagtaaagaagggtacatgttaccaattaataaaaatgtgtacgaagaattagaaagaacgattgagaacaatggtcatgaagctgatttgaatgtacgtatgacttattatcataatgtaagtcgcaaacaacaggaagttatattaaaaggtcaaatcgaccgttttaatacttataataataaagaaatttatgatttgcagtttatc

SEQ ID NO: 2926 - protein, 173 aa, Staphylococcus aureus
  MISC_FEATURE (1)..(173): hypothetical protein
MINIISAIGSIGTFIMALFYFVSVSVQLYQMKISFLPALGFNQILLEREEDQLNIMNSATEEHHHKDYIKLYNLGGGAAKKIAIEVLLGKDKVIQKKYVHILPSKEGYMLPINKNVYEELERTIENNGHEADLNVRMTYYHNVSRKQQEVILKGQIDRFNTYNNKEIYDLQFI

SEQ ID NO: 2927 - DNA, 726 bp, Staphylococcus aureus
atgaaaaaagtaatggggatattattagcaagtacacttatcttaggtgcttgtggacatcatcaagatagtgcaaaaaaagagagcactagtcacaaaaagaaagaaaatgacaatgaagaattaaatgaagaacttaaagaatttaaaagcaaaaaaaatatggatataaaaattaaaggcgatactattgttagtgacaaatttgaagctaaaataaaagaaccgtttatcatcaatgaaaaagatgagaaaaagaaatatatcgcttttaaaatggaaattactgctaaaaaagacgataaagatttaaatccatcttctatttctcatgactatattaatatcactcaagatgataaaaatacagtaaataaattaagagatggttatcttttaagtgataaaaaatataaagattggacagaacataaccaagatcaaattaaaaaaggcaaaactgcacaagccatgtttatctatgagttaagaggtgatggaaatattaatttaaatgtccataaatactcagaagataaaacagttgattctaaatcattcaaatttagtaaacttaaaaccgaagatttttctcatagagcggaaacaagagaagaagtagaaaagaaagaaaaagaatttgaagaagagtacaaaaaagaacaagaacgagagaaagaaaaagaaaagcaaaaagatgacgaccacagtggtttagatgaagta

SEQ ID NO: 2928 - protein, 242 aa, Staphylococcus aureus
  MISC_FEATURE (1)..(242): conserved hypothetical
MKKVMGILLASTLILGACGHHQDSAKKESTSHKKKENDNEELNEELKEFKSKKNMDIKIKGDTIVSDKFEAKIKEPFIINEKDEKKKYIAFKMEITAKKDDKDLNPSSISHDYINITQDDKNTVNKLRDGYLLSDKKYKDWTEHNQDQIKKGKTAQAMFIYELRGDGNINLNVHKYSEDKTVDSKSFKFSKLKTEDFSHRAETREEVEKKEKEFEEEYKKEQEREKEKEKQKDDDHSGLDEV

SEQ ID NO: 2929 - DNA, 483 bp, Staphylococcus aureus
atgattttacaaattgtaggttacaaaaagtctggtaagacaacattgatgaggcatattgtctctttcttaaagtcacatggttatacagttgctactattaaacatcatgggcatggtaaggaagatattcaattacaggattcagacgtcgatcacatgaagcattttgaagcgggggcagatcaaagtattgtacaaggttttcaatatcagcaaactgtaacacgtgtagataatcaaaatcttactcaaattattgaaaaatctgttacaattgacaccaatatcgtattagttgaaggctttaaaaatgctgattttgaaaaagtcgtagtctatcgaaatgaagaagagttgcaagtattacaacaattgtcgaatgtttgttatagcattaatgtaagggagcatgaagattttacagcatttgagcaatggttattaaataaaattaaaaatgattgtgatacacaattaaca

SEQ ID NO: 2930 - protein, 161 aa, Staphylococcus aureus
  MISC_FEATURE (1)..(161): probable
MILQIVGYKKSGKTTLMRHIVSFLKSHGYTVATIKHHGHGKEDIQLQDSDVDHMKHFEAGADQSIVQGFQYQQTVTRVDNQNLTQIIEKSVTIDTNIVLVEGFKNADFEKVVVYRNEEELQVLQQLSNVCYSINVREHEDFTAFEQWLLNKIKNDCDTQLT

SEQ ID NO: 2931 - DNA, 144 bp, Staphylococcus aureus
ttgaataatgcattaaaacaagaagaggctacatggggaaatgtacaaggtcaagtttcacaagcattgatgggaactggtattaaagattctactgcaagaagcatagggttttgggtttcccaagttggtcaagcattaata

SEQ ID NO: 2932 - protein, 48 aa, Staphylococcus aureus
LNNALKQEEATWGNVQGQVSQALMGTGIKDSTARSIGFWVSQVGQALI

SEQ ID NO: 2933 - DNA, 321 bp, Staphylococcus aureus
atgaataatgaagaattagaaatgagattgttattaatgaaacaatcaatagaacaattacaagaagaactagcgcctaacttaaaaactagagatttagtgttattaagatatatgtattcatataaagaaattaatatgctagattcttacttgttccaattggctacaaataaagagcaaataacaaaaaaacaatttaaaacaaaattggaaaacattagagaagtaccagaaatacctattagacaagttaatgatatattagaaggttataaaaatagtgagttatatgttgagttgataaatagcatcctaaaa

SEQ ID NO: 2934 - protein, 107 aa, Staphylococcus aureus
  MISC_FEATURE (1)..(107): hypothetical protein
MNNEELEMRLLLMKQSIEQLQEELAPNLKTRDLVLLRYMYSYKEINMLDSYLFQLATNKEQITKKQFKTKLENIREVPEIPIRQVNDILEGYKNSELYVELINSILK

SEQ ID NO: 2935 - DNA, 462 bp, Staphylococcus aureus
atggctaagaagaaatcaccaggtacattagcggaaaatcgtaaggcaagacatgattataatattgaagatacgattgaagcgggaattgtattgcaaggcacagaaataaaatcaattcgccgaggtagtgctaaccttaaagatagttatgcgcaagttaaaaacggtgaaatgtatttgaataatatgcatatagcaccatacgaagaagggaatcgttttaatcacgatcctcttcgttctcgaaaattattattgcacaagcgtgaaatcattaaattgggtgatcaaacacgtgagattggttattcgattgtgccgttaaagctttatttgaagcatggacattgtaaagtattacttggtgttgcacgaggtaagaaaaaatatgataaacgtcaagctttgaaagaaaaagcagtcaaacgagatgttgcgcgcgatatgaaagcccgttat

SEQ ID NO: 2936 - protein, 154 aa, Staphylococcus aureus
  MISC_FEATURE (1)..(154): ssrA-binding protein
MAKKKSPGTLAENRKARHDYNIEDTIEAGIVLQGTEIKSIRRGSANLKDSYAQVKNGEMYLNNMHIAPYEEGNRFNHDPLRSRKLLLHKREIIKLGDQTREIGYSIVPLKLYLKHGHCKVLLGVARGKKKYDKRQALKEKAVKRDVARDMKARY

SEQ ID NO: 2937 - DNA, 2370 bp, Staphylococcus aureus
atgaatttaaagcaatctatagaagagattattaatcaacctgaatatgaacctatgtcagtgtcagattttcaagatgcattaggtttaagcagtgccgactcgtttagagatttaattaaggtgcttgtggagttagaacaatcaggattaatcgaacgtacaaaaacagacagataccaaaaaaagcatagttatagaggtcaatcaaaattgataaaaggaacgttaagtcaaaataaaaaaggctttgcattcttaagacctgaagatgaggatatggaagatatatttattcccccgacgaaaattaatcgtgccttggatggagatactgttattgtagaaatccatcaatcaaaaggtgaacataaaggtaaaatcgaaggggaagttaagtcgattgagaagcattctgtaactcaagttgttggtacgtatagtgaagctagacattttggctttgttattccggatgataaacgtattatgcaagatattttcattcctaaaggtcaaagtttaggcgcagtcgatggtcataaggtacttgtacaaattactaagtatgctgatggttcagataatccagaaggacatatttctgctattttaggacataaaaatgatcctggcgtagatattttatctattatctatcaacatggcatagaaattgaatttcctgatgaagtgttacaagaagctgaagcagtacctgatcatattgaaaatactgaaattaaaggccgtcatgatttacgtgatgaattgacaatcacaattgatggtgctgatgctaaagacttagatgacgcaattagtgttaaaaagttagcgaacggtaatacgcaattaactgtaagtattgctgatgtcagctattatgtaacagaaggttctgcattggataaagaggcatatgatagagcgacaagtgtatatcttgttgaccgtgtaattccaatgattccacatcgattaagtaatggtatttgttcattgaatcctaatgttgatcgtttaactctaagctgtcgcatggaaatcgatgctagtggtcgcgttgttaaacatgaaatttttgatagtgttatacattctgattatcgaatgacgtatgatgcggtaaatcagattattactgaaaaggatcctaacattcgcgaacaatataatgaaattacgcctatgctagatttagcacaagatttatctaatcgtttgattcaaatgagaaaacgacgtggtgaaatcgattttgatattagtgaagcaaaagtattagttaacgaagacggtataccaacagatgttcaattaagacaacgtggcgagggtgaacgtctaattgaatcatttatgttaattgcaaatgaaacagttgctgaacattttagtaagttagatgtaccttttatttaccgagtgcatgagcaacctaaatcagatcgcttaagacaattctttgattttattacaaactttggcatcatgattaagggtactggcgaagatattcatccaacaacacttcaaaaggttcaagaagaagtagaaggtcgacctgaacaaatggtcatttcaacaatgatgttgcgttcaatgcaacaagcgcattatgatgatgtgaacttgggacattttggcttatcagctgaatattatacgcattttacatcaccaattagacgttatcctgatttaacagttcatcgtttaatccgtaagtatttaattgagaaatcaatggataacaaagaagtgaagcgttgggaagacaaattgcctgagttagctgaacatacttctaaacgtgaacgtcgtgctattgaggcagaacgtgatactgatgaattgaaaaaagcagaatatatgattcaacatattggtgatgaatttgaaggtattgtcagctcagtagctaacttcggtatgttcattgaattgccaaatacgatagaaggtatggttcatattgcgaatatgactgatgattattaccgttttgaagagcgtcaaatggcattaattggtgagcgtcaagctaaagtatttagaattggtgacacagttaaggttaaagtgacgcatgttgatgtagatgaacgattaattgattttcaaattgtaggtatgcctttaccgaaaaatgatcgatcacagcgcccagcgcgaggtaagacaattcaagccaaaacgcgtggtaaatcattagataaatcaaaatctgatgataagggtcgtaagaaaaaaggtaagcaacgtaaaggtaaaaaccaacgtaataatgataaatcaggtaatagtaagcataagccattttataaagataaaagtgtgaaaaagaaagcacgtcgtaagaaaaaa

SEQ ID NO: 2938 - protein, 790 aa, Staphylococcus aureus
  MISC_FEATURE (1)..(790): conserved hypothetical
MNLKQSIEEIINQPEYEPMSVSDFQDALGLSSADSFRDLIKVLVELEQSGLIERTKTDRYQKKHSYRGQSKLIKGTLSQNKKGFAFLRPEDEDMEDIFIPPTKINRALDGDTVIVEIHQSKGEHKGKIEGEVKSIEKHSVTQVVGTYSEARHFGFVIPDDKRIMQDIFIPKGQSLGAVDGHKVLVQITKYADGSDNPEGHISAILGHKNDPGVDILSIIYQHGIEIEFPDEVLQEAEAVPDHIENTEIKGRHDLRDELTITIDGADAKDLDDAISVKKLANGNTQLTVSIADVSYYVTEGSALDKEAYDRATSVYLVDRVIPMIPHRLSNGICSLNPNVDRLTLSCRMEIDASGRVVKHEIFDSVIHSDYRMTYDAVNQIITEKDPNIREQYNEITPMLDLAQDLSNRLIQMRKRRGEIDFDISEAKVLVNEDGIPTDVQLRQRGEGERLIESFMLIANETVAEHFSKLDVPFIYRVHEQPKSDRLRQFFDFITNFGIMIKGTGEDIHPTTLQKVQEEVEGRPEQMVISTMMLRSMQQAHYDDVNLGHFGLSAEYYTHFTSPIRRYPDLTVHRLIRKYLIEKSMDNKEVKRWEDKLPELAEHTSKRERRAIEAERDTDELKKAEYMIQHIGDEFEGIVSSVANFGMFIELPNTIEGMVHIANMTDDYYRFEERQMALIGERQAKVFRIGDTVKVKVTHVDVDERLIDFQIVGMPLPKNDRSQRPARGKTIQAKTRGKSLDKSKSDDKGRKKKGKQRKGKNQRNNDKSGNSKHKPFYKDKSVKKKARRKKK

SEQ ID NO: 2939 - DNA, 738 bp, Staphylococcus aureus
atgcagataaaattaccaaaacctttcttttttgaggaaggtaaacgtgccgtgttattactacatggttttacaggcaattcgtctgatgttcgtcaattaggtcgatttttacaaaagaaaggttatacatcatatgcaccgcaatatgaaggccacgcggcaccaccagatgaaatactgaaatctagtcctttcgtttggtttaaagatgcgttagatggttatgattatcttgttgaacaaggttatgatgaaattgttgttgctggtctatcattaggtggggattttgctttaaaattaagcttaaatagagatgtaaagggtattgtaacgatgtgtgctcctatgggtggcaaaactgaaggtgccatttatgaaggctttttagaatatgcacgcaattttaaaaagtatgaaggtaaagatcaagagactattgataatgaaatggatcattttaaaccaactgaaactttaaaagaactaagtgaagcattagatacgattaaagagcaagttgatgaagtgttggatcctattttagtgattcaagcagaaaacgacaatatgattgatccacaatccgcaaattatatatatgaccatgtagattctgatgacaaaaatatcaagtggtacagtgaatctggacatgttattacgattgataaagagaaagaacaagtatttgaagatatttatcaatttttagagtcattagactggtcagaa

SEQ ID NO: 2940 - protein, 246 aa, Staphylococcus aureus
  MISC_FEATURE (1)..(246): carboxyesterase precursor
MQIKLPKPFFFEEGKRAVLLLHGFTGNSSDVRQLGRFLQKKGYTSYAPQYEGHAAPPDEILKSSPFVWFKDALDGYDYLVEQGYDEIVVAGLSLGGDFALKLSLNRDVKGIVTMCAPMGGKTEGAIYEGFLEYARNFKKYEGKDQETIDNEMDHFKPTETLKELSEALDTIKEQVDEVLDPILVIQAENDNMIDPQSANYIYDHVDSDDKNIKWYSESGHVITIDKEKEQVFEDIYQFLESLDWSE

SEQ ID NO: 2941 - DNA, 273 bp, Staphylococcus aureus
atgatatactacttgtcgtatataaggaacggaggacaatttatgcatacatttttaatcgtattattaatcattgattgtattgcattaataactgttgtactactccaagaaggtaaaagcagtggactttcaggtgccatcagtggtggtgctgagcagttattcggtaaacaaaaacaacgtggcgtcgatttattcttaaatagattaacaattattttatcaatattattttttgtacttatgatttgcataagttatcttggtatg

SEQ ID NO: 2942 - protein, 91 aa, Staphylococcus aureus
  MISC_FEATURE (1)..(91): probable protein-export
MIYYLSYIRNGGQFMHTFLIVLLIIDCIALITVVLLQEGKSSGLSGAISGGAEQLFGKQKQRGVDLFLNRLTIILSILFFVLMICISYLGM

SEQ ID NO: 2943 - DNA, 471 bp, Staphylococcus aureus
atgaggagtaaacaaatggctgatagaacgaataaagaaattaaaacaggacgctttattgcaactgcatcaatcgtattctcaatattattgattattcattactttgtttcgttggataatgcgactgccaaagcattacttaatttaacgaatcaaaacacttcagataaagcgattgattacattttaaacagctttagattcactggtattatgtatattttggcttatctagcaggcttcatcactttttggaatcgacatacttatgtgtggtggtttatgtttgcagtttatgtatcaaatagtttgtttacgttgattaatttatcaatcacaattcaagcaataaaagctgcacacggtgcgtacttaacattgccaattttaattgttattataggttcggttgcattagcgatttatatgcttgttgtttctatcaaacgtaaaagtacatttaatcgc

SEQ ID NO: 2944 - protein, 157 aa, Staphylococcus aureus
  MISC_FEATURE (1)..(157): hypothetical protein
MRSKQMADRTNKEIKTGRFIATASIVFSILLIIHYFVSLDNATAKALLNLTNQNTSDKAIDYILNSFRFTGIMYILAYLAGFITFWNRHTYVWWFMFAVYVSNSLFTLINLSITIQAIKAAHGAYLTLPILIVIIGSVALAIYMLVVSIKRKSTFNR

SEQ ID NO: 2945 - DNA, 1302 bp, Staphylococcus aureus
atgccaattattacagatgtttacgctcgcgaagtcttagactctcgtggtaacccaactgttgaagtagaagtattaactgaaagtggcgcatttggtcgtgcattagtaccatcaggtgcttcaactggtgaacacgaagctgttgaattacgtgatggagacaaatcacgttatttaggtaaaggtgttactaaagcagttgaaaacgttaatgaaatcatcgcaccagaaattattgaaggtgaattttcagtattagatcaagtatctattgataaaatgatgatcgcattagacggtactccaaacaaaggtaaattaggtgcaaatgctattttaggtgtatctatcgcagtagcacgtgcagcagctgacttattaggtcaaccactttacaaatatttaggtggatttaatggtaagcagttaccagtaccaatgatgaacatcgttaatggtggttctcactcagatgctccaattgcattccaagaattcatgattttacctgtaggtgctacaacgttcaaagaatcattacgttggggtactgaaattttccacaacttaaaatcaattttaagcaaacgtggtttagaaactgcagtaggtgacgaaggtggtttcgctcctaaatttgaaggtactgaagatgctgttgaaacaattatccaagcaatcgaagcagctggttacaaaccaggtgaagaagtattcttaggatttgactgtgcatcatcagaattctatgaaaatggtgtatatgactacagtaagttcgaaggcgaacacggtgcaaaacgtacagctgcagaacaagttgactacttagaacaattagtagacaaatatcctatcattacaattgaagacggtatggacgaaaacgactgggatggttggaaacaacttacagaacgtatcggtgaccgtgtacaattagtaggtgacgatttattcgtaacaaacactgaaattttagcaaaaggtattgaaaacggaattggtaactcaatcttaattaaagttaaccaaatcggtacattaactgaaacatttgatgcaatcgaaatggctcaaaaagctggttacacagcagtagtttctcaccgttcaggtgaaacagaagatacaacaattgctgatattgctgttgctacaaacgctggtcaaattaaaactggttcattatcacgtactgaccgtattgctaaatacaatcaattattacgtatcgaagatgaattatttgaaactgctaaatatgacggtatcaaatcattctataacttagataaa

SEQ ID NO: 2946 - protein, 434 aa, Staphylococcus aureus [sequence omitted]

SEQ ID NO: 2947 - DNA, 1515 bp, Staphylococcus aureus
atggctaagaaaccaactgcgttaattattttagatggttttgcgaaccgcgaaagcgaacatggtaatgcggtaaaattagcaaacaagcctaattttgatcgttattacaacaaatatccaacgactcaaatcgaagcgagtggcttagatgttggactacctgaaggacaaatgggtaactcagaagttggtcatatgaatatcggtgcaggacgtatcgtttatcaaagtttaactcgaatcaataaatcaattgaagacggtgatttctttgaaaatgatgttttaaataatgcaattgcacacgtgaattcacatgattcagcgttacacatctttggtttattgtctgacggtggtgtacacagtcattacaaacatttatttgctttgttagaacttgctaaaaaacaaggtgttgaaaaagtttacgtacacgcatttttagatggccgtgacgtagatcaaaaatccgctttgaaatacatcgaagagactgaagctaaattcaatgaattaggcattggtcaatttgcatctgtgtctggtcgttattatgcaatggatcgtgacaaacgttgggaacgtgaagaaaaagcttacaatgctattcgtaattttgatgccccaacttatgcaactgccaaagaaggtgtagaagcaagctataatgagggcttaactgacgaattcgtagtaccattcatcgttgagaatcaaaatgacggtgttaatgatggagatgcagtgatcttctataatttccgacctgatagagcagcgcaattatcggaaatttttgcgaacagagcattcgaaggctttaaagttgaacaagttaaagacttattctatgcaacattcactaagtataatgacaatatcgatgcggctatcgtcttcgaaaaagttgatttaaataatacaattggtgaaattgcacaaaataacaatttaactcaattacgtattgcagaaactgaaaaataccctcacgttacttactttatgagtggtggacgtaacgaggaatttaaaggtgaacgccgtcgtttaattgattcacctaaagttgcaacgtatgacttgaaaccagaaatgagtgcttatgaagttaaagatgcattattagaagagttaaataaaggtgacttggacttaattattttaaactttgctaaccctgatatggttggacatagtggtatgcttgagccgacaatcaaagcaatcgaagcggttgatgaatgtttaggagaagtggttgataagattttagacatggacggttatgcaattattactgctgaccatggtaactctgatcaagtattgacggatgatgatcaaccaatgactacgcatacaacgaacccagtaccagtgattgtaacaaaagaaggcgttacacttagagaaactggtcgcttaggtgacttagcacctacattattagatttattaaatgtagaacaacctgaagatatgacaggtgaatctttaattaaacac

SEQ ID NO: 2948 - protein, 505 aa, Staphylococcus aureus
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVENQNDGVNDGDAVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 2949 - DNA, 858 bp, Staphylococcus aureus
gtggcatgtttgtttaacattgttacgggaaaacagtcacaagatgacatcgtgtttcatcacttttcaaaaatatttacaaaacaaggagtgtctttaatgagaacaccaattatagctggtaactggaaaatgaacaaaacagtacaagaagcaaaagacttcgtcaatacattaccaacactaccagattcaaaagaagtagaatcagtaatttgtgcaccagcaattcaattagatgcattaactactgcagttaaagaaggaaaagcacaaggtttagaaatcggtgctcaaaatacgtatttcgaagataatggtgcgttcacaggtgaaacgtctccagttgcattagcagatttaggcgttaaatacgttgttatcggtcattctgaacgtcgtgaattattccacgaaacagatgaagaaattaacaaaaaagcgcacgctattttcaaacatggaatgactccaattatatgtgttggtgaaacagacgaagagcgtgaaagtggtaaagctaacgatgttgtaggtgagcaagttaagaaagctgttgcaggtttatctgaagatcaacttaaatcagttgtaattgcttatgaaccaatctgggcaatcggaactggtaaatcatcaacatctgaagatgcaaatgaaatgtgtgcatttgtacgtcaaactattgctgacttatcaagcaaagaagtatcagaagcaactcgtattcaatatggtggtagtgttaaacctaacaacattaaagaatacatggcacaaactgatattgatggggcattagtaggtggcgcatcacttaaagttgaagatttcgtacaattgttagaaggtgcaaaa

SEQ ID NO: 2950 - protein, 286 aa, Staphylococcus aureus
  MISC_FEATURE (1)..(286): triosephosphate isomerase
VACLFNIVTGKQSQDDIVFHHFSKIFTKQGVSLMRTPIIAGNWKMNKTVQEAKDFVNTLPTLPDSKEVESVICAPAIQLDALTTAVKEGKAQGLEIGAQNTYFEDNGAFTGETSPVALADLGVKYVVIGHSERRELFHETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 2951 - DNA, 1257 bp, Staphylococcus aureus
atggtagtagaaaaaagaaacccaatcccagttaaagaagcaattcaacgtatcgttaatcagcagagttcaatgccggcaattacggtagcacttgaaaaaagtctaaatcatatcttagcagaagatattgtagctacttatgatataccaaggtttgataaatcaccttatgatggttttgcaattcgcagtgttgattcacaaggggcaagtggtcagaatcgcattgagtttaaagtgattgatcatattggtgcaggttcagtttctgataaattagttggggatcacgaagcggtgcgtattatgactggagcacaaatacctaatggcgcagatgctgttgttatgtttgaacaaacgattgaactagaagatacatttacaattcgtaaaccattttcaaaaaatgaaaatatatctttaaaaggtgaagaaacaaagacaggcgatgttgttctaaaaaaaggacaagtaattaatccaggggctatcgcggtccttgcaacatatggctatgcagaggttaaagttattaagcaaccgagtgtcgctgttattgcaacaggaagcgaattattagatgttaatgatgtattagaagatgggaaaattcgtaactctaatggcccaatgattcgtgccttagcagaaaaattaggtcttgaagttggtatttacaaaacacaaaaagatgatttagatagtggcatccaagtcgttaaagaagctatggaaaaacatgatatcgttattacaacgggcggagtttctgttggagattttgactatttacctgagatttataaggctgtaaaggcggaagtgttatttaataaagtagcaatgcgtcctggtagcgtaacaacggttgcatttgtagatggaaagtatttgtttggattatctggaaatccatcagcttgttttacaggatttgaactatttgtgaaaccagctgttaaacatatgtgtggcgcactagaagtcttcccgcaaataattaaagcaacattaatggaagattttaccaaggcaaacccattcacacgatttatacgtgctaaagcaacgttaacaagtgctggagctactgtagtaccttcaggattcaataaatcaggtgcggttgtagcgattgcacatgctaactgtatggtcatgttaccaggagggtcacgtggttttaaagcggggcatacagtagatattatattgactgaatctgacgctgctgaagaggaacttctttta

SEQ ID NO: 2952 - protein, 419 aa, Staphylococcus aureus
  MISC_FEATURE (1)..(419): molybdopterin biosynthesis
MVVEKRNPIPVKEAIQRIVNQQSSMPAITVALEKSLNHILAEDIVATYDIPRFDKSPYDGFAIRSVDSQGASGQNRIEFKVIDHIGAGSVSDKLVGDHEAVRIMTGAQIPNGADAVVMFEQTIELEDTFTIRKPFSKNENISLKGEETKTGDVVLKKGQVINPGAIAVLATYGYAEVKVIKQPSVAVIATGSELLDVNDVLEDGKIRNSNGPMIRALAEKLGLEVGIYKTQKDDLDSGIQVVKEAMEKHDIVITTGGVSVGDFDYLPEIYKAVKAEVLFNKVAMRPGSVTTVAFVDGKYLFGLSGNPSACFTGFELFVKPAVKHMCGALEVFPQIIKATLMEDFTKANPFTRFIRAKATLTSAGATVVPSGFNKSGAVVAIAHANCMVMLPGGSRGFKAGHTVDIILTESDAAEEELLL

SEQ ID NO: 2953 - DNA, 492 bp, Staphylococcus aureus
atgactgagtttactcatattaatcaacaaggccacgccaaaatggtcgatgtatcagacaaacaaattacaaaaagaactgctgtcgctcattcaagcattactgtaaatgaaactatttttaagcagatttctaataacaccaataccaaaggcaatgtattgaacactgctcaaatcgctggtattatggctgccaaaaatacatcaacacttattccgatgtgccatccattaccattgactggcatagatgttcacttcagctgggatgaaacaaatgcacccctttatactttaaacattcaaacaactgtctctacaactggcaaaaccggtgttgaaatggaagctttaaccgctgcatcagcaacggctttaaccatttacgacatgacgaaagcagttgataaaggtatgattattggcgaaacctaccttgaaagcaagtctggcggtaaatctggagattttcaacgccaatcaaatcaa

SEQ ID NO: 2954 - protein, 164 aa, Staphylococcus aureus
  MISC_FEATURE (1)..(164): molybdenum cofactor
MTEFTHINQQGHAKMVDVSDKQITKRTAVAHSSITVNETIFKQISNNTNTKGNVLNTAQIAGIMAAKNTSTLIPMCHPLPLTGIDVHFSWDETNAPLYTLNIQTTVSTTGKTGVEMEALTAASATALTIYDMTKAVDKGMIIGETYLESKSGGKSGDFQRQSNQ

SEQ ID NO: 2955 - DNA, 1188 bp, Staphylococcus aureus
atggctaaaaaaattgtttctgatttagatcttaaaggtaaaacagtcctagtacgtgctgattttaacgtacctttaaaagacggtgaaattactaatgacaaccgtatcgttcaagctttacctacaattcaatacatcatcgaacaaggtggtaaaatcgtactattttcacatttaggtaaagtgaaagaagaaagtgataaagcaaaattaactttacgtccagttgctgaagacttatctaagaaattagataaagaagttgttttcgtaccagaaacacgcggcgaaaaacttgaagctgctattaaagaccttaaagaaggcgacgtattattagttgaaaatacacgttatgaagatttagacggtaaaaaagaatctaaaaatgatccagaattaggtaaatactgggcatctttaggtgatgtgtttgtaaatgatgcttttggtactgcgcatcgtgagcatgcatctaatgttggtatttctacacatttagaaactgcagctggattcttaatggataaagaaattaagtttattggcggcgtagttaacgatccacataaaccagttgttgctattttaggtggagcaaaagtatctgacaaaattaatgtcatcaaaaacttagttaacatagctgataaaattatcatcggcggaggtatggcttatactttcttaaaagcgcaaggtaaagaaattggtatttcattattagaagaagataaaatcgacttcgcaaaagatttattagaaaaacatggtgataaaattgtattaccagtagacactaaagttgctaaagaattttctaatgatgccaaaatcactgtagtaccatctgattcaattccagcagaccaagaaggtatggatattggaccaaacactgtaaaattatttgcagatgaattagaaggtgcgcacactgttgtatggaatggacctatgggtgtattcgagttcagtaactttgcacaaggtacaattggtgtatgtaaagcaattgcaaaccttaaagatgcaattacgattatcggtggcggtgattcagctgcagcagcaatctctttaggttttgaaaatgacttcactcatatttcaactggtggcggcgcgtcattagagtacctagaaggtaaagaattgcctggtatcaaagcaatcaataataaa

SEQ ID NO: 2956 - protein, 396 aa, Staphylococcus aureus
  MISC_FEATURE (1)..(396): phosphoglycerate kinase
MAKKIVSDLDLKGKTVLVRADFNVPLKDGEITNDNRIVQALPTIQYIIEQGGKIVLFSHLGKVKEESDKAKLTLRPVAEDLSKKLDKEVVFVPETRGEKLEAAIKDLKEGDVLLVENTRYEDLDGKKESKNDPELGKYWASLGDVFVNDAFGTAHREHASNVGISTHLETAAGFLMDKEIKFIGGVVNDPHKPVVAILGGAKVSDKINVIKNLVNIADKIIIGGGMAYTFLKAQGKEIGISLLEEDKIDFAKDLLEKHGDKIVLPVDTKVAKEFSNDAKITVVPSDSIPADQEGMDIGPNTVKLFADELEGAHTVVWNGPMGVFEFSNFAQGTIGVCKAIANLKDAITIIGGGDSAAAAISLGFENDFTHISTGGGASLEYLEGKELPGIKAINNK

SEQ ID NO: 2957 - DNA, 1008 bp, Staphylococcus aureus
atggcagtaaaagtagcaattaatggttttggtagaattggtcgtttagcattcagaagaattcaagaagtagaaggtcttgaagttgtagcagtaaacgacttaacagatgacgacatgttagcgcatttattaaaatatgacactatgcaaggtcgtttcacaggtgaagtagaggtagttgatggtggtttccgcgtaaatggtaaagaagttaaatcattcagtgaaccagatgcaagcaaattaccttggaaagacttaaatatcgatgtagtattagaatgtactggtttctacactgataaagataaagcacaagctcatattgaagcaggcgctaaaaaagtattaatctcagcaccagctactggtgacttaaaaacaatcgtattcaacactaaccaccaagagttagacggttctgaaacagttgtttcaggtgcttcatgtactacaaactcattagcaccagttgctaaagttttaaacgatgactttggtttagttgaaggtttaatgactacaattcacgcttacacaggtgatcaaaatacacaagacgcacctcacagaaaaggtgacaaacgtcgtgctcgtgcagcggcagaaaacatcatccctaactcaacaggtgctgctaaagctatcggtaaagttattcctgaaatcgatggtaaattagatggtggtgcacaacgtgttcctgtagctacaggttcattaactgaattaacagtagtattagaaaaacaagacgtaacagttgaacaagttaacgaagctatgaaaaatgcttcaaacgaatcattcggttacactgaagacgaaatcgtttcttcagacgttgtaggtatgacttacggttcattattcgacgctacacaaactcgtgtaatgtcagttggcgaccgtcaattagttaaagttgcagcttggtatgataacgaaatgtcatatactgcacaattagttcgtacattagcatacttagctgaactttctaaa

SEQ ID NO: 2958 - protein, 336 aa, Staphylococcus aureus
  MISC_FEATURE (1)..(336): glyceraldehyde-3-phosphate
MAVKVAINGFGRIGRLAFRRIQEVEGLEVVAVNDLTDDDMLAHLLKYDTMQGRFTGEVEVVDGGFRVNGKEVKSFSEPDASKLPWKDLNIDVVLECTGFYTDKDKAQAHIEAGAKKVLISAPATGDLKTIVFNTNHQELDGSETVVSGASCTTNSLAPVAKVLNDDFGLVEGLMTTIHAYTGDQNTQDAPHRKGDKRRARAAAENIIPNSTGAAKAIGKVIPEIDGKLDGGAQRVPVATGSLTELTVVLEKQDVTVEQVNEAMKNASNESFGYTEDEIVSSDVVGMTYGSLFDATQTRVMSVGDRQLVKVAAWYDNEMSYTAQLVRTLAYLAELSK

SEQ ID NO: 2959 - DNA, 1011 bp, Staphylococcus aureus
gtgaaagacttattgcaagcacagcaaaagcttataccggatctcatagataaaatgtataaacgtttttctattcttactactatctcaaaaaatcagcctgtcggacgtcgaagtttaagcgaacatatggatatgactgaacgtgtactgcgttctgaaacagatatgcttaagaaacaagatttgataaaagttaagcctaccggaatggaaattacagctgaaggtgagcaactgatttcgcaattgaaaggttactttgatatctatgcagatgataatcgtctgtcagaaggtattaagaataaatttcaaattaaggaagttcatgttgttcctggtgatgctgataatagtcaatctgttaaaacagaattaggtagacaagcaggtcaattacttgaaggcatattacaagaagacgcgatagttgctgtaactggcggatccacgatggcatgtgttagtgaagcaattcatttattaccatataatgtattcttcgtaccagccagaggtggactaggcgaaaatgttgtctttcaggcaaacacaattgcagccagtatggcacaacaagctggcggttattatacgacgatgtatgtacctgataatgtcagtgaaacaacatataatacattgttgttagagccatcagtcataaacactttagacaaaattaaacaagcaaacgttatattacacggcattggtgatgcgctgaagatggcgcatcgacgtcaatcacctgaaaaggtcattgaacaacttcaacatcatcaagctgtcggagaggcatttggttattattttgatacacaaggtcaaattgtccataaggttaaaacaattggacttcaattagaagaccttgaatcaaaagactttatttttgcagttgcaggaggcaaatcgaaaggtgaagcaattaaagcatacttgacgattgcacccaagaatacagtgttaatcactgatgaagccgcagcaaagataatacttgaa

SEQ ID NO: 2960 - protein, 337 aa, Staphylococcus aureus
  MISC_FEATURE (1)..(337): glycolytic operon regulator
VKDLLQAQQKLIPDLIDKMYKRFSILTTISKNQPVGRRSLSEHMDMTERVLRSETDMLKKQDLIKVKPTGMEITAEGEQLISQLKGYFDIYADDNRLSEGIKNKFQIKEVHVVPGDADNSQSVKTELGRQAGQLLEGILQEDAIVAVTGGSTMACVSEAIHLLPYNVFFVPARGGLGENVVFQANTIAASMAQQAGGYYTTMYVPDNVSETTYNTLLLEPSVINTLDKIKQANVILHGIGDALKMAHRRQSPEKVIEQLQHHQAVGEAFGYYFDTQGQIVHKVKTIGLQLEDLESKDFIFAVAGGKSKGEAIKAYLTIAPKNTVLITDEAAAKIILE

SEQ ID NO: 2961 - DNA, 639 bp, Staphylococcus aureus
gtgagggagagtatgtcgaatcaaaattacgactacaataaaaatgaagatggaagtaagaagaaaatgagtacaacagcgaaagtagttagcattgcgacggtattgctattactcggaggattagtatttgcaatttttgcatatgtagatcattcgaataaagctaaagaacgtatgttgaacgaacaaaagcaggaacaaaaagaaaagcgtcaaaaagaaaatgcagaaaaagagagaaagaaaaagcaacaagaggaaaaagagcagaatgagctagattcacaagcaaaccaatatcagcaattgccacagcagaatcaatatcaatatgtgccacctcagcaacaagcacctacaaagcaacgtcctgctaaagaagagaatgatgataaagcatcaaaggatgagtcgaaagataaggatgacaaagcatctcaagataaatcagatgataatcagaagaaaactgatgataataaacaaccagctcagcctaaaccacagccgcaacaaccaacaccaaagccaaataataatcaacaaaacaatcaatcaaatcagcaagcaaaaccacaagcaccacaacaaaatagccaatcaacaacaaataaacaaaataatgctaatgataag

SEQ ID NO: 2962 - protein, 213 aa, Staphylococcus aureus
  MISC_FEATURE (1)..(213): conserved hypothetical
VRESMSNQNYDYNKNEDGSKKKMSTTAKVVSIATVLLLLGGLVFAIFAYVDHSNKAKERMLNEQKQEQKEKRQKENAEKERKKKQQEEKEQNELDSQANQYQQLPQQNQYQYVPPQQQAPTKQRPAKEENDDKASKDESKDKDDKASQDKSDDNQKKTDDNKQPAQPKPQPQQPTPKPNNNQQNNQSNQQAKPQAPQQNSQSTTNKQNNANDK

SEQ ID NO: 2963 - DNA, 906 bp, Staphylococcus aureus
atgataatgaaacaatacttaattactggtgggactggtatggttggatctcaattagttaatgaaattaaaaaatcagattcacatatcacgatattaacgcgacacgaccaaatttcaaatgataagaaaatttcatatgtcaactgggctaaatctgggtgggaacacaaagttcctcaaaatatcgatgtggtcatcaacttagcaggtgctacattgaataaacgatggacaccggaatataaacaaacgctaatgctaagtagaattcaatctacgcaagctttatatgaattgtttaaatcacgtaataaagcacctaaagctttatttaatgctagtgccactggttactatcctcctgatttatttatgagttacacagaagtttataaaactttaccttttgatttcttatcagatattgtgtatcaatgggaacgtttcgcacaacaatttgaacaattaggtacacgagttgtcatcggtcgtttcggtataattttatcgaatgaaggcggtgcgttacaaacaatgaaactaccatacgaatattacattggtggtaaattaggttctggtcaacaatggtattcatggattcatatcaatgatttaattcaagctattttatttttaataaataacgagtcagctagtggtccgtttaatttaactgcacctatacctgaacgtcaaaatttatttggctacactttagcaagagctatgcataagcctcatgaaacttgggcaccaagtcttgcaatgcgtctcatacttggtcaaatgtcaacagtagtattggatactcaaaaagtattacctaataaaattcaagcattgggattccaatttaaatatagtaatttaaaaatggcacttgaagatttaattaaagaa

SEQ ID NO: 2964 - protein, 302 aa, Staphylococcus aureus
  MISC_FEATURE (1)..(302): hypothetical protein
MIMKQYLITGGTGMVGSQLVNEIKKSDSHITILTRHDQISNDKKISYVNWAKSGWEHKVPQNIDVVINLAGATLNKRWTPEYKQTLMLSRIQSTQALYELFKSRNKAPKALFNASATGYYPPDLFMSYTEVYKTLPFDFLSDIVYQWERFAQQFEQLGTRVVIGRFGIILSNEGGALQTMKLPYEYYIGGKLGSGQQWYSWIHINDLIQAILFLINNESASGPFNLTAPIPERQNLFGYTLARAMHKPHETWAPSLAMRLILGQMSTVVLDTQKVLPNKIQALGFQFKYSNLKMALEDLIKE

SEQ ID NO: 2965 - DNA, 585 bp, Staphylococcus aureus
atgaatttaattcctacagttattgaaacaacaaaccgcggtgaacgtgcatatgatatatactcacgtttattaaaagaccgtattattatgttaggttcacaaattgatgacaacgtagcaaattcaatcgtatcacagttattattcttacaagcgcaagactcagagaaagatatttatttatacattaattcaccaggtggaagtgtaacagctggttttgcgatttatgatacaattcaacacattaaacctgatgttcaaacaatttgtatcggtatggctgcatcaatgggatcattcttattagcagctggtgcaaaaggtaaacgtttcgcgttaccaaatgcagaagtaatgattcaccaaccattaggtggtgctcaaggacaagcaactgaaatcgaaattgctgcaaatcacattttaaaaacacgtgaaaaattaaaccgcattttatcagagcgtactggtcaaagtattgaaaaaatacaaaaagacacagatcgtgataacttcttaactgcagaagaagctaaagaatatggcttaattgatgaagtgatggtacctgaaacaaaa

SEQ ID NO: 2966 - protein, 195 aa, Staphylococcus aureus
  MISC_FEATURE (1)..(195): ATP-dependent Clp protease
MNLIPTVIETTNRGERAYDIYSRLLKDRIIMLGSQIDDNVANSIVSQLLFLQAQDSEKDIYLYINSPGGSVTAGFAIYDTIQHIKPDVQTICIGMAASMGSFLLAAGAKGKRFALPNAEVMIHQPLGGAQGQATEIEIAANHILKTREKLNRILSERTGQSIEKIQKDTDRDNFLTAEEAKEYGLIDEVMVPETK

SEQ ID NO: 2967 - DNA, 942 bp, Staphylococcus aureus
atgagctttgcatcagaaatgaaaaatgaattaactagaatagacgtcgatgaaatgaatgcaaaagcagagctcagtgcactgattcgaatgaatggtgcacttagtctttcaaatcaacaatttgttataaatgttcaaacggaaaatgcaacaacggcaagacgtatttattcgttgattaaacgtgtctttaatgtggaagttgaaatattagtccgtaaaaaaatgaaacttaaaaaaaataatatttatatttgtcgtacaaagatgaaagcgaaagaaattcttgatgaattaggaattttaaaagacggcatttttacgcatgaaattgatcattcaatgattcaagatgacgaaatgagacgcagttacttgagaggagcttttctggcaggtggctcagtgaataaccctgaaacatcttcgtaccatttggaaattttttctcaaaatgagagtcatgcagaaggcttaacgaaactaatgaatagttatgagttgaatgccaaacatttagagcgaaaaaaaggaagtattacgtatttaaaagaagcggaaaagatttcggattttcttagtttgataggtggctatcaagcgttattaaaatttgaagacgtacgtattgtaagagatatgcgtaattctgttaaccgactcgttaattgtgaaacggccaatctaaataaaacagttagtgctgcgatgaaacaagttgagagcattaaattgattgataaagaaattggtattgaaaatttaccagacaggttgagagagattgctagaattcgagtagaacatcaagaaatttcgttgaaagagcttggagaaatggtatcaactggtccaatttcaaaatcaggtgtaaatcaccgattaagaaaactgaatgatttagccgataagattagaaatggtgaacaaatagaatta

SEQ ID NO: 2968 - protein, 314 aa, Staphylococcus aureus
  MISC_FEATURE (1)..(314): conserved hypothetical
MSFASEMKNELTRIDVDEMNAKAELSALIRMNGALSLSNQQFVINVQTENATTARRIYSLIKRVFNVEVEILVRKKMKLKKNNIYICRTKMKAKEILDELGILKDGIFTHEIDHSMIQDDEMRRSYLRGAFLAGGSVNNPETSSYHLEIFSQNESHAEGLTKLMNSYELNAKHLERKKGSITYLKEAEKISDFLSLIGGYQALLKFEDVRIVRDMRNSVNRLVNCETANLNKTVSAAMKQVESIKLIDKEIGIENLPDRLREIARIRVEHQEISLKELGEMVSTGPISKSGVNHRLRKLNDLADKIRNGEQIEL

SEQ ID NO: 2969 - DNA, 993 bp, Staphylococcus aureus
atgagacaaataaaagttgtacttatcggtggtggcactggcttatcagttatggctaggggattaagagaattcccaattgatattacggcgattgtaacagttgctgataatggtgggagtacagggaaaatcagagatgaaatggatataccagcaccaggagacatcagaaatgtgattgcagctttaagtgattctgagtcagttttaagccaactttttcagtatcgctttgaagaaaatcaaattagcggtcactcattaggtaatttattaatcgcaggtatgactaatattacgaatgatttcggacatgccattaaagcattaagtaaaattttaaatattaaaggtagagtcattccatctacaaatacaagtgtgcaattaaatgctgttatggaagatggagaaattgtttttggagaaacaaatattcctaaaaaacataaaaaaattgatcgtgtgtttttagaacctaacgatgtgcaaccaatggaagaagcaatcgatgctttaagggaagcagatttaatcgttcttggaccagggtcattatatacgagcgttatttctaacttatgtgtgaatggtatttcagatgcgttaattcattctgatgcgcctaagctatatgtttctaatgtgatgacgcaacctggggaaacagatggttatagcgtgaaagatcatatcgatgcgattcatagacaagctggacaaccgtttattgattatgtcatttgtagtacacaaactttcaatgctcaagttttgaaaaaatatgaagaaaaacattctaaaccagttgaagttaataaggctgaacttgaaaaagaaagcataaatgtaaaaacatcttcaaatttagttgaaatttctgaaaatcatttagtaagacataatactaaagtgttatcgacaatgatttatgacatagctttagaattaattagtactattcctttcgtaccaagtgataaacgtaaa

SEQ ID NO: 2970 - protein, 331 aa, Staphylococcus aureus
  MISC_FEATURE (1)..(331): conserved hypothetical
MRQIKVVLIGGGTGLSVMARGLREFPIDITAIVTVADNGGSTGKIRDEMDIPAPGDIRNVIAALSDSESVLSQLFQYRFEENQISGHSLGNLLIAGMTNITNDFGHAIKALSKILNIKGRVIPSTNTSVQLNAVMEDGEIVFGETNIPKKHKKIDRVFLEPNDVQPMEEAIDALREADLIVLGPGSLYTSVISNLCVNGISDALIHSDAPKLYVSNVMTQPGETDGYSVKDHIDAIHRQAGQPFIDYVICSTQTFNAQVLKKYEEKHSKPVEVNKAELEKESINVKTSSNLVEISENHLVRHNTKVLSTMIYDIALELISTIPFVPSDKRK

SEQ ID NO: 2971 - DNA, 363 bp, Staphylococcus aureus
atgaagaagaaaaaaaacgcgattaaagttatcattatattatttatttcattaattgttgcagtagcatttttctttggtctgaaaacatatcaaggccataagaatattcaactaattgacagttacttggaagagaaaaatctaaaagataaaattaaatcagaaaaaacagagtatagtgctaaaaaaggtctcttctataaggaagttacatttaaagatgaacctggtgtaacttatgttgtgcaaccaatcagtactaataaaggattatttgttgaaggctttgatacagagactaagaaaagtttgaaaactgcaaagcataaatatttcaatcaaaattataaaccatcaaaa

SEQ ID NO: 2972 - protein, 121 aa, Staphylococcus aureus
  MISC_FEATURE (1)..(121): hypothetical protein
MKKKKNAIKVIIILFISLIVAVAFFFGLKTYQGHKNIQLIDSYLEEKNLKDKIKSEKTEYSAKKGLFYKEVTFKDEPGVTYVVQPISTNKGLFVEGFDTETKKSLKTAKHKYFNQNYKPSK

SEQ ID NO: 2973 - DNA, 300 bp, Staphylococcus aureus
gtggggggagaggatagattaccagacgatgatggaggtcacttaatcgctagaatgtttggtggttcaaaagacattgataaccttgtggcacaaagtaaatttatcaaccgtccatttaaggagaaaggtcattggtataatcttgagaaagagtggcaagagttcttaaactctgggaaagaggtgaaaaatattaaaatggaagtaaaatatagcggtaatagtcaaagaccgactatatttaaagttgaatatgaaattaatggtgaaagaaatattagaagaatattaaataag

SEQ ID NO: 2974 - protein, 100 aa, Staphylococcus aureus
  MISC_FEATURE (1)..(100): conserved hypothetical
VGGEDRLPDDDGGHLIARMFGGSKDIDNLVAQSKFINRPFKEKGHWYNLEKEWQEFLNSGKEVKNIKMEVKYSGNSQRPTIFKVEYEINGERNIRRILNK

SEQ ID NO: 2975 - DNA, 810 bp, Staphylococcus aureus
atgggatatttttgtgtagataatctaccaccagtgttattgcctaaatttgtagagttgatggaacaaggaaatccatccttaagaaaagtggcaattgcaattgatttaagaggtaaggaactatttaattcattagttgcagtagtggataaagtcaaaagtgaaagtgacgtcatcattgatgttatgtttttagaagcaagtactgaaaaattaatttcaagatataaggaaacgcgtcgtgcacatcctttgatggaacaaggtaaaagatcgttaatcaatgcaattaatgatgagcgagagcatttgtctcaaattagaagtatagctaattttgttatagatactacaaagttatcacctaaagaattaaaagaacgcattcgtcgatactatgaagatgaagagtttgaaacttttacaattaatgtcacaagtttcggttttaaacatgggattcagatggatgcagatttagtatttgatgtacgatttttaccaaatccatattatgtagtagatttaagacctttaacaggattagataaagacgtttataattatgttatgaaatggaaagagacggagattttctttgaaaaattaactgatttgttagattttatgatacccgggtataaaaaagaagggaaatctcaattagtaattgccatcggttgtacgggtggacaacatcgatctgtagcattagcagaacgactaggtaattatctaaatgaagtatttgaatataatgtttatgtgcatcatagggacgcacatattgaaagtggcgagaaaaaa

SEQ ID NO: 2976 - protein, 270 aa, Staphylococcus aureus
  MISC_FEATURE (1)..(270): conserved hypothetical
MGYFCVDNLPPVLLPKFVELMEQGNPSLRKVAIAIDLRGKELFNSLVAVVDKVKSESDVIIDVMFLEASTEKLISRYKETRRAHPLMEQGKRSLINAINDEREHLSQIRSIANFVIDTTKLSPKELKERIRRYYEDEEFETFTINVTSFGFKHGIQMDADLVFDVRFLPNPYYVVDLRPLTGLDKDVYNYVMKWKETEIFFEKLTDLLDFMIPGYKKEGKSQLVIAIGCTGGQHRSVALAERLGNYLNEVFEYNVYVHHRDAHIESGEKK

SEQ ID NO: 2977 - DNA, 423 bp, Staphylococcus aureus
atgaaaatgcgcttgcaacaagcttttttcaactctagtcaggggccccaacacagagaatttcgaaaagaaattctacaggcaatgcgagttggggtgtgggccccaacacagagaatttcgaaaagaaattctacaggcaatgcgagttggggtgtgggccccaacacagagaatttcgaaaagaaattctacaggcaatgcgagttggggtgtgggccccaacatagagaaattggattcccaatttctacagacaatgcaagttggcggggccccaacacagaagctgacgaaaagtcagcttacaataatgtgcaagttggcggggccccaacacagaagctgacgaaaagtcagcttacaataatgtgcaagttggcggggccccaacacagaagctggcggaaagtcagcttacaa

SEQ ID NO: 2978 - protein, 141 aa, Staphylococcus aureus
MKMRLQQAFFNSSQGPQHREFRKEILQAMRVGVWAPTQRISKRNSTGNASWGVGPNTENFEKKFYRQCELGCGPQHREIGFPISTDNASWRGPNTEADEKSAYNNVQVGGAPTQKLTKSQLTIMCKLAGPQHRSWRKVSLQ

SEQ ID NO: 2979 - DNA, 933 bp, Staphylococcus aureus
atgactgaaatagattttgatatagcaattatcggtgcaggtccagctggtatgactgctgcagtatacgcatcacgtgctaatttaaaaacagttatgattgaaagaggtattccaggcggtcaaatggctaatacagaagaagtagagaacttccctggtttcgaaatgattacaggtccagatttatctacaaaaatgtttgaacacgctaaaaagtttggtgcagtttatcaatatggagatattaaatctgtagaagataaaggcgaatataaagtgattaactttggtaataaagaattaacagcgaaagcggttattattgctacaggtgcagaatacaagaaaattggtgttccgggtgaacaagaacttggtggacgcggtgtaagttattgtgcagtatgtgatggtgcattctttaaaaataaacgcctattcgttatcggtggtggtgattcagcagtagaagagggaacattcttaactaaatttgctgacaaagtaacaatcgttcaccgtcgtgatgagttacgtgcacagcgtattttacaagatagagcattcaaaaatgataaaatcgactttatttggagtcatactttgaaatcaattaatgaaaaagacggcaaagtgggttctgtgacattaacgtctacaaaagatggttcagaagaaacacacgaggctgatggtgtattcatctatattggtatgaaaccattaacagcgccatttaaagacttaggtattacaaatgatgttggttatattgtaacaaaagatgatatgacaacatcagtaccaggtatttttgcagcaggagatgttcgcgacaaaggtttacgccaaattgtcactgctactggcgatggtagtattgcagcgcaaagtgcagcggaatatattgaacatttaaacgatcaagct

SEQ ID NO: 2980 - protein, 311 aa, Staphylococcus aureus
  MISC_FEATURE (1)..(311): thioredoxine reductase
MTEIDFDIAIIGAGPAGMTAAVYASRANLKTVMIERGIPGGQMANTEEVENFPGFEMITGPDLSTKMFEHAKKFGAVYQYGDIKSVEDKGEYKVINFGNKELTAKAVIIATGAEYKKIGVPGEQELGGRGVSYCAVCDGAFFKNKRLFVIGGGDSAVEEGTFLTKFADKVTIVHRRDELRAQRILQDRAFKNDKIDFIWSHTLKSINEKDGKVGSVTLTSTKDGSEETHEADGVFIYIGMKPLTAPFKDLGITNDVGYIVTKDDMTTSVPGIFAAGDVRDKGLRQIVTATGDGSIAAQSAAEYIEHLNDQA

SEQ ID NO: 2981 - DNA, 1437 bp, Staphylococcus aureus
atggcgcaaaagaataataatgtaattccaatgacttttgatgatgcattttatcgtaaaatggctaaacagaagtttaaacaaagagaatataaacgagctgctgaatactttgaaaaagtgttagaattgtcacctgatgatctggaaattcaaattgattatgcacaatgtctagtgcaacttggtattgctaaaaaagcagaacatttattttatgacaatattatttataataggcatctagaagatagcttttatgaattgagtcagctcaacattgaagttaacgaaccaaacaaggcattcttgtttggtattaattatgttattgttagcgacgaccaagattatagagatgaattagatcaaatgtttgatgtgaaatatcaaagtgaagaacaaattgaacttgaagctcaattgtttgtagttcaaatactattccaatatcttttttctcaaggtcgattaaaagatgcaaagaattatgtcttacatcaaccacaagaagttcaagatcatcgtgtagtacgtaatttattggcaatgtgttatttatatctcggtgaatatgatacggctaaagcattgtacgaagcactattacaagaggatagtacagatatatatgcattatgccattatactttgctactttataacactaaggaaaatgaacaatatcaaaaatatttaaaaatattaaacaaagttgtacctatgaatgacgatgaaagttttaaattaggtattgtattaagttatttaaagcagtatcgtgcatcacaacaattgttgtaccctttatataaaaaagggaaatttttatcaattcaaatgtacaatgctttagcatataattattattatttaggtgaagaagacgaaagtcattactactgggataaattgaagcaaatttctaaagtggaaattggacatgcgccttgggtaattgaaaatagcaaagaagtttttgaccaacatattttgccattacttcaaagtgatgacagtcattatcgtttatatggtatttttttattggatcaattaaatggtaaagaaattgtgatgacggaaagtatttggcaggttttggaaaatctaaataattatgagaaattgtatttaacgtatttagttcaaggtttaacgctcaataaattagacttcattcatcgcggcttattaacgctttaccataatgaattatttgtaagtgaaaatgatgtaatggttgcatggattaatcaaggtgaactcataattgctgaaaaagtagatttaactgatgttgagccatatatcggtgcgtttatttatttgtattttaaaaatcaacctcgaaacgttacaaagaagcaaattacaacatggttaggcataacacaatataaactgaacaaaatgattgaatttctcttgagcata

SEQ ID NO: 2982 - protein, 479 aa, Staphylococcus aureus
  MISC_FEATURE (1)..(479): conserved hypothetical
MAQKNNNVIPMTFDDAFYRKMAKQKFKQREYKRAAEYFEKVLELSPDDLEIQIDYAQCLVQLGIAKKAEHLFYDNIIYNRHLEDSFYELSQLNIEVNEPNKAFLFGINYVIVSDDQDYRDELDQMFDVKYQSEEQIELEAQLFVVQILFQYLFSQGRLKDAKNYVLHQPQEVQDHRVVRNLLAMCYLYLGEYDTAKALYEALLQEDSTDIYALCHYTLLLYNTKENEQYQKYLKILNKVVPMNDDESFKLGIVLSYLKQYRASQQLLYPLYKKGKFLSIQMYNALAYNYYYLGEEDESHYYWDKLKQISKVEIGHAPWVIENSKEVFDQHILPLLQSDDSHYRLYGIFLLDQLNGKEIVMTESIWQVLENLNNYEKLYLTYLVQGLTLNKLDFIHRGLLTLYHNELFVSENDVMVAWINQGELIIAEKVDLTDVEPYIGAFIYLYFKNQPRNVTKKQITTWLGITQYKLNKMIEFLLSI

SEQ ID NO: 2983 - DNA, 483 bp, Staphylococcus aureus
ttgaggaaatttttatcaaaaacacatcatcatacaaaccctttatggcgtgtataccgtcttgttaaattttcgaaagtttttaagaatgtaattatcattgaattttcgaaatttattccaagtatggtactgaaaagacatatatataaacaacttttaaatattaatatcggtaatcaatcgtcgatagcttataaagtaatgttagatattttttacccagaactgattacgattggtagtaacagtgttattggttacaatgtaacaattttgacgcatgaagcattagttgatgaatttcgttatggaccagtgacgataggatctaacactttgattggtgcaaatgctaccattttacccggtataacgattggtgacaatgtaaaagttgcagctggtacggttgtttcaaaagatataccggataatggatttgcatatggcaaccctatgtatataaaaatgattaggagg

SEQ ID NO: 2984 - protein, 161 aa, Staphylococcus aureus
  MISC_FEATURE (1)..(161): hypothetical protein
LRKFLSKTHHHTNPLWRVYRLVKFSKVFKNVIIIEFSKFIPSMVLKRHIYKQLLNINIGNQSSIAYKVMLDIFYPELITIGSNSVIGYNVTILTHEALVDEFRYGPVTIGSNTLIGANATILPGITIGDNVKVAAGTVVSKDIPDNGFAYGNPMYIKMIRR

SEQ ID NO: 2985 - DNA, 837 bp, Staphylococcus aureus
atgggtattgtatttaactatatagatcctgtggcatttaacttaggaccactgagtgtacgatggtatggaattatcattgctgtcggaatattacttggttactttgttgcacaacgtgcactagttaaagcaggattacataaagatactttagtagatattattttttatagtgcactatttggatttatcgcggcacgaatctattttgtgattttccaatggccatattacgcggaaaatccaagtgaaattattaaaatatggcatggtggaatagcaatacatggtggtttaataggtggctttattgctggtgttattgtatgtaaagtgaaaaatttaaacccatttcaaattggtgatatcgttgcgccaagtataattttagcgcaaggaattggacgctggggtaactttatgaatcacgaggcacatggtggatcggtgtcacgcgcttttttagaacaattacatttgcctaattttataatagaaaatatgtatattaacggccaatattatcatccaacattcttatatgaatccatttgggatgtcgctggatttattatcttagttaatattcgtaaacatttaaaattaggagaaacattctttttatatttaacttggtattcaattggtcgattctttatagaaggattacgtacagatagcttaatgctcacaagtaatattagagttgcacaattagtatcaattcttttaattttaataagtataagtttaattgtatatagaaggattaagtataatccaccgttgtatagcaaagttggggcgcttccatggccaacaaaaaaagtgaag

SEQ ID NO: 2986 - protein, 279 aa, Staphylococcus aureus
  MISC_FEATURE (1)..(279): prolipoprotein
MGIVFNYIDPVAFNLGPLSVRWYGIIIAVGILLGYFVAQRALVKAGLHKDTLVDIIFYSALFGFIAARIYFVIFQWPYYAENPSEIIKIWHGGIAIHGGLIGGFIAGVIVCKVKNLNPFQIGDIVAPSIILAQGIGRWGNFMNHEAHGGSVSRAFLEQLHLPNFIIENMYINGQYYHPTFLYESIWDVAGFIILVNIRKHLKLGETFFLYLTWYSIGRFFIEGLRTDSLMLTSNIRVAQLVSILLILISISLIVYRRIKYNPPLYSKVGALPWPTKKVK

SEQ ID NO: 2987 - DNA, 930 bp, Staphylococcus aureus
atgttaacgacagaaaaactagttgaaacattaaagttagatttaatcgctggtgaagaaggactatcgaagccaattaaaaatgctgatatatcaagaccgggcttagagatggcaggttatttttcacattatgcgtcagatagaatacaactattaggaacaacggaactatcgttttacaatttattaccagataaggatcgcgcaggtcgtatgcgtaaactatgcagaccagaaacgcctgcaattattgtgacacgtggattgcagccaccagaagaattagttgaagctgcaaaagaattaaataccccacttatagttgctaaagatgcgactacaagtttaatgagtcgcttaacaacgtttttagagcatgcacttgcaaagacgacatctttacatggtgttttagtagatgtttacggtgttggtgtactaattaccggtgattcaggaataggtaaaagtgagactgcgttggaattagttaaacgtgggcatagattagtagcagatgataatgtagaaatacgtcaaattaataaagatgaactaatagggaaaccaccaaagttaatagaacatctattagaaatacgtggactaggtattatcaatgttatgactttatttggcgcgggttcaatattaactgaaaaacgaattagattaaatattaatttggaaaactggaacaagcaaaagttatatgaccgcgtaggtcttaatgaagagacgctaagtattttagatactgaaatcactaaaaaaacaatacctgtaagacctggtagaaatgttgcggtaattattgaggtcgctgcaatgaactatcgattaaatatcatgggcattaacacggccgaagaatttagtgaaagattaaatgaagaaattatcaagaacagtcataagagtgaggag

SEQ ID NO: 2988 - protein, 310 aa, Staphylococcus aureus
  MISC_FEATURE (1)..(310): HPr kinase/phosphatase
MLTTEKLVETLKLDLIAGEEGLSKPIKNADISRPGLEMAGYFSHYASDRIQLLGTTELSFYNLLPDKDRAGRMRKLCRPETPAIIVTRGLQPPEELVEAAKELNTPLIVAKDATTSLMSRLTTFLEHALAKTTSLHGVLVDVYGVGVLITGDSGIGKSETALELVKRGHRLVADDNVEIRQINKDELIGKPPKLIEHLLEIRGLGIINVMTLFGAGSILTEKRIRLNINLENWNKQKLYDRVGLNEETLSILDTEITKKTIPVRPGRNVAVIIEVAAMNYRLNIMGINTAEEFSERLNEEIIKNSHKSEE

SEQ ID NO: 2989 - DNA, 2844 bp, Staphylococcus aureus
atgaaagaaccatccatagtagtaaaaggtgctcgtgcgcataacttgaaagatattgatatcgaactacctaaaaataaattaattgttatgacaggtttatctgggtcaggtaaatcgtcattagcattcgatactatatatgctgaaggacaacgacgttatgttgaatcattaagtgcctatgcgcgtcaatttttaggccaaatggacaaaccagatgttgatacaattgaaggattatcgccagcaatttcaatagatcaaaaaacaacaagtaaaaatccaagatcaactgtagcaacagtaacagaaatatatgattatatacgtttgttatatgcacgtgttggtaaaccttactgtccaaatcacaatatagaaattgaatcgcaaacagtacaacaaatggttgaccgcattatggaattagaggcacgtacaaagattcaattattagcacctgtcatcgctcatcgtaaaggtagtcatgaaaagctaatcgaagatattggtaaaaaaggttatgtacgtttaagaatcgatggcgaaattgttgatgtaaatgatgtacctactttagataagaacaagaatcatacaatagaagttgttgtagaccgattagttgttaaagatggaattgaaacacgactagctgactctatagaaactgccttagagctttcagaaggacaattaacagtcgatgtcattgacggggaagaccttaagttttcagaaagccatgcttgtcctatatgtggattttcaatcggagagttagaaccaagaatgtttagctttaacagtccttttggtgcttgtccgacatgtgatggcttaggccaaaagttaacagtcgatgtagacttggttgttcccgacaaagataagacgctaaacgaaggtgcaatagaaccttggataccgacgagttctgatttttatccaacattgttaaaacgtgtttgtgaagtttataaaatcaatatggataaaccttttaaaaagttaacagaacgtcaacgtgatattttattgtatggttctggtgacaaagaaattgaatttacatttacacaacgtcaaggtggtactagaaaacgaacaatggttttcgagggtgtagttcctaatataagtagacgattccatgaatctccttcagaatatacacgtgaaatgatgagtaaatatatgactgaactaccttgcgaaacttgtcatggaaagcgattgagtcgtgaagcgttatctgtttatgtaggtggtttaaatattggtgaagtagtcgaatattcaatcagtcaagcgctgaactattataaaaacattgatttgtcagaacaagatcaagcgattgcaaatcaaatattgaaagaaattatttcccgactcacttttttaaataatgtgggacttgaatatttaacgttaaacagagcttcaggtacactttcaggtggtgaagcacaacgtattcgattagcaacgcaaattgggtcgcgtttgactggtgtcttatatgtattagatgagccatcaattggactgcatcaaagagataatgatcgattaattaatacacttaaagaaatgagagatttaggaaatactttaattgtagttgaacacgatgatgatacaatgcgtgcggctgattacttagtggatataggtcctggtgctggtgaacatggagggcagattgtgtctagtggtactcctcaaaaggtaatgaaagataaaaaatcattaacaggacaatacttgagtggtaagaaacgtattgaagtacctgaatatcgcagaccggcttcagatcgtaaaatttctatacgtggagctagaagcaacaatcttaaaggggttgatgtggacataccactatcaatcatgacggttgttacaggtgtatcaggttctggtaaaagctcattagtaaatgaagtattatacaaatcattagctcaaaaaattaataaatctaaagtaaagccaggattgtacgataagattgaaggtattgatcaacttgataaaattattgatattgatcaatcaccaataggtagaacgccacgctctaatccagcaacatatactggtgtgtttgatgatatacgtgatgtgtttgcgcaaacaaatgaagctaaaattcgaggatatcaaaaagggcgttttagttttaatgtaaaaggtggacgctgtgaagcttgtaaaggtgacggtattattaaaattgaaatgcattttttacctgatgtttatgttccttgtgaagtgtgtgatggtaaacgatataatcgtgagacactagaggttacttacaaaggtaaaaatattgctgacattttagaaatgactgttgaagaagcaacacaattttttgaaaatattcctaagattaagcgcaagttacaaacactagttgatgttggtcttggatacgtcacattaggtcaacaagctacaacgttatcaggtggtgaggctcaacgtgtgaaacttgcatctgaacttcataaacgttcaactggtaaatctatttatatcctagatgaaccgacaacagggttacatgttgacgatattagtagattattaaaagtattaaaccgattagttgaaaatggtgatactgttgtaattattgaacataacctagatgttatcaaaacagcagactatattatagacttaggtcctgaaggtggtagtggcggtggtactattgttgcgactggcacacccgaagatattgctcagacaaagtcatcatatacaggaaagtatttaaaagaagtacttgaacgagataaacaaaatactgaagataaa

SEQ ID NO: 2990 - protein, 948 aa, Staphylococcus aureus
  MISC_FEATURE (1)..(948): exinuclease ABC subunit A
MKEPSIVVKGARAHNLKDIDIELPKNKLIVMTGLSGSGKSSLAFDTIYAEGQRRYVESLSAYARQFLGQMDKPDVDTIEGLSPAISIDQKTTSKNPRSTVATVTEIYDYIRLLYARVGKPYCPNHNIEIESQTVQQMVDRIMELEARTKIQLLAPVIAHRKGSHEKLIEDIGKKGYVRLRIDGEIVDVNDVPTLDKNKNHTIEVVVDRLVVKDGIETRLADSIETALELSEGQLTVDVIDGEDLKFSESHACPICGFSIGELEPRMFSFNSPFGACPTCDGLGQKLTVDVDLVVPDKDKTLNEGAIEPWIPTSSDFYPTLLKRVCEVYKINMDKPFKKLTERQRDILLYGSGDKEIEFTFTQRQGGTRKRTMVFEGVVPNISRRFHESPSEYTREMMSKYMTELPCETCHGKRLSREALSVYVGGLNIGEVVEYSISQALNYYKNIDLSEQDQAIANQILKEIISRLTFLNNVGLEYLTLNRASGTLSGGEAQRIRLATQIGSRLTGVLYVLDEPSIGLHQRDNDRLINTLKEMRDLGNTLIVVEHDDDTMRAADYLVDIGPGAGEHGGQIVSSGTPQKVMKDKKSLTGQYLSGKKRIEVPEYRRPASDRKISIRGARSNNLKGVDVDIPLSIMTVVTGVSGSGKSSLVNEVLYKSLAQKINKSKVKPGLYDKIEGIDQLDKIIDIDQSPIGRTPRSNPATYTGVFDDIRDVFAQTNEAKIRGYQKGRFSFNVKGGRCEACKGDGIIKIEMHFLPDVYVPCEVCDGKRYNRETLEVTYKGKNIADILEMTVEEATQFFENIPKIKRKLQTLVDVGLGYVTLGQQATTLSGGEAQRVKLASELHKRSTGKSIYILDEPTTGLHVDDISRLLKVLNRLVENGDTVVIIEHNLDVIKTADYIIDLGPEGGSGGGTIVATGTPEDIAQTKSSYTGKYLKEVLERDKQNTEDK

SEQ ID NO: 2991 - DNA, 972 bp, Staphylococcus aureus
atgattgatgaatcacatgtgacattaccgcaagttcgaggcatgtataacggagacagagcgcgtaaacaagttttggtggatcatgggtttagattaccgagtgcattagataaccgtccacttaaatttgaagaatttgaagaaaagacaaaacaacttgtgtatgtatctgcaacgcctggaccatacgaaattgaacatacggataagatggttgaacaaattattcgtcctactggtttactggatcctaagattgaggttagacctactgaaaatcaaattgacgatttattaagtgaaattcaaacaagagttgagcgtaatgaacgcgtacttgttacaacgctcactaaaaagatgagtgaagatttaaccacatacatgaaagaagcgggtattaaagttaattatctgcattcagaaatcaagacattagaacgaattgaaataattagagacttacgaatgggtacatatgatgttatcgtaggtattaatttattaagagagggtattgatataccagaagtttctctagttgtcatattagatgcagataaagaagggtttttacgttctaaccgctcattaattcaaacaataggtagagctgcgcgtaacgataaaggtgaagtcattatgtatgccgataaaatgactgattcgatgaagtatgcaattgatgagacacaacgtcgtcgagaaatacagatgaaacataatgaaaaacatggtattacacctaaaacaattaataaaaaaatacatgatttaattagtgctactgttgaaaatgacgaaaataatgacaaagcacaaactgtgatacctaagaagatgacgaaaaaagaacgtcaaaagacaatcgacaatatagaaaaagaaatgaaacaagcagcgaaagatttagatttcgagaaagctacagaattaagagatatgttatttgaattaaaagcagaaggg

SEQ ID NO: 2992 - protein, 324 aa, Staphylococcus aureus
  MISC_FEATURE (1)..(324): exinuclease ABC subunit B
MIDESHVTLPQVRGMYNGDRARKQVLVDHGFRLPSALDNRPLKFEEFEEKTKQLVYVSATPGPYEIEHTDKMVEQIIRPTGLLDPKIEVRPTENQIDDLLSEIQTRVERNERVLVTTLTKKMSEDLTTYMKEAGIKVNYLHSEIKTLERIEIIRDLRMGTYDVIVGINLLREGIDIPEVSLVVILDADKEGFLRSNRSLIQTIGRAARNDKGEVIMYADKMTDSMKYAIDETQRRREIQMKHNEKHGITPKTINKKIHDLISATVENDENNDKAQTVIPKKMTKKERQKTIDNIEKEMKQAAKDLDFEKATELRDMLFELKAEG

SEQ ID NO: 2993 - DNA, 1014 bp, Staphylococcus aureus
atgtttgtcatctggagccatagaacagggttcatcatgagtcatcaacttaccttcgccgacagtgaattcagcagtaagcgccgtcagaccagaaaagagattttcttgtcccgcatggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtctgtttgcccggttatccctggatagcgccttgccggaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctggtcaccaccgcggccaacgagcatgacctcaatcagctgggtaatctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccagggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcac

SEQ ID NO: 2994 - protein, 338 aa, Staphylococcus aureus
MFVIWSHRTGFIMSHQLTFADSEFSSKRRQTRKEIFLSRMEQILPWQNMVEVIEPFYPKAGNGRRPYPLETMLRIHCMQHWYNLSDGAMEDALYEIASMRLFARLSLDSALPDRTTIMNFRHLLEQHQLARQLFKTINRWLAEAGVMMTQGTLVDATIIEAPSSTKNKEQQRDPEMHQTKKGNQWHFGMKAHIGVDAKSGLTHSLVTTAANEHDLNQLGNLLHGEEQFVSADAGYQGAPQREELAEVDVDWLIAERPGKVRTLKQHPRKNKTAINIEYMKASIRARVEHPFRIIKRQFGFVKARYKGLLKNDNQLAMLFTLANLFRADQMIRQWERSH

SEQ ID NO: 2995 - DNA, 504 bp, Staphylococcus aureus
atgggcgaacatcaaaacgttaaattgaatcgtacagttaaagcagccgtactaacggtatcagatactagagactttgatacagataaaggtggtcaatgcgtgcgccaactattacaagcagatgacgttgaagtgagtgacgcacattatacaattgtgaaagatgaaaaagtagccatcacgacgcaggtgaagaagtggttagaagaagatattgatgtcatcattacgactggtggaacaggtattgcacaacgtgatgtgacgattgaagcagtaaaaccacttttaactaaagagatagaaggctttggggaattgtttagatatttgagttatgttgaagatgttggcacgcgtgcattattgtctcgtgctgtagcaggtacagttaataataaattgatattttcgattccaggatcaacaggcgcagttaaattagcattagaaaagctcattaaaccagaattaaatcatctgattcatgagcttacaaaa

SEQ ID NO: 2996 - protein, 168 aa, Staphylococcus aureus
  MISC_FEATURE (1)..(168): molybdopterin precursor
MGEHQNVKLNRTVKAAVLTVSDTRDFDTDKGGQCVRQLLQADDVEVSDAHYTIVKDEKVAITTQVKKWLEEDIDVIITTGGTGIAQRDVTIEAVKPLLTKEIEGFGELFRYLSYVEDVGTRALLSRAVAGTVNNKLIFSIPGSTGAVKLALEKLIKPELNHLIHELTK

SEQ ID NO: 2997 - DNA, 1077 bp, Staphylococcus aureus
ttgagcggaaatataaataatacgttgaaagaggaggcatatgtgacaatggttgaacattatccttttaaaatacattctgattttgagcctcaaggtgaccaaccgcaagcaattaaagaaatcgtggaaggtattaaagcggggaaaagacatcaaactttattaggtgctactggcacagggaaaacatttacgatgagtaatgttattaaagaagttgggaaaccaacgttaattatcgcgcataacaaaacattagcaggacaattatatagtgagtttaaagaattttttcctgaaaacagggtggaatactttgtaagttactatgattattatcaaccagaggcatacgtaccgtctactgacacttttattgaaaaagatgcctcaatcaatgatgaaattgatcaactacgacattctgctacaagtgcattatttgaacgcgatgatgtaattattattgctagtgtaagttgtatatatggtttaggtaatcctgaagaatataaagatttagtagtaagtgttcgagttggtatggaaatggatagaagtgaattacttagaaaacttgtagatgtgcaatatacacgaaatgacatcgatttccaacgaggaacgtttcgagtgcgtggtgatgtagtggaaatattcccagcctctaaagaagaactttgtataagggttgagtttttcggcgatgagattgaccgtatccgagaagttaactacctaacaggtgaagtgttgaaagaaagagaacattttgcgatattcccagcttctcacttcgtaacacgtgaagaaaagttgaaagttgcgattgaacgtattgaaaaagaattggaagaacgattgaaagaattacgagatgagaataaattactagaagcgcaaaggttagaacagcgtaccaactatgatttagaaatgatgcgagagatgggattctgttcaggaattgaaaactattccgtacatttaactttgcgaccactgggttcgacaccatatactttattggattactttggcgatgattggttagggaaggtgcgaacaagtccc

SEQ ID NO: 2998 - protein, 359 aa, Staphylococcus aureus
  MISC_FEATURE (1)..(359): exinuclease ABC subunit B
LSGNINNTLKEEAYVTMVEHYPFKIHSDFEPQGDQPQAIKEIVEGIKAGKRHQTLLGATGTGKTFTMSNVIKEVGKPTLIIAHNKTLAGQLYSEFKEFFPENRVEYFVSYYDYYQPEAYVPSTDTFIEKDASINDEIDQLRHSATSALFERDDVIIIASVSCIYGLGNPEEYKDLVVSVRVGMEMDRSELLRKLVDVQYTRNDIDFQRGTFRVRGDVVEIFPASKEELCIRVEFFGDEIDRIREVNYLTGEVLKEREHFAIFPASHFVTREEKLKVAIERIEKELEERLKELRDENKLLEAQRLEQRTNYDLEMMREMGFCSGIENYSVHLTLRPLGSTPYTLLDYFGDDWLGKVRTSP

SEQ ID NO: 2999 - DNA, 234 bp, Staphylococcus aureus
atgatatggtattttagcgcagcattctttccatgtgtcttggtagtattatttagtgtaataacaagaagtaaatgggtcggtactattctgacattaattttaattggtgcctcaatctataaagagtatttccataacgagtggattatttttattgatgtagtgtcattattagctggttatttaattatagatcaactcgaatttcataaacatcaagatgaagatcgc

SEQ ID NO: 3000 - protein, 78 aa, Staphylococcus aureus
  MISC_FEATURE (1)..(78): conserved hypothetical
MIWYFSAAFFPCVLVVLFSVITRSKWVGTILTLILIGASIYKEYFHNEWIIFIDVVSLLAGYLIIDQLEFHKHQDEDR

SEQ ID NO: 3001 - DNA, 666 bp, Staphylococcus aureus
atggaggaggtaattgaaatgggtgtacatcaatattttaaaagattatcagatatggaaagacttataagattacctggaaaatttaaatattttgaacacaatgttgcagcacactcctttaaagtaactaaaattgcacaatatctagcaacagttgaagaatatcatggacgaaagattaattggaaaagcttatatgaaaaagcattaaatcatgatttcgccgaagtgtttactggtgatataaaaacacctgttaaatatgcgagtagtgaattaaaaaaattattttcgcaagttgaagaagaaatggtagagacctttattgaagaagaaattccattacaatatagagatgtttataagcaacgactgcaagaaggtaaagatgattcattagaaggccaaatactttcagttgctgataaaattgatttgctttatgaaacatttggagaaatacaaaaacgtaatcccgaagaattatttttcgaaatttatgaaatgagtctagaaacaattattcaatttgaccatttagcatctgtacaagattttattaataatatcattccagaaatgttgactgaaaactttatacctagaacagaattaagagaaacaaccatgaacattttaaataaaagaaaagaggaaaatgaa

SEQ ID NO: 3002 - protein, 222 aa, Staphylococcus aureus
  MISC_FEATURE (1)..(222): conserved hypothetical
MEEVIEMGVHQYFKRLSDMERLIRLPGKFKYFEHNVAAHSFKVTKIAQYLATVEEYHGRKINWKSLYEKALNHDFAEVFTGDIKTPVKYASSELKKLFSQVEEEMVETFIEEEIPLQYRDVYKQRLQEGKDDSLEGQILSVADKIDLLYETFGEIQKRNPEELFFEIYEMSLETIIQFDHLASVQDFINNIIPEMLTENFIPRTELRETTMNILNKRKEENE

SEQ ID NO: 3003 - DNA, 837 bp, Staphylococcus aureus
atgaaaaaatctcttacagtgacggtttcgtcagtgttagcttttttagctttaaataatgcagcacatgcacaacaacatggcacacaagtaaaaacacctgttcaacataattatgtatcaaatgttcaagcacaaacgcaatcaccgacaacttatacagtagttgctggcgattcattatataagattgctttagagcatcacttaacgttgaatcaattatattcatacaatcctggtgtaacacctttaatttttcctggtgacgtgatttcacttgtgcctcaaaataaagtgaaacaaactaaagcggttaaatcaccagtaagaaaagcaagccaagctaaaaaggtagtaaaacaacctgtacaacaagcatctaaaaaagtagtagttaagcaagcacctaagcaagcagtaactaagacagttaatgtagcatacaaacctgctcaagtacaaaaatcagtaccaactgtacctgttgcacataactacaataaatcagttgctaacagaggaaacttatatgcttatggaaactgcacatattatgctttcgatcgtcgtgcacaattaggtagaagtataggaagtttatggggcaatgcaaataactggaattacgcagcaaaagttgcaggatttaaagtagataaaacaccagaagttggcgctattttccaaacagctgctggtccatatggacatgttggtgttgttgaatctgtaaaccctaatggaacaattactgtttctgaaatgaactatgctggatttaatgttaaatcttcaagaacaattttaaatccaggaaaatataattacatccac

SEQ ID NO: 3004 - protein, 279 aa, Staphylococcus aureus
  MISC_FEATURE (1)..(279): conserved hypothetical
MKKSLTVTVSSVLAFLALNNAAHAQQHGTQVKTPVQHNYVSNVQAQTQSPTTYTVVAGDSLYKIALEHHLTLNQLYSYNPGVTPLIFPGDVISLVPQNKVKQTKAVKSPVRKASQAKKVVKQPVQQASKKVVVKQAPKQAVTKTVNVAYKPAQVQKSVPTVPVAHNYNKSVANRGNLYAYGNCTYYAFDRRAQLGRSIGSLWGNANNWNYAAKVAGFKVDKTPEVGAIFQTAAGPYGHVGVVESVNPNGTITVSEMNYAGFNVKSSRTILNPGKYNYIH

SEQ ID NO: 3005 - DNA, 993 bp, Staphylococcus aureus
atgatggcagaacctaatttttgggataaccaaacgaaagcgcaagatattatagataaaaataatgcgttaaaagcaatagttaatggttataaaacactacaagcagaagtagatgacatggatgctacttgggatttattacaagaagaatttgatgaagaaatgaaagaagacttagagcaagaggtcattaattttaaggctaaagtggatgaatacgaattgcaattattattagatgggcctcacgatgccaataacgcaattctagagttacatcctggtgcaggtggcacggagtctcaagattgggctaatatgctatttagaatgtatcaacgttattgtgagaagaaaggctttaaagttgaaactgttgattatctacctggggatgaagcggggattaaaagtgtaacattgctcatcaaagggcataatgcttatggttatttaaaagctgaaaaaggtgtacaccgactagtacgaatttctccatttgattcatcaggacgtcgtcatacatcatttgcatcatgcgacgttattccagattttaataatgatgaaatagagattgaaatcaatccggatgatattacagttgatacattcagagcttctggtgcaggtggtcagcatattaacaaaactgaatcggcaatacgaattacccaccacccctcaggtatagttgttaataaccaaaatgaacgttctcaaattaaaaaccgtgaagcagctatgaaaatgttaaagtctaaattatatcaattaaaattggaagagcaggcacgtgaaatggctgaaattcgtggcgaacaaaaagaaatcggctggggaagccaaattagatcatatgttttccatccatactcaatggtgaaagatcatcgtacgaacgaagaaacaggtaaggttgatgcagtgatggatggagacattggaccatttatcgaatcatatttaagacagacaatgtcgcacgat

SEQ ID NO: 3006 - protein, 331 aa, Staphylococcus aureus
  MISC_FEATURE (1)..(331): peptide chain release
MMAEPNFWDNQTKAQDIIDKNNALKAIVNGYKTLQAEVDDMDATWDLLQEEFDEEMKEDLEQEVINFKAKVDEYELQLLLDGPHDANNAILELHPGAGGTESQDWANMLFRMYQRYCEKKGFKVETVDYLPGDEAGIKSVTLLIKGHNAYGYLKAEKGVHRLVRISPFDSSGRRHTSFASCDVIPDFNNDEIEIEINPDDITVDTFRASGAGGQHINKTESAIRITHHPSGIVVNNQNERSQIKNREAAMKMLKSKLYQLKLEEQAREMAEIRGEQKEIGWGSQIRSYVFHPYSMVKDHRTNEETGKVDAVMDGDIGPFIESYLRQTMSHD

SEQ ID NO: 3007 - DNA, 2529 bp, Staphylococcus aureus
atgggatttttatcaaaaattcttgatggcaataataaagaaattaaacagttaggtaaacttgctgataaagtaatcgctttagaagaaaaaacggcaattttaactgatgaagaaattcgtaataaaacgaaacaattccaaacagaattagctgacattgataatgtcaaaaagcaaaatgattatttagataaaattttaccagaagcatatgcacttgttagagaaggctctaaacgtgtattcaatatgacaccatataaagttcaaattatgggtggtattgcaattcataaaggtgatatcgctgagatgagaacaggtgaaggtaaaacattaacagcgacaatgccaacatacttaaatgcattagctggtagaggtgttcacgttattacagtcaatgaatacttatcaagtgttcaaagtgaagaaatggctgagttatataacttcttaggtttgactgtcggattaaacttaaacagtaagacgacagaagaaaaacgtgaagcatacgcacaagacattacttacagtactaataatgagctaggttttgattacttacgagataacatggtgaattattctgaagatagagtaatgcgtccattacattttgcaatcattgatgaggttgactcaattttaatcgacgaggcacgtacgccattaattatttctggtgaagctgaaaagtcaacgtcactttatacacaagcaaatgtttttgcgaaaatgttaaaacaggacgaagattataaatacgatgaaaaaacgaaagctgtacatttaacagaacaaggtgcggataaagctgaacgtatgttcaaagttgaaaacttatatgatgtacaaaatgttgatgttattagtcatatcaacacagctttacgtgcgcacgttacattacaacgtgacgtagactatatggttgttgatggcgaagtattaattgtcgatcaatttacaggacgtacaatgccaggccgtcgtttctcggaaggtttacaccaagctattgaagcgaaggaaggcgttcaaattcaaaatgaatctaaaactatggcgtctattacattccaaaactatttcagaatgtacaataaacttgcgggtatgacaggtacagctaaaactgaagaagaagaatttagaaatatttataacatgacagtaactcaaattccgacaaataaacctgtgcaacgtaacgataagtctgatttaatttacattagccaaaaaggtaaatttgatgcagtagtagaagatgttgttgaaaaacacaaggcagggcaaccagtgctattaggtactgttgcagttgagacttctgaatatatttcaaatttacttaaaaaacgtggtatccgtcatgatgtgttaaatgcgaaaaatcatgaacgtgaagctgaaattgttgcaggcgctggacaaaaaggtgccgttactattgccactaacatggctggtcgtggtacagatatcaaattaggtgaaggcgtagaggaattaggcggtttagcagtaataggtacagagcgacatgaatctcgtcgtattgatgaccagttacgtggtcgttctggacgtcaaggtgataaaggggatagtcgcttctatttatcattacaagatgaattaatgattcgttttggttctgaacgtttacagaaaatgatgagccgactaggtttagatgactctacaccaattgaatcaaaaatggtatcaagagctgtagaatcagcacaaaaacgtgtagaaggtaataacttcgacgcgcgtaaacgtatcttagaatacgatgaagtattacgtaaacaacgtgaaattatctataacgaaagaaatagtattattgatgaagaagacagctctcaagttgtagatgcaatgctacgttcaacgttacaacgtagtatcaattactatattaatacagcagatgacgagcctgaatatcaaccattcatcgactacattaatgacatcttcttacaagaaggtgacattacagaggatgatatcaaaggtaaagatgctgaagatattttcgaagtcgtttgggctaagattgaagcagcatatcaaagtcaaaaagatatcttagaagaacaaatgaatgagtttgagcgtatgattttacttcgttctattgatagccattggactgatcatatcgacacaatggatcaattacgtcaaggtattcacttacgttcttatgcacaacaaaatccattacgtgactatcaaaatgaaggtcatgaattatttgatatcatgatgcaaaatattgaagaagatacttgtaaattcattttaaaatctgtagtacaagttgaagataatattgaacgtgaaaaaacaacagagtttggtgaagcgaagcacgtttcagctgaagatggtaaagaaaaagtgaaaccgaaaccaatcgttaaaggcgatcaagttggtcgtaacgatgattgtccatgtggtagtggtaaaaaattcaaaaattgccatggaaaa

SEQ ID NO: 3008 - protein, 843 aa, Staphylococcus aureus
  MISC_FEATURE (1)..(843): preprotein translocase
MGFLSKILDGNNKEIKQLGKLADKVIALEEKTAILTDEEIRNKTKQFQTELADIDNVKKQNDYLDKILPEAYALVREGSKRVFNMTPYKVQIMGGIAIHKGDIAEMRTGEGKTLTATMPTYLNALAGRGVHVITVNEYLSSVQSEEMAELYNFLGLTVGLNLNSKTTEEKREAYAQDITYSTNNELGFDYLRDNMVNYSEDRVMRPLHFAIIDEVDSILIDEARTPLIISGEAEKSTSLYTQANVFAKMLKQDEDYKYDEKTKAVHLTEQGADKAERMFKVENLYDVQNVDVISHINTALRAHVTLQRDVDYMVVDGEVLIVDQFTGRTMPGRRFSEGLHQAIEAKEGVQIQNESKTMASITFQNYFRMYNKLAGMTGTAKTEEEEFRNIYNMTVTQIPTNKPVQRNDKSDLIYISQKGKFDAVVEDVVEKHKAGQPVLLGTVAVETSEYISNLLKKRGIRHDVLNAKNHEREAEIVAGAGQKGAVTIATNMAGRGTDIKLGEGVEELGGLAVIGTERHESRRIDDQLRGRSGRQGDKGDSRFYLSLQDELMIRFGSERLQKMMSRLGLDDSTPIESKMVSRAVESAQKRVEGNNFDARKRILEYDEVLRKQREIIYNERNSIIDEEDSSQVVDAMLRSTLQRSINYYINTADDEPEYQPFIDYINDIFLQEGDITEDDIKGKDAEDIFEVVWAKIEAAYQSQKDILEEQMNEFERMILLRSIDSHWTDHIDTMDQLRQGIHLRSYAQQNPLRDYQNEGHELFDIMMQNIEEDTCKFILKSVVQVEDNIEREKTTEFGEAKHVSAEDGKEKVKPKPIVKGDQVGRNDDCPCGSGKKFKNCHGK

SEQ ID NO: 3009 - DNA, 570 bp, Staphylococcus aureus
atgattagatttgaaattcatggagataacctcactatcacagatgctattcgcaactatattgaggaaaaaattggtaagttggaacgttattttaatgacgtaccaaatgcagtggcgcatgttaaagttaaaacttattcaaattcagctactaaaattgaagtaacaattccattgaaaaatgttacgttaagagctgaagagcgaaacgatgatttatacgcaggtattgatttaattaataataaacttgaaagacaagttcgaaaatataaaacacgtattaatcgtaagagccgtgatcgaggagatcaagaagtgtttgttgccgaattacaagaaatgcaagaaacacaagttgataatgacgcttacgatgataacgagatagaaattattcgttcaaaagaattcagcttaaaaccaatggattcagaagaagcggtattacaaatgaatctattaggtcatgacttctttgtattcacagacagagaaactgatggaacaagtatcgtttaccgccgtaaagacggtaaatatggcttgattcaaactagtgaacaa

SEQ ID NO: 3010 - protein, 190 aa, Staphylococcus aureus
  MISC_FEATURE (1)..(190): conserved hypothetical
MIRFEIHGDNLTITDAIRNYIEEKIGKLERYFNDVPNAVAHVKVKTYSNSATKIEVTIPLKNVTLRAEERNDDLYAGIDLINNKLERQVRKYKTRINRKSRDRGDQEVFVAELQEMQETQVDNDAYDDNEIEIIRSKEFSLKPMDSEEAVLQMNLLGHDFFVFTDRETDGTSIVYRRKDGKYGLIQTSEQ

SEQ ID NO: 3011 - DNA, 675 bp, Staphylococcus aureus
ttgatgaataattgtttgagttgtggtgctaagttatatgaaaatataaccatttataatttgttcaagaaacctaatagattatgtgacagatgcaaagagaattgggacaatattaaacttgatattaaagcaaggcgatgttcaaggtgcttaaaacacttaaatcaagatgaagcgtattgtttagactgcaagtttctatcggcacactttaatttaatggaacaattatattgtcaatttcaatatgacggtttaatgaaagagatgatacatcagtataaatttttgaaagactattatttatgtgaattattggcacatttgattgaaataccacaaacatcttatgactatattgtgccaattccttcttcgccggcacatgatttatctagaacatttaacccggtagaagcagtactaaaagctaaagggattcgctttgataagattttaaagatgtcaaatagaccaaaacagtctcatttaactaagaaagagcgtctggcagatgaaaatccatttattattgatacggaattagatttaaatggtaaggaaatattactcgttgacgatatttatacaactggattaacaattcatcgtgcagggtgtaaattatatgctaaaaatatcagaaaattcaaagtgtttgcgtttgcacga

SEQ ID NO: 3012 - protein, 225 aa, Staphylococcus aureus
  MISC_FEATURE (1)..(225): hypothetical protein
LMNNCLSCGAKLYENITIYNLFKKPNRLCDRCKENWDNIKLDIKARRCSRCLKHLNQDEAYCLDCKFLSAHFNLMEQLYCQFQYDGLMKEMIHQYKFLKDYYLCELLAHLIEIPQTSYDYIVPIPSSPAHDLSRTFNPVEAVLKAKGIRFDKILKMSNRPKQSHLTKKERLADENPFIIDTELDLNGKEILLVDDIYTTGLTIHRAGCKLYAKNIRKFKVFAFAR

SEQ ID NO: 3013 - DNA, 1080 bp, Staphylococcus aureus
atggataatgtaacaagatataaaataacagagagttcgcaaagttcatcacaagcatattatcatctctcatttgaattgtcggaacagcagtcttatgcctcagaacatattgttcgagccattagaaagagacaaacgattttgttatatgccgtaacaggtgcaggtaagacagaaatgatgtttcaaggcattcaatatgcaagaatacagggagataatatagctattgtgtcaccacgtgtagatgttgttgtagaaattagtaaacgtattaaagacgcatttcttaatgaagatatagacatactacaccagcaatcaagacaacaatttgaagggcattttgttgtatgcacagtgcatcaactttaccgattcaaacagcactttgatactatttttattgatgaagtcgatgcctttcctttatcaatggataaaaatttacaacaagcattgaagtcatcttctaaagttgaacatgcaacaatttatatgacagcaacaccaccgaaacaacttctgtcagagattccccacgaaaatataattaaattgccagctcgctttcataaaaaatcacttccagttcctaaatatcgttatttcaaacttaataataagaagattcagaaaatgttataccgaattttacaagatcaaattaataatcaacgttatacactggtgttttttaacaatatagaaacaatgattaaaacattttcggtttataagcagaaaattactaaattaacatacgtccatagcgaggatgtttttcgctttgaaaaagttgaacaattaaggaatggacatttcgatgtcatttttactacgacaatattagaacgtggatttacaatggcaaatttggatgttgttgttatcgatgcacatcaatatactcaagaggctttaatacaaattgctggacgtgttggacgaaaattagaatgtcctactggaaaagtattgttttttcatgaaggggtaagtatgaatatgattcaagctaaaaaagagattcaaaggatgaacaaattagcattaaaaagaggttggattgatgaa

SEQ ID NO: 3014 - protein, 360 aa, Staphylococcus aureus
  MISC_FEATURE (1)..(360): hypothetical protein
MDNVTRYKITESSQSSSQAYYHLSFELSEQQSYASEHIVRAIRKRQTILLYAVTGAGKTEMMFQGIQYARIQGDNIAIVSPRVDVVVEISKRIKDAFLNEDIDILHQQSRQQFEGHFVVCTVHQLYRFKQHFDTIFIDEVDAFPLSMDKNLQQALKSSSKVEHATIYMTATPPKQLLSEIPHENIIKLPARFHKKSLPVPKYRYFKLNNKKIQKMLYRILQDQINNQRYTLVFFNNIETMIKTFSVYKQKITKLTYVHSEDVFRFEKVEQLRNGHFDVIFTTTILERGFTMANLDVVVIDAHQYTQEALIQIAGRVGRKLECPTGKVLFFHEGVSMNMIQAKKEIQRMNKLALKRGWIDE

SEQ ID NO: 3015 - DNA, 381 bp, Staphylococcus aureus
atgaaaattgctgtgatgaccgattctacaagttatctgtcgcaggacttaatcgataaatataatattcaaatagcgccattaagtgtgacttttgaagatggcaagattataccagaagaaaaagttcgtactaaaaagcgtgccattcaaacattagaaaagaaagtattagatattgtaaaagactttgaagaagtaactttatttgtcataaatggagatcatttcgaagatggtcaagcgttatacaaaaagttacaagatgattgtccttcagcttatcaagtagcatactctgagtttggtccagttgttgcagcacatttaggttctggtggattaggtttaggctatgttggcagaaaaataagattaaca

SEQ ID NO: 3016 - protein, 127 aa, Staphylococcus aureus
  MISC_FEATURE (1)..(127): conserved hypothetical
MKIAVMTDSTSYLSQDLIDKYNIQIAPLSVTFEDGKIIPEEKVRTKKRAIQTLEKKVLDIVKDFEEVTLFVINGDHFEDGQALYKKLQDDCPSAYQVAYSEFGPVVAAHLGSGGLGLGYVGRKIRLT

SEQ ID NO: 3017 - DNA, 1002 bp, Staphylococcus aureus
gtgagtcaagaacgttattcaaggcaaattttatttaaacaaataggtgaaataggtcaaagcaaaataaatcaaaaatgtgcgttgattattggtatgggcgcattaggtacacatgtggccgaaggacttgttagagcaggcattgccaaactaatcattgttgatagagattatattgaatttagtaatttacaaagacaaacattgtttactgaagaagatgctttgaaaatgatgcctaaggtggttgcagctaaaaagcatttgctagcgttacgtagtgatgttgatattgatgattatattgcccatgtggattattattttttggaaacacatggacaggacgttgacgttattattgatgcaaccgataactttgaaacacgacaactgattaatgattttgcatataaatatcgtataccttggatttatggtggtgttgtacagagtacatatacagaagctgcatttatacctggtaaaacaccttgctttaactgtttggtaccacaattgccagcattaaatttaacatgtgatacagtaggggtcattcaacctgccgtgacgatggcaacaagtttacaattaagagatgcgatgaaagtattaacggaacaaccaattgacacaaaaataacttatggcgatatttgggaaggtagtcattattcatttggtttcagtaaaatgcaacgttcagactgtacaacttgtggagatgtaccaagttatccgtatttaaacaagaatgaacaacgttatgcaacattgtgtggtagagacactgtacagtatgaaaatgcatcaattacacacgacattcttgttcaatttttaaaacaacatcagttaaattatcgcagtaattcgtatatggttatgtttgaatttaaaggacaccgcattgttgcttttaaaggtggaaggtttttaatacatggcatgacacgcacatcagatgccacacatctaatgaatttattgtttgga

SEQ ID NO: 3018 - protein, 334 aa, Staphylococcus aureus
  MISC_FEATURE (1)..(334): molybdopterin biosynthesis
VSQERYSRQILFKQIGEIGQSKINQKCALIIGMGALGTHVAEGLVRAGIAKLIIVDRDYIEFSNLQRQTLFTEEDALKMMPKVVAAKKHLLALRSDVDIDDYIAHVDYYFLETHGQDVDVIIDATDNFETRQLINDFAYKYRIPWIYGGVVQSTYTEAAFIPGKTPCFNCLVPQLPALNLTCDTVGVIQPAVTMATSLQLRDAMKVLTEQPIDTKITYGDIWEGSHYSFGFSKMQRSDCTTCGDVPSYPYLNKNEQRYATLCGRDTVQYENASITHDILVQFLKQHQLNYRSNSYMVMFEFKGHRIVAFKGGRFLIHGMTRTSDATHLMNLLFG

SEQ ID NO: 3019 - DNA, 639 bp, Staphylococcus aureus
atgacacaaaatatcattactgttaaaaaagaacacattattgaaaatgtgattagtaaatcaagattcattgctcatatcaaacctgttcaaaatgaagatgaagctaaagcatttattgctgcaataaaaaaagaacataaagatgccactcataattgttctgcatatactattggacctgaaatgaatattcaaaaagcgaatgatgatggtgaaccgacaggaactgccggtgtcccaatgttagacatattaaaaaagctcgatgttcataatgcgtgtgtcgtagtaacaagatattttggtggtattaaattaggtggtggcggtttaattcgcgcctatagcggtgctgttagagacgtcatttatgatatcgggcgtgtcgaactacgagaagcagtaccatgtatagtaacactgaattatgatcaaactggtaaatttgaatatgaattagcttcaactcattttatgttaagaaaccaaacttacactgataaggtaagctactatatcgatgtcgttaaaagtgactatgaagcgtttattaactttttaaatcaaatgactgcaggaaatttcgatttgactgaagaaactccaaagcagttacctttcgatataccaactgaa

SEQ ID NO: 3020 - protein, 213 aa, Staphylococcus aureus
  MISC_FEATURE (1)..(213): conserved hypothetical
MTQNIITVKKEHIIENVISKSRFIAHIKPVQNEDEAKAFIAAIKKEHKDATHNCSAYTIGPEMNIQKANDDGEPTGTAGVPMLDILKKLDVHNACVVVTRYFGGIKLGGGGLIRAYSGAVRDVIYDIGRVELREAVPCIVTLNYDQTGKFEYELASTHFMLRNQTYTDKVSYYIDVVKSDYEAFINFLNQMTAGNFDLTEETPKQLPFDIPTE

SEQ ID NO: 3021 - DNA, 1053 bp, Staphylococcus aureus
atggttacattattactagttgcagtaacaatgattgtcagtttgacgataacaccaattgttattgcaatatcgaaaagattaaatttagttgataaaccaaattttagaaaagtacacactaaacctatttcagttatgggtggtacagtgattctcttttcatttttaataggtatttggattggtcatcctattgaaacagaaatcaaaccacttattattggtgcgattattatgtacgtacttgggcttgtagatgatatctacgatttgaaaccgtatataaaattggctggtcaaattgccgctgccttagtagttgctttttatggtgtgactattgattttatttcgttgccaatgggtacaacgattcattttggatttcttagtattccaattactgtgatttggattgttgctattacaaatgcaattaacttaattgatggactcgatggtttggcgtcgggtgtttctgcaatcggactcattacaatagggttcattgcaattttacaagctaatattttcataacgatgatttgttgtgttttattaggctctttaattgggtttttattttacaatttccatcctgccaaaatatttttaggtgatagtggggctttaatgattggatttatcatcggattcctttctttactcggattcaaaaatattacaattattgcattgttcttcccaattgttatcttagcagttccattcattgatactttgttcgcaatgattcgacgtgtgaaaaaagggcagcatataatgcaagctgataaatcgcatttgcatcataaactattagctttaggctacacacatagacaaacagtattattaatctattcaatctctattttatttagtctttcgagcattattttgtatgtatcgccaccattaggtgttgtattaatgtttgtattaatcatatttagtattgaattaattgttgaatttacaggattaatagataacaactaccgaccaatattaaatttaattagtcgtaagtcatctcataaagaggaa

SEQ ID NO: 3022 - protein, 351 aa, Staphylococcus aureus
  MISC_FEATURE (1)..(351): lipophilic protein
MVTLLLVAVTMIVSLTITPIVIAISKRLNLVDKPNFRKVHTKPISVMGGTVILFSFLIGIWIGHPIETEIKPLIIGAIIMYVLGLVDDIYDLKPYIKLAGQIAAALVVAFYGVTIDFISLPMGTTIHFGFLSIPITVIWIVAITNAINLIDGLDGLASGVSAIGLITIGFIAILQANIFITMICCVLLGSLIGFLFYNFHPAKIFLGDSGALMIGFIIGFLSLLGFKNITIIALFFPIVILAVPFIDTLFAMIRRVKKGQHIMQADKSHLHHKLLALGYTHRQTVLLIYSISILFSLSSIILYVSPPLGVVLMFVLIIFSIELIVEFTGLIDNNYRPILNLISRKSSHKEE

SEQ ID NO: 3023 - DNA, 1068 bp, Staphylococcus aureus
atgttcgaagcatttatatacaatatatctgttatagtcgctggaatctatttattccatcgcttacagtattcagaaaacaaacgtatggttttttctaaggcttatgtcactgttttaatgacaatcgtatcattattattatctgtctaccctatcccttatcgtgaagattatttaattcacttaacattcgttcctttattgtttttaggtagatttacaaatatggtctatacattatctgccacagtaattgtagcaattgttgaaattgtagtatttaacaactcgattatgtacggtgttacgttgattgttattgctgcagtaacaagtgctattggaccatttttaaaacaaaatgatgtgctatcattattaatacttaatgttgttacaataatcattttatttggtgtcgcgttagtgagtcctatttacacactatcggaagttatcattttaataccaatttcattaattatcactttagcttcagcgataacatttgtcgatatttggcatttcttctcactcgtaaatcgttatgaaaacgaagataaatatgattacttaacaggcttaggtaatgtaaaagaatttgatagacatttaaatgaaatttcacgaaaagctgaaaaagaacatcaaagtatcgcattattattaatcgatatcgatggatttaaagatgtcaatgatacctactcacacaaatcaggtgatgctgtattaaaacaaatgtctcaattacttaaaaactatgtgccgaatcaatttaaaatttttagaaatggtggcgaagagttctcagttgtcattcacaattattcacttgatcaaagtgttaaattagctgaaaatattcgttcgggtgttgaaaaatcatcattccatttaccaaacaaagaagttattaaattgtcagtgtctatcggtgttggttatttaacagatgacgatccaaaatcacagcgtaaagtgtttaaagatgcagacgatatggtgcatgtagccaaaaatcaagggcgaaacaaagtaatgtttaaccctattatcaattta

SEQ ID NO: 3024 - protein, 356 aa, Staphylococcus aureus
  MISC_FEATURE (1)..(356): conserved hypothetical
MFEAFIYNISVIVAGIYLFHRLQYSENKRMVFSKAYVTVLMTIVSLLLSVYPIPYREDYLIHLTFVPLLFLGRFTNMVYTLSATVIVAIVEIVVFNNSIMYGVTLIVIAAVTSAIGPFLKQNDVLSLLILNVVTIIILFGVALVSPIYTLSEVIILIPISLIITLASAITFVDIWHFFSLVNRYENEDKYDYLTGLGNVKEFDRHLNEISRKAEKEHQSIALLLIDIDGFKDVNDTYSHKSGDAVLKQMSQLLKNYVPNQFKIFRNGGEEFSVVIHNYSLDQSVKLAENIRSGVEKSSFHLPNKEVIKLSVSIGVGYLTDDDPKSQRKVFKDADDMVHVAKNQGRNKVMFNPIINL

SEQ ID NO: 3025 - DNA, 759 bp, Staphylococcus aureus
atgccagattcaatcacaattatagatgaaaacaaagtgattgatgttgtattaattgcaggtagaattttacttgaatcaggtgctgaaacatatcgagttgaagatacaatgaaccgtatcgcacatagttatggtcttcataatacatatagttttgtcagttcaactgcaattattttttcattaaacgatcgaacaagtacaagattaattcgtgtacaagagcgtacaacagatttagagaaaatcgctttaacgaatagtctttcacgtaaaatatcaaataaagaactcacaattgatgaagctaaatctgaatttattcatttacagcatgcatcattacaatattcttttttaacgaatttctttgcagctgccattgcatgtggcttcttcctatttatgtttggtggtgtcgcatcagattgttggattgcagtcattgctggcggatccgcatttttaacattcagctttgtgcaacgctatatacaaattaaatttttctcagagtttgttgcagccgctgtggtcatatccattgcagccacatttactaaattaggcattgcaaccaatcaagatatcattactatagccagtgtcatgccacttgtccctggtatattaattaccaatgccattcgagatttattagcgggtgaattacttgcaggtatgtctcgcggtgttgaagctgcattaacagcattcgcaatcggtgctggtgtcgcaatcgttttattaatcatt

SEQ ID NO: 3026 - protein, 253 aa, Staphylococcus aureus
  MISC_FEATURE (1)..(253): conserved hypothetical
MPDSITIIDENKVIDVVLIAGRILLESGAETYRVEDTMNRIAHSYGLHNTYSFVSSTAIIFSLNDRTSTRLIRVQERTTDLEKIALTNSLSRKISNKELTIDEAKSEFIHLQHASLQYSFLTNFFAAAIACGFFLFMFGGVASDCWIAVIAGGSAFLTFSFVQRYIQIKFFSEFVAAAVVISIAATFTKLGIATNQDIITIASVMPLVPGILITNAIRDLLAGELLAGMSRGVEAALTAFAIGAGVAIVLLII

SEQ ID NO: 3027 - DNA, 492 bp, Staphylococcus aureus
atgctattttatttatttcattttacaatcagctttatatcaacagtacttttctctatcattttcaatgcacccaaacgcctcttagtagcatgtggatttgtgggtgccattgcatggacgatttaccaattaacggtagatttagagtttggaaaagttggcgcttcatttttgggaagcttaattttaggcttaatgagtcatactatgagtcgcagatataaacgaccggtaattatattcatagtgccaggcattataccattagtacctggtggtgcagcttatcaagcgactcgttttttagtatcaaatgattatacaagtgctgtaaatacatttttagaagttacactgatttcaggtgcgattgctttcggtatattagtttctgaaattctatattacctatacacacgtatcaaacaactgtatggtaaaatcaaaggtaagacatataaaaaatcttacaacatgaataatagagtt

SEQ ID NO: 3028 - protein, 164 aa, Staphylococcus aureus
  MISC_FEATURE (1)..(164): conserved hypothetical
MLFYLFHFTISFISTVLFSIIFNAPKRLLVACGFVGAIAWTIYQLTVDLEFGKVGASFLGSLILGLMSHTMSRRYKRPVIIFIVPGIIPLVPGGAAYQATRFLVSNDYTSAVNTFLEVTLISGAIAFGILVSEILYYLYTRIKQLYGKIKGKTYKKSYNMNNRV

SEQ ID NO: 3029 - DNA, 1224 bp, Staphylococcus aureus
atgaagaaccaattgatagatagattaacaagatatacgacaattgatacgcaatctgatccaaaatctacaacaacaccttcaactgaaaagcaatgggatttgttacatttattagaaaaagaattacaacaattaggattgccaactgatttagatgaaaatggctacttatttgctacattagaaagtaacatcgatgtcgacgtcccaacagttggatttttggcgcatgttgatacatcacctgatttcaatgcttcaaatgttaaaccgcaaattattgaaaactatgatggtaagccatacaaactaggcaatactaaacgtgtcttagatcctaaagtatttccagaacttaacagtttagttggtcatacattaatggtaactgatggtacatcgttactaggtgcagacgataaagcgggtattgtggaaattatggaagctatttgttatttacaagaacatccagaaattaaacatggtaccattcgcattggatttacaccagacgaagaaatcggtcgtggtccacataaatttgatgttgaccgcttcaatgctgattttgcttatactatggatggtagtcaatatggagaattacaatatgaaagctttaacgctgctgaagcggttattacatgccacggtgtaaatgttcatcctggttcagctaaaaatgcaatggtaaacgcaatacgtttaggtgaacaattcgatagtttgctacctgatagtgaagttccggagcgaacagaaggatacgaaggcttttatcacttaatgaactttgaaggaactgttgaaaaagcaactttgcaatacattattcgtgatcatgataaaaaacaattcgaattgcgtaagaaacgtattttagaaatacgtgacgatatcaatgcccattttgaaaattatccagttaaagttgatatatcggatcaatatttcaatatggcagaaaaaatattaccattgcctcatattattgatatacctaaacgtgtctttgccaaattagatattccagcaaacactgaacctattcgcggtggtacagatggttcacaattgtcatttatggggttaccaactccaaacatctttacaggttgcggtaacttccacggcccatatgaatatgcatccattgatgttatggaaaaagcagtacaagtaatcattggaattgtagaagatatcgctgaaaatcac

SEQ ID NO: 3030 - protein, 408 aa, Staphylococcus aureus
  MISC_FEATURE (1)..(408): aminotripeptidase
MKNQLIDRLTRYTTIDTQSDPKSTTTPSTEKQWDLLHLLEKELQQLGLPTDLDENGYLFATLESNIDVDVPTVGFLAHVDTSPDFNASNVKPQIIENYDGKPYKLGNTKRVLDPKVFPELNSLVGHTLMVTDGTSLLGADDKAGIVEIMEAICYLQEHPEIKHGTIRIGFTPDEEIGRGPHKFDVDRFNADFAYTMDGSQYGELQYESFNAAEAVITCHGVNVHPGSAKNAMVNAIRLGEQFDSLLPDSEVPERTEGYEGFYHLMNFEGTVEKATLQYIIRDHDKKQFELRKKRILEIRDDINAHFENYPVKVDISDQYFNMAEKILPLPHIIDIPKRVFAKLDIPANTEPIRGGTDGSQLSFMGLPTPNIFTGCGNFHGPYEYASIDVMEKAVQVIIGIVEDIAENH

SEQ ID NO: 3031 - DNA, 1134 bp, Staphylococcus aureus
gtggtcaaggttatgaaagtattagtagccatggatgagtttcatggaattatttcaagttatcaagctaatagatatgttgaagaggcagttgcaagccaaattgaaactgcagatgtagttcaagtaccattgtttaatggaagacatgaattattagattctgtatttttatggcaatctgggcaaaagtatcgtataccagtacatgatgcagatatgaatgaagttgaaggtgtttacggacaaactgatacagggatgaccgttatcgaggggaatttatttttaaaaggtaaaaaaccaattgttgaacgaacaagttatggtttaggagaaatgattaaacatgcattagataacgacgcaaaacatgttgtaatttcactaggtgggattgatagttttgatgctggtgcaggtatgttacaagcattaggtgctcaattctatgatgacgaagggcgtgtcgtagatatgagacaaggtgctggtgtaattaaatatattcgtcgtatggatatgtcgaacttacaccctaaaatggaaacagcaagaattcaagtaatgtcggatttttcaagtcgattatatggtaagcaaagtgaaatcatgcaaacttatgatgcgcatcagttgaatcataatcaagcagcagaaatcgataatttaatttggtattttagtgagttatttaaaagtgaattgaaaattgcaattggtccagttgaacgtggtggtgctggtggtggaattgcagcagtcttgaatggactgtatcaagctgaaatattaaccagtcatgcattagtagaccaactaacacatttagaaaatttagttgaacaagcggatttaattatttttggagaaggattaaatgaaaatgatcagttgctagaaacgacaacattgcgtattgcagaactttgtcataaacatcaaaaggttgccattgcaatttgtgcaactgctgaaaagtttgatttatttgaatcacaaggggttacagcaatgtttaatacatttatcgatatgccagaaacttatactgactttaaaatggggttacaaattaggcattatacggttcagtctttaaaactgttgaaaacacattttaatgttgaggtt

SEQ ID NO: 3032 - protein, 378 aa, Staphylococcus aureus
  MISC_FEATURE (1)..(378): hypothetical protein
VVKVMKVLVAMDEFHGIISSYQANRYVEEAVASQIETADVVQVPLFNGRHELLDSVFLWQSGQKYRIPVHDADMNEVEGVYGQTDTGMTVIEGNLFLKGKKPIVERTSYGLGEMIKHALDNDAKHVVISLGGIDSFDAGAGMLQALGAQFYDDEGRVVDMRQGAGVIKYIRRMDMSNLHPKMETARIQVMSDFSSRLYGKQSEIMQTYDAHQLNHNQAAEIDNLIWYFSELFKSELKIAIGPVERGGAGGGIAAVLNGLYQAEILTSHALVDQLTHLENLVEQADLIIFGEGLNENDQLLETTTLRIAELCHKHQKVAIAICATAEKFDLFESQGVTAMFNTFIDMPETYTDFKMGLQIRHYTVQSLKLLKTHFNVEV

SEQ ID NO: 3033 - DNA, 327 bp, Staphylococcus aureus
gtgaatagagtggctataaagctaagttcaattgaccaatttgaacaggttattgaggaaaataaatatgtttttgtattaaaacatagtgaaacttgtccaatatcggcaaatgcgtacgatcaatttaataaatttttatatgaacgcgatatggacggttattatttgattgtccaacaagaacgcgatttgtcagattatattgctaaaaaaacgaacgttaaacatgaatcacctcaagcattttattttgtaaatggtgaaatggtttggaatcgagaccacggtgatatcaatgtgtcgtcattagcacaagcagaagaa

SEQ ID NO: 3034 - protein, 109 aa, Staphylococcus aureus
  MISC_FEATURE (1)..(109): conserved hypothetical
VNRVAIKLSSIDQFEQVIEENKYVFVLKHSETCPISANAYDQFNKFLYERDMDGYYLIVQQERDLSDYIAKKTNVKHESPQAFYFVNGEMVWNRDHGDINVSSLAQAEE

SEQ ID NO: 3035 - DNA, 900 bp, Staphylococcus aureus
atgaatctgttaaggagtgcaatcatgaaaaaaattgttattatcgctgttttagcgattttatttgtagtaataagtgcttgtggtaataaagaaaaagaggcacaacatcaatttactaagcaatttaaagatgttgagcaaaaacaaaaagaattacaacatgtcatggataatatacatttgaaagaaattgatcatctaagtaaaactgatacaactgataaaaatagtaaagaatttaaggcactacaagaagatgttaaaaaccatctcatacctaaatttgaagcatattataagtcagcaaaaaatttgcctgatgatacaatgaaagttaagaaattaaaaaaagaatatatgacgcttgcaaatgagaagaaggatgcgatatatcaattaaaaaaattcataggtttatgtaatcaatctatcaagtataacgaagacattttagattatacgaaacaatttgaaaaaaatagatacaaagttgaatcagaaattaaattagctgataataaaagtgaagcaactaatcttacgacaaaattagaacataataataaagcgttaagagatactgcgaagaagaacctagatgatagtaaagaaaatgaagtaaaaggcgcgattaaaaatcacattatgccaatgattgaaaagcaaattaccgatattaaccaaactaatattagtgataagcatgttaataatgcaaggaaaaacgcaatagaaatgtattacagtctgcagaactattataatacacgtattgaaacaataaaggttagtgagaagttatcaaaagtcgatgtagataagttgccgaaaaagggtatagatataactcacggcgataaagcctttgaaaaaaagcttgaaaaattagaagaaaaa

SEQ ID NO: 3036 - protein, 300 aa, Staphylococcus aureus
  MISC_FEATURE (1)..(300): hypothetical protein
MNLLRSAIMKKIVIIAVLAILFVVISACGNKEKEAQHQFTKQFKDVEQKQKELQHVMDNIHLKEIDHLSKTDTTDKNSKEFKALQEDVKNHLIPKFEAYYKSAKNLPDDTMKVKKLKKEYMTLANEKKDAIYQLKKFIGLCNQSIKYNEDILDYTKQFEKNRYKVESEIKLADNKSEATNLTTKLEHNNKALRDTAKKNLDDSKENEVKGAIKNHIMPMIEKQITDINQTNISDKHVNNARKNAIEMYYSLQNYYNTRIETIKVSEKLSKVDVDKLPKKGIDITHGDKAFEKKLEKLEEK

SEQ ID NO: 3037 - DNA, 603 bp, Staphylococcus aureus
atgcttaaaatcaatgtgaaatatcaattaaagaacactttaattcgcatcaatatagatgatactgaaccaaaaatttatgcagttcgtggtccatctggcattggtaaaactactgttttaaatatgattgccggattacgtaaagcagatgaagctattatcgaagtgaatgggcaattacttactgatacggcaaaaaacgtgaatgttaaaattcaacaacgacgtattggatatctgtttcaagactaccaattgtttcctaatatgacggtctataaaaatattacttttatggctgaaccatctgaacacatcgatcaattaattcaaactttaaacattgatcatttgatgaaacaatatcctatgacattgtcaggtggagaggcacaacgtgtagcacttgcacgtgcacttagcacgaaaccagatttaattttattagatgaacctttttctagtttggatgatactacaaaagatgagagtattacattagttaaacgtattttcaacgaatggcaaataccaatcatatttgtgacacattcaaactatgaagcagaacaaatggctcatgaaattattacaattggg

SEQ ID NO: 3038 - protein, 201 aa, Staphylococcus aureus
  MISC_FEATURE (1)..(201): molybdenum transport
MLKINVKYQLKNTLIRINIDDTEPKIYAVRGPSGIGKTTVLNMIAGLRKADEAIIEVNGQLLTDTAKNVNVKIQQRRIGYLFQDYQLFPNMTVYKNITFMAEPSEHIDQLIQTLNIDHLMKQYPMTLSGGEAQRVALARALSTKPDLILLDEPFSSLDDTTKDESITLVKRIFNEWQIPIIFVTHSNYEAEQMAHEIITIG

SEQ ID NO: 3039 - DNA, 516 bp, Staphylococcus aureus
atgtattcaaatgttcaaccattcattaatagtgatttaactaattgttttcaatcacaatacactgaaattgaatcattattattcaacctcttagacagcccagtaaaatatacaaaacatattggcggtacgcatcattttaaatattcaacagagccaattttagatattttagtaggtgtagaaaatttgcatgatattacatccttagatgaaaaacgcttaaattatgtagggttttatcgtttgcatcataaatatactaagaaagttatgatggcgaagtttaacaattttcatgaactaaaacaacaggtgcgtctacatatcattcaaatgaatacccaaacatttgaatcttatcttgcacttgattacctcttatcaactaatgatgatattgctttgcaattcaatacaaaaaaacaccaaatattgcaacatagcttaacaattagacaatatgagatgcaaaagcaacaatactttgaaaaactatgtaaaaaatactta

SEQ ID NO: 3040 - protein, 172 aa, Staphylococcus aureus
  MISC_FEATURE (1)..(172): conserved hypothetical
MYSNVQPFINSDLTNCFQSQYTEIESLLFNLLDSPVKYTKHIGGTHHFKYSTEPILDILVGVENLHDITSLDEKRLNYVGFYRLHHKYTKKVMMAKFNNFHELKQQVRLHIIQMNTQTFESYLALDYLLSTNDDIALQFNTKKHQILQHSLTIRQYEMQKQQYFEKLCKKYL

SEQ ID NO: 3041 - DNA, 921 bp, Staphylococcus aureus
gtgataaataaagacatctatcaagctttacaacaacttatcccaaatgaaaaaattaaagttgatgaacctttaaaacgatacacttatactaaaacaggtggtaatgccgacttttacattacccctactaaaaatgaagaagtacaagcagttgttaaatatgcctatcaaaatgagattcctgttacatatttaggaaatggctcaaatattattatccgtgaaggtggtattcgcggtattgtaattagtttattatcactagatcatatcgaagtatctgatgatgcgataatagccggtagcggcgctgcaattattgatgtctcacgtgttgctcgtgattacgcacttactggccttgaatttgcatgtggtattccaggttcaattggtggtgcagtgtatatgaatgctggcgcttatggtggcgaagttaaagattgtatagactatgcgctttgcgtaaacgaacaaggctcgttaattaaacttacaacaaaagaattagagttagattatcgtaatagcattattcaaaaagaacacttagttgtattagaagctgcatttactttagctcctggtaaaatgactgaaatacaagctaaaatggatgatttaacagaacgtagagaatctaaacaacctttagagtatccttcatgtggtagtgtattccaaagaccgcctggtcattttgcaggtaaattgatacaagattctaatttgcaaggtcaccgtattggcggcgttgaagtttcaaccaaacacgctggttttatggtaaatgtagacaatggaactgctacagattatgaaaaccttattcattatgtacaaaagaccgtcaaagaaaaatttggcattgaattaaatcgtgaagttcgcattattggtgaacatccaaaggaatcg

SEQ ID NO: 3042 - protein, 307 aa, Staphylococcus aureus
  MISC_FEATURE (1)..(307): hypothetical protein
VINKDIYQALQQLIPNEKIKVDEPLKRYTYTKTGGNADFYITPTKNEEVQAVVKYAYQNEIPVTYLGNGSNIIIREGGIRGIVISLLSLDHIEVSDDAIIAGSGAAIIDVSRVARDYALTGLEFACGIPGSIGGAVYMNAGAYGGEVKDCIDYALCVNEQGSLIKLTTKELELDYRNSIIQKEHLVVLEAAFTLAPGKMTEIQAKMDDLTERRESKQPLEYPSCGSVFQRPPGHFAGKLIQDSNLQGHRIGGVEVSTKHAGFMVNVDNGTATDYENLIHYVQKTVKEKFGIELNREVRIIGEHPKES

SEQ ID NO: 3043 - DNA, 120 bp, Staphylococcus aureus
gtgcttttcaaactcattatggcacttatagcatggatagtatttattacaacatttaaatttaatagcaataatatcttcttcggtaaaataatggcgacagcgtgtttcagtatcgat

SEQ ID NO: 3044 - protein, 40 aa, Staphylococcus aureus
VLFKLIMALIAWIVFITTFKFNSNNIFFGKIMATACFSID

SEQ ID NO: 3045 - DNA, 318 bp, Staphylococcus aureus
ttgtctatgcctaaagtttatggttcattaatcgatactgaaacacgctgtcgccattattttaccgaagaagatattattgctattaaatttaaatgttgtaataaatactatccatgctataagtgccataatgagtttgaaaagcacgccattaagcgttggtctgagccttcatttaacgaaaaagcaatcttatgcggtgtatgcaaacacgaattaacaatcaatgaatatatgatggtagagcgttgtccaaattgccaatctcggtttaacaatcgctgtaaatatcactatcatatttattttgaaatt

SEQ ID NO: 3046 - protein, 106 aa, Staphylococcus aureus
  MISC_FEATURE (1)..(106): conserved hypothetical
LSMPKVYGSLIDTETRCRHYFTEEDIIAIKFKCCNKYYPCYKCHNEFEKHAIKRWSEPSFNEKAILCGVCKHELTINEYMMVERCPNCQSRFNNRCKYHYHIYFEI

SEQ ID NO: 3047 - DNA, 1026 bp, Staphylococcus aureus
atgaagaaaacagtcttatatttagtattagcagtaatgtttttattagcggcatgcggtaacaattctgataaagaacaatcaaaatcagaaactaaaggttctaaagatacagtaaaaattgaaaataactataaaatgcgtggcgagaaaaaagatggtagtgacgctaaaaaagttaaagaaactgttgaagtaccaaaaaatcctaaaaatgcagttgtgttagactatggcgcattagatgtaatgaaagaaatgggcttatcagataaagtaaaagcattacctaaaggggaaggcggtaagtcattaccgaatttcttagaatcatttaaagatgataaatatacaaacgttggtaatttaaaagaagtgaattttgataaaattgctgcgacgaaacccgaagtaatctttatctctggacgtacagctaatcaaaagaatttagatgaattcaaaaaagctgcacctaaagcgaaaattgtttatgttggtgcagatgaaaagaacttaattggttcaatgaaacaaaacactgaaaatatcggaaaaatttacgataaagaagataaagctaaagaattaaataaagatttagataacaaaattgcttcaatgaaagataaaacgaaaaacttcaataaaactgttatgtatttactagttaacgaaggtgaattatcaacatttggacctaaaggtcgttttggtggattagtttacgatacattaggattcaatgcagttgataaaaaagtaagtaatagcaatcatggacaaaatgtttctaacgaatatgttaataaagaaaatccagatgttattttagcgatggatagaggtcaagcgataagtggtaaatcaactgcgaaacaagcattaaataatcctgtattaaaaaatgttaaagcaattaaagaagacaaagtatataatttagatcctaaattatggtactttgcagctggatcaactacaactacaattaaacaaattgaggaacttgataaagttgtaaaa

SEQ ID NO: 3048 - protein, 342 aa, Staphylococcus aureus
  MISC_FEATURE (1)..(342): lipoprotein [Staphylococcus
MKKTVLYLVLAVMFLLAACGNNSDKEQSKSETKGSKDTVKIENNYKMRGEKKDGSDAKKVKETVEVPKNPKNAVVLDYGALDVMKEMGLSDKVKALPKGEGGKSLPNFLESFKDDKYTNVGNLKEVNFDKIAATKPEVIFISGRTANQKNLDEFKKAAPKAKIVYVGADEKNLIGSMKQNTENIGKIYDKEDKAKELNKDLDNKIASMKDKTKNFNKTVMYLLVNEGELSTFGPKGRFGGLVYDTLGFNAVDKKVSNSNHGQNVSNEYVNKENPDVILAMDRGQAISGKSTAKQALNNPVLKNVKAIKEDKVYNLDPKLWYFAAGSTTTTIKQIEELDKVVK

SEQ ID NO: 3049 - DNA, 759 bp, Staphylococcus aureus
atgattcaagttgaaaatttaactaaaactataaataatcaaatgatattggaagatattagcatagatatcgaaaaaggtaaattgacttctttaattggacctaatggtgcgggtaagagtactttactttcagcgatatgtaggttaattcgttttgagaacggtgaagtgaaaatagatggacagctcatgtctgattataaaaataatgacttgtcgaaaaaaatatctatattaaaacaaacaaaccatactgaaatgaatattacggtagagcagttggtaaactttggacgattcccttattctaaaggtcgtttgacgaaagaggatcatgatattgtcaatgatgcgctagatttgttgcaactacaagatatcagaaatcgtaatattaagtcattatctggtggacaacgtcagcgtgcatacattgcaatgacaatagcacaagatactgaatatattttgctagatgaaccattaaataatttagatatgaagcatgctgttcaaattatgcaaacgttaaaaatgttagcgcataaaatgaataaagcgattgtcattgtgttacatgatattaactttgcgtcctgttattcagatcagattgtagcattgaaaaacggacaactagttaagtcagatttgaaagataatgtcattcaaagtagtgttttaagtgatttatatgacatgaatattcaaattgaacatataagaaatcaaaggatttgtttatattttaaggat

SEQ ID NO: 3050 - protein, 253 aa, Staphylococcus aureus
  MISC_FEATURE (1)..(253): hypothetical protein
MIQVENLTKTINNQMILEDISIDIEKGKLTSLIGPNGAGKSTLLSAICRLIRFENGEVKIDGQLMSDYKNNDLSKKISILKQTNHTEMNITVEQLVNFGRFPYSKGRLTKEDHDIVNDALDLLQLQDIRNRNIKSLSGGQRQRAYIAMTIAQDTEYILLDEPLNNLDMKHAVQIMQTLKMLAHKMNKAIVIVLHDINFASCYSDQIVALKNGQLVKSDLKDNVIQSSVLSDLYDMNIQIEHIRNQRICLYFKD

SEQ ID NO: 3051 - DNA, 954 bp, Staphylococcus aureus
atgcgcaacaataataaaaaaataatgcttttaattgcagtaacgttattaattagtatgctgtacttatttgtaggtattgattttgaaatatttgaatatcaattttcaagtcgtttaagaaagttcatattaattattttagtaggtgctgccattgcaacttcagtggtgatttttcaagcgattacaaataaccgtctattgacaccatcaataatggggttagatgcagtttatttatttatcaaagtattgccagtctttttatttggaattcaatcggtatgggttactaatgtatatttgaactttatattaacacttataacgatggtgttattcgcactaatcctattccaaggtatctttaaaatcggacatttttcaatttattttatcttacttattggtgtccttttaggaacattttttagaagcataacaggttttattcaactgattatggatcctgagtcatttttagcaatacaaagtagtatgtttgctaattttaatgcttctaattcgaatttagttactttctcagcagtgctattagtaatcttattagtcattacaattttactattgccttatttagatgtattgcttttaggtcgtgctgaagcaattaatcttgggatatcgtatgaaaaattaacgcgaattctacttgtaatagtctcagttttagtttctgtgtcaactgcattagtaggaccaattacatttttaggtttattaactgtaaatctagcgcatgaactaatgaagacgtatgaacataagtatattttaattgcgacaatttgcttgagttggattagtttatttagtgcgcaatgggtagttgaaagtgtgtttgaagctacgacagaaatgagtatacttattgatttgattggtggaagttatttcatttatctattagttagaaggagaaatgcgcaa

SEQ ID NO: 3052 - protein, 318 aa, Staphylococcus aureus
  MISC_FEATURE (1)..(318): hypothetical protein
MRNNNKKIMLLIAVTLLISMLYLFVGIDFEIFEYQFSSRLRKFILIILVGAAIATSVVIFQAITNNRLLTPSIMGLDAVYLFIKVLPVFLFGIQSVWVTNVYLNFILTLITMVLFALILFQGIFKIGHFSIYFILLIGVLLGTFFRSITGFIQLIMDPESFLAIQSSMFANFNASNSNLVTFSAVLLVILLVITILLLPYLDVLLLGRAEAINLGISYEKLTRILLVIVSVLVSVSTALVGPITFLGLLTVNLAHELMKTYEHKYILIATICLSWISLFSAQWVVESVFEATTEMSILIDLIGGSYFIYLLVRRRNAQ

SEQ ID NO: 3053 - DNA, 1011 bp, Staphylococcus aureus
atgataatgattatcattaatttaaagggagaaaaatttgtaatgaagtatttattaaagggaaatattttgcttctattactaatattgttgacaattatttcgttgttcataggtgtgagtgaactatcaattaaagatttactacatttaactgagtcacagcggaatattttattctcaagccgaataccaaggacgatgagtattttaattgctggaagttcgttggctttagcaggcttgataatgcaacaaatgatgcaaaataagtttgttagtccgactacagctggaacgatggaatgggctaaactaggtattttaattgctttattgttctttccaaccggtcatattttattaaaactagtatttgctgttatttgcagtatttgcggtacgtttttatttgttaaaatcattgattttataaaagtgaaagatgtcatttttgtaccgcttttaggaattatgatgggtgggattgttgcaagtttcacaaccttcatctcattgcgcacgaatgctgttcaaagcattggtaactggcttaacgggaactttgccattatcacaagtggacgctatgaaattttatatttaagtattcctcttttagcattgacatatctttttgctaatcatttcacgattgtaggaatgggtaaagactttactaataatttaggtttgagttacgaaaaattaattaacatcgcattgtttattactgcaactattacagcattggtagtggtgactgttggaacattaccgttcttaggactagtaataccaaatattatttcaatttatcgaggtgatcatttgaaaaatgctatccctcatacgatgatgttaggtgccatctttgtattattttctgatatagttggcagaattgttgtttatccatatgaaataaatattggtttaacaataggtgtatttggaacaatcattttccttatcttgcttatgaaaggtaggaaaaattatgcgcaacaa

SEQ ID NO: 3054 - protein, 337 aa, Staphylococcus aureus
  MISC_FEATURE (1)..(337): hypothetical protein
MIMIIINLKGEKFVMKYLLKGNILLLLLILLTIISLFIGVSELSIKDLLHLTESQRNILFSSRIPRTMSILIAGSSLALAGLIMQQMMQNKFVSPTTAGTMEWAKLGILIALLFFPTGHILLKLVFAVICSICGTFLFVKIIDFIKVKDVIFVPLLGIMMGGIVASFTTFISLRTNAVQSIGNWLNGNFAIITSGRYEILYLSIPLLALTYLFANHFTIVGMGKDFTNNLGLSYEKLINIALFITATITALVVVTVGTLPFLGLVIPNIISIYRGDHLKNAIPHTMMLGAIFVLFSDIVGRIVVYPYEINIGLTIGVFGTIIFLILLMKGRKNYAQQ

SEQ ID NO: 3055 - DNA, 153 bp, Staphylococcus aureus
gtgttctattttactttaagtaaacaaaatacacattccgaaaaattaaatttcagtttaattgcaaatatcaataaaattgacactaaattatttgaaaggctattgaaattatggtcaaaaaacgctactattaatgagaaatattatcaa

SEQ ID NO: 3056 - protein, 51 aa, Staphylococcus aureus
VFYFTLSKQNTHSEKLNFSLIANINKIDTKLFERLLKLWSKNATINEKYYQ

SEQ ID NO: 3057 - DNA, 102 bp, Staphylococcus aureus
atgtacaatgctatttatattggcagtagttggcggggccccaacacagaagcaggcggaaagtcagctaacaatattgtgcaagttggcggggccccaaca

SEQ ID NO: 3058 - protein, 34 aa, Staphylococcus aureus
MYNAIYIGSSWRGPNTEAGGKSANNIVQVGGAPT

SEQ ID NO: 3059 - DNA, 669 bp, Staphylococcus aureus
atgcctgacttaacacctttttggatatcaatacgagttgctgtaatcagtacgattattgtaacggttttaggtatttttatatctaaatggttgtatcgtcgtaagggttcgtgggttaaagtattggaaagtttattgatattacctattgttttgccgccaacggtattaggttttattctattaatcatcttctcgccaagaggaccaatcggtcaattctttgcgaatgtactacatttacctgtagtgttcactttgacaggtgctgtgatagcatctgtcattgttagttttccactaatgtatcaacatactgtgcaaggcttcagaggtatagacacgaaaatgattaatacagctagaacgatgggagcaagtgaaacgaaaattttcctcaaattaattttaccattagctaaacgctctattttagcaggtataatgatgagttttgctcgtgcattaggtgagtttggtgctacattaatggttgcaggatatattccaaataaaacgaatacactacctttagaaatatacttcttagtggaacaaggtagagaaaatgaagcgtggttatgggtattagtgctagtcgcattctctattgtggttatatctacaattaatttattgaataaagataaatataaggaggtcgac

SEQ ID NO: 3060 - protein, 223 aa, Staphylococcus aureus
  MISC_FEATURE (1)..(223): probable molybdenum
MPDLTPFWISIRVAVISTIIVTVLGIFISKWLYRRKGSWVKVLESLLILPIVLPPTVLGFILLIIFSPRGPIGQFFANVLHLPVVFTLTGAVIASVIVSFPLMYQHTVQGFRGIDTKMINTARTMGASETKIFLKLILPLAKRSILAGIMMSFARALGEFGATLMVAGYIPNKTNTLPLEIYFLVEQGRENEAWLWVLVLVAFSIVVISTINLLNKDKYKEVD

SEQ ID NO: 3061 - DNA, 969 bp, Staphylococcus aureus
atgatagctgttaattggaacacacaagaagatatgacgaatatgttttggagacaaaatatatctcaaatgtgggttgaaacagaatttaaagtatcaaaagacattgcaagttggaagactttatctgaagctgaacaagacacatttaaaaaagcattagctggtttaacaggcttagatacacatcaagcagatgatggcatgcctttagttatgctacatacgactgacttaaggaaaaaagcagtttattcatttatggcgatgatggagcaaatacacgcgaaaagctattcacatattttcacaacactattaccatctagtgaaacaaactacctattagatgaatgggttttagaggaaccccatttaaaatataaatctgataaaattgttgctaattatcacaaactttggggtaaagaagcttcgatatacgaccaatatatggccagagttacgagtgtatttttagaaacattcttattcttctcaggtttctattatccactatatcttgctggtcaagggaaaatgacgacatcaggtgaaatcattcgtaaaattcttttagatgaatctattcatggtgtatttaccggtttagatgcacagcatttacgaaatgaactatctgaaagtgagaaacaaaaagcagatcaagaaatgtataaattgctaaatgacttgtatttaaatgaagagtcatacacaaaaatgttatacgatgatcttggaatcactgaagatgtgctaaactatgttaaatataatggaaacaaagcactttcaaacttaggctttgaaccttattttgaggaacgtgaatttaacccaatcattgagaatgccttagatacaacaactaaaaaccatgacttcttctcagtaaaaggtgatggttatgtattagcattaaacgtagaagcattacaagatgatgactttgtatttgacaacaaa

SEQ ID NO: 3062 - protein, 323 aa, Staphylococcus aureus
  MISC_FEATURE (1)..(323): ribonucleoside-diphosphate
MIAVNWNTQEDMTNMFWRQNISQMWVETEFKVSKDIASWKTLSEAEQDTFKKALAGLTGLDTHQADDGMPLVMLHTTDLRKKAVYSFMAMMEQIHAKSYSHIFTTLLPSSETNYLLDEWVLEEPHLKYKSDKIVANYHKLWGKEASIYDQYMARVTSVFLETFLFFSGFYYPLYLAGQGKMTTSGEIIRKILLDESIHGVFTGLDAQHLRNELSESEKQKADQEMYKLLNDLYLNEESYTKMLYDDLGITEDVLNYVKYNGNKALSNLGFEPYFEEREFNPIIENALDTTTKNHDFFSVKGDGYVLALNVEALQDDDFVFDNK

SEQ ID NO: 3063 - DNA, 2103 bp, Staphylococcus aureus
atgaaaaccatggaagagaaaaagtacaatcatattgaattaaataatgaggtcactaaacgaagagaagatggattctttagtttagaaaaagaccaagaagctttagtagcttatttagaagaagtaaaagacaaaacaatcttcttcgacactgaaatcgagcgtttacgttatttagtagacaacgatttttatttcaatgtgtttgatatttatagtgaagcggatctaattgaaatcactgattatgcaaaatcaatcccgtttaattttgcaagttatatgtcagctagtaaatttttcaaagattacgctttgaaaacaaatgataaaagtcaatacttagaagactataatcaacacgttgccattgttgctttatacctagcaaatggtaataaagcacaagctaaacaatttatttctgctatggttgaacaaagatatcaaccagcgacaccaacatttttaaacgcaggccgtgcgcgtcgtggtgagctagtgtcatgtttcttattagaagtggatgacagcttaaattcaattaactttattgattcaactgcaaaacaattaagtaaaattgggggcggcgttgcaattaacttatctaaattgcgtgcacgtggtgaagcaattaaaggaattaaaggcgtagcgaaaggcgttttacctattgctaagtcacttgaaggtggctttagctatgcagatcaacttggtcaacgccctggtgctggtgctgtgtacttaaatatcttccattatgatgtagaagaatttttagatactaaaaaagtaaatgcggatgaagatttacgtttatctacaatatcaactggtttaattgttccatctaaattcttcgatttagctaaagaaggtaaggacttttatatgtttgcacctcatacagttaaagaagaatatggtgtgacattagacgatatcgatttagaaaaatattatgatgacatggttgcaaacccaaatgttgagaaaaagaaaaagaatgcgcgtgaaatgttgaatttaattgcgcaaacacaattacaatcaggttatccatatttaatgtttaaagataatgctaacagagtgcatccgaattcaaacattggacaaattaaaatgagtaacttatgtacggaaattttccaactacaagaaacttcaattattaatgactatggtattgaagacgaaattaaacgtgatatttcttgtaacttgggctcattaaatattgttaatgtaatggaaagcggaaaattcagagattcagttcactctggtatggacgcattaactgttgtgagtgatgtagcaaatattcaaaatgcaccaggagttagaaaagctaacagtgaattacattcagttggtcttggtgtgatgaatttacacggttacctagcaaaaaataaaattggttatgagtcagaagaagcaaaagattttgcaaatatcttctttatgatgatgaatttctactcaatcgaacgttcaatggaaatcgctaaagagcgtggtatcaaatatcaagactttgaaaagtctgattatgctaatggcaaatatttcgagttctatacaactcaagaatttgaacctcaattcgaaaaagtacgtgaattattcgatggtatggctattcctacttctgaggattggaagaaactacaacaagatgttgaacaatatggtttatatcatgcatatagattagcaattgctccaacacaaagtatttcttatgttcaaaatgcaacaagttctgtaatgccaatcgttgaccaaattgaacgtcgtacttatggtaatgcggaaacattttaccctatgccattcttatcaccacaaacaatgtggtactacaaatcagcattcaatactgatcagatgaaattaatcgatttaattgcgacaattcaaacgcatattgaccaaggtatctcaacgatcctttatgttaattctgaaatttctacacgtgagttagcaagattatatgtatatgcgcactataaaggattaaaatcactttactatactagaaataaattattaagtgtagaagaatgtacaagttgttctatc

SEQ ID NO: 3064 - protein, 701 aa, Staphylococcus aureus
  MISC_FEATURE (1)..(701): ribonuceloside diphosphate
MKTMEEKKYNHIELNNEVTKRREDGFFSLEKDQEALVAYLEEVKDKTIFFDTEIERLRYLVDNDFYFNVFDIYSEADLIEITDYAKSIPFNFASYMSASKFFKDYALKTNDKSQYLEDYNQHVAIVALYLANGNKAQAKQFISAMVEQRYQPATPTFLNAGRARRGELVSCFLLEVDDSLNSINFIDSTAKQLSKIGGGVAINLSKLRARGEAIKGIKGVAKGVLPIAKSLEGGFSYADQLGQRPGAGAVYLNIFHYDVEEFLDTKKVNADEDLRLSTISTGLIVPSKFFDLAKEGKDFYMFAPHTVKEEYGVTLDDIDLEKYYDDMVANPNVEKKKKNAREMLNLIAQTQLQSGYPYLMFKDNANRVHPNSNIGQIKMSNLCTEIFQLQETSIINDYGIEDEIKRDISCNLGSLNIVNVMESGKFRDSVHSGMDALTVVSDVANIQNAPGVRKANSELHSVGLGVMNLHGYLAKNKIGYESEEAKDFANIFFMMMNFYSIERSMEIAKERGIKYQDFEKSDYANGKYFEFYTTQEFEPQFEKVRELFDGMAIPTSEDWKKLQQDVEQYGLYHAYRLAIAPTQSISYVQNATSSVMPIVDQIERRTYGNAETFYPMPFLSPQTMWYYKSAFNTDQMKLIDLIATIQTHIDQGISTILYVNSEISTRELARLYVYAHYKGLKSLYYTRNKLLSVEECTSCSI

SEQ ID NO: 3065 - DNA, 417 bp, Staphylococcus aureus
ttgaagaaagaaggtgatccaatgaaaataatatatttttcatttactggaaatgtccgtcgttttattaagagaacagaacttgaaaatacgcttgagattacagcagaaaattgtatggaaccagttcatgaaccgtttattatcgttactggcactattggatttggagaagtaccagaacccgttcaatcttttttagaagttaatcatcaatacatcagaggtgtggcagctagcggtaatcgaaattggggactaaatttcgcaaaagcgggtcgcacgatatcagaagagtataatgtccctttattaatgaagtttgagttacatggaaaaaacaaagacgttattgaatttaagaacaaggtgggtaattttaatgaaaaccatggaagagaaaaagtacaatcatat

SEQ ID NO: 3066 - protein, 139 aa, Staphylococcus aureus
  MISC_FEATURE (1)..(139): NrdI protein involved in
LKKEGDPMKIIYFSFTGNVRRFIKRTELENTLEITAENCMEPVHEPFIIVTGTIGFGEVPEPVQSFLEVNHQYIRGVAASGNRNWGLNFAKAGRTISEEYNVPLLMKFELHGKNKDVIEFKNKVGNFNENHGREKVQSY

SEQ ID NO: 3067 - DNA, 864 bp, Staphylococcus aureus
ttgaatcctaaagtaaaaggtatcattgccattttaatttcggctattggtttcagttttatgtcagtgtttttcagacttgcaggtgaccttcctgtttttcaaaaatcattagcacgaaacttagtagcaatgtttattccattattttttatatataaataccatcagccaatgtttggcagactttcaagtcaacccttattaataacacgatcaacacttggacttattggtgtattgttaaatatttatgccattgatcatatggtacttagtgatgccgattcattaatgaaactcaatcctttctggacgattttattaagcattgttttcttacatgaaaaggtaaggaagtatcaaattacagcaatgataattgctattttaggtatgcttttaatagtgaaacctgaattttcatcatctatgattccatcattagctggcttattctcaggtatttttgcagcatcagcatatacatgtgttcgagcacttagtacaagagaagcaccatatactatagtattttacttctccttattttctgtcatcgttttaatacctttcactgcatatacttatgaaccaatgagtcagatgcaaatactttatctattaggggctggcttagctgccgctgtgggtcaaattggtgttactttagcatatagttttgcagcagcaaaagatatttctatttttacgtatgcatctataattttcacagcaatacttggatttattctattcggagaatctccagatttctatgcaacattaggttacgtcgttattatcggtgcaagttattacatgtttgaaaaagcacgccgagacgccaaaataataaaaaaa

SEQ ID NO: 3068 - protein, 288 aa, Staphylococcus aureus
  MISC_FEATURE (1)..(288): conserved hypothetical
LNPKVKGIIAILISAIGFSFMSVFFRLAGDLPVFQKSLARNLVAMFIPLFFIYKYHQPMFGRLSSQPLLITRSTLGLIGVLLNIYAIDHMVLSDADSLMKLNPFWTILLSIVFLHEKVRKYQITAMIIAILGMLLIVKPEFSSSMIPSLAGLFSGIFAASAYTCVRALSTREAPYTIVFYFSLFSVIVLIPFTAYTYEPMSQMQILYLLGAGLAAAVGQIGVTLAYSFAAAKDISIFTYASIIFTAILGFILFGESPDFYATLGYVVIIGASYYMFEKARRDAKIIKK

SEQ ID NO: 3069 - DNA, 498 bp, Staphylococcus aureus
atggcacatggccgtcaacaagatgaattacaagatataactttattaggaaatcaagacaatacttacaattttgactatcgtcctgatgtattagaatcgtttgataataagcatcaaggtcgtgactatttcgtaaaattcaactgtccagaatttacatcattatgtccaattactgggcaaccagattttgcaactatctatatttcatatattccaaatgttaaaatggttgaatcaaaatctttgaaattatacttatttagtttcagaaatcacggtgattttcacgaagattgtatgaatattattatgaatgatttgatagagcttatggacccacattatattgaagtctggggcaagttcacaccacgtggtggaatttctattgatccttatacaaactatggacgtccaaattctaaatatgaaaaaatggctgagcatcgtttgatgaatcatgatttatatcccgaaaaaatagataatcgt

SEQ ID NO: 3070 - protein, 166 aa, Staphylococcus aureus
  MISC_FEATURE (1)..(166): conserved hypothetical
MAHGRQQDELQDITLLGNQDNTYNFDYRPDVLESFDNKHQGRDYFVKFNCPEFTSLCPITGQPDFATIYISYIPNVKMVESKSLKLYLFSFRNHGDFHEDCMNIIMNDLIELMDPHYIEVWGKFTPRGGISIDPYTNYGRPNSKYEKMAEHRLMNHDLYPEKIDNR

SEQ ID NO: 3071 - DNA, 1503 bp, Staphylococcus aureus
atgacacaacaaaactcccatggaaatcaaattcaagacatacctcaaacaggatttttcgggcatcctcgaggactaggcgtactcttctttgtagagttctgggaaaggtttagttattatggcatgcgtgccctactcattttctacatgtactttgccgtaacagataatggccttggaattgataaaacaacagctatgtcaattatgtcagtttatggttcattaatctatatgacatcaataccaggcggatggattgctgacagaattacaggcactagaggcgctactttattaggtgcagtctttattattatcggacatatttgtttaagcttaccatttgcattaatcggcttattcacatcaatgttcttcatcattattggttcaggtttaatgaagccaaacatttcaaatatcgttggccgtttatatcctgaaaatgatagacgtatggatgcaggttttgttattttctatatgtcagttaatatgggtgcattattatcacctattattttgcaacactttgttaatgttaaaaacttccacggcggattcttgattgcagcagttggtatggcattaggtttagtatggtatgtacttttcaaccgcaaaaacttaggtagcgttggtatgaaacctactaacccattgacaccagctgaaaagaaaaagtatggtcttattatcggaagtgttgttttagcaattgtattaattatcgttattggtgcattaactaactcattatcatttaacttagttagtaatactgttttagtattaggtattgcattaccaatcatttacttcactttaattattagaagtaaagatgtcactgatactgaacgttctcgtgttaaagcatttattccattatttattcttggaatggtgttctgggctattcaagaacaagggtctaatgtattaaacatatatggaattgaacattcagatatgaaattaaacttatttggttggaaaacaaactttggtgaagcgatcttccaatcaattaacccattatttattttattactagctccaattatttcacttttatggcaaaagcttggaactaaacaacctagcctgccagtaaaatttgcaattggtacgttcttagcaggtgcgtcatacatactaattggtattgtaggttatgcatcaggttcatcaaacttttcagttaactgggttattttatcgtacattatttgtgttatcggtgagctatgcttatcaccaacgggtaatagtgctgctgttaagttagcacctaaagcatttaatgcccaaatgatgagtatttggtacttaactaacgcttctgcacaagcaatcaatggtactttagttaagttaatagaaccactaggtcaaacaaattactttattttcctaggtgttgttgcaattattgttacaacaattgtattagcattctcacctttaatcatcaaagcgatgaaaggtatacgt

SEQ ID NO: 3072 - protein, 501 aa, Staphylococcus aureus
  MISC_FEATURE (1)..(501): hypothetical protein
MTQQNSHGNQIQDIPQTGFFGHPRGLGVLFFVEFWERFSYYGMRALLIFYMYFAVTDNGLGIDKTTAMSIMSVYGSLIYMTSIPGGWIADRITGTRGATLLGAVFIIIGHICLSLPFALIGLFTSMFFIIIGSGLMKPNISNIVGRLYPENDRRMDAGFVIFYMSVNMGALLSPIILQHFVNVKNFHGGFLIAAVGMALGLVWYVLFNRKNLGSVGMKPTNPLTPAEKKKYGLIIGSVVLAIVLIIVIGALTNSLSFNLVSNTVLVLGIALPIIYFTLIIRSKDVTDTERSRVKAFIPLFILGMVFWAIQEQGSNVLNIYGIEHSDMKLNLFGWKTNFGEAIFQSINPLFILLLAPIISLLWQKLGTKQPSLPVKFAIGTFLAGASYILIGIVGYASGSSNFSVNWVILSYIICVIGELCLSPTGNSAAVKLAPKAFNAQMMSIWYLTNASAQAINGTLVKLIEPLGQTNYFIFLGVVAIIVTTIVLAFSPLIIKAMKGIR

SEQ ID NO: 3073 - DNA, 915 bp, Staphylococcus aureus
atggaaaataaatatacacatggtgtcctcttttaccatgaacacagtggattaaaaaatattaatcaaggtattggggaagttacaacagcattaagttcaatttgtaagcatctttctattcaattgagtgaaaacgaaggtgacattattaaatattgccaagaaatcaaaactaaaaactatgcaaaagatgtagatatattatttattcttggcggtgatggcacggttaacgaacttataaacggtgttatgacacatgaccttcaactccctattggcattttaccaggcggtacttttaatgattttacaaaaacgctaaatatagcacctaatcataaacaagctagtgaacaaatgatttctgcacaagttggtacatacgatgtaattaaaataaataatcaatatgcactcaactttgttggcttaggtctcattgttcaaaacgctgaaaacgtacaagatggttcaaaagatatatttggtaaattgagttatattggatcaactgtcaaaacactgctaaatccaacacaatttaattatcaattatcaatagatgataagacatattctggcgaaacgaccatgatactaacagcaaatggtccattcattggtggtagtcgtataccattgactgatttgtctcctcaagatggtgaactgaacactttcatttttaatgaacaaagtttcagtattttaaatgatatttttaaaaagcgtgatagcatgaattggaatgaaattactcaaggtattgagcatatacctggtaaaaagatttcacttacaacagatccagcaatgaaagttgatattgatggcgaaatttcattagaaacacctattgatattgaggttataccaaatgccattcagttacttactgtcaatgatttg

SEQ ID NO: 3074 - protein, 305 aa, Staphylococcus aureus
  MISC_FEATURE (1)..(305): hypothetical protein
MENKYTHGVLFYHEHSGLKNINQGIGEVTTALSSICKHLSIQLSENEGDIIKYCQEIKTKNYAKDVDILFILGGDGTVNELINGVMTHDLQLPIGILPGGTFNDFTKTLNIAPNHKQASEQMISAQVGTYDVIKINNQYALNFVGLGLIVQNAENVQDGSKDIFGKLSYIGSTVKTLLNPTQFNYQLSIDDKTYSGETTMILTANGPFIGGSRIPLTDLSPQDGELNTFIFNEQSFSILNDIFKKRDSMNWNEITQGIEHIPGKKISLTTDPAMKVDIDGEISLETPIDIEVIPNAIQLLTVNDL

SEQ ID NO: 3075 - DNA, 540 bp, Staphylococcus aureus
atgacccgtaaatcaatcgcgattgatatggatgaagtattggcagatacattaggagaaatcattgatgctgtcaattttagagcggatttaggtattaaaatggaagctttgaatggtcaaaaacttaaacatgttattcctgaacatgatggattaattacagaagtattgagagaaccaggcttcttcagacatcttaaagtgatgccgtatgcacaagaagttgtgaaaaaattaactgaacattatgatgtatatattgctacagcagcaatggatgtaccaacatcatttagtgataaatatgaatggttactagagttctttccatttttagatcctcagcattttgttttttgtggtagaaaaaacatcgttaaagctgattatttaatagatgacaatcctagacagcttgaaatttttactggtacaccgattatgtttacagcagtgcataatattaatgatgatcgatttgaacgcgtaaatagctggaaagatgtagaacagtattttttagataatattgagaaa

SEQ ID NO: 3076 - protein, 180 aa, Staphylococcus aureus
  MISC_FEATURE (1)..(180): conserved hypothetical
MTRKSIAIDMDEVLADTLGEIIDAVNFRADLGIKMEALNGQKLKHVIPEHDGLITEVLREPGFFRHLKVMPYAQEVVKKLTEHYDVYIATAAMDVPTSFSDKYEWLLEFFPFLDPQHFVFCGRKNIVKADYLIDDNPRQLEIFTGTPIMFTAVHNINDDRFERVNSWKDVEQYFLDNIEK

SEQ ID NO: 3077 - DNA, 1152 bp, Staphylococcus aureus
gtgaaaatagtagcattgcattttagaaacatagagcgatataatgaatataagttttttgaaatttcagttaattctaaggaggttgtttttattatgaaagaacaacttaatcaactatcagcatatcagcctggtttatctccaagggcattgaaagaaaagtatggcattgaaggagatttatataaacttgcatcaaatgaaaatttgtatggaccatcgcctaaagttaaagaagcgatatcagcacacttagatgagttatattattatcctgaaacaggatcaccgacattaaaagcggcgattagtaaacatttaaatgtagatcaatcacgcattttatttggtgcgggattagatgaagttatattaatgatttctagagctgtattaacgccaggggatactattgttacaagtgaagcgacattcggtcaatattatcacaatgcgattgttgaatcagctaatgtgatacaagtacctttaaaagatggtggcttcgatttagaaggtattttaaaagaagttaatgaagatacgtcattggtatggttatgtaatccaaataatcctacaggtacatattttaatcatgagagcttagattcgtttttatctcaagtacctccacatgtaccagtaattatagatgaagcttattttgaatttgtgacagcagaggactacccggatacacttgctttgcaacaaaaatatgacaatgctttcttattacgtacattttcaaaggcgtatggattagcgggtttacgtgtaggatatgtggtagcaagtgaacatgcgattgaaaaatggaacatcattagaccaccatttaatgtgacacgtatatctgaatacgcagcagttgcagcacttgaagatcaacaatatttaaaagaggtaacacataaaaatagtgttgaacgcgaaagattttatcaattacctcaaagtgagtatttcttgccaagtcaaacgaattttatatttgtaaaaacaaagcgggtaaatgaactttatgaagcacttttaaatgtagggtgtattacgcgaccatttccaactggtgttagaattacaattggttttaaagaacaaaatgataaaatgttagaagttttatcaaactttaaatacgaa

SEQ ID NO: 3078 - protein, 384 aa, Staphylococcus aureus
  MISC_FEATURE (1)..(384): hypothetical protein
VKIVALHFRNIERYNEYKFFEISVNSKEVVFIMKEQLNQLSAYQPGLSPRALKEKYGIEGDLYKLASNENLYGPSPKVKEAISAHLDELYYYPETGSPTLKAAISKHLNVDQSRILFGAGLDEVILMISRAVLTPGDTIVTSEATFGQYYHNAIVESANVIQVPLKDGGFDLEGILKEVNEDTSLVWLCNPNNPTGTYFNHESLDSFLSQVPPHVPVIIDEAYFEFVTAEDYPDTLALQQKYDNAFLLRTFSKAYGLAGLRVGYVVASEHAIEKWNIIRPPFNVTRISEYAAVAALEDQQYLKEVTHKNSVERERFYQLPQSEYFLPSQTNFIFVKTKRVNELYEALLNVGCITRPFPTGVRITIGFKEQNDKMLEVLSNFKYE

SEQ ID NO: 3079 - DNA, 1512 bp, Staphylococcus aureus
atgactaactttttcgacatattgagtgaacgtaaggggcaactcttttcgacaatgatagaacatattcaaatatcatttatcgcattattgattgcaactgctattgcggtaccattaggtattttattaacgaagactaaaacgatatctgaaatcgtaatgaatattgcggcaattcttcaaaccataccatcgttggcattattaggtttaatgattcctttatttggtatcggtcgtgtgccagcaattattgcacttgtagtgtatgcgttgttaccaattttaaggaatacgtatactggaattaaagaagttgatccatcactcattgaagcggctaaaggtataggtatgaaaccatttagacgtttaactaaagtcgaacttccgatagcaatgcctgttataatggctggtgtaagaacggctatggtattaattataggtacagcaacactagcagcattaattggtgcaggcggactaggagatttaattttattaggtatagaccgtaacaatgcatcgttgatattattaggtgcaattccagcagccttattggcaattatatttgatttaattttaagatttatggctaaattatcttataaaaagttattgatgacgttaggtgttatagtgatgattattatactggctatcgctattcctatgtttgcacaaaaaggtgataaaattacgttagctggaaagcttggctccgagccatcgattattacaaatatgtataaaattttaatagaagaagagaccaaaaatactgtagaagtgaaagatggtatgggcaaaacagcatttttatttaatgctttaaaatctgacgatatagatgggtatttagaatttactggaacagttttaggtgaattaacaaaagaaccattgaagtcaaaagaagagaaaaaagtttatgaacaagctaagcaaagtcttgaaaagaaatatcaaatgactatgttaaaaccaatgaagtataacaatacgtatgctttagctgtaaaacgtgattttgctaaacaacataatatacgtacaattggtgatttaaataaggttaaagatcaacttaaaccaggatttacattggaatttaatgatcgtccagatggttacaaagctgttcaaaaggcttataatttaaatttagataacatacgtacaatggaacctaagttgagatatcaagcgatcaataaaggtaatattaatttaatagatgcatattcaactgacgctgaattaaaacaatatgatatggttgtgttaaaagatgataagcacgtatttccaccatatcaaggagcaccattatttaaagaaagctttttaaagaaacatccagaaattaagaaaccgttaaacaaactagaaaacaaaatatctgatgaagatatgcaaatgatgaactataaagtaacagttaaaaatgaagacccatatacagttgcgaaagattatttaaaagcaaaagggttaatcaaa

SEQ ID NO: 3080 - protein, 504 aa, Staphylococcus aureus
  MISC_FEATURE (1)..(504): hypothetical protein
MTNFFDILSERKGQLFSTMIEHIQISFIALLIATAIAVPLGILLTKTKTISEIVMNIAAILQTIPSLALLGLMIPLFGIGRVPAIIALVVYALLPILRNTYTGIKEVDPSLIEAAKGIGMKPFRRLTKVELPIAMPVIMAGVRTAMVLIIGTATLAALIGAGGLGDLILLGIDRNNASLILLGAIPAALLAIIFDLILRFMAKLSYKKLLMTLGVIVMIIILAIAIPMFAQKGDKITLAGKLGSEPSIITNMYKILIEEETKNTVEVKDGMGKTAFLFNALKSDDIDGYLEFTGTVLGELTKEPLKSKEEKKVYEQAKQSLEKKYQMTMLKPMKYNNTYALAVKRDFAKQHNIRTIGDLNKVKDQLKPGFTLEFNDRPDGYKAVQKAYNLNLDNIRTMEPKLRYQAINKGNINLIDAYSTDAELKQYDMVVLKDDKHVFPPYQGAPLFKESFLKKHPEIKKPLNKLENKISDEDMQMMNYKVTVKNEDPYTVAKDYLKAKGLIK

SEQ ID NO: 3081 - DNA, 795 bp, Staphylococcus aureus
atgggggttcactcaatgaaattgaaacgtttatttgctgttgtgattgcaatgcttttagtattagctggttgctctaattctaacgataataatgaaagtaaaaaagatgacgcagacaatggtaagaaacaagagattcaagttgcagcggcagcaagtttaacagatgtaaccaagaaattagcttcagaatttaaaaaagagcataaaaatgctgatattaaatttaactatggtggatcaggggcattaagaaaacaaattgaatcaggcgcacctgttgacgtatttatgtctgcaaatactaaagatgtagatgcattaaaagacaagaataaagcgcatgatacatataaatatgcgaaaaatagtctagtattaattggtgataaagattcaaattacacttcagtaaaagacttaaaagacaatgataaattagcattaggtgaagtgaaaactgtaccagcaggaaaatatgcgaaacagtatttagataacaataacttatttaaagaagtcgaaagtaaaatcgtttatgctaaagatgtaaaacaagtattaaattatgttgaaaagggtaatgcgaaacaaggttttgtgtataaaactgacttatataaacaaaataaaaaaattgatactgtaaaagtaattaaagaagtagaacttaagaagccaatcacatacgaagctggtgctacatcagatagtaaattagcaaaagagtggatggaattcttaaaatcagataaagctaaagaaatactaaaagaataccactttgcagca

SEQ ID NO: 3082 - protein, 265 aa, Staphylococcus aureus
MGVHSMKLKRLFAVVIAMLLVLAGCSNSNDNNESKKDDADNGKKQEIQVAAAASLTDVTKKLASEFKKEHKNADIKFNYGGSGALRKQIESGAPVDVFMSANTKDVDALKDKNKAHDTYKYAKNSLVLIGDKDSNYTSVKDLKDNDKLALGEVKTVPAGKYAKQYLDNNNLFKEVESKIVYAKDVKQVLNYVEKGNAKQGFVYKTDLYKQNKKIDTVKVIKEVELKKPITYEAGATSDSKLAKEWMEFLKSDKAKEILKEYHFAA

SEQ ID NO: 3083 - DNA, 795 bp, Staphylococcus aureus
atgaacaaagatgtatctttaggtcaaccaattgttagatatgaagatggaaaattattcaatacaacagatcaatatgtgacagaatttccacttacaattatggtgaatggtgaagaatttgcgactgttatatgcagtccaacaaaccttgaggagttagtcattggatttctggcttcggaaggtgccattttaaagcgagatgaattaaaatctgtactgattgatgatagtaaaggttttgcccatgttgaacttaataaagatttaggcgatcgctttcaatattccacaaaacgaatgattgcatcttgttgcggaaagagtcgtgagttttattttcaaaatgatgctgctatcgctaaaacatctatgtctaaaatcactttaactccaatgcaaattattaacatgatgactcgattacaaagtgcaagtcatatttaccaagaaacaggtggcttacataatgctgctataagcgatggtttgacattttttgtacatcgacaagacattggtagacataacgctctagataaattatatggattttgtattcagcgacatattactgtccgagataaagtattaatttttagtggacgtatttcatcagaaattttaattaaagccgcaaaaattggtgttggcgtcattttatctaaatcagctccgacaacgcttgctgtaaccttagctaatgacctaaatattacggcagttggatttattcgaaatggtggctttaatatatacagtcatccagaacgtatcattgattctgaacaa

SEQ ID NO: 3084 - protein, 265 aa, Staphylococcus aureus
  MISC_FEATURE (1)..(265): FdhD protein homolog
MNKDVSLGQPIVRYEDGKLFNTTDQYVTEFPLTIMVNGEEFATVICSPTNLEELVIGFLASEGAILKRDELKSVLIDDSKGFAHVELNKDLGDRFQYSTKRMIASCCGKSREFYFQNDAAIAKTSMSKITLTPMQIINMMTRLQSASHIYQETGGLHNAAISDGLTFFVHRQDIGRHNALDKLYGFCIQRHITVRDKVLIFSGRISSEILIKAAKIGVGVILSKSAPTTLAVTLANDLNITAVGFIRNGGFNIYSHPERIIDSEQ

SEQ ID NO: 3085 - DNA, 975 bp, Staphylococcus aureus
gtgattaagtttaaaaatgtaactaagcgttatggcaaacatgttgctgtcgataacattagtttcaatattaatgagggtgaattttttgtgctaattggaccttcaggttgtggaaaaactacgacattaaaaatgattaatcgactcattcacttaagtgaaggttatatttattttaaagataaaccaataagtgattatccagtatacgaaatgcgttgggatattggatacgtattgcagcagattgcattattcccacatatgacaatcaaagaaaatattgcacaagtgccacaaatgaaaaagtggaaagaaaaagatatagataaaagagtagatgaattacttgaaatggttggattagaacctgaaaaatataaaaacagaaaacctgatgaattgtcaggggggcaacgacaacgtgtaggagttatacgtgcgttagcagctgatccaccagttattttaatggatgaaccgtttagtgcattagacccaatcagccgagaaaaacttcaagatgatttaattgaattacaaactaaaattaagaagacaatcatatttgttacacatgatattcaagaggcgatgaaacttggtgataagatttgtcttttgaatgaagggcatattgaacaaattgacacaccagaaggatttaaaaataatcctcaaagtgaatttgttaaacaatttatgggtagtcatttagaagatgatgcgccatgtgttgaagagaacgcaattatccgtgacttggatattatgaaaccaatcgatgaggttacatctatgagcgcttatccaattgtttatgacaatcaaccaattgaagtattgtatcaacttttatcagagagcgagcgtgtcattgtcatgcaagaagatagcgtaggtcaatatgttattgataggaaagatatcttcaaatatttgtcccagaaaaaggaggtagctcaacatgac

SEQ ID NO: 3086 - protein, 325 aa, Staphylococcus aureus
  MISC_FEATURE (1)..(325): hypothetical protein
VIKFKNVTKRYGKHVAVDNISFNINEGEFFVLIGPSGCGKTTTLKMINRLIHLSEGYIYFKDKPISDYPVYEMRWDIGYVLQQIALFPHMTIKENIAQVPQMKKWKEKDIDKRVDELLEMVGLEPEKYKNRKPDELSGGQRQRVGVIRALAADPPVILMDEPFSALDPISREKLQDDLIELQTKIKKTIIFVTHDIQEAMKLGDKICLLNEGHIEQIDTPEGFKNNPQSEFVKQFMGSHLEDDAPCVEENAIIRDLDIMKPIDEVTSMSAYPIVYDNQPIEVLYQLLSESERVIVMQEDSVGQYVIDRKDIFKYLSQKKEVAQHD

SEQ ID NO: 3087 - DNA, 1779 bp, Staphylococcus aureus
atgatgcaacaaacattatcgcattactttgggtatgaaacgtttcgaccaggacaagaagaaattattagcaaagtattagaccatcgtaatgtgcttggtgtcttaccaactggtggaggtaagtctatatgctatcaagtaccaggtttattgttaggtggtacaacaattgtaataagtccactaatatcattaatgaaagatcaagtggatcaattaaaagcgatgggaattcaagctgcttttttaaatagtagtttgactcaaaaagagcaacaacgtattgaaaaagcattatcaaatggagaaattcaatttttgtatgttgcaccagaacgatttgaaaaccgatattttttaaatatgcttcagcgtataaagattcacttagtcgcgtttgatgaagcgcattgtatttctaaatggggtcatgatttcaggccgagttaccaaaatgttatttcaaaagtatttacgttacctcaagattttacaataatagcgttgacagcaactgccacggttgaagtacagcaagatattagagaaaagttaaatatcgctcaaactgatcaaattaaaacgagtactaagcgtagaaacttaatttttaaagtaaatcctacttatcaacgtcaaaaatttatattggattatattaaaacacacgatgaagatgcaggtattatttattgttctacacgtaagcaagttgaagagcttcaagaagccttagaaagtcagaaaattgaaagtgttatatatcatgcaggtttgagcaataaagaaagagaagaagcgcagaatgatttcttatttgatcgtgttaaagtagtcgttgctacaaatgcttttggtatgggtattgataaatccaatgtacgctttgttattcattataatatgcctggagatttagaatcttattatcaagaagcgggtcgtgcaggtcgtgacgggttgaaaagtgaatgtattttgttatttagcgaacgcgatatcaatttacacgagtattttataacagtctctcaagctgatgatgactataaagataaaatgggcgaaaagttaactaaaatgattcaatatacaaaaacaaaaaaatgtctagaagcaacaattgtccattattttgaaccgaatgaaaaattagaagaatgtgaacaatgtagtaattgtgttcaacaagataaatcatataatatgacacaagaagctaagatgattattagttgcatcgctcgtatgaaacaacaagagagttatagtgttatcattcaagtgttaagaggagagtcaacagattatattaagtataaaggttatgaccaaatttcaacccatggtttaatgaaaggttacacaacatcagaattaagtcacttaatagatgaattaagattcaaagggttcttaaatgaaaatgacgaaatattaatgtgtgatacttcaattaaaaaattactcagtaatgaagtagaagtattcacaacaccatttaagcaaaaagcgactgaaaaagtatttataaatacggttgaaggggttgaccgagtattattcagtcagttggtagaagttcgtaaaaagttaagtgacaaattaacgatagcacctgtaagtatattttctgattacacgttggaggaatttgctaaacgtaagcctgcttcgaaacaagatatgattaatattgatggcgtaggtagttacaaattaaaacattattgtccagcatttttagaaacgattcaaaattataaagccaaagta

SEQ ID NO: 3088 - protein, 593 aa, Staphylococcus aureus
  MISC_FEATURE (1)..(593): probable DNA helicase
MMQQTLSHYFGYETFRPGQEEIISKVLDHRNVLGVLPTGGGKSICYQVPGLLLGGTTIVISPLISLMKDQVDQLKAMGIQAAFLNSSLTQKEQQRIEKALSNGEIQFLYVAPERFENRYFLNMLQRIKIHLVAFDEAHCISKWGHDFRPSYQNVISKVFTLPQDFTIIALTATATVEVQQDIREKLNIAQTDQIKTSTKRRNLIFKVNPTYQRQKFILDYIKTHDEDAGIIYCSTRKQVEELQEALESQKIESVIYHAGLSNKEREEAQNDFLFDRVKVVVATNAFGMGIDKSNVRFVIHYNMPGDLESYYQEAGRAGRDGLKSECILLFSERDINLHEYFITVSQADDDYKDKMGEKLTKMIQYTKTKKCLEATIVHYFEPNEKLEECEQCSNCVQQDKSYNMTQEAKMIISCIARMKQQESYSVIIQVLRGESTDYIKYKGYDQISTHGLMKGYTTSELSHLIDELRFKGFLNENDEILMCDTSIKKLLSNEVEVFTTPFKQKATEKVFINTVEGVDRVLFSQLVEVRKKLSDKLTIAPVSIFSDYTLEEFAKRKPASKQDMINIDGVGSYKLKHYCPAFLETIQNYKAKV

SEQ ID NO: 3089 - DNA, 1881 bp, Staphylococcus aureus
atgggtatggaagcatataaaattgaacatttaaataaatcttatgccgataagactatattcgataacctagatttatcaatttcagaaggtgaaaaaataggtttagtaggcataaatggtacagggaaaagtacgttgttaaaagtaattggtggtattgatgatgattttacagccaatgttatgcatccaaatcaatatcgaattcgatattcgtctcagaaacaggaccttaatgaagatatgacagtttttgatgcagtattaagttctgatacaacaactttacgcatcatcaagcaatatgagcaggcagtacaagcttatgcggatgaccaaagtgataaattgttcaagcgaatgatggatgcgcaagatgctatggatcaacatgatgcttgggactataacgctgaaattaaaacaatcctctcaaaactaggtatacatgatactactaaatacattaaagaattatccggcggacaacaaaaacgtgttgtacttgctaaaacattaatagaacaaccagatttattgttattagatgaacctacgaaccatttagacttcgaatcaatcagctggttgatcaattatgtgaagcaatatcctcatactgttttattcgtaacccatgatcgatattttttaaatgaagtttccactagaattattgaactaaacagaggtaagttagcgtcatatcctggtaactatgaatcttatattgaaatgcgcgctgaaagagaagtaacacttcaaaagcaacaacaaaagcaacgagctttatataaggaagaacttgcttggatgagggctggagctaaggctcgtactacaaagcaacaagctagaattaatcgatttaatgacctagaaaatgaagttaaccagcaatataaagacgataaaggtgaattgaatcttgcttattcaagattaggtaagcaagtgttcgaattagaagacttatcaaaggctattaatgataaagtattatttgaacatctgacggaaattattcaaaaaggtgagcgtattggtgttgttgggccaaatggagctggtaaaacaacactcttaaatattttgagtggagaagaccaacaattcgaaggtaaattgaagactgggcagacggttaaagtagcttattttaagcaaacagatgagaccctggatagagatattcgtatgattgattatttaagagaagaaagtgagatcgcaaaagaaaaagatggaacctcggtatctattacacaacttcttgaacgatttttatttccaagtgcaactcatggtaaaaaagtttataaattatctggtggagagcaaaagcgtttgtatttattacgtctactcgtacaccagccaaatgttctgttgttagatgaaccgacaaatgatttagatactgagactttaacaatacttgaagattatattcatactttcggtggtacagtgattaccgtaagccatgatcgctacttcttaaataaagttgcacagtcatattggtttattcatgatggtcagatggaaaagattatcggaacttttgaagattatgaaagttataaaaaatcattagataaaaataaatccacattgaagcaacaatctaaatcttctacaactgtacgtaagaaaaatggtttatcatataaagaaaaattagaatatgaacaattgatgaaacgcatagaacaagcggaagtaagaatggaagaaattgatgtgctcatgattgaggcaagtgcagattatgggaaaattaaagaattaaacgaagaaaaagaacaacttgaaattcaatatgatttagacatcacaagatggagtgagttagaagaaattaaagaacaacaa

SEQ ID NO: 3090 - protein, 627 aa, Staphylococcus aureus
  MISC_FEATURE (1)..(627): hypothetical protein
MGMEAYKIEHLNKSYADKTIFDNLDLSISEGEKIGLVGINGTGKSTLLKVIGGIDDDFTANVMHPNQYRIRYSSQKQDLNEDMTVFDAVLSSDTTTLRIIKQYEQAVQAYADDQSDKLFKRMMDAQDAMDQHDAWDYNAEIKTILSKLGIHDTTKYIKELSGGQQKRVVLAKTLIEQPDLLLLDEPTNHLDFESISWLINYVKQYPHTVLFVTHDRYFLNEVSTRIIELNRGKLASYPGNYESYIEMRAEREVTLQKQQQKQRALYKEELAWMRAGAKARTTKQQARINRFNDLENEVNQQYKDDKGELNLAYSRLGKQVFELEDLSKAINDKVLFEHLTEIIQKGERIGVVGPNGAGKTTLLNILSGEDQQFEGKLKTGQTVKVAYFKQTDETLDRDIRMIDYLREESEIAKEKDGTSVSITQLLERFLFPSATHGKKVYKLSGGEQKRLYLLRLLVHQPNVLLLDEPTNDLDTETLTILEDYIHTFGGTVITVSHDRYFLNKVAQSYWFIHDGQMEKIIGTFEDYESYKKSLDKNKSTLKQQSKSSTTVRKKNGLSYKEKLEYEQLMKRIEQAEVRMEEIDVLMIEASADYGKIKELNEEKEQLEIQYDLDITRWSELEEIKEQQ

SEQ ID NO: 3091 - DNA, 1938 bp, Staphylococcus aureus
atgagttcacaaaaaaagaaaattagtctttttgcgttcttcttattaaccgtaataacgattaccttgaagacgtatttttcttattatgttgatttttctttaggtgttaaaggtttagtacaaaacttaatattattgatgaatccttatagtttagtagcactggttttaagtgtgttcctattctttaaaggcaaaaaagcattttggttcatgttcataggcggcttcttattgacgttcctattatatgccaatgttgtgtactttagattcttctctgattttttaacgtttagtactttaaaccaagtaggtaacgtagaatctatgggtggtgcggttagtgcatcattcaaatggtatgactttgtttatttcattgatacgttagtttacttattcattttaatatttaaaacaaaatggttagacacaaaagcatttagtaagaaatttgttcctgtcgtaatggcggcttcagtagcattattcttcttaaacttagcttttgctgaaactgacagaccagaattattaacacgtacatttgaccataaatatttagtgaaatatttaggaccttataactttacagtatacgatggtgttaaaactatcgaaaataatcaacaaaaagcgctagcatctgaagatgacttaacaaaagtattaaattatacgaaacaacgtcaaacagagcctaacccagaatattatggggtggcaaagaagaaaaatattattaagattcatttagaaagtttccaaaccttcttaattaataaaaaggttaatggtaaagaagtaacaccgtttttaaacaaattatcaagtgggaaagagcaattcacatacttccctaactttttccatcaaacaggtcaaggtaaaacatctgactctgaatttacaatggataacagtttatacggtttaccgcaaggttctgccttttcattaaaaggagataatacgtatcagtcattaccagcaattttagatcaaaagcaaggctacaaatctgatgtcatgcacggtgactataaaacattctggaacagagaccaagtatataaacactttggtatcgataaattctatgatgcaacatactatgacatgtcagataaaaacgttgtaaacttaggcttgaaagacaaaattttctttaaagattctgctaattatcaagctaagatgaaatcaccattctattctcatttaattacattgactaaccactatccattcacattagatgaaaaggatgcaactattgagaaatcaaacacaggtgatgcaacagttgatggttatattcaaacagcacgttatttagacgaagcattagaagaatatattaatgacttgaagaaaaaaggattatatgacaattcagtgattatgatttatggtgaccactatggtatctctgaaaaccataacaatgccatggaaaaactattaggtgaaaaaatcacaccggctaaatttacagatttaaacagaactggtttctggattaaaatccctggtaaatctggtggtatcaataatgaatatgctggtcaagtcgatgtaatgccaacaattttacatttggctggtatagatacgaagaactatttaatgttcggtactgatttattctctaaaggtcataatcaagtagttccattcagaaatggtgactttataacaaaagattataaatatgttaatggtaagatttattctaataaaaataatgaactcataactactcaaccagctgatttcgaaaagaataaaaagcaagttgaaaaggatctcgaaatgagtgacaacgtgcttaatggtgatttgtttagattctacaaaaatccagacttcaaaaaggtaaatccttcgaagtataaatatgaaacaggacctaaagcaaactctaaaaaa

SEQ ID NO: 3092 - protein, 646 aa, Staphylococcus aureus
  MISC_FEATURE (1)..(646): hypothetical protein
MSSQKKKISLFAFFLLTVITITLKTYFSYYVDFSLGVKGLVQNLILLMNPYSLVALVLSVFLFFKGKKAFWFMFIGGFLLTFLLYANVVYFRFFSDFLTFSTLNQVGNVESMGGAVSASFKWYDFVYFIDTLVYLFILIFKTKWLDTKAFSKKFVPVVMAASVALFFLNLAFAETDRPELLTRTFDHKYLVKYLGPYNFTVYDGVKTIENNQQKALASEDDLTKVLNYTKQRQTEPNPEYYGVAKKKNIIKIHLESFQTFLINKKVNGKEVTPFLNKLSSGKEQFTYFPNFFHQTGQGKTSDSEFTMDNSLYGLPQGSAFSLKGDNTYQSLPAILDQKQGYKSDVMHGDYKTFWNRDQVYKHFGIDKFYDATYYDMSDKNVVNLGLKDKIFFKDSANYQAKMKSPFYSHLITLTNHYPFTLDEKDATIEKSNTGDATVDGYIQTARYLDEALEEYINDLKKKGLYDNSVIMIYGDHYGISENHNNAMEKLLGEKITPAKFTDLNRTGFWIKIPGKSGGINNEYAGQVDVMPTILHLAGIDTKNYLMFGTDLFSKGHNQVVPFRNGDFITKDYKYVNGKIYSNKNNELITTQPADFEKNKKQVEKDLEMSDNVLNGDLFRFYKNPDFKKVNPSKYKYETGPKANSKK

SEQ ID NO: 3093 - DNA, 1002 bp, Staphylococcus aureus
atgtcaatcataattgaaaaaagtggcttattcagtagctttcaggactttggcagaaggggatatgaacatgatggtgtaattccatgtggtgcacttgatactttagcacatgaaattgctaatcgattagttgcaaatgacaagaatgaagcaactttggaaatgactaataaaatggcaacgattcgttttacagaacctacgctgattgcattagcagggggtaatgtcaaagcttacactgagcatatgactatatctccatataaattgtatttgttagataaaggcgatgttttaaagtttagagaaacaagttatacatcgcgagtgtatttagctgtgggaggcggatttgaattagatgcatggttaggatctaactcaaccgactttaatgtaaaaattggtggttttaaaggtagaacattacaagatggcgatgaaataaagcttaagagagattatacagctcgtcatcataagttatttgaaaaccttgctcacacgaaacaaacagattggggtattgatggatacgccttgtcatttaattatatgtctgatgtatttcatgtcgttaaaaataaaggtacggaagattttaaagaagatgccattcaaagatttgtgaaacatgattataaagtaacgagcaaagcaaatcgcatggggatgatgcttgaaggtgaaaaaatcaaagctttttatgaagatatgccaccgtatcagactgtcaaaaaaggaacgatacaaattaagcgtgatggcacacctattatcctattaaatgatcattatacgctaggtagctacccgcaaatcggtacaatcgcaagttatcatttaacgaaattagcacaaaaaccgcaaggatcacgtttgaaatttcaatttatagatattttaacggctgaaaagaaccttgttaagtatagtaactggttaaaccaattattccatggaatagaatatagaatgcaattagaaatgatgaaa

SEQ ID NO: 3094 - protein, 334 aa, Staphylococcus aureus
  MISC_FEATURE (1)..(334): conserved hypothetical
MSIIIEKSGLFSSFQDFGRRGYEHDGVIPCGALDTLAHEIANRLVANDKNEATLEMTNKMATIRFTEPTLIALAGGNVKAYTEHMTISPYKLYLLDKGDVLKFRETSYTSRVYLAVGGGFELDAWLGSNSTDFNVKIGGFKGRTLQDGDEIKLKRDYTARHHKLFENLAHTKQTDWGIDGYALSFNYMSDVFHVVKNKGTEDFKEDAIQRFVKHDYKVTSKANRMGMMLEGEKIKAFYEDMPPYQTVKKGTIQIKRDGTPIILLNDHYTLGSYPQIGTIASYHLTKLAQKPQGSRLKFQFIDILTAEKNLVKYSNWLNQLFHGIEYRMQLEMMK

SEQ ID NO: 3095 - DNA, 708 bp, Staphylococcus aureus
atgaaaatatatagtcaaggtgaccaagccattgtagtcgcaattgaaaaagaagtatctaaaagtttaaccgaagatttattaacacttcgctcatatttaattgaacaaaattatccatttattatagaaattgtgccatcagaatcagacatgatgattgtctatgacgcaagggatatgattaaacaccataatatacaatcaccttttttatacatgaaagcactaatagaatcgattcatttaaacataaaacatgattttaaccagcaagatttgattgaaataccaattgtgtatggttcgaaatatggtccggatttagaatcacttttaaaacattacaaaatcaagctagaaacttttattgaattacattctaaggcgcaatattttgtttcgatgatgggatattcacctgggtttccttatttaactggattaaataagaaattgtatattaatcacacgagtaaacagaaaaaattcattccagctggttctgtagtacttgaagggaaaaaatgcggtattgtaactacggatacaattaatgattggttagttattggttatacaccattatcactttttaatccgaaagaatcagatttcgcacgcttaaagttaggcgataatattaaatttagacctatcaatgaaaatgaattagaagtaggagcgtttaaagatgtcaatcataat

SEQ ID NO: 3096 - protein, 236 aa, Staphylococcus aureus
  MISC_FEATURE (1)..(236): hypothetical protein
MKIYSQGDQAIVVAIEKEVSKSLTEDLLTLRSYLIEQNYPFIIEIVPSESDMMIVYDARDMIKHHNIQSPFLYMKALIESIHLNIKHDFNQQDLIEIPIVYGSKYGPDLESLLKHYKIKLETFIELHSKAQYFVSMMGYSPGFPYLTGLNKKLYINHTSKQKKFIPAGSVVLEGKKCGIVTTDTINDWLVIGYTPLSLFNPKESDFARLKLGDNIKFRPINENELEVGAFKDVNHN

SEQ ID NO: 3097 - DNA, 105 bp, Staphylococcus aureus
ttgttgctatcaaacgaacaacatatattctattttcagatagcaatcgattcactaatcgataatttacgtatacaagaattaacaacagcacaatataaacaa

SEQ ID NO: 3098 - protein, 35 aa, Staphylococcus aureus
LLLSNEQHIFYFQIAIDSLIDNLRIQELTTAQYKQ

SEQ ID NO: 3099 - DNA, 606 bp, Staphylococcus aureus
atgcaattatttgaaacaatgaaaattgataatggacatatccctagacttacttatcatactaatcgcataaaatgttcttctgagcgattaaactttaaatttgatgaacatgcatggcgaaatgaattaaacgatgtaacaacaaagtatcacagtggtcaatatagacttaaaatcgtattaaatgctgaaagcaaatttgaaacgatagtgtcacctttacctgagaaaagtagttttacagcaaaatttcaagtgttgcccaaagtagttaatccaacttttataaaaaataaaacgacagaacgaaagcatttagcacacaatcatgaaacagatttaatattgctaacttcagaggacggcaaggtccttgaatttgatattggcaacattgtcattgaagaggatggaaaatggtacacaccaagttataaagatgatttcttaaaaggatgcatgcgtgattatttaatagatagtgacaaacttgttgaaaaagactttaataaaaacgaattgatttataaatatcataacaatgagatacgtttatttttgataaatagtttacgagaggttgccgatgtccacctttgcctt

SEQ ID NO: 3100 - protein, 202 aa, Staphylococcus aureus
  MISC_FEATURE (1)..(202): hypothetical protein
MQLFETMKIDNGHIPRLTYHTNRIKCSSERLNFKFDEHAWRNELNDVTTKYHSGQYRLKIVLNAESKFETIVSPLPEKSSFTAKFQVLPKVVNPTFIKNKTTERKHLAHNHETDLILLTSEDGKVLEFDIGNIVIEEDGKWYTPSYKDDFLKGCMRDYLIDSDKLVEKDFNKNELIYKYHNNEIRLFLINSLREVADVHLCL

SEQ ID NO: 3101 - DNA, 1158 bp, Staphylococcus aureus
gtgattactgtgagaatagaatataattatcgctactatttaactgaaaatgaatataagcaataccatattcaattaaagggatttataaagaagtatgttgctactaagttggctgatgtgggagaagtgatacactttgcacaagcgcagcaacgacaaggtagatatgtctcgttatatttaagttacgaagcggcaaagtattttaatcatgctatgtgtacacattcattagctaaagatgatatttatgcagcagcttatagttttgaaaaagcggaaagcataaattcaacatatgaacatcaaacttcttatgtatcaaagtatcatttttcatttgttgaatcttctgaggttatgatgactaatattaaacgtgtccaacaagcaattgttgaaggcgaaacgtatcaagtgaactatacggcgcgcttaacggataacatttattatcctattagtactttatatgaacgattaactcaatttagtaatggtaattatactgcgttattacaaactgatgaaatccaagtagcgtctatctcaccagaattattttttcaaaaaggacaatttaacaatgtcgataacgttatcataagcaaaccgatgaaagggacaatgcctagaggtaaaacggaagctgaagatcaacagtattataaaacattgcaaacttcttcgaaagatcgtgcagaaaatgtcatgattgttgatttactaagaaacgatatagggagaatatcacagagtggctcaattaaggtgtataaactattttttattgaggcatataaaactgtatttcaaatgacttcgatggtaagtggaactttaaaaaataatacagacttaactcaaattttaacatcgttatttccttgtggttcgattacaggtgcaccgaaactgaatacaatgaaatatattaaacaattagaaagttcacctcgtggtatatactgcggagcaattggactattacttccaactgaagatgataaaatgatttttaatattccgattcgcactattgagtataaatatggacaagcgatttatggagtcggagcaggtattacaattgattctaagccaaaagatgaagtgaatgaattttacgcaaaaaccaagattttggagatgtta

SEQ ID NO: 3102 - protein, 386 aa, Staphylococcus aureus
  MISC_FEATURE (1)..(386): hypothetical protein
VITVRIEYNYRYYLTENEYKQYHIQLKGFIKKYVATKLADVGEVIHFAQAQQRQGRYVSLYLSYEAAKYFNHAMCTHSLAKDDIYAAAYSFEKAESINSTYEHQTSYVSKYHFSFVESSEVMMTNIKRVQQAIVEGETYQVNYTARLTDNIYYPISTLYERLTQFSNGNYTALLQTDEIQVASISPELFFQKGQFNNVDNVIISKPMKGTMPRGKTEAEDQQYYKTLQTSSKDRAENVMIVDLLRNDIGRISQSGSIKVYKLFFIEAYKTVFQMTSMVSGTLKNNTDLTQILTSLFPCGSITGAPKLNTMKYIKQLESSPRGIYCGAIGLLLPTEDDKMIFNIPIRTIEYKYGQAIYGVGAGITIDSKPKDEVNEFYAKTKILEML

SEQ ID NO: 3103 - DNA, 591 bp, Staphylococcus aureus
atgattctagtcatagataataatgattcatttacatataatttaatagactatattaagactcaaacgaaactaacagttcaagttgttggtattgataatctgctgatagaagacgtcattaatatgaagccaaaagcaattgttatttcgcctgggccgggtaatccggatgattatcctatcttgaatgaagtgttagaacaattttatcagcgtgtacctatactaggtgtatgtttaggatttcaatgtatcgtgtcttattttggtggaaatatcattcacggctatcatcctgtacacggacatactacacagttacgccataccaatgaaggtatttttcaaggactgcctcaaaatttcaatgtaatgcgttatcattcattaattgctgacggagcgacttttccaaattgcttaaagattacagcaaaaaacgatgaagcgattattatggcatttgagcatattagatttccggtttttggtgtgcaatatcatcctgaatctattttgagtgaatacggttatcgacaagttgaattatttttatcgaaggtaggtgattactgtgagaatagaata

SEQ ID NO: 3104 - protein, 197 aa, Staphylococcus aureus
  MISC_FEATURE (1)..(197): hypothetical protein
MILVIDNNDSFTYNLIDYIKTQTKLTVQVVGIDNLLIEDVINMKPKAIVISPGPGNPDDYPILNEVLEQFYQRVPILGVCLGFQCIVSYFGGNIIHGYHPVHGHTTQLRHTNEGIFQGLPQNFNVMRYHSLIADGATFPNCLKITAKNDEAIIMAFEHIRFPVFGVQYHPESILSEYGYRQVELFLSKVGDYCENRI

SEQ ID NO: 3105 - DNA, 420 bp, Staphylococcus aureus
atggaaagtgtattaaataatgaaaaagccatcgttgtctttagtggtggtcaagacagtacaacatgtctcttttatgcaaaaaaacatttcaaagaagttgaactcgtaacgtttaattatggccaaagacatgatactgaaattgaagtcgcaaaacaaattgcacaagatcaaggaatgaaacatcacgttttagatatgtcattattatcacaacttactccaaacgcattaacacaacatgatatggaaattactaataatgaagatggtatacctaatacatttgttccagctagaaatttacttttcttgtcgtttgcaggcgctctagcttatcaaattggggctaagcatattattacaggcgtatgtgaaacagactttcaggctacccagactgtcgcgatagtttta

SEQ ID NO: 3106 - protein, 140 aa, Staphylococcus aureus
  MISC_FEATURE (1)..(140): conserved hypothetical
MESVLNNEKAIVVFSGGQDSTTCLFYAKKHFKEVELVTFNYGQRHDTEIEVAKQIAQDQGMKHHVLDMSLLSQLTPNALTQHDMEITNNEDGIPNTFVPARNLLFLSFAGALAYQIGAKHIITGVCETDFQATQTVAIVL

SEQ ID NO: 3107 - DNA, 237 bp, Staphylococcus aureus
atgaacgtaacattaagcctagctatggacaaagattttgtcattcatactcctttaatgtggttaaacaaagcagaaacgtggaaattaagtgatgaactcgaagttttagattatattcgtacaaaaacattaacatgctataacggtatcattggggatggctgtggtgaatgtccagcttgtcatttacgtcaacgtggactaaatcaatatcttgaaagtaaaggagcgctt

SEQ ID NO: 3108 - protein, 79 aa, Staphylococcus aureus
  MISC_FEATURE (1)..(79): conserved hypothetical
MNVTLSLAMDKDFVIHTPLMWLNKAETWKLSDELEVLDYIRTKTLTCYNGIIGDGCGECPACHLRQRGLNQYLESKGAL

SEQ ID NO: 3109 - DNA, 441 bp, Staphylococcus aureus
ttgaaagtaaaggagcgctttaaaatgttacaacaaatctatcctagtacaacgcatccatatcaattcgaattaaataaagattttaatttttcggctgcacatcacattccatgtgaagaagcaggtatttgtcaaaatgtccatggtcatacttactttgttaatttaacaattgtcggtgataaactagatgacactggcttcttagtgaactttagccatttgaaaaagatgatacacggtaaatttgaccatcaactgttaaataacttacctgcttttaaaaacaaaatcccttcaactgaaatcgtagcggaaacaatttatcaaattgttaaagaaaatttggcatcgctcgaacaccaaccaaaatgtattcaagtatttgtaagagaaacaccaacaagttatgtcgtatttagaccaaaggaacaggtg

SEQ ID NO: 3110 - protein, 147 aa, Staphylococcus aureus
  MISC_FEATURE (1)..(147): 6-pyruvoyl
LKVKERFKMLQQIYPSTTHPYQFELNKDFNFSAAHHIPCEEAGICQNVHGHTYFVNLTIVGDKLDDTGFLVNFSHLKKMIHGKFDHQLLNNLPAFKNKIPSTEIVAETIYQIVKENLASLEHQPKCIQVFVRETPTSYVVFRPKEQV

SEQ ID NO: 3111 - DNA, 711 bp, Staphylococcus aureus
atggctaaaattcctgtactcgaaatattcggtccaaccattcagggtgaaggtcgagtaatcggtagaaaaacgatgtttgtgagaacagctggatgtgattatcgctgtagctggtgtgattctgcatttacttgggatggtagtgctaaaggcgatataaaactcatgaccgctgaagaaatttatgatgaattaaaacgaattggtggcgatttatttaaccacgttacaatttctggtggtaacccagcattaattaaaggtatccaagagttagttgacttatttcaagataaaggtattttcagcgcactggagacacaaggcagtaaattccaaccttggatgacacaaattgatgatttaacgattagtccaaaaccaccaagttcaactatgacacctgatttaaaaaagttagatgaagtgattacacaatgcgtaccttcatcattaaacttaaaagtagttgtattcgacgataaagattatgattttgccaaaatgatacaccaccgttatccagatattcccttctatttacaagttggtaacccatatttatcagacagcgtagataatcataccgaaaagttgttagaacgctacgagcagttggtggatttagttatgcaaagtaatgatatgaatcacgtttatgtgttaccacaacttcatacattactttggagcaataaaaaaggtgta

SEQ ID NO: 3112 - protein, 237 aa, Staphylococcus aureus
  MISC_FEATURE (1)..(237): coenzyme PQQ synthesis
MAKIPVLEIFGPTIQGEGRVIGRKTMFVRTAGCDYRCSWCDSAFTWDGSAKGDIKLMTAEEIYDELKRIGGDLFNHVTISGGNPALIKGIQELVDLFQDKGIFSALETQGSKFQPWMTQIDDLTISPKPPSSTMTPDLKKLDEVITQCVPSSLNLKVVVFDDKDYDFAKMIHHRYPDIPFYLQVGNPYLSDSVDNHTEKLLERYEQLVDLVMQSNDMNHVYVLPQLHTLLWSNKKGV

SEQ ID NO: 3113 - DNA, 609 bp, Staphylococcus aureus
ttgaagtataacgaacaggagtccatcatgattgtatatatattaattaatattgctatcgtcgtacttataactggattcaatttatataggcatcaaatgcaacatttatcattaagtgcaatgttgttatctattacgataaacgcctttataaatacattcataattgataaatataactttattactctgtgtactataacgatgtttatcatttggacgatactacagttttacattgataaaaaattaaaacctgtatacattacagaccaaaaatttattgctatcatattaacgattgttgtcagtttaacgcaacgtgttaccgacttttcaagtacacaatcaatatatatgtctattccatttttagcccctgccattttcatcattggtggtattatgttgtttatttcaacatttaatagcttagatgaaactgctgaaaataataacaaaataaagaaactaatgattaaaggacttatcattattaacatttcatttatcgttatgatggttttaacaccatattggtacttgtatttaatcgtctatcttattttcttgttgtttttattgtggcaaaaggtttataaattt

SEQ ID NO: 3114 - protein, 203 aa, Staphylococcus aureus
  MISC_FEATURE (1)..(203): hypothetical protein
LKYNEQESIMIVYILINIAIVVLITGFNLYRHQMQHLSLSAMLLSITINAFINTFIIDKYNFITLCTITMFIIWTILQFYIDKKLKPVYITDQKFIAIILTIVVSLTQRVTDFSSTQSIYMSIPFLAPAIFIIGGIMLFISTFNSLDETAENNNKIKKLMIKGLIIINISFIVMMVLTPYWYLYLIVYLIFLLFLLWQKVYKF

SEQ ID NO: 3115 - DNA, 438 bp, Staphylococcus aureus
atgaatacaaaatattttttagcagctggtgctgttatcacaacattagctttaggtgcttgtggtaattctaattcacaagatcaaggtaacaaaactgaacaaaaaacaaagtcagaagatagcaatgttaaaactgataaaacaaaacacctaacaggtacattcagttctaaaaacggtgaaactgttgaaggtaaagctgagattaaaaatggtaaattaatgcttactaactacaaatcatcaaaaggtccagatttatacgtctacctaacaaaaaatggcgacattaaaaacggtaaagaaatcgcaatggttgactacgataaagaaaaacaaacatttgatcttaaaaatgtagatttaagcaaatatgatgaagtaacaatctattgtaaaaaagctcacgtcatcttcggcggcgctaaattaaaa

SEQ ID NO: 3116 - protein, 146 aa, Staphylococcus aureus
  MISC_FEATURE (1)..(146): hypothetical protein
MNTKYFLAAGAVITTLALGACGNSNSQDQGNKTEQKTKSEDSNVKTDKTKHLTGTFSSKNGETVEGKAEIKNGKLMLTNYKSSKGPDLYVYLTKNGDIKNGKEIAMVDYDKEKQTFDLKNVDLSKYDEVTIYCKKAHVIFGGAKLK

SEQ ID NO: 3117 - DNA, 480 bp, Staphylococcus aureus
gtgaacatcatgaataaattattgctactcgttacatttatcattcgtgtgggttcaggtattgttatgttaatgcaaggctacgaaaaattaacgggcggatttacgctgaaaggtttagtaccagtcatcgctaacaatactgattcaccagagtggtataagtggtttttcgcaaatatagttgcacatacgacgtcattatttgatattgttgtcccactcggagagattgcaattggattaggtttaatttttggagtttttgcatatgctgctagtttctttggagcctttgttatgataaattatatcttagcagatatgatatttacgtatcctcttcaattaactttctttatccttttactaatgagtcactcattgttaaaacagatttcacttaaagaaatcattaattactttagaggtcgtaagaacagaggtgaaaaaatagatgacccacttactgatcgtgga

SEQ ID NO: 3118 - protein, 160 aa, Staphylococcus aureus
  MISC_FEATURE (1)..(160): hypothetical protein
VNIMNKLLLLVTFIIRVGSGIVMLMQGYEKLTGGFTLKGLVPVIANNTDSPEWYKWFFANIVAHTTSLFDIVVPLGEIAIGLGLIFGVFAYAASFFGAFVMINYILADMIFTYPLQLTFFILLLMSHSLLKQISLKEIINYFRGRKNRGEKIDDPLTDRG

SEQ ID NO: 3119 - DNA, 684 bp, Staphylococcus aureus
atgacccacttactgatcgtggatgatgaacaagacattgtagacatttgtcaaacctattttgaatatgaaggttacaaagtaacaacgacaactagcggtaaagaagcaatttctttactatcaaatgatattgatatcatggtacttgatatcatgatgccagaagttaatggttacgacattgtcaaagaaatgaaaaggcaaaaattagatatcccctttatctatttaactgccaaaacacaagaacatgataccatttacgccttaactttaggtgcagatgactatgtcaaaaaaccatttagtccaagggaactcgttttacgtattaataatttacttacaagaatgaagaaataccatcatcaaccagttgaacaactgtcgtttgatgaattaacacttattaacttaagtaaagttgtgactgtaaatggtcacgaagtccctatgcgtattaaggaatttgagttattgtggtatttagcttctagagaaaatgaagttatttctaaatcagaattacttgaaaaagtttggggatatgactattacgaagatgctaataccgtgaatgtccatatacaccgtattagagaaaaattagaaaaagagagctttacaacatataccatcacaactgtatggggattaggatataaatttgaaaggagccga

SEQ ID NO: 3120 - protein, 228 aa, Staphylococcus aureus
  MISC_FEATURE (1)..(228): response regulator
MTHLLIVDDEQDIVDICQTYFEYEGYKVTTTTSGKEAISLLSNDIDIMVLDIMMPEVNGYDIVKEMKRQKLDIPFIYLTAKTQEHDTIYALTLGADDYVKKPFSPRELVLRINNLLTRMKKYHHQPVEQLSFDELTLINLSKVVTVNGHEVPMRIKEFELLWYLASRENEVISKSELLEKVWGYDYYEDANTVNVHIHRIREKLEKESFTTYTITTVWGLGYKFERSR

SEQ ID NO: 3121 - DNA, 1053 bp, Staphylococcus aureus
atggtgttatcaattagaagtcaaatcattattggcgtcgtatcgagtatactattaacttcaactattttagcaattgcatatattttaatgtggtttaacggccatatgacactaactttgaccttaacgacaataattacaagctgtttaaccttattaatatgtagtatttttattaatccacttatacaaaaaattaagcagtttaatataaaaactaagcaatttgctaacggaaattacgcaagcaatgataaaacgtttaattcaccaaaagaaatttatgaattaaatcaatcttttaataaaatggcttctgaaattacgcaacaaatgaatcaaattaaatccgaacaacaagaaaaaacagaactgattcaaaacttagcccatgatttaaaaacacctttagcaagcattatttcatattctgaaggactacgtgatggtataatcactaaggatcatgagattaaagagtcatacgacatattaattaaacaagcaaacagattatcaacattatttgatgatatgactcatattatcactttaaatacaggtaaaacatatcccccagaattaatacaactagaccaattacttgtatcaatattgcaaccatatgagcaacgtatcaaacatgaaaaccgcacattagaagtgaatttctgtaacgaaattgatgcattttatcaatatcgaacgccacttgagcgtattttaacaaacttacttgataatgcgctaaaattttcaaatgttggtagtcgcattgatattaatattagtgaaaacgaagatcaagatactatcgacattgctattagcgatgaaggtattggcattataccagaactacaagaacgtatattcgaacgtacattcagagtagaaaactctcgtaatacaaaaacgggtggttctggattaggcttatatatagctaatgaactcgcgcaacaaaataacgcaaaaatcagtgtaagcagtgatatagatgtaggaactacgatgactgtaacattacacaaattagacattacgtca

SEQ ID NO: 3122 - protein, 351 aa, Staphylococcus aureus
  MISC_FEATURE (1)..(351): histidine protein kinase
MVLSIRSQIIIGVVSSILLTSTILAIAYILMWFNGHMTLTLTLTTIITSCLTLLICSIFINPLIQKIKQFNIKTKQFANGNYASNDKTFNSPKEIYELNQSFNKMASEITQQMNQIKSEQQEKTELIQNLAHDLKTPLASIISYSEGLRDGIITKDHEIKESYDILIKQANRLSTLFDDMTHIITLNTGKTYPPELIQLDQLLVSILQPYEQRIKHENRTLEVNFCNEIDAFYQYRTPLERILTNLLDNALKFSNVGSRIDINISENEDQDTIDIAISDEGIGIIPELQERIFERTFRVENSRNTKTGGSGLGLYIANELAQQNNAKISVSSDIDVGTTMTVTLHKLDITS

SEQ ID NO: 3123 - DNA, 981 bp, Staphylococcus aureus
atgaaaattagagtcgtcattccttgttttaatgaaggggaagtcattacacaaacacatcaacaattaactgaaatactttcacaagatagtagtgtgaaaggctatgattataatatgcttttcatagatgatggtagtacggataccactatagatgaaatgcaacatcttgccacaatagataggcatgtcagctttatttcttttagtagaaattttggaaaagaagcagctatgattgcaggttaccagcatagtactgaatttgatgcagtcatcatgatagattgtgatttgcaacatccacctgaatatattccgaaaatggttgaaggttttatggaaggctatgatcaagtgattgcaaagcgtgatagaagtggtgaaaattttagtcgcaaaacattaagccatttgtattataagttagttaattgctttgtagaagaagtacaatttgatgatggtgttggtgattttagacttttaagccaaagagctgttaaatccattgcatcacttgaagaatataatcgattttcaaaagggttatttgaatggataggctataatactaaagtgtttacgtatcaaaatgttgagagacaaaaaggggaatctaagtggtcctttaaaaagttatttaattatggtattgatggattgatttcctttaatagtaaacctttgagaatgatgatttatcttggcttgtttatcttttcaataagcgtgttatatattatctatttattcatcaatattatgatatctggtgttaatattccgggatatttttcaacgattgcagctattttattattaggcggcatacagttaatttcaattggtgttgtaggtgaatatattggcaggatatattatgaagttaaggcacgtcctaaatatattattcaagctacaaatctttcaagtcttgaaaatgatgagaaggatacccataaagtttattctaaa

SEQ ID NO: 3124 - protein, 327 aa, Staphylococcus aureus
  MISC_FEATURE (1)..(327): hypothetical protein
MKIRVVIPCFNEGEVITQTHQQLTEILSQDSSVKGYDYNMLFIDDGSTDTTIDEMQHLATIDRHVSFISFSRNFGKEAAMIAGYQHSTEFDAVIMIDCDLQHPPEYIPKMVEGFMEGYDQVIAKRDRSGENFSRKTLSHLYYKLVNCFVEEVQFDDGVGDFRLLSQRAVKSIASLEEYNRFSKGLFEWIGYNTKVFTYQNVERQKGESKWSFKKLFNYGIDGLISFNSKPLRMMIYLGLFIFSISVLYIIYLFINIMISGVNIPGYFSTIAAILLLGGIQLISIGVVGEYIGRIYYEVKARPKYIIQATNLSSLENDEKDTHKVYSK

SEQ ID NO: 3125 - DNA, 774 bp, Staphylococcus aureus
gtgtcaatggctagtataagtatgtcagatatatattgtaacggcactatatttgaaaatgacgacgagcagttgatttatttaacgccttcttttccacaacgatacacaagtaacacatggatatataaaaagacgcctacccaagagcgatggctgaaagacttagaacgtcaacatcaattacatacaaatcaaggttcaaatcattatgcgtttagtttcccggaaaatgaacaacttgataatcattggatggctatgtttaaagatatgaattttgaactaggtattatggaattgtatgccatagaaagtgatgcgcttgccaatttgccgcgtaactctgacgttgaaattgccatcgttgacgagtcgcatatagatgcctatttaaaagttgcatatcagtttagtttgccatttggaaaagactatgcagatgcacatgaagaaatggtaagggaacattatcaaaaagatgtgattaaacgcttagtagcttatttaaataatgaacctattggcgttgtagatgtcattgaaagtgaaaattacattgaattagatggatttggtgtattagaacaatttcggcaccaaggaattggatctacaattcaatcgttgataggtgaatacgccatatcaaaaaatcacaaaccaatcatattagttgcagatggtgaagatacagcaaaagatatgtatgcaaagcaaggttatgtctatcaatcgttttgttatcaaatattaaaagaagatattggaaat

SEQ ID NO: 3126 - protein, 258 aa, Staphylococcus aureus
  MISC_FEATURE (1)..(258): hypothetical protein
VSMASISMSDIYCNGTIFENDDEQLIYLTPSFPQRYTSNTWIYKKTPTQERWLKDLERQHQLHTNQGSNHYAFSFPENEQLDNHWMAMFKDMNFELGIMELYAIESDALANLPRNSDVEIAIVDESHIDAYLKVAYQFSLPFGKDYADAHEEMVREHYQKDVIKRLVAYLNNEPIGVVDVIESENYIELDGFGVLEQFRHQGIGSTIQSLIGEYAISKNHKPIILVADGEDTAKDMYAKQGYVYQSFCYQILKEDIGN

SEQ ID NO: 3127 - DNA, 837 bp, Staphylococcus aureus
atgttgaatgagatacaaatattaaataatggatacccgatgccttcagttgggttaggtgtttataaaatctctgacgaagatatgactaaagttgtaaatgctgcaattgacgcaggctatagagcgtttgatacagcatacttttatgataatgaggcttcactaggacgagcattaaaggataatggcgtcgatagagaagatttgtttataacaacgaagttatggaatgactatcaaggttatgagaaaacattcgaatatttcaacaaatcgattgaaaatttacaaactgattatcttgatttatttctaatacattggccttgtgaagcagatggtctatttttagaaacatataaagctatggaagaactttacgagcaaggtaaggtaaaagcaataggtgtatgtaattttaatgttcatcatctagaaaaattaatggctcaatcaagtatcaaaccaatggtgaatcaaattgaggtacatccatattttaaccaacaagaattacaagaattttgtgatcgtcacgatattaaagtgactgcatggatgcctttgatgagaaatagaggactactagacgaccctgtcattgttaaaattgctgaaaaatatcataaaacaccagcacaagttgtattacgttggcatttagcacacaatagaattattattccaaaatctcagacacctaaacgcattcaagaaaatatagatattttagattttaatttagaattaacagaagtagctgaaattgatgctttaaatagaaatgcaagacaaggtaaaaatccagatgatgtgaaaattggggatttaaaa

SEQ ID NO: 3128 - protein, 279 aa, Staphylococcus aureus
  MISC_FEATURE (1)..(279): hypothetical protein
MLNEIQILNNGYPMPSVGLGVYKISDEDMTKVVNAAIDAGYRAFDTAYFYDNEASLGRALKDNGVDREDLFITTKLWNDYQGYEKTFEYFNKSIENLQTDYLDLFLIHWPCEADGLFLETYKAMEELYEQGKVKAIGVCNFNVHHLEKLMAQSSIKPMVNQIEVHPYFNQQELQEFCDRHDIKVTAWMPLMRNRGLLDDPVIVKIAEKYHKTPAQVVLRWHLAHNRIIIPKSQTPKRIQENIDILDFNLELTEVAEIDALNRNARQGKNPDDVKIGDLK

SEQ ID NO: 3129 - DNA, 1347 bp, Staphylococcus aureus
ttggaaacttcgaccataattagtttgattatatttattctattaattgcattaaccactgtatttgttggttcagaatttgcattagtaaaaattagagcaacaagaattgaacagctagcagatgaaggaaataaacctgctaaaatagtaaaaaagatgattgctaatctagattattatctttctgcttgtcagttaggtataacagtaacatctttagggttaggttggcttggtgaaccaacgtttgaaaagctattacacccaatatttgaagcaatcaatttaccaactgcattaacgacgacgatttcgtttgcagtgtcatttataatcgttacgtatttgcatgtagtacttggtgaattagcgcctaaatctatagctattcaacatactgaaaagcttgctttagtatatgcaagaccattgttctatttcggtaacattatgaaaccattgatttggctgatgaatggttctgcacgtgttattattagaatgtttggtgtaaatcctgatgcccaaactgatgcaatgtcagaagaagaaatcaaaattattattaacaatagttataatggtggagaaatcaaccaaactgaattggcatatatgcaaaatatcttttcattcgatgaaagacatgcaaaagatataatggtacctagaactcaaatgattacactaaatgaaccttttaatgtagacgaattactagaaacaataaaagaacatcaatttacgcgttatccaattactgatgatggtgataaagaccacattaaaggatttattaacgtcaaagaatttttaactgaatacgcttctggaaaaacgattaaaatagcaaactatatacatgagttgccaatgatttcagagacaacacgtatcagtgatgcattaattagaatgcaacgtgaacatgtacatatgagtcttattatagatgaatatggtggaacggcaggtattttaacgatggaagatattttagaagaaatcgttggagaaattcgtgatgaatttgatgatgatgaagtgaatgatatcgttaaaattgataataagacattccaagtaaatggcagagtactattggatgatttaactgaagagttcggtatagaatttgatgactctgaggatattgatacgataggtggatggttacaatctcgtaataccaatttacaaaaagatgattacgtggatacaacttatgatcgctgggttgtttcagaaatcgataaccaccaaattatttgggtgatattaaactatgaatttaatgaagcgagacctactatcggacagtctgatgaagatgaaaaatcagaa

SEQ ID NO: 3130 - protein, 449 aa, Staphylococcus aureus
  MISC_FEATURE (1)..(449): hypothetical protein
LETSTIISLIIFILLIALTTVFVGSEFALVKIRATRIEQLADEGNKPAKIVKKMIANLDYYLSACQLGITVTSLGLGWLGEPTFEKLLHPIFEAINLPTALTTTISFAVSFIIVTYLHVVLGELAPKSIAIQHTEKLALVYARPLFYFGNIMKPLIWLMNGSARVIIRMFGVNPDAQTDAMSEEEIKIIINNSYNGGEINQTELAYMQNIFSFDERHAKDIMVPRTQMITLNEPFNVDELLETIKEHQFTRYPITDDGDKDHIKGFINVKEFLTEYASGKTIKIANYIHELPMISETTRISDALIRMQREHVHMSLIIDEYGGTAGILTMEDILEEIVGEIRDEFDDDEVNDIVKIDNKTFQVNGRVLLDDLTEEFGIEFDDSEDIDTIGGWLQSRNTNLQKDDYVDTTYDRWVVSEIDNHQIIWVILNYEFNEARPTIGQSDEDEKSE

SEQ ID NO: 3131 - DNA, 1179 bp, Staphylococcus aureus
gtgtcagaattaattatatataacggcaaagtttatactgaagatggcaaaatcgataatggttacattcatgtgaaagatggacagattgttgcaattggagaagtggatgataaagcagcaattgataatgatacgacaaataaaattcaagtgattgatgctaaaggtcatcatgtattaccaggttttattgatatacatattcatggtggttatggtcaagatgcaatggatgggtcatacgatggcttaaaatatctatccgaaaatttgttgtctgaagggacgacatcatacttggccactacaatgacgcaatcgactgataaaatagataatgcacttacaaatattgctaaatatgaagcggagcaagatgttcacaatgcagcggaaattgtaggtatacatttagaaggaccatttatatctgaaaataaagttggtgctcaacatccgcaatacgttgtacgcccatttatcgataaaattaaacattttcaagagactgctaacggattaataaagattatgacgtttgcacctgaaattgaaggtgcaaaagaagcgcttgaaacgtataaagatgacattattttttcaattggtcatacagtagcaacatacgaagaagcagttgaagctgttgagcgaggagctaaacatgtcacgcatttatataatgcagcgacgccattccaacatagagaaccaggtgtttttggagcagcatggttgaatgatgctctacataccgaaatgattgttgatggcactcattctcatccggcatcggttgcaattgcttaccgtatgaaaggtaatgaacgtttttatttaattaccgatgcaatgcgtgcaaaaggtatgcctgaaggagaatatgatttgggtggacaaaaagtaactgttcaatcgcaacaagcacgtcttgcaaatggtgcgcttgctggtagtattttaaaaatgaatcatgggttacgtaacttaatatcatttacaggtgatacattagatcatttatggcgagtaacaagtttaaatcaagccattgcattaggtatcgatgatagaaaaggtagtattaaagtaaataaggatgcagatcttgttattctagatgatgatatgaatgtaaaatctacaataaaacaaggcaaggttcacacatttagc

SEQ ID NO: 3132 - protein, 393 aa, Staphylococcus aureus
  MISC_FEATURE (1)..(393): probable
VSELIIYNGKVYTEDGKIDNGYIHVKDGQIVAIGEVDDKAAIDNDTTNKIQVIDAKGHHVLPGFIDIHIHGGYGQDAMDGSYDGLKYLSENLLSEGTTSYLATTMTQSTDKIDNALTNIAKYEAEQDVHNAAEIVGIHLEGPFISENKVGAQHPQYVVRPFIDKIKHFQETANGLIKIMTFAPEIEGAKEALETYKDDIIFSIGHTVATYEEAVEAVERGAKHVTHLYNAATPFQHREPGVFGAAWLNDALHTEMIVDGTHSHPASVAIAYRMKGNERFYLITDAMRAKGMPEGEYDLGGQKVTVQSQQARLANGALAGSILKMNHGLRNLISFTGDTLDHLWRVTSLNQAIALGIDDRKGSIKVNKDADLVILDDDMNVKSTIKQGKVHTFS

SEQ ID NO: 3133 - DNA, 171 bp, Staphylococcus aureus
ttgcaaaatattaaaaaagtctatacatttgtggtgtctatttcttcattcatttatctaaaaataaaaacactttcatatcaattcataaaaactgaattaatagaaagtgtttttacagctttgtataagctaccgttaacacgatatataaaactaacatatattcat

SEQ ID NO: 3134 - protein, 57 aa, Staphylococcus aureus
LQNIKKVYTFVVSISSFIYLKIKTLSYQFIKTELIESVFTALYKLPLTRYIKLTYIH

SEQ ID NO: 3135 - DNA, 1965 bp, Staphylococcus aureus
gtgaaaataatgagagtaacagagttattaacaaaagatacaatagcaatggatttaatggcaaatgacaaaaatggtgttattgatgagttagtaaatcaattagacaaagcaggtaaattaagtgatgtcgcgtcatttaaggaagcgattcacaatcgagaatcacaaagtacaactggtatcggcgaaggtattgccattccacatgccaaagtggccgcagttaagtcaccagctattgcgtttggtaaatctaaagcaggcgtagattatcaaagtttggatatgcaaccagcacacttattctttatgattgcagcgccagaaggtggcgcccaaacacatctagatgctttagctaagttgtctggtattttaatggatgaaaatgtacgtgagaaattattacatgcttcatcacctgaagaagtactagcgatcatagatgaggctgatgatgaagtgacaaaagaagaagaggcagaagctgaagcacaacaagttgcaactgcagaacaatcatctaaacaatctaatgagccatatgtgttagcagtaactgcttgtccaacaggtattgcacacacatatatggcacgtgatgcattgaaaaagcaagcggataaaatgggtattaaaattaaagtagaaacgaatggttcaagcggcattaaaaaccatttaactgaacaagatattgaaaatgcaacaggtatcattgttgctgctgatgttcatgttgagacggatcgcttcgatggtaaaaatgtcgtagaagtaccagtagcagatggtattaaacgcccagaagaattaattaataaagcattagatacaagtcgtaaaccttttgttgcccgtgatggtcaaagaaaaggtaactcaaatgacagtcaagaaaaattaagcccaggtaaagcattctataaacacttaatgaacggtgtttctaacatgttgccacttgtaatatctggtggtattttaatggcaattgtatttttatttggagcaaattcatttaatccaaaaagctcagagtacaatgcgtttgcagagcagctttggaacattggtagtaaaagtgcattcgcgttaatcattccaattttatctggattcattgcacgtagtattgcggataaacctggtttcgcttcaggtcttgtaggtggtatgttagcaatttcaggtggttcaggatttattggtggtattattgcaggtttcttagcaggttacttaacacaaggtgttaaagccatgacacgtaagttaccacaagcattagagggattaaagccaacattaatttatccactattaacagtgacggctacaggcttattgatgatttatgcctttaatccaccagcatcttggttaaatcatttgttattagatggattaaacaatttatcaggttctaatattgtattattaggtttagttattggcgctatgatggcgattgatatgggcggtccattcaacaaagcggcatatgtttttgcaacaggtgcgttgattgaaggtaatgcagcaccaattacagctgcaatgattggtggtatgattccaccgttagcaattgcgacagcgatgttaatttttagacgtaaatttacaaaagaacaacgtggttcaattatccctaactatgtgatgggtatgtcatttattacagaaggtgcgattccatttgcagctgccgatccattacgtgttattccttcaatgatgattggttcaggtataggtggcgcaattgctttaggcttaggttcacgaattactgcgccacatggtggtattattgtaattgttggtactgatggtgcacacttacttcaaactcttattgcacttctagttggcacattagtttcagcattaatttacggtttaatcaaaccaaagttaactgaaacagaaatcgaagcttcaaaatcaatggacgag

SEQ ID NO: 3136 - protein, 655 aa, Staphylococcus aureus
  MISC_FEATURE (1)..(655): fructose specific permease
VKIMRVTELLTKDTIAMDLMANDKNGVIDELVNQLDKAGKLSDVASFKEAIHNRESQSTTGIGEGIAIPHAKVAAVKSPAIAFGKSKAGVDYQSLDMQPAHLFFMIAAPEGGAQTHLDALAKLSGILMDENVREKLLHASSPEEVLAIIDEADDEVTKEEEAEAEAQQVATAEQSSKQSNEPYVLAVTACPTGIAHTYMARDALKKQADKMGIKIKVETNGSSGIKNHLTEQDIENATGIIVAADVHVETDRFDGKNVVEVPVADGIKRPEELINKALDTSRKPFVARDGQRKGNSNDSQEKLSPGKAFYKHLMNGVSNMLPLVISGGILMAIVFLFGANSFNPKSSEYNAFAEQLWNIGSKSAFALIIPILSGFIARSIADKPGFASGLVGGMLAISGGSGFIGGIIAGFLAGYLTQGVKAMTRKLPQALEGLKPTLIYPLLTVTATGLLMIYAFNPPASWLNHLLLDGLNNLSGSNIVLLGLVIGAMMAIDMGGPFNKAAYVFATGALIEGNAAPITAAMIGGMIPPLAIATAMLIFRRKFTKEQRGSIIPNYVMGMSFITEGAIPFAAADPLRVIPSMMIGSGIGGAIALGLGSRITAPHGGIIVIVGTDGAHLLQTLIALLVGTLVSALIYGLIKPKLTETEIEASKSMDE

SEQ ID NO: 3137 - DNA, 918 bp, Staphylococcus aureus
atgatttatacagtgactttcaatccttcaattgactatgtcatttttacgaatgattttaaaattgatggtttgaacagagcaacagcaacatataaattcgctggggggaaaggtattaatgtctcgcgcgtcttaaagacattggatgttgagtcaactgccttgggatttgcaggtggatttcctgggaaattcattatagatacattaaataacagtgcaattcaatcgaattttattgaagttgatgaagatacacgtattaatgtgaaattaaaaacaggacaagaaacagaaatcaatgcaccgggtcctcatataacgtcaacacaatttgaacaactgttacaacaaattaaaaatacaacaagcgaagatatagttattgttgctggaagtgtaccaagtagtattccaagcgatgcgtatgcgcaaattgcacaaattacagcacagacaggtgctaaattagtagtcgacgctgaaaaagaattggctgaaagcgttttaccatatcatccactatttattaaacctaataaagatgaattagaagtgatgtttaatacaacagtgaactcagacacagatgttattaaatatggtcgtttgttagttgataaaggtgcgcaatctgttattgtctcgcttggcggtgatggtgctatttatattgataaagaaatcagtattaaagcagttaatccacaagggaaagtggttaatacagttggctctggtgatagtacagttgcaggcatggtggctggaattgcttcaggtttaacgattgaaaaagcattccaacaagcagtcgcatgcggtactgccacggcatttgatgaggacttagcaacacgggacgctatagaaaaaataaaatcacaagttacgattagcgtacttgatggggag

SEQ ID NO: 3138 - protein, 306 aa, Staphylococcus aureus
  MISC_FEATURE (1)..(306): fructose 1-phosphate kinase
MIYTVTFNPSIDYVIFTNDFKIDGLNRATATYKFAGGKGINVSRVLKTLDVESTALGFAGGFPGKFIIDTLNNSAIQSNFIEVDEDTRINVKLKTGQETEINAPGPHITSTQFEQLLQQIKNTTSEDIVIVAGSVPSSIPSDAYAQIAQITAQTGAKLVVDAEKELAESVLPYHPLFIKPNKDELEVMFNTTVNSDTDVIKYGRLLVDKGAQSVIVSLGGDGAIYIDKEISIKAVNPQGKVVNTVGSGDSTVAGMVAGIASGLTIEKAFQQAVACGTATAFDEDLATRDAIEKIKSQVTISVLDGE

SEQ ID NO: 3139 - DNA, 765 bp, Staphylococcus aureus
gtgatgatgataattactgaaaaaagacacgagttaatattagaagaactttcgcacaaagattttttgactttacaagaattaatagatcgaactggttgcagtgcttcaacaatacgaagagatttatctaaactacaacaattagggaaattgcaacgtgtgcatggtggtgcaatgttaaaagaaaatcgtatggttgaggcgaatttaactgaaaaattagcaacgaatcttgatgaaaagaaaatgattgctaaaatagcagctaatcaaatcaacgataatgaatgcttatttatcgatgctggttcatctacattggagctaattaaatatattcaagcgaaagatatcattgtggtaaccaatggtttaacacatgtagaagctttacttaaaaaaggtattaaaacaattatgctaggtggtcaagttaaagaaaatacacttgctacgattggttctagtgctatggagatattaagacgatattgtttcgataaagcttttatcgggatgaatggattagatattgaacttggattaactactcccgatgagcaagaggcattagttaaacaaacagcaatgtcattagccaatcaatcatttgtacttatagatcattctaagtttaataaagtatattttgctcgtgtacctttgctagaaagtacgacaatcatcacatctgaaaaagcattaaatcaagaatcgttaaaagaataccaacaaaagtatcactttataggagggacttta

SEQ ID NO: 3140 - protein, 255 aa, Staphylococcus aureus
  MISC_FEATURE (1)..(255): hypothetical protein
VMMIITEKRHELILEELSHKDFLTLQELIDRTGCSASTIRRDLSKLQQLGKLQRVHGGAMLKENRMVEANLTEKLATNLDEKKMIAKIAANQINDNECLFIDAGSSTLELIKYIQAKDIIVVTNGLTHVEALLKKGIKTIMLGGQVKENTLATIGSSAMEILRRYCFDKAFIGMNGLDIELGLTTPDEQEALVKQTAMSLANQSFVLIDHSKFNKVYFARVPLLESTTIITSEKALNQESLKEYQQKYHFIGGTL

SEQ ID NO: 3141 - DNA, 480 bp, Staphylococcus aureus
atggctaaaaataagaaaacgaacgcgatgcgtatgcttgatcgtgcaaaaattaaatacgaagttcatagctttgaggtaccagaagaacatttatctggtcaagaagtcgcagaactcatacaagcaaatgttaaaacagtatttaaaacgcttgttctagaaaatacaaaacatgaacattttgtatttgttatcccagtaagtgaaactttagatatgaaaaaggcagctgctttggttggagagaagaaattgcagcttatgcctttagataatttgaaaaatgtaacgggatacattcgtggtgggtgttcgcctgttggtatgaaaacattgtttccaacagtcgttgacaaatcgtgtgaaaattatagtcatatcagtgtgagtggtgggcttcgaacaatgcaaatcacaatagctgttgaggatttgattacaataactaaaggcaaaattggagcagttatccatgaa

SEQ ID NO: 3142 - protein, 160 aa, Staphylococcus aureus
  MISC_FEATURE (1)..(160): hypothetical protein
MAKNKKTNAMRMLDRAKIKYEVHSFEVPEEHLSGQEVAELIQANVKTVFKTLVLENTKHEHFVFVIPVSETLDMKKAAALVGEKKLQLMPLDNLKNVTGYIRGGCSPVGMKTLFPTVVDKSCENYSHISVSGGLRTMQITIAVEDLITITKGKIGAVIHE

SEQ ID NO: 3143 - DNA, 462 bp, Staphylococcus aureus
gtgggtaaggggatgacagtaaaaaatttatttttaggctttgttgctgtaatattaaccgtttgtttaattggtttattaatattagcaacaaatgaagatgcgcttgctaaggtacataaaacaattaatacgcttaacgcgataaatgtatcaactgaagatacttataaaaagaaaatggatattctcaatattcatactgctaaagcatctgaagtgaatgaaaatgtgaaaaagcaaaatcattttaaacatcgtgtgaatgcaaataaatcaaattcttttaacgaacaagagtgccaagttattgctgatcgttatgcagataagcatatcaatgataattatggtttagaaagaatttctaagacaaatcatggatataattatgtgtattccaatgataattcaactagtaagcaacatgtaagtatttcaaatcaaggcataataacgaaa

SEQ ID NO: 3144 - protein, 154 aa, Staphylococcus aureus
  MISC_FEATURE (1)..(154): hypothetical protein
VGKGMTVKNLFLGFVAVILTVCLIGLLILATNEDALAKVHKTINTLNAINVSTEDTYKKKMDILNIHTAKASEVNENVKKQNHFKHRVNANKSNSFNEQECQVIADRYADKHINDNYGLERISKTNHGYNYVYSNDNSTSKQHVSISNQGIITK

SEQ ID NO: 3145 - DNA, 336 bp, Staphylococcus aureus
ttgatggatatagatgttaataaattgcttcaagcttttgtctattttaaatcatttgagaagttcagttttgttgtcttcataggttttgatatgatacgaccagccattacaaattatttttctaatattgctggagaaaggcaaggctttgcaggcggattgaactcgacattcactagtatgggtaatttcataggtcctttaatcgcaggtgcgttatttgatgtacacattgaagcaccaatttatatggctataggtgtttcattagcaggtgttgttattgttttaattgaaaagcaacatagagcaaaattgaaagaacaaaatatg

SEQ ID NO: 3146 - protein, 112 aa, Staphylococcus aureus
  MISC_FEATURE (1)..(112): quinolone resistance
LMDIDVNKLLQAFVYFKSFEKFSFVVFIGFDMIRPAITNYFSNIAGERQGFAGGLNSTFTSMGNFIGPLIAGALFDVHIEAPIYMAIGVSLAGVVIVLIEKQHRAKLKEQNM

SEQ ID NO: 3147 - DNA, 552 bp, Staphylococcus aureus
atgacaacaaaacagttagtatatacagctttaatgacagcgattatcgctattttaggattggtaccggtaattccactaccattttcttcagtaccaattgtacttcaaaacattggtattttcttagcaggtgcgattttaggacgtaaatatggcacattaagtgttatcgtctttttattattagtagttgctggcttgccattgttatcaggtggtcgcggtggcatcggtgtattcgcaggtccttcagcagggtttttactattatatccagttgtagcattcatgattggggcgattcgagatagattcatcaatgaaattaatttctggattttattcgttggtattttagtttttggtgttatagcattagatgttattggtacattgattatgggcatgattattaacataccatttacgaaagctatttcaatttcattagcttatttgcctggtgatatattaaaagcaattgtagcaagtttgattggtacagctttacttaatcactcgcagtttcgtcaaattatgggaataaaa

SEQ ID NO: 3148 - protein, 184 aa, Staphylococcus aureus
  MISC_FEATURE (1)..(184): hypothetical protein
MTTKQLVYTALMTAIIAILGLVPVIPLPFSSVPIVLQNIGIFLAGAILGRKYGTLSVIVFLLLVVAGLPLLSGGRGGIGVFAGPSAGFLLLYPVVAFMIGAIRDRFINEINFWILFVGILVFGVIALDVIGTLIMGMIINIPFTKAISISLAYLPGDILKAIVASLIGTALLNHSQFRQIMGIK

SEQ ID NO: 3149 - DNA, 1725 bp, Staphylococcus aureus
atgaaacgagaaaatccattgtttttcttatttaaaaaactatcatggccagtgggtcttatcgttgcagctatcactatttcatcactagggagcttaagtggactattagtgccactgtttactggacgaattgtagataaattttccgtgagccatatcaattggaatctaatcgcattatttggtggtatctttgtcatcaatgctttattaagcggattaggtttatatttattaagtaaaattggtgaaaagattatttatgcgatacgctcagttttatgggagcatatcatacaattaaaaatgccattctttgacaaaaatgaaagtggtcaattaatgagtcgattaactgacgatacgaaagtgataaatgaatttatttcacaaaagctacctaacttattaccatcaatcgttacattagttgggtcactaatcatgttatttattttagattggaaaatgacattattaacatttataacgataccgatattcgttttaattatgattcctctaggtcgtattatgcaaaagatatcgacaagtacacaatctgaaattgcaaacttcagtggtttgttagggcgtgtcctaactgaaatgcgtcttgttaaaatatcaaatacagagcgtcttgaattagataatgcacataaaaatttgaatgaaatatataaattaggtttaaaacaggctaaaattgcggcagttgtacaaccaatttcaggtatagttatgttgctaacaattgcaattattttaggttttggtgcattagaaattgcgactggtgcaatcactgcaggtacattaattgcaatgatattttatgttattcagttatctatgcctttaatcaatctttccacgttagttacagattataaaaaggcagtcggtgcaagtagtagaatatacgaaatcatgcaagaacctattgaaccgacagaagctcttgaagattctgaaaatgtattaattgatgacggtgtattgtcatttgaacatgtagactttaaatatgatgtgaagaaaatattagatgatgtgtcgttccaaatcccacaaggtcaagtgagtgcttttgtaggcccttctgggtctggtaaaagtacgatatttaatctgatagaacgtatgtatgaaattgagtcaggtgatattaaatatggccttgaaagtgtctatgatatcccgttatctaagtggcgacgcaaaattggatatgttatgcaatcaaattcgatgatgagtggtacaattagagacaatattttatacggaattaatcgtcatgtttcagatgaagaacttattaattatgctaaattagcgaactgtcatgattttatcatgcaatttgatgaaggatatgacacgcttgtaggtgaacgaggattgaaactgtctggcggacaacgtcaacgtattgatattgctagaagttttgttaaaaatcctgatattttgttacttgatgaagcaacagctaatctcgatagtgaaagtgaattgaaaattcaagaagctttagaaacattgatggaaggtagaacaacgattgtcattgcgcatcgtttgtctacaattaaaaaagccggtcaaattatattcttagacaaaggacaggtaacaggtaaaggtacgcattcagaactgatggcatcacatgcgaagtataaaaactttgtagtgtctcaaaaattaacagat

SEQ ID NO: 3150 - protein, 575 aa, Staphylococcus aureus
  MISC_FEATURE (1)..(575): ATP-binding cassette
MKRENPLFFLFKKLSWPVGLIVAAITISSLGSLSGLLVPLFTGRIVDKFSVSHINWNLIALFGGIFVINALLSGLGLYLLSKIGEKIIYAIRSVLWEHIIQLKMPFFDKNESGQLMSRLTDDTKVINEFISQKLPNLLPSIVTLVGSLIMLFILDWKMTLLTFITIPIFVLIMIPLGRIMQKISTSTQSEIANFSGLLGRVLTEMRLVKISNTERLELDNAHKNLNEIYKLGLKQAKIAAVVQPISGIVMLLTIAIILGFGALEIATGAITAGTLIAMIFYVIQLSMPLINLSTLVTDYKKAVGASSRIYEIMQEPIEPTEALEDSENVLIDDGVLSFEHVDFKYDVKKILDDVSFQIPQGQVSAFVGPSGSGKSTIFNLIERMYEIESGDIKYGLESVYDIPLSKWRRKIGYVMQSNSMMSGTIRDNILYGINRHVSDEELINYAKLANCHDFIMQFDEGYDTLVGERGLKLSGGQRQRIDIARSFVKNPDILLLDEATANLDSESELKIQEALETLMEGRTTIVIAHRLSTIKKAGQIIFLDKGQVTGKGTHSELMASHAKYKNFVVSQKLTD

SEQ ID NO: 3151 - DNA, 270 bp, Staphylococcus aureus
atgaaaaatttaatatctattatcatcattttatgtttaacattaagtattatgacaccatatgcacaagctactaacagtgacgtaacccctgtacaagcagcaaatcaatatggttatgcaggtttgtcggctgcatacgaaccgacgagtgctgttaatgtaagtcaaactggacaattactgtatcaatacaatatcgatactaagtggaatccagcgtctatgactaaattaatgacaatgtacttaacattggaagctgtaaaa

SEQ ID NO: 3152 - protein, 90 aa, Staphylococcus aureus
  MISC_FEATURE (1)..(90): penicillin binding
MKNLISIIIILCLTLSIMTPYAQATNSDVTPVQAANQYGYAGLSAAYEPTSAVNVSQTGQLLYQYNIDTKWNPASMTKLMTMYLTLEAVK

SEQ ID NO: 3153 - DNA, 990 bp, Staphylococcus aureus
atgacgaacaaagaatatattatgtctacactacctgagttgagtaatacgaaactatatcctggacaagtatggacaatcgcagacctattacaaattacagtatctaattctagtaatgccgcggcattaattttagctaagaaggtttcaaaaaacaccagcgatttcgttgatttaatgaataacaaagctaaagctatcggaatgaaaaatacacatttcgtcaatccaacgggtgctgaaaattcaagattacgtacatttgcaccaacaaagtataaagaccaagaacgtactgtaacgactgctagagactatgccattttagatttacacgtgattaaagagacacctaaaatattagactttacaaagcagttagcaccaacaacgcatgcagttacgtattacacattcaacttttcattggaaggtgcaaaaatgagtttgccgggtacagatggtttaaaaactggatcaagtgatacagcaaattacaaccatacgattactaccaaacgaggtaaatttagaattaatcaagttatcatgggtgcaggagactataaaaaccttggtggcgagaagcaacgtaatatgatggggaatgcattaatggaacgctcatttgatcagtataaatatgtaaaaatattgtctaaaggtgagcaaaggataaatggtaagaaatattatgttgaaaatgatctttacgatgttttaccaagtgattttagtaaaaaagattataaacttgtagtcgaagatggtaaagtacacgcggactatccaagagaatttattaataaagattatggacctccaactgtagaagttcatcagccaattattcaaaaggcaaatactgttgctaaaagtatgtgggaagaacatccattattcactatcattggtggtacatgccttgtcgctggattagcacttattgttcatatgataatcaatcgtttatttagaaaaagaaaa

SEQ ID NO: 3154 - protein, 330 aa, Staphylococcus aureus
  MISC_FEATURE (1)..(330): penicillin binding protein
MTNKEYIMSTLPELSNTKLYPGQVWTIADLLQITVSNSSNAAALILAKKVSKNTSDFVDLMNNKAKAIGMKNTHFVNPTGAENSRLRTFAPTKYKDQERTVTTARDYAILDLHVIKETPKILDFTKQLAPTTHAVTYYTFNFSLEGAKMSLPGTDGLKTGSSDTANYNHTITTKRGKFRINQVIMGAGDYKNLGGEKQRNMMGNALMERSFDQYKYVKILSKGEQRINGKKYYVENDLYDVLPSDFSKKDYKLVVEDGKVHADYPREFINKDYGPPTVEVHQPIIQKANTVAKSMWEEHPLFTIIGGTCLVAGLALIVHMIINRLFRKRK

SEQ ID NO: 3155 - DNA, 396 bp, Staphylococcus aureus
atgaaacgtgtaataacatatggcacatatgacttacttcactatggtcatatcgaattgcttcgtcgtgcaagagagatgggcgattatttaatagtagcattatcaacagatgaatttaatcaaattaaacataaaaaatcttattatgattatgaacaacgaaaaatgatgcttgaatcaatacgctatgtcgatttagtcattccagaaaagggctggggacaaaaagaagacgatgtcgaaaaatttgatgtagatgtttttgttatgggacatgactgggaaggtgaattcgacttcttaaaggataaatgtgaagtcatttatttaaaacgtacagaaggcatttcgacgactaaaatcaaacaagaattatatggtaaagatgctaaa

SEQ ID NO: 3156 - protein, 132 aa, Staphylococcus aureus
  MISC_FEATURE (1)..(132): teichoic acid biosynthesis
MKRVITYGTYDLLHYGHIELLRRAREMGDYLIVALSTDEFNQIKHKKSYYDYEQRKMMLESIRYVDLVIPEKGWGQKEDDVEKFDVDVFVMGHDWEGEFDFLKDKCEVIYLKRTEGISTTKIKQELYGKDAK

SEQ ID NO: 3157 - DNA, 1059 bp, Staphylococcus aureus
atgaggtttacgataatcatacctacatgtaataatgaggcaacaattcgacaattgttaatatctattgagagtaaagaacactatagaatcctttgtattgatggtggttctactgatcaaacaattcctatgattgaacggttacaaagagaactcaagcatatttcattaatacaattacaaaatgcttcgatagctacgtgtattaataaaggtttgatggatatcaaaatgacagatccacatgatagtgacgcatttatggtcataaaaccaacatcaatcgtattgccaggtaaattagataggttaactgctgctttcaaaaataatgataatattgatatggtaatagggcagcgagcttacaattaccatggtgaatggaaattgaaaagtgctgatgagtttattaaagacaatcgaatcgttacattaacggaacaaccagatttgttatcaatgatgtcttttgacggaaagttattcagtgctaaatttgctgaattacagtgtgacgaaactttagctaacacatacaatcacgcaatacttgtcaaggcgatgcaaaaagctacggatatacatttagtttcacagatgattgtcggagataacgatatagatacacatgctacaagtaacgatgaagattttaatagatatatcacagaaattatgaaaataagacaacgagtcatggaaatgttactattacctgaacaaaggctattatatagtgatatggttgatcgtattttattcaataattcattaaaatattatatgaacgaacacccagcagtaacgcacacgacaattcaactcgtaaaagactatattatgtctatgcagcattctgattatgtatcgcaaaacatgtttgacattataaatacagttgaatttattggtgagaattgggatagagaaatatacgaattgtggcgacaaacattaattcaagtgggcattaataggccgacttataaaaaattcttgatacaacttaaagggagaaagtttgcacatcgaacaaaatcaatgttaaaacga

SEQ ID NO: 3158 - protein, 353 aa, Staphylococcus aureus
  MISC_FEATURE (1)..(353): teichoic acid biosynthesis
MRFTIIIPTCNNEATIRQLLISIESKEHYRILCIDGGSTDQTIPMIERLQRELKHISLIQLQNASIATCINKGLMDIKMTDPHDSDAFMVIKPTSIVLPGKLDRLTAAFKNNDNIDMVIGQRAYNYHGEWKLKSADEFIKDNRIVTLTEQPDLLSMMSFDGKLFSAKFAELQCDETLANTYNHAILVKAMQKATDIHLVSQMIVGDNDIDTHATSNDEDFNRYITEIMKIRQRVMEMLLLPEQRLLYSDMVDRILFNNSLKYYMNEHPAVTHTTIQLVKDYIMSMQHSDYVSQNMFDIINTVEFIGENWDREIYELWRQTLIQVGINRPTYKKFLIQLKGRKFAHRTKSMLKR

SEQ ID NO: 3159 - DNA, 1101 bp, Staphylococcus aureus
atgaacgttttaataaagaaattttatcatttggtagttcgaatactttctaaaatgattacgcctcaagtgattgataaaccgcatatcgtatttatgatgacttttccagaagatattaagcctatcatcaaagcattaaataattcgtcgtatcagaaaactgttttaacaacaccaaaacaagcgccttatttatctgaacttagcgacgatgttgatgtgatagaaatgactaatcgaacattggtaaaacaaattaaggctttgaaaagcgcgcagatgattattatcgataattattacctattgctaggtggatataataagacttctaatcaacacattgttcaaacgtggcatgcaagtggtgcattaaaaaactttggcttaacagatcatcaagtcgatgtgtctgacaaggcaatggttcagcagtaccgtaaagtttatcaagcgacggatttttacttagtgggttgtgaacaaatgtcacaatgttttaaacagtctttaggtgcaacagaagagcaaatgctgtattttgggcttccgagaattaataaatattacacagctgatagagcaacggttaaggcagagttaaaggataaatatggaattacaaataagttggtattatatgtaccaacatatagagaagataaagcagataatagggctattgataaagcttattttgaaaaatgtttaccaggatatacactgattaataaattacatccatcaattgaagattcagacattgatgacgtatcttcaatcgacacgtctacattaatgctaatgtcagatataattattagcgactatagttcgctgccaatagaagctagcttgttagatattccaactatattttatgtgtatgatgaaggaacatatgatcaggtgagaggcctgaatcaattttacaaagcaataccggatagctacaaagtgtatactgaagaagatttaataatgacgatacaagaaaaagaacatctattaagtccgttatttaaagattggcataagtataatactgataaaagtttacatcagctcacagaatatatagataagatggtgacaaaa

SEQ ID NO: 3160 - protein, 367 aa, Staphylococcus aureus
  MISC_FEATURE (1)..(367): teichoic acid biosynthesis
MNVLIKKFYHLVVRILSKMITPQVIDKPHIVFMMTFPEDIKPIIKALNNSSYQKTVLTTPKQAPYLSELSDDVDVIEMTNRTLVKQIKALKSAQMIIIDNYYLLLGGYNKTSNQHIVQTWHASGALKNFGLTDHQVDVSDKAMVQQYRKVYQATDFYLVGCEQMSQCFKQSLGATEEQMLYFGLPRINKYYTADRATVKAELKDKYGITNKLVLYVPTYREDKADNRAIDKAYFEKCLPGYTLINKLHPSIEDSDIDDVSSIDTSTLMLMSDIIISDYSSLPIEASLLDIPTIFYVYDEGTYDQVRGLNQFYKAIPDSYKVYTEEDLIMTIQEKEHLLSPLFKDWHKYNTDKSLHQLTEYIDKMVTK

SEQ ID NO: 3161 - DNA, 831 bp, Staphylococcus aureus
ttgaaagtgtggtttaatggaatgtcagcaataggaacagtttttaaagaacatgtaaagaacttttatttaattcaaagactggctcagtttcaagttaaaattatcaatcatagtaactatttaggtgtggcttgggaattaattaaccctgttatgcaaattatggtttactggatggtttttggattaggaataagaagtaatgcaccaattcatggtgtaccttttgtttattggttattggttggtatcagtatgtggttcttcatcaaccaaggtattttagaaggtactaaagcaattacacaaaagtttaatcaagtatcgaaaatgaacttcccgttatcgataataccgacatatattgtgacaagtagattttatggacatttaggcttacttttacttgtgataattgcatgtatgtttactggtatttatccatcaatacatatcattcaattattgatatatgtaccgttttgttttttcttaactgcctcggtgacgttattaacatcaacactcggtgtgttagttagagatacacaaatgttaatgcaagcaatattaagaatattattttacttttcaccaattttgtggctaccaaagaaccatggtatcagtggtttaattcatgaaatgatgaaatataatccagtttactttattgctgaatcataccgtgcagcaattttatatcacgaatggtatttcatggatcattggaaattaatgttatacaatttcggtattgttgccattttctttgcaattggtgcgtacttacacatgaaatatagagatcaatttgcagacttcttg

SEQ ID NO: 3162 - protein, 277 aa, Staphylococcus aureus
  MISC_FEATURE (1)..(277): teichoic acid translocation
LKVWFNGMSAIGTVFKEHVKNFYLIQRLAQFQVKIINHSNYLGVAWELINPVMQIMVYWMVFGLGIRSNAPIHGVPFVYWLLVGISMWFFINQGILEGTKAITQKFNQVSKMNFPLSIIPTYIVTSRFYGHLGLLLLVIIACMFTGIYPSIHIIQLLIYVPFCFFLTASVTLLTSTLGVLVRDTQMLMQAILRILFYFSPILWLPKNHGISGLIHEMMKYNPVYFIAESYRAAILYHEWYFMDHWKLMLYNFGIVAIFFAIGAYLHMKYRDQFADFL

SEQ ID NO: 3163 - DNA, 813 bp, Staphylococcus aureus
gtgaataaggaaggtctacaaatgaacgtttcggtaaacattaaaaatgtaacaaaagaatatcgtatttatcgtacaaataaagaacgtatgaaagatgcgctcattcccaaacataaaaacaaaacatttttcgctttagatgacattagtttaaaagcatatgaaggtgacgtcatagggcttgttggcatcaatggttccggcaaatcaacgttgagcaatatcattggcggttctttgtcgcctactgttggcaaagtggatcgtaatggtgaagtcagcgttatcgcaattagtgctggcttgagtggacaacttacagggattgaaaatatcgaatttaaaatgttatgtatgggctttaagcgaaaagaaattaaagcgatgacacctaagattattgaatttagtgaacttggtgagtttatttatcaaccagttaaaaagtattcaagtggtatgcgtgcaaaacttggtttttcaattaatatcacagttaatccagatatcttagtcattgacgaagctttatctgtaggtgaccaaacttttgcacaaaaatgtttagataaaatttacgagtttaaagagcaaaacaaaaccatctttttcgttagtcataacttaggacaagtgagacaattttgtactaagattgcttggattgaaggcggaaagttaaaagattacggtgaacttgatgatgtattacctaaatatgaagctttccttaacgattttaaaaagaaatccaaagccgaacaaaaagaatttagaaacaaactcgatgagtcccgcttcgttattaaa

SEQ ID NO: 3164 - protein, 271 aa, Staphylococcus aureus
  MISC_FEATURE (1)..(271): teichoic acid translocation
VNKEGLQMNVSVNIKNVTKEYRIYRTNKERMKDALIPKHKNKTFFALDDISLKAYEGDVIGLVGINGSGKSTLSNIIGGSLSPTVGKVDRNGEVSVIAISAGLSGQLTGIENIEFKMLCMGFKRKEIKAMTPKIIEFSELGEFIYQPVKKYSSGMRAKLGFSINITVNPDILVIDEALSVGDQTFAQKCLDKIYEFKEQNKTIFFVSHNLGQVRQFCTKIAWIEGGKLKDYGELDDVLPKYEAFLNDFKKKSKAEQKEFRNKLDESRFVIK

SEQ ID NO: 3165 - DNA, 762 bp, Staphylococcus aureus
atgactgttgaagaaagatccaatacagccaaagttgacattttaggggtcgattttgataatacaacaatgttgcaaatggttgaaaatattaaaaccttttttgcaaatcaatcaacgaataatctttttatagtaacagccaaccctgaaatagtgaattacgcgacgacacatcaagcgtatttagagttaataaatcaagcgagctatattgttgctgatgggacaggagtagtcaaagcttcgcatcgtttaaagcaacctctagcgcatcgtatacctggtattgagttgatggatgaatgtttgaaaattgctcatgtaaatcatcaaaaagtatttttgctaggggcaactaatgaagttgtagaagcggcacaatatgcattgcaacaaagatatccaaacatatcgtttgcacatcatcacggttatattgatttagaagatgagacagtagtgaaacgaattaaactgtttaaacctgattacatatttgtaggtatgggattccctaaacaagaagaatggattatgacacatgaaaaccaatttgaatctacagtgatgatgggcgtaggtggttctcttgaagtatttgctggggctaaaaagagagcgccttatatctttagaaaattaaacattgaatggatatatagagcattaatagattggaaacgtattggtagattaaagagtattccaatatttatgtataaaatagccaaagcaaaaagaaaaataaaaaaggcgaaa

SEQ ID NO: 3166 - protein, 254 aa, Staphylococcus aureus
  MISC_FEATURE (1)..(254): teichoic acid biosynthesis
MTVEERSNTAKVDILGVDFDNTTMLQMVENIKTFFANQSTNNLFIVTANPEIVNYATTHQAYLELINQASYIVADGTGVVKASHRLKQPLAHRIPGIELMDECLKIAHVNHQKVFLLGATNEVVEAAQYALQQRYPNISFAHHHGYIDLEDETVVKRIKLFKPDYIFVGMGFPKQEEWIMTHENQFESTVMMGVGGSLEVFAGAKKRAPYIFRKLNIEWIYRALIDWKRIGRLKSIPIFMYKIAKAKRKIKKAK

SEQ ID NO: 3167 - DNA, 939 bp, Staphylococcus aureus
gtgactaagaaagtttattttaaccacgatggtggtgtagatgatttagtatctctatttttattattacaaatggaaaacgttcaattgataggggtcagtacaattggtgctgattgttatttagagccatctttgagcgcatcagtaaaaattattaatcgtttttcaaatgaagatattcaagttgcgccatcatatgaacgaggaaaaaatccatttcctaaagaatggcgtatgcatgccttttttatggacgcattgccaattttaaatgagccagtcaaacatgttgcttcaaatgtgagcgacaaagaagcctttgaagacattattcaaactttaaagagacaatcagaaaaagtaacattattatttacaggcccgcttacagatttagcaaaagcactacaaaaagattcatctatcgttcagtatatagaaaaattagtttggatgggtggcacctttttaccaaaaggaaatgttgaagaacctgagcatgatggttctgcagaatggaatgcatattgggatccagaagcggttaaaattgtttttgatagcgatatagagattgatatggttgctttagaaagtacgaatcaagtaccgctaacgttagatgttagacaaagatgggcgaatgaacgccaatatacgggcattgattttttaggagtaagttatgcagcggtaccaccattaacacactttataacaaattctacttactttttatgggatgttttaacgactgcttatattggtaacaaggacttggttcattcaattgagaaaaaagtcgatgtaataagttatggaccaagtcaaggtaagacatttgagtgtaaagatgggcgcaaaattaatgtcataaatcatgtagataacaacgcattttttgattatataactgcacttgctaaaaaagtaaat

SEQ ID NO: 3168 - protein, 313 aa, Staphylococcus aureus
  MISC_FEATURE (1)..(313): hypothetical protein
VTKKVYFNHDGGVDDLVSLFLLLQMENVQLIGVSTIGADCYLEPSLSASVKIINRFSNEDIQVAPSYERGKNPFPKEWRMHAFFMDALPILNEPVKHVASNVSDKEAFEDIIQTLKRQSEKVTLLFTGPLTDLAKALQKDSSIVQYIEKLVWMGGTFLPKGNVEEPEHDGSAEWNAYWDPEAVKIVFDSDIEIDMVALESTNQVPLTLDVRQRWANERQYTGIDFLGVSYAAVPPLTHFITNSTYFLWDVLTTAYIGNKDLVHSIEKKVDVISYGPSQGKTFECKDGRKINVINHVDNNAFFDYITALAKKVN

SEQ ID NO: 3169 - DNA, 762 bp, Staphylococcus aureus
atgaggttaacaatgaattatttatcaaacttttttaatacgacaattcaacttaatatatacattatcgttattgttgcagcttgttatattgctattcatcaatatagacataagcctgttttgaactatttagatgtcattttaaactatatccctgttttaacacatgaatttggtcatgtactgtttaataaactcgctggtggccgtgcaaaagatttagtcattgtaacaagtccacgagagcgacaacagacattacaacaaggattcgcaattacacaatctagacatctagcaggccaatggcttacaacgattggtggttattttatgccacctattatgttattgataggtttagcgtcgagccattatcagatacctagtttctttatatttacctatttattgatatttatttattttttaattttaacatctagaaaaggctcacccattgttgttataactttaatttctatcatgttgtattttatattaaaagatgaaaatatagtagaaattcaactacttgtcacaatgagttatcaatatattttaggtgtattattaggcgaagttctacaatctagttggacgattgctaaattgactttccagcgtccgagtccacagtgggatggtagtgcacttaaagaactcagtcatgtacctatcttcatttatagtacaatctggattatcttcaatctttatgcagtgaatattttactcaaatatactcacttgataaat

SEQ ID NO: 3170 - protein, 254 aa, Staphylococcus aureus
  MISC_FEATURE (1)..(254): hypothetical protein
MRLTMNYLSNFFNTTIQLNIYIIVIVAACYIAIHQYRHKPVLNYLDVILNYIPVLTHEFGHVLFNKLAGGRAKDLVIVTSPRERQQTLQQGFAITQSRHLAGQWLTTIGGYFMPPIMLLIGLASSHYQIPSFFIFTYLLIFIYFLILTSRKGSPIVVITLISIMLYFILKDENIVEIQLLVTMSYQYILGVLLGEVLQSSWTIAKLTFQRPSPQWDGSALKELSHVPIFIYSTIWIIFNLYAVNILLKYTHLIN

SEQ ID NO: 3171 - DNA, 642 bp, Staphylococcus aureus
atgttaactgaagaaaaagaggactatttaaaggcaatccttacgaataatggcgataaaaactttgtgacaaataaaatcttatctcaatttttaaatattaagcctccatctgtaagtgaaatggtaggacgtcttgaaaaagcaggctatgttgaaacaaaaccatacaaaggtgttagattaacagaggatggtttaacgcatacgcttgatatcattaagagacatcgactattagaattatttttaatagaaatattgaaatataattgggaagaagtacatcaagaagcagaaattttagaacatcgaatttcagatttatttgttgaaaggctggatagcctgttaaatttcccagaaacttgcccgcacggcggtgtgattcctagaaataatgaatataaagagaaatatataacaacgattttgaattatgaacctggtgatatcgttacaatcaaacgtgtgagagataagaccgatttgctaatatatttgtctagtaaagatatttctattggtaatgaagtggaaattgtatcgaaagatgaaatgaataaagtaattatcattaaacgtaatgataatgtaattattgtcagttacgaaaatgcaatgaacatgtttgctgaaaaa

SEQ ID NO: 3172 - protein, 214 aa, Staphylococcus aureus
  MISC_FEATURE (1)..(214): hypothetical protein
MLTEEKEDYLKAILTNNGDKNFVTNKILSQFLNIKPPSVSEMVGRLEKAGYVETKPYKGVRLTEDGLTHTLDIIKRHRLLELFLIEILKYNWEEVHQEAEILEHRISDLFVERLDSLLNFPETCPHGGVIPRNNEYKEKYITTILNYEPGDIVTIKRVRDKTDLLIYLSSKDISIGNEVEIVSKDEMNKVIIIKRNDNVIIVSYENAMNMFAEK

SEQ ID NO: 3173 - DNA, 741 bp, Staphylococcus aureus
ttgttagaaacaaaagatttaaatctgtttttaggtaataagcatgtacttaaaaacatttccttatcgataccagtacgcggcgaaataattggtatcatgggcccgaatggtgctggtaaatcttcccttatcaagtctttaattggtgaatttaatgctaccggtactaaattgttatataacaaacctatacaacaacaactgcaacatattacatatattccacaaaaagcacatattgatttagattttcctataagtgtggaacaagtgattttatcaggttgctacaaagaaattggatggtttagacgacctaataaatcagcaagggataaactcaaacagttattaagcgatttagaattagaatctttacgtcatcgacaaatttcagaattaagtggtggacaattacaacgtgtgctagtagcaagagcattgatgtccgaaagtgaagtttattttctagatgagccgtttgtcggaattgattttagtagcgaaaaattaatcatgacaaaaatcgagaacttaaaacaacaaggaaaacttattcttatcatccaccatgatctatcaaaagcaaagcaatactttgatcgcattattctattaaatcaaacattacgatactttggtgatagtgaagaggctatgagtgtcactcgcttaaacgaaacatttatgagtagcactgactgtagtgaccctagtcaaaggagcaatataacatgt

SEQ ID NO: 3174 - protein, 247 aa, Staphylococcus aureus
  MISC_FEATURE (1)..(247): hypothetical protein
LLETKDLNLFLGNKHVLKNISLSIPVRGEIIGIMGPNGAGKSSLIKSLIGEFNATGTKLLYNKPIQQQLQHITYIPQKAHIDLDFPISVEQVILSGCYKEIGWFRRPNKSARDKLKQLLSDLELESLRHRQISELSGGQLQRVLVARALMSESEVYFLDEPFVGIDFSSEKLIMTKIENLKQQGKLILIIHHDLSKAKQYFDRIILLNQTLRYFGDSEEAMSVTRLNETFMSSTDCSDPSQRSNITC

SEQ ID NO: 3175 - DNA, 834 bp, Staphylococcus aureus
atgttagagtttgtcgaacatttatttacatatcaattcttgaatcgagcattgataacttcaattattgtagggatagtttgtggtacagttggtagtttaattgtattacgtggtctttcattaatgggagatgcaatgagtcacgcagtattacctggtgttgccctatcattcttatttggtattccaatgtttgtaggcgcacttataactggtatgatcgcaagtatttttatcggttatatcacatctagtagtaaaacgaaacctgacgccgctattggaattagttttaccgctttcttagcttcggggattattattattagcttaataaacactacgacagatttgtaccatattctgtttggtaatttactggcaatcacaaatagtgcatttttaacaactattgtgattggttcaatcgtccttattctaatcattattttctatcgtccattaatgatttctacattcgatccaacgtttagtagaatgagtggtctaaatacgacgttattacattactttgtgatgttgttactctcattagtaacagtagcaagtattcaaacggtaggtattattcttgtagttgcattattaattacacctgcatctacagcatttttaattagtaaaaaactatactcaatgatgattatagcaagtttaataagtgtcataagttcaattgtcggactttattacagctatatttacaacattcctagtggtgcgacaatcgtactttgtacgtttgtaatttatatcatcacattatttttcacaaaatttacgaatagaaagaaacgaggaagtttaaca

SEQ ID NO: 3176 - protein, 278 aa, Staphylococcus aureus
  MISC_FEATURE (1)..(278): conserved hypothetical
MLEFVEHLFTYQFLNRALITSIIVGIVCGTVGSLIVLRGLSLMGDAMSHAVLPGVALSFLFGIPMFVGALITGMIASIFIGYITSSSKTKPDAAIGISFTAFLASGIIIISLINTTTDLYHILFGNLLAITNSAFLTTIVIGSIVLILIIIFYRPLMISTFDPTFSRMSGLNTTLLHYFVMLLLSLVTVASIQTVGIILVVALLITPASTAFLISKKLYSMMIIASLISVISSIVGLYYSYIYNIPSGATIVLCTFVIYIITLFFTKFTNRKKRGSLT

SEQ ID NO: 3177 - DNA, 936 bp, Staphylococcus aureus
atgaaaaaattagtacctttattattagccttattacttctagttgctgcatgtggtactggtggtaaacaaagcagtgataagtcaaatggcaaattaaaagtagtaacgacgaattcaattttatatgatatggctaaaaatgttggtggagacaacgtcgatattcatagtattgtacctgttggtcaagatcctcatgaatatgaagttaaacctaaagatattaaaaagttaactgacgctgacgttattttatacaacggattaaatttagagactggtaacggttggtttgaaaaagccttagaacaggctggtaaatcattaaaagataaaaaagttatcgcagtatcaaaagatgttaaacctatctatttaaacggtgaagaaggcaacaaagataaacaagatccacacgcatggttaagtttagataacggtattaaatacgtaaaaacaattcaacaaacatttatcgataacgacaaaaaacataaagcagattatgaaaagcaaggtaacaaatacattgctcaattggaaaaattaaataatgacagtaaagacagtaaagacaaatttaatgacattccaaaagaacaacgtgccatgattacaagtgaaggtgccttcaagtacttctcaaaacaatacggtattacaccaggttatatttgggaaattaacactgaaaaacaaggtacacctgaacaaatgagacaagctattgagtttgttaaaaagcacaaattaaaacacttattagtagaaacaagtgttgataagaaagcaatggaaagtttatctgaagaaacgaagaaagatatctttggtgaagtgtacacagattcaatcggtaaagaaggcactaaaggtgactcttactacaaaatgatgaaatcaaatattgaaactgtacacggaagcatgaaa

SEQ ID NO: 3178 - protein, 312 aa, Staphylococcus aureus
  MISC_FEATURE (1)..(312): lipoprotein [Staphylococcus
MKKLVPLLLALLLLVAACGTGGKQSSDKSNGKLKVVTTNSILYDMAKNVGGDNVDIHSIVPVGQDPHEYEVKPKDIKKLTDADVILYNGLNLETGNGWFEKALEQAGKSLKDKKVIAVSKDVKPIYLNGEEGNKDKQDPHAWLSLDNGIKYVKTIQQTFIDNDKKHKADYEKQGNKYIAQLEKLNNDSKDSKDKFNDIPKEQRAMITSEGAFKYFSKQYGITPGYIWEINTEKQGTPEQMRQAIEFVKKHKLKHLLVETSVDKKAMESLSEETKKDIFGEVYTDSIGKEGTKGDSYYKMMKSNIETVHGSMK

SEQ ID NO: 3179 - DNA, 2040 bp, Staphylococcus aureus
ttggaaatatttgaaacaattcttatatttatagctgttgtgatactaagttcgtttgtccatactttcatacctaaagtacccctagcatttatacaaattttcttgggcatgttactatttattaccccaatccctgttcaatttaattttgattctgaattgtttatggtaacaatgattgcgcctttgttatttgtagaaggtgttaatgtttctagagtccatttaaggaaatatattaagccagtgatgatgatggcattaggattagtcattactactgtgataggtgtaggtttatttattcattggatttggccagatttacctattggagcagcatttgcaattgctgccattctttgtcctactgatgcagtagcagtgcaagcaatcactaaaggaaaggtcttgccaaaaggagcaatgacaattcttgaaggtgagtcattattgaatgatgctgctggtattatttcatttaaaatagctgttggagtattagttacaggtgctttttcacttgttgatgctgttcagttgtttttaattgcatcaattggtggcgcagtggttggtttacttataggtatggcattagtaaggttccgattaacattgatgcgtcgaggatatgaaaacattaatatgtttacaattattcaattgttaacaccatttgttacgtatttaattgctgaattgtttcacgcatcaggaatcattgcagcagtagttgcaggacttgtacatggtttcgaacgtgacagaattatgcaagtacgtacacaactgcaaatgagttacaatcatacatggaatatactaggttatgttttaaatggctttgttttttcaatattaggatttttagtacctgaagttattattaaaattatcaaaacagaaccgcacaatttaatctttttaataggcatcactattgttgttgctttagctgtctatctatttagatttgtttgggtttatgtcttatatccttatttttatttagccatcagtccattccaaaaaatgatgactaaaaatgatgatgataatccaacgactgagaaaccaccaaagcgaagtttatacgctttaattatgacgttatgtggtgtgcatggaacaatttctttagcaatcgcattaacgttaccgtattttttagcagggcatcatgcttttacgtatagaaacgacttattatttattgcatctggtatggttattattagtttggtagttgcgcaagtattattgccattattaacgaaacctgcacctaaaacagtaattggcaatatgtcgtttaaagttgctagaatttatatattagaacaagttattgattatctaaatcaaaaatctactttcgaaacaagttttaaatatggtaacgtgattaaagaatatcatgataaattagcatttttaaaaactgtagagaaagatgatgaaaactctaaagaattagaacgtctacaaaaaattgcttttaatgtagaaacaaaaacattagagtctttagtagatgaaggacaaataacgaatagtgtacttgaaaactatatgcgttatgctgaaagaacacaggtatatagacaagcatcattaataagaagaatgattgtattattacgaggtgctttattaaaacgaagagtacaaacgagagtgaactccgcatcttcacttagtgttacggataacttaatggaattaaataaaattaataaattagtccattataatgtggttagtcgtttgtctaaggaaacaacaaaagataatacacttgaagttggaatggtttgtgacggttatttaatgcgaattgaaaacttaacaccatcaaatttcttcaactcagcaagtgaagatacgattactaaaattaaattaaatgcattgagagaacaacgtcgcattttacgtgagttgattgatacagatgaagtatcagaaggtacagcgttaaaactaagagaagccatcaattatgatgaaatggttattgtagatagtatgacg

SEQ ID NO: 3180 - protein, 680 aa, Staphylococcus aureus
  MISC_FEATURE (1)..(680): conserved hypothetical
LEIFETILIFIAVVILSSFVHTFIPKVPLAFIQIFLGMLLFITPIPVQFNFDSELFMVTMIAPLLFVEGVNVSRVHLRKYIKPVMMMALGLVITTVIGVGLFIHWIWPDLPIGAAFAIAAILCPTDAVAVQAITKGKVLPKGAMTILEGESLLNDAAGIISFKIAVGVLVTGAFSLVDAVQLFLIASIGGAVVGLLIGMALVRFRLTLMRRGYENINMFTIIQLLTPFVTYLIAELFHASGIIAAVVAGLVHGFERDRIMQVRTQLQMSYNHTWNILGYVLNGFVFSILGFLVPEVIIKIIKTEPHNLIFLIGITIVVALAVYLFRFVWVYVLYPYFYLAISPFQKMMTKNDDDNPTTEKPPKRSLYALIMTLCGVHGTISLAIALTLPYFLAGHHAFTYRNDLLFIASGMVIISLVVAQVLLPLLTKPAPKTVIGNMSFKVARIYILEQVIDYLNQKSTFETSFKYGNVIKEYHDKLAFLKTVEKDDENSKELERLQKIAFNVETKTLESLVDEGQITNSVLENYMRYAERTQVYRQASLIRRMIVLLRGALLKRRVQTRVNSASSLSVTDNLMELNKINKLVHYNVVSRLSKETTKDNTLEVGMVCDGYLMRIENLTPSNFFNSASEDTITKIKLNALREQRRILRELIDTDEVSEGTALKLREAINYDEMVIVDSMT

SEQ ID NO: 3181 - DNA, 345 bp, Staphylococcus aureus
gtgaaattccaagatgttttcttaagaagtcacgctgcgacaaaaagttcaactttatccgtgttattaactttaatcggtgtattaatttattttattgtgaatacaggatttttcagtgtgcgtttattactgtcacttgtttttattaatttaacttcaccagtcggcatgcacttagtcgctcgcgctgcttatcgcaacggcgcttatatgtatcgaaaaaatgatgctcacacacatgcatcaatattattaagttcaaatgaacaaaactctacagaagcattacaattacgtgctgaaaaacgagaagagcatcgtaagaaatggtatcaaaacgat

SEQ ID NO: 3182 - protein, 115 aa, Staphylococcus aureus
  MISC_FEATURE (1)..(115): conserved hypothetical
VKFQDVFLRSHAATKSSTLSVLLTLIGVLIYFIVNTGFFSVRLLLSLVFINLTSPVGMHLVARAAYRNGAYMYRKNDAHTHASILLSSNEQNSTEALQLRAEKREEHRKKWYQND

SEQ ID NO: 3183 - DNA, 300 bp, Staphylococcus aureus
atgatacaaacaataacacatattatgattattagttcactcattatttttggaattgcattaatcatctgtttatttagattaatcaagggacctacaacagcagatcgtgtcgttacatttgatacaacaagtgctgtcgtaatgtcaattgtgggtgtgttaagtgtacttatgggcaccgtttctttcttagattcaatcatgctcattgccattatatcttttgtaagttctgtttcaatatcacgctttattggtggggggcatgtgtttaatggaaataacaaaagaaatctt

SEQ ID NO: 3184 - protein, 100 aa, Staphylococcus aureus
  MISC_FEATURE (1)..(100): hypothetical protein
MIQTITHIMIISSLIIFGIALIICLFRLIKGPTTADRVVTFDTTSAVVMSIVGVLSVLMGTVSFLDSIMLIAIISFVSSVSISRFIGGGHVFNGNNKRNL

SEQ ID NO: 3185 - DNA, 324 bp, Staphylococcus aureus
ttgttatttccattaaacacatgccccccaccaataaagcgtgatattgaaacagaacttacaaaagatataatggcaatgagcatgattgaatctaagaaagaaacggtgcccataagtacacttaacacacccacaattgacattacgacagcacttgttgtatcaaatgtaacgacacgatctgctgttgtaggtcccttgattaatctaaataaacagatgattaatgcaattccaaaaataatgagtgaactaataatcataatatgtgttattgtttgtatcatcgcgacacctccaatattaagtcttcataatgct

SEQ ID NO: 3186 - protein, 108 aa, Staphylococcus aureus
LLFPLNTCPPPIKRDIETELTKDIMAMSMIESKKETVPISTLNTPTIDITTALVVSNVTTRSAVVGPLINLNKQMINAIPKIMSELIIIICVIVCIIATPPILSLHNA

SEQ ID NO: 3187 - DNA, 906 bp, Staphylococcus aureus
atgaaaaaactattattaccattaataattatgttattagtgttagctgcgtgtgggaaccaaggtgaaaaaaataacaaagctgaaactaaatcttataaaatggacgatggcaaaacggtagatattccgaaagaccctaaacgcattgcagtagttgcgccaacatatgctggtggacttaaaaaattaggtgcaaacattgtagctgtaaatcaacaagtcgatcaaagcaaagtattaaaagataaatttaaaggtgttacaaaaattggtgatggcgatgtagaaaaagttgctaaagaaaagccagatttaattattgtatactctactgacaaagatattaaaaaatatcaaaaagtagcaccaacagtagttgttgactataataagcataaatatttagaacaacaagaaatgttagggaaaattgttggtaaagaagataaagtaaaagcttggaagaaagattgggaagaaacaactgctaaagacggtaaagaaattaaaaaagcaattggacaagatgcaacagtgtcattgtttgatgaatttgataaaaaattatacacttacggcgataactggggtcgtggtggagaagtattatatcaagcatttggtttgaaaatgcaaccagaacaacaaaagttaactgcaaaagcaggttgggctgaagtgaaacaagaagaaattgaaaaatatgctggtgattacattgtgagtacaagtgaaggtaaacctacaccaggatacgaatcaacaaacatgtggaagaatttgaaagctactaaagaaggacatattgttaaagttgatgctggtacatactggtacaacgatccttatacattagatttcatgcgtaaagatttaaaagaaaaattaattaaagctgcaaaa

SEQ ID NO: 3188 - protein, 302 aa, Staphylococcus aureus
  MISC_FEATURE (1)..(302): hypothetical protein
MKKLLLPLIIMLLVLAACGNQGEKNNKAETKSYKMDDGKTVDIPKDPKRIAVVAPTYAGGLKKLGANIVAVNQQVDQSKVLKDKFKGVTKIGDGDVEKVAKEKPDLIIVYSTDKDIKKYQKVAPTVVVDYNKHKYLEQQEMLGKIVGKEDKVKAWKKDWEETTAKDGKEIKKAIGQDATVSLFDEFDKKLYTYGDNWGRGGEVLYQAFGLKMQPEQQKLTAKAGWAEVKQEEIEKYAGDYIVSTSEGKPTPGYESTNMWKNLKATKEGHIVKVDAGTYWYNDPYTLDFMRKDLKEKLIKAAK

SEQ ID NO: 3189 - DNA, 489 bp, Staphylococcus aureus
atgacatttgaagagaagcttagcaaaatatacaatgaaattgcgaatgagattagcagtatgataccggtagagtgggaaaaagtatatacaatggcttatatagatgatggaggaggtgaagtattctttaattatactaaaccaggtagtgatgacttgaattattacaccaatatacctaaggagtataacatttctgtgcaagtatttgatgatttatggatggatttatatgatttatttgaggagttaagagatttatttaaagaagaagatttagaaccatggacatcatgcgaatttgattttacaagagaaggtgaattaaaagtttcatttgattatattgattggataaattcagaatttggtcaaataggtcgacaaaattactataagtatagaaaatttggaattttaccagaaacggaatatgaaattaataaagttaaagaaatcgagcaatatattaaagagctagaagaa

SEQ ID NO: 3190 - protein, 163 aa, Staphylococcus aureus
  MISC_FEATURE (1)..(163): conserved hypothetical
MTFEEKLSKIYNEIANEISSMIPVEWEKVYTMAYIDDGGGEVFFNYTKPGSDDLNYYTNIPKEYNISVQVFDDLWMDLYDLFEELRDLFKEEDLEPWTSCEFDFTREGELKVSFDYIDWINSEFGQIGRQNYYKYRKFGILPETEYEINKVKEIEQYIKELEE

SEQ ID NO: 3191 - DNA, 480 bp, Staphylococcus aureus
atgaatcaaatagttttaaatattatcattgcattcttatgggtattatttcaagatgaagatcattttaaattctcgactttcttttctggatatctaattggtttaattgtcatttatatattacacaggtttttcagcgatgatttttatgttagaaaaatatgggtagctattaaatttttaggtgtttatttatatcaattaataacatctagcattagcacgattaattatattctttttaaaacaaaagatatgaaccctggattactttcatatgaaacaagactaacaagtgattggtcaataacatttttaacaattttaattattataactccagggtctacagtaatacgaatttctcaagactctaaaaagttttttattcatagtatcgacgtgtcagaaaaagaaaaagatagtttgttaagaagtattaagcattatgaagacttaatattggaggtgtcgcga

SEQ ID NO: 3192 - protein, 160 aa, Staphylococcus aureus
  MISC_FEATURE (1)..(160): hypothetical protein
MNQIVLNIIIAFLWVLFQDEDHFKFSTFFSGYLIGLIVIYILHRFFSDDFYVRKIWVAIKFLGVYLYQLITSSISTINYILFKTKDMNPGLLSYETRLTSDWSITFLTILIIITPGSTVIRISQDSKKFFIHSIDVSEKEKDSLLRSIKHYEDLILEVSR

SEQ ID NO: 3193 - DNA, 1497 bp, Staphylococcus aureus
atgatgctaagtaacttattgattttaccaatgttattaccattcctttgtgccttaatccttgtatttttaaaaaataatgatcgtatttctaaatatttatacttaggtacaatgactatcaccacaattatttcattaatgctattaatttatgttcagcgtcaccgtccaattacgctagactttggaggatggtcagcgccctttggtatacagtttttaggagattctttaagtttaattatggttacaaccgcttcgtttgtgattactttaattatggcatacggatttgggcgtggcgaacataaagcaaatcgttatcacttgccatcgttcatattatttttaagtgttggcgtgataggctcttttctaacatcagatttatttaatttatacgtcatgtttgaaattatgttactagcgtcatttgtactcattacacttggacaatctgtagaacaattacgtgctgcaattatttatgttgtcttgaatattattggttcatggctattcttattaggtataggtttactttataaaacagtaggtacattaaacttttcacatattgcaatgcgtttgaatgacatgggagataatcgcactgttacaatgatttcattaatcttcttagtcgcatttagtgcgaaagcagcgctggtcctttttatgtggctacccaaagcctacgctgtgttaaatactgagcttgcagcattatttgcagcgttaatgaccaaagtaggggcctatgcattaattcgattcttcactttactatttgatcaacataatgatctcatacatccattgctagcaactatggctgctataactatggtcatcggcgctataggtgtcattgcttataaagatattaaaaagattgcagcttaccaagtcataatctcaataggatttatcattttaggtttaggaacaaacacgtttgcaggtattaatggtgcaatattttatttggtaaatgacattgttgtaaaaacattgctattttttattattggtagtttagtttacattacaggctatcgacaatatcaatatttgaatggcttagctaaaaaagaacctttatttggagttgcgtttattataatgatttttgctattggcggcgtgcctccatttagtggctttccggggaaagtacttattttccaaggtgcattgcaaaatggcaattatattggactagcgttaatgattattactagtctaattgcaatgtacagtttatttaggatacttttttatatgtattttggagataaagatggggaggaagttaattttaagaaaatcccgctatatcgaaaaagaattttaagtattttagtagttgtggttatcgcaatcggaattgctgcacctgttgtgttaaatgttacaagtgatgcaactgagttgaacacgagtgatcaattatatcaaaaacttgtaaatccgcatttgaaaggagaggac

SEQ ID NO: 3194 - protein, 499 aa, Staphylococcus aureus
  MISC_FEATURE (1)..(499): MnhD homologue
MMLSNLLILPMLLPFLCALILVFLKNNDRISKYLYLGTMTITTIISLMLLIYVQRHRPITLDFGGWSAPFGIQFLGDSLSLIMVTTASFVITLIMAYGFGRGEHKANRYHLPSFILFLSVGVIGSFLTSDLFNLYVMFEIMLLASFVLITLGQSVEQLRAAIIYVVLNIIGSWLFLLGIGLLYKTVGTLNFSHIAMRLNDMGDNRTVTMISLIFLVAFSAKAALVLFMWLPKAYAVLNTELAALFAALMTKVGAYALIRFFTLLFDQHNDLIHPLLATMAAITMVIGAIGVIAYKDIKKIAAYQVIISIGFIILGLGTNTFAGINGAIFYLVNDIVVKTLLFFIIGSLVYITGYRQYQYLNGLAKKEPLFGVAFIIMIFAIGGVPPFSGFPGKVLIFQGALQNGNYIGLALMIITSLIAMYSLFRILFYMYFGDKDGEEVNFKKIPLYRKRILSILVVVVIAIGIAAPVVLNVTSDATELNTSDQLYQKLVNPHLKGED

SEQ ID NO: 3195 - DNA, 342 bp, Staphylococcus aureus
atgaatttaatattattactagttataggatttttagtgtttataggaacatatatgattttatcaatcaatttaattcgtattgtaatcggaatttcaatatatactcatgctggtaatctcattattatgagtatgggaacgtatggttctagtagatcagaaccactaataactggtggaaaccaattgtttgttgatcccttgttacaagctattgtactaactgcaatagttatagggtttgggatgactgcgtttttacttgtacttgtttatagaacttataaagtaacaaaagaagatgaaattgaaggcctaaggggggaagatgatgctaag

SEQ ID NO: 3196 - protein, 114 aa, Staphylococcus aureus
  MISC_FEATURE (1)..(114): hypothetical protein
MNLILLLVIGFLVFIGTYMILSINLIRIVIGISIYTHAGNLIIMSMGTYGSSRSEPLITGGNQLFVDPLLQAIVLTAIVIGFGMTAFLLVLVYRTYKVTKEDEIEGLRGEDDAK

SEQ ID NO: 3197 - DNA, 423 bp, Staphylococcus aureus
atgaaagagaatgatgtcgtgttaagaacggtcacgaaacttgttgtatttattttattgactttcggattctatgtcttcttcgcaggtcataataatcctggtggtgggtttattggtggtttaatatttagttcagcgtttattttaatgtttctggcttttaatgttgaagaggttttagaaagtttaccgattgattttagaattttaatgattattggagcattggtatcatctattactgcgataatacctatgttttttggaaaaccatttttgtctcaatatgaaacaacttggatacttccaattttaggacaaattcatgtaagtacaataacactttttgaattaggtattttattctcagttgttggtgttattgtcacagtgatgttgtcgcttagcggaggtcgatca

SEQ ID NO: 3198 - protein, 141 aa, Staphylococcus aureus
  MISC_FEATURE (1)..(141): hypothetical protein
MKENDVVLRTVTKLVVFILLTFGFYVFFAGHNNPGGGFIGGLIFSSAFILMFLAFNVEEVLESLPIDFRILMIIGALVSSITAIIPMFFGKPFLSQYETTWILPILGQIHVSTITLFELGILFSVVGVIVTVMLSLSGGRS

SEQ ID NO: 3199 - DNA, 2400 bp, Staphylococcus aureus
atgagtttggtttatttattaattgctatacttgtgattatggcgatgatacttctaatgtctaaacgtagagcattggctaaatatgccgggtacatagcgttggttgcacctgtaatttcatctatctattttttgattcaaataccatcagtagctaaactgcaatatctttctacctctattccatggattaagacattagatattaatttagatttacgtttagatggtttaagtttaatgttttctcttattatttcacttattggaattgcagtattcttctatgcaactcaatatttatcctctcgaaaagacaatttaccaaggttttatttttatttaacgttatttatgttcagtatgattggtattgtattatcagacaatacgatattgatgtacattttttgggaattaacgagtgtatcatcatttttattgatttcatattggtataacaatggtgacagtcaatttggtgcgattcaatcatttatgattacagtatttggtggattggcgttattagttggttttattatgctgtatatcatgacaggaacgaataacatcacagagatattaggacaagcagatcatattaagaatcatggattgtttatccctatgatttttatgtttttattaggtgcatttacaaaatcagcacaatttccatttcatatttggctacctagagcaatggctgcacctacacctgtaagtgcttatttacattcagccacgatggtaaaagctggtatctttttattacttcgatttacaccattattaggtcttagcaatatgtacgtatatatcgttacgtttgttggtttaataacaatgttatttggttcaattacagctttaaaacaatgggatttaaaaggtatcctagcgtactctacaatcagtcaacttgggatgattatggctatggtgggtataggtggcggatatgctcaacaccaacaagacgcaatagcatctatttatgtatttgtattatttggtgcgctatttcatctaatgaatcatgccatctttaaatgtgcgcttttcatgggagtaggtattttagatcatgaagcaggttcaagggatatacgaattttaagtggaatgcgtcaactatttcctaaaatgaatctagtcatgacgatagcggctctatctatggctggagtaccatttttaaatggatttttaagtaaagaaatgtttttagatgcattaacacaaactggacaattatcccaatttagtttgatttcaatgatagctatcgtgtttgttggtgttattgcgagtgtttttacattcacatatgcactatacatggtaaaagaagtattttggacaaaatatgattctaaggtttttactaaaaaaaatatccacgaaccatggttgtttagtttaccatctcttatattaatggtgctagtacctgtaatcttttttgtaccaaatatatttgggaaggggattatcgttctagcattaagagctgtatcaggtggtaatcatcaaattgatcaattggcaccacatgtttcgcaatggcatggatttaacataccgcttcttttaaccatcatcattattttattgggtagtgtactagcaatcaaagtagattggaaaaaagtgttcacaggtaaaattagacagatttcagtttcaaaaagctatgagatggtatatcgacattttgaaaagtttgctacgaagcgatttaaacgtgttatgcaagatcgtttaaaccaatacattattatgaccttaggcatatttatgattatcattggatatggttatattcgaattggacttcctaaagtacatcagttacatgtttctgaatttggggcattagaaattatattagcaatcgtaactgtcacaattggtatttctttaatttttatacgtcaacgactgacaatggtcattttaaatggagtcatcggatttgttgtgaccttattctttatagcaatgaaagcccctgatctagcattgactcagctagtagttgaaacaataacgacgatactatttattgtcagtttttcaagattaccaaacgtgccaagatctaacgctaacaaaaaaagagaaataattaaaatttctgtatcactcttgatggcacttattgttgtatcattaatttttattacacaacaaacagatggtttatcatcaatatcagacttttatttaaaagctgacaaactaacaggtggtaaaaatattgtaaatgcgatacttggtgactttagagcattagatacattatttgaaggattagtgttaattattactgggctaggtatttacacattattaaattatcaagatcggaggggacaagatgaaagagaa

SEQ ID NO: 3200 - protein, 800 aa, Staphylococcus aureus
  MISC_FEATURE (1)..(800): hypothetical protein
MSLVYLLIAILVIMAMILLMSKRRALAKYAGYIALVAPVISSIYFLIQIPSVAKLQYLSTSIPWIKTLDINLDLRLDGLSLMFSLIISLIGIAVFFYATQYLSSRKDNLPRFYFYLTLFMFSMIGIVLSDNTILMYIFWELTSVSSFLLISYWYNNGDSQFGAIQSFMITVFGGLALLVGFIMLYIMTGTNNITEILGQADHIKNHGLFIPMIFMFLLGAFTKSAQFPFHIWLPRAMAAPTPVSAYLHSATMVKAGIFLLLRFTPLLGLSNMYVYIVTFVGLITMLFGSITALKQWDLKGILAYSTISQLGMIMAMVGIGGGYAQHQQDAIASIYVFVLFGALFHLMNHAIFKCALFMGVGILDHEAGSRDIRILSGMRQLFPKMNLVMTIAALSMAGVPFLNGFLSKEMFLDALTQTGQLSQFSLISMIAIVFVGVIASVFTFTYALYMVKEVFWTKYDSKVFTKKNIHEPWLFSLPSLILMVLVPVIFFVPNIFGKGIIVLALRAVSGGNHQIDQLAPHVSQWHGFNIPLLLTIIIILLGSVLAIKVDWKKVFTGKIRQISVSKSYEMVYRHFEKFATKRFKRVMQDRLNQYIIMTLGIFMIIIGYGYIRIGLPKVHQLHVSEFGALEIILAIVTVTIGISLIFIRQRLTMVILNGVIGFVVTLFFIAMKAPDLALTQLVVETITTILFIVSFSRLPNVPRSNANKKREIIKISVSLLMALIVVSLIFITQQTDGLSSISDFYLKADKLTGGKNIVNAILGDFRALDTLFEGLVLIITGLGIYTLLNYQDRRGQDERE

SEQ ID NO: 3201 - DNA, 558 bp, Staphylococcus aureus
atgaataaagtagaagcgattaaatttaatgatgatattgttaaaatgtatgaagcgctcaagataaaatctgaacgtgactatttattctttaagttagctatacatagtggattgaaagtatcagaattattaacaattacagtctctcaagttaagagactaattgaaaagtgtacgttatcagaaatgtgtaaagcacattttcattcgttgattaaaattaggttaccagaaacattatcgaaagaactacttcaatatatagaggacaggagtctttcgaatgaagacgttctttttcaatcactacgaacaaatcaagtattatctagacagcaagcatatcgaataattcaccaagcatcaattgaagctggtatagataatgtaggactaacgacattgcgtaagacatttgcatatcatgcttatcaaaaaggtatacttataccagtcattcaaaagtatttagggcatcaatctgctattgaaacactaaattttatcggtttagaaaatgagtgtgaacatagtatttatatttcattacaatta

SEQ ID NO: 3202 - protein, 186 aa, Staphylococcus aureus
  MISC_FEATURE (1)..(186): hypothetical protein
MNKVEAIKFNDDIVKMYEALKIKSERDYLFFKLAIHSGLKVSELLTITVSQVKRLIEKCTLSEMCKAHFHSLIKIRLPETLSKELLQYIEDRSLSNEDVLFQSLRTNQVLSRQQAYRIIHQASIEAGIDNVGLTTLRKTFAYHAYQKGILIPVIQKYLGHQSAIETLNFIGLENECEHSIYISLQL

SEQ ID NO: 3203 - DNA, 201 bp, Staphylococcus aureus
atgagtaaaataaaccacatcactattgtattatcatttactaaagtagacgctaacggcaaacaaacagaatttaagcgtcgattcgctaacattaaccctgatgcatcaaacgaccaaattaaaacattcagcaaacttattgagcgacttactggagaaacatatagcaatatcgaactcatcaaatctttatcaatt

SEQ ID NO: 3204 - protein, 67 aa, Staphylococcus aureus
  MISC_FEATURE (1)..(67): hypothetical protein
MSKINHITIVLSFTKVDANGKQTEFKRRFANINPDASNDQIKTFSKLIERLTGETYSNIELIKSLSI

SEQ ID NO: 3205 - DNA, 222 bp, Staphylococcus aureus
atgactaaaacacttgaattaagttttaaatcttcactagacaagcctgtaaaactgcaattaccacaattaaacaacgtagtgaccgagcaagttgcacgtgatagtatgaatgcattagtagatttaaatattataaagtcaaatagtggtactatcaccaaagtacattctgctcaaattattgataaaacaacaactgttttatttgaagataagaaa

SEQ ID NO: 3206 - protein, 74 aa, Staphylococcus aureus
  MISC_FEATURE (1)..(74): hypothetical protein
MTKTLELSFKSSLDKPVKLQLPQLNNVVTEQVARDSMNALVDLNIIKSNSGTITKVHSAQIIDKTTTVLFEDKK

SEQ ID NO: 3207 - DNA, 927 bp, Staphylococcus aureus
atgcttcttttctatatcattggtgtcctagttggaatgcttattcctatccaaacatctgtcaattcaagactatcactgtatactaaatcgcctttctatacttcattcatttcattttcagttggaacaatttgtttaattattttaaatatcattatcaatccagaagtatttactattcacttttacaataatcaatcatttaactacacatgggtagtcggtggtttgcttggggttagctttttaactggcaatttattgttattgccaaaattaggtgcaacattaactgtaattgcaacagttgcgggtcaaattattatgggtgtcattattgatacatttggattatttggcgctacaattcatgattttaatttaattaaagcaattggagtattgttactcattgtcggcatcgtcataatgaatcaatttaacaagaataatttattactaactgatcaaaagtatttactgttttggcttctattaggatttatttttggtttctttccacctattcaaacgacaattaatagtgctttagctagtcatactcattcaccagcctttgcatcattagtatcatttacaattgggtcaatagcgctattgattttaaccgctatttttaatcgttctttaaaactaaaaacaagtcatttaaaattcggtaaattaaagcctatctattttactggcggtatacttggcatggcttttgtaacagctaacattatcttaatgcctcatatgggtgcagcattaacaacacttattgggatgtttggccagattctaatgggcatattgatagatcactttggattatttggttcacctaaaatagcaatgacatccagaaaaactattggtctattatgtattttgacaggcattatacttttaagattattt

SEQ ID NO: 3208 - protein, 309 aa, Staphylococcus aureus
  MISC_FEATURE (1)..(309): conserved hypothetical
MLLFYIIGVLVGMLIPIQTSVNSRLSLYTKSPFYTSFISFSVGTICLIILNIIINPEVFTIHFYNNQSFNYTWVVGGLLGVSFLTGNLLLLPKLGATLTVIATVAGQIIMGVIIDTFGLFGATIHDFNLIKAIGVLLLIVGIVIMNQFNKNNLLLTDQKYLLFWLLLGFIFGFFPPIQTTINSALASHTHSPAFASLVSFTIGSIALLILTAIFNRSLKLKTSHLKFGKLKPIYFTGGILGMAFVTANIILMPHMGAALTTLIGMFGQILMGILIDHFGLFGSPKIAMTSRKTIGLLCILTGIILLRLF

SEQ ID NO: 3209 - DNA, 372 bp, Staphylococcus aureus
atggcaattacaaaaatcaatgattgctttgagttgttatcaatggtcacttatgctgacaaattaaaaagtttaattaaaaaggaattttcaattagctttgaagaattcgctgtattgacatacatcagcgaaaacaaagagaaagaatactatcttaaagatattattaatcatttaaactacaaacaaccacaagttgttaaagcagttaaaattttatctcaagaagattacttcgataaaaaacgtaatgagcatgatgaaagaactgtattaattcttgttaatgcacaacaacgtaaaaaaatcgaatcattattgagtcgagtaaataaacgaatcactgaagcaaacaacgaaattgaacta

SEQ ID NO: 3210 - protein, 124 aa, Staphylococcus aureus
  MISC_FEATURE (1)..(124): staphylococcal accessory
MAITKINDCFELLSMVTYADKLKSLIKKEFSISFEEFAVLTYISENKEKEYYLKDIINHLNYKQPQVVKAVKILSQEDYFDKKRNEHDERTVLILVNAQQRKKIESLLSRVNKRITEANNEIEL

SEQ ID NO: 3211 - DNA, 156 bp, Staphylococcus aureus
gtgattgatttagcgatgagaatagttggtgctaaaagcttagaaatgaatcgaccattacaacgttactatcgtgacatgcgtgcaggattacacaatccacctatggaagatgcagcatatacaaatattgctaagagtattacagatacattt

SEQ ID NO: 3212 - protein, 52 aa, Staphylococcus aureus
  MISC_FEATURE (1)..(52): hypothetical protein
VIDLAMRIVGAKSLEMNRPLQRYYRDMRAGLHNPPMEDAAYTNIAKSITDTF

SEQ ID NO: 3213 - DNA, 786 bp, Staphylococcus aureus
atgaataaagtcacaattaatcctcaaatccaattaacttatcaaattgaaggtaaaggggatcctataatattacttcatggattggatggtaatttagctggatttgaagatttgcaacatcaactagcatcatcatataaagtacttacttacgatttaagaggtcatggcaagtcttctaaaagtgaatcatacgatttaaacgatcacgttgaggatttaaaaattctaatggagaagttaaatattcatgaggcacatattctaggacatgatttaggtggggtagttgctaagttatttacagataaatatgcttatcgtgtaaaatcattaactaccattgcatcgaagaaagatgacttaatacacagctttactcaattgttaatacaatatcaagatgatatagcgggttttaataagtctgaagcgtatattcttttattttctaaattgtttagaaatcaagagaagacgatgaaatggtatcaaaaacaaagaatatatagcattaagtctgaggatgatagtgcggtggcaattcgttcattaattttgcataaagatgaacctatgtatttaaaaaaacgtacatgtgtacctactttgttaattaatggggaacatgatcctttgattaaagataagaatcattttaaattggaagcgcattttttaaatgttacgaaaaaaatcttcgaacattcaggacatgcaccgcatattgaagaaccagaagcatttatgaattattatttaaaatttttaaaaagcgtatca

SEQ ID NO: 3214 - protein, 262 aa, Staphylococcus aureus
  MISC_FEATURE (1)..(262): hypothetical protein
MNKVTINPQIQLTYQIEGKGDPIILLHGLDGNLAGFEDLQHQLASSYKVLTYDLRGHGKSSKSESYDLNDHVEDLKILMEKLNIHEAHILGHDLGGVVAKLFTDKYAYRVKSLTTIASKKDDLIHSFTQLLIQYQDDIAGFNKSEAYILLFSKLFRNQEKTMKWYQKQRIYSIKSEDDSAVAIRSLILHKDEPMYLKKRTCVPTLLINGEHDPLIKDKNHFKLEAHFLNVTKKIFEHSGHAPHIEEPEAFMNYYLKFLKSVS

SEQ ID NO: 3215 - DNA, 741 bp, Staphylococcus aureus
atgtttcattttaaaggagtactaccaatgcgtattaacgataaaattttactagaaaatatagaagattactttaatcataaaggtttatcaccgcatttgattgatgatattaaagagaaagtaattactgatataaaaaattctgaaaagaaagatcaagattatattgaatataaaagaaaatctccagcacaaatcatattaatgattcaaaggaatttgtttgctttacaaatgaatccagttattttctttattataaacttcattctcatatcctatttatatgataaacagtatgttcagtttcaagctattactggaatgagtctattttattgtttagtgatttttccaatgactattgttgtatacctaagggtgtctcaaaagaattacttgcgtagtaataaaatagaaatgattatgggtacaattatcgctatcatatccttgttattaattatattacaagcatttaatattacttggggcgttataccaattacaaattttggacatcaatttttctttttcattggtattattttagtaattgccggcatattttataagcgacttgagttttcgggaatcgggttattattttgtcaaaaaaccgtcgatgcaatgattcataatccacaatcagcccagattttttcattaattatatggatattattagtagttctagttatatatttcacaattagattatcttcacgtacaagatta

SEQ ID NO: 3216 - protein, 247 aa, Staphylococcus aureus
  MISC_FEATURE (1)..(247): hypothetical protein
MFHFKGVLPMRINDKILLENIEDYFNHKGLSPHLIDDIKEKVITDIKNSEKKDQDYIEYKRKSPAQIILMIQRNLFALQMNPVIFFIINFILISYLYDKQYVQFQAITGMSLFYCLVIFPMTIVVYLRVSQKNYLRSNKIEMIMGTIIAIISLLLIILQAFNITWGVIPITNFGHQFFFFIGIILVIAGIFYKRLEFSGIGLLFCQKTVDAMIHNPQSAQIFSLIIWILLVVLVIYFTIRLSSRTRL

SEQ ID NO: 3217 - DNA, 510 bp, Staphylococcus aureus
gtgcttatgaaaaagctactaacggcaagtataattgcatgttctgttgtaatgggagtaggcttagtgaacactagtgccgaagcagcaagtggcaactctattgatactgttaaacaattaattaagggtgatcagtcattagaaaatgtgaaaattggcgaatctattaaagatgttttaactaagtacaaaaatccgatgtattcttacaatgaagatggaactgaacattattacgaattccatactaaaaaaggtatgttattagtaactactgatggtaagaaaaacaatggtaaagtaactcatatttcaatgatgtataatgatgctaatggtccaacatatcaagctgttaaaaattatgttggcaaagcagtaacacatacggaatatagcaaagttgctggtaattttggatatattgaaaaaggcaaaacgacttatcaatttgcctcagcaccaaaagataaaaacataaaattatatcgtattgatttggaaaaa

SEQ ID NO: 3218 - protein, 170 aa, Staphylococcus aureus
  MISC_FEATURE (1)..(170): hypothetical protein
VLMKKLLTASIIACSVVMGVGLVNTSAEAASGNSIDTVKQLIKGDQSLENVKIGESIKDVLTKYKNPMYSYNEDGTEHYYEFHTKKGMLLVTTDGKKNNGKVTHISMMYNDANGPTYQAVKNYVGKAVTHTEYSKVAGNFGYIEKGKTTYQFASAPKDKNIKLYRIDLEK

SEQ ID NO: 3219 - DNA, 819 bp, Staphylococcus aureus
atgataataaaggagaaaattatggatctatttactagaaaagatggaacatcgatacattacagtacattaggtgaaggctatcctatcgtattgattcatactgtacttgataattattctgtgtttaataaattagcagcagaattagcaaaatcatttcaagttgtgttaattgatttacgtggacatggctattctgataaacctcgtcacattgaaataaaagatttttctgatgacattgttgaattacttaaatatttatatattgaagaagttgcatttgtatgccatgaaatgggtggaatcattggtgcggatatttcagtacgttatcctgaatttacatcatcacttacgttggtaaatccaacatctattgaaggtgaattaccggaagaacgtttatttagaaaatatgcccatattattcgaaactgggatcctgaaaaacaagataaatttttaaataagcgtaagtattatcgtccgagaaaaatgaatcgattcctcaaacatgtcgtagatacaaatgaaatatcaactaaagaagaaattcaagcagttaaagaggtattcaaaaacgctgatatttctcaaacttatagaaatgtcgtagtaccgacaaaaattattgcaggagaattcggtgaaagaacaacaagattagaagctaaagaagtagctgatttaatccaaaatgcggactttgaagtatatcaagaatcaagtgcattcccatttgttgaagagcaagaaagattcgtcgaagatacagctgcatttatcaacaaacatcacgatgaaaagcatgtt

SEQ ID NO: 3220 - protein, 273 aa, Staphylococcus aureus
  MISC_FEATURE (1)..(273): hypothetical protein
MIIKEKIMDLFTRKDGTSIHYSTLGEGYPIVLIHTVLDNYSVFNKLAAELAKSFQVVLIDLRGHGYSDKPRHIEIKDFSDDIVELLKYLYIEEVAFVCHEMGGIIGADISVRYPEFTSSLTLVNPTSIEGELPEERLFRKYAHIIRNWDPEKQDKFLNKRKYYRPRKMNRFLKHVVDTNEISTKEEIQAVKEVFKNADISQTYRNVVVPTKIIAGEFGERTTRLEAKEVADLIQNADFEVYQESSAFPFVEEQERFVEDTAAFINKHHDEKHV

SEQ ID NO: 3221 - DNA, 717 bp, Staphylococcus aureus
atggatttgaatcaaattaaagcagttgtatttgatttagaaggtacgttgttggacagagttaaatctcgagagaaatttatcgaagagcaatatgaacgatttcatgactacttaattcatgttcaactggcagattttaaaaaagcatttattgagctagatgacgatgaagataatgataaacctgatttatataaagaaatcattaaacgtttccatgtagataggttaacttggaaagacttatttaatgattttgaaatgcatttttatcgttatgtatttccttattacgatactttgtatacactagaaaagctatcgcaaaaaggctttcaaattggtgttatcgcaaatggtaaatctaagattaaacaatttcgattacattcacttggtttgatgcatgttattaattatttatcaacatcagaaacagttggttttcgtaaaccacatcctaaaatttttgaagatatgattgatcaactaggggtattacctgagcaaattatgtatgttggcgatgatgcgttaaatgatgtagctccagcacgagctatgggcatggttagtgtatggtataaacaagaagatgctgaaattgaaccactcgaagaagaagttgattttacaattacaacagtggaagaattattaaccattttaccaataaaaaatgataataaaggagaaaattatggatctatttac

SEQ ID NO: 3222 - protein, 239 aa, Staphylococcus aureus
  MISC_FEATURE (1)..(239): hypothetical protein
MDLNQIKAVVFDLEGTLLDRVKSREKFIEEQYERFHDYLIHVQLADFKKAFIELDDDEDNDKPDLYKEIIKRFHVDRLTWKDLFNDFEMHFYRYVFPYYDTLYTLEKLSQKGFQIGVIANGKSKIKQFRLHSLGLMHVINYLSTSETVGFRKPHPKIFEDMIDQLGVLPEQIMYVGDDALNDVAPARAMGMVSVWYKQEDAEIEPLEEEVDFTITTVEELLTILPIKNDNKGENYGSIY

SEQ ID NO: 3223 - DNA, 996 bp, Staphylococcus aureus
gtgattgctataatgaatgtaattatcgatgaaagaaaagagaatgctatgacatttaataaagtattattgagctggatagtcatattgattataacaactagcatatatctattttggcagttgggcgatatcaatgatgtatttaaccagtctattttaatcaatgttagattaccgagattattagaagcattgttgacaggtatgatattaactgttgcaggccttatatttcaaacagttttaaataatgcattggcagatagctttacattaggattggcaagcggcgctacatttggttcaggattagcattatttttaggtttaacaacgttatggattcctgtattttcaataacatttagtttgataacattaataactgtattagtcattacgtcggtattgagccaaggctatccagttagaatcttaatattaagtggtttaatgattggtgcgttattcaattcacttctatattttttgattttattaaaacctcgcaaattaaatacaattgccaattatctgtttggtggttttggtgatgcagaatactcaaatgtatctataatagcaatcacatttatcattgcattgtttggtatatttatcattcttaatcaactaaagttattgcaattaggagaactaaaaagtcagtcactaggcttaaatgttcaattgattacatatatcgcgttatgtatagcttctatgataacggcgataaatgtcgcatatgttggcatcattggattcattggtatggtgataccgcaactcattagaaaatggcagtggaaacaatcattaggaagacaattggctttaaatattgtaactggaggacaaataatggttatggcagattttattggtagccatatattgtcaccagtacaaataccggcaagtattatcattgcattaattggtataccagtgttattttacatgctaatatctcagtcgaaacggttacac

SEQ ID NO: 3224 - protein, 332 aa, Staphylococcus aureus
  MISC_FEATURE (1)..(332): hypothetical protein
VIAIMNVIIDERKENAMTFNKVLLSWIVILIITTSIYLFWQLGDINDVFNQSILINVRLPRLLEALLTGMILTVAGLIFQTVLNNALADSFTLGLASGATFGSGLALFLGLTTLWIPVFSITFSLITLITVLVITSVLSQGYPVRILILSGLMIGALFNSLLYFLILLKPRKLNTIANYLFGGFGDAEYSNVSIIAITFIIALFGIFIILNQLKLLQLGELKSQSLGLNVQLITYIALCIASMITAINVAYVGIIGFIGMVIPQLIRKWQWKQSLGRQLALNIVTGGQIMVMADFIGSHILSPVQIPASIIIALIGIPVLFYMLISQSKRLH

SEQ ID NO: 3225 - DNA, 912 bp, Staphylococcus aureus
gtgggattaaaaaggagatgtgatagtgtgaagaaatcgttaattgcttttattttgatttttatgcttgtcctgagtggctgtggtatgaaagataatgataaacaaggtagcaatgataatggctcgtctaaatcgccgtaccatagaattgtttcgttaatgcctagtaatactgaaattttatatgaattaggattaggtaaatacatagttggtgtttcaacggttgatgattatccaaaagatgtgaaaaagggtaagaaacaatttgatgctttgaatctaaataaagaggaacttttaaaggcaaagccagatctaattcttgcgcatgagtcgcaaaaggcaactgctaataaagtattgtcatcattagagaaacaaggcatcaaagtagtgtatgttaaagatgcacaatcaattgatgaaacttacaacacatttaagcaaattgggaaattaacgcatcatgataagcaggctgaacaacttgttgaggaaactaaagataatatcgataaagtcatagattcaattcctgctcatcataaaaaatcaaaagtatttattgaggtttcatcaaagcctgaaatatatacagcagggaagcatacattttttaatgatatgttagaaaaattagaagcccaaaatgtgtatagtgacattaatggttggaaccctgtaacgaaggaaagtattattaaaaagaacccagatatattaatttcgacggaagctaagacaagatcagattatatggatatcatcaaaaaaagaggtggattcaataaaattaatgctgtcaagaatacacgtattgaagttgtaaatggtgatgaagtatcaagaccaggtccacgtattgatgaaggattaaaagaattaagagatgcaatttatagaaaa

SEQ ID NO: 3226 - protein, 304 aa, Staphylococcus aureus
  MISC_FEATURE (1)..(304): hypothetical protein
VGLKRRCDSVKKSLIAFILIFMLVLSGCGMKDNDKQGSNDNGSSKSPYHRIVSLMPSNTEILYELGLGKYIVGVSTVDDYPKDVKKGKKQFDALNLNKEELLKAKPDLILAHESQKATANKVLSSLEKQGIKVVYVKDAQSIDETYNTFKQIGKLTHHDKQAEQLVEETKDNIDKVIDSIPAHHKKSKVFIEVSSKPEIYTAGKHTFFNDMLEKLEAQNVYSDINGWNPVTKESIIKKNPDILISTEAKTRSDYMDIIKKRGGFNKINAVKNTRIEVVNGDEVSRPGPRIDEGLKELRDAIYRK

SEQ ID NO: 3227 - DNA, 633 bp, Staphylococcus aureus
atgttaggaactgatgaattatataaagttttatatgaacatctcggaccacaattttggtggcctgctgataatgacattgaaatgatgttaggtgcaattttagttcaaaatactagatggcgaaatgcagaaattgcattgaatcagattaaagaacatacgcattttaatccaaatcatatattagaactacctattgaaacgttacaatcattgatacattcaagtggcttttataaaagtaaatcactgacgattaaaacattattaacatggttagcacgacatcatttcaattatcaagagattaatgagcgatataaaggtggattaagaaaagaattattatctttgaaaggtattggaagtgaaacagcagatgtcttacttgtttatatattcggacgtattgaatttattccagatagctatacaagaaaaatatatgataaattaggatatgaaaacactaaaaattatgatcaattaaaaaaagtagtcacattaccaaatcattttacaaatcaagatgctaatgaatttcatgctctgttagatgtatttggtaaacattactttagagacaaagatataaagaattatgattttttagaaccttactttaaaaag

SEQ ID NO: 3228 - protein, 211 aa, Staphylococcus aureus
  MISC_FEATURE (1)..(211): hypothetical protein
MLGTDELYKVLYEHLGPQFWWPADNDIEMMLGAILVQNTRWRNAEIALNQIKEHTHFNPNHILELPIETLQSLIHSSGFYKSKSLTIKTLLTWLARHHFNYQEINERYKGGLRKELLSLKGIGSETADVLLVYIFGRIEFIPDSYTRKIYDKLGYENTKNYDQLKKVVTLPNHFTNQDANEFHALLDVFGKHYFRDKDIKNYDFLEPYFKK

SEQ ID NO: 3229 - DNA, 1659 bp, Staphylococcus aureus
atgaatattattgatcaagtgaaacaaacattagtagaagaaattgcagcaagtattaacaaagcaggattagcagatgagattcctgatattaaaattgaagttcctaaagatacaaaaaatggagattatgctactaatattgcgatggtactgactaagattgcaaagcgtaatcctcgtgaaattgctcaagcgattgttgataacttagatactgaaaaagcacatgtaaaacaaattgacattgctggtccaggattcattaatttttacttagataatcagtatttaacagcaattattcctgaagcaattgaaaaaggtgatcaatttggacatgtaaatgaatcaaaaggtcaaaatgtattgcttgagtatgtttcagctaaccctacaggagatttacatattggtcatgctagaaatgcagcagttggtgatgctttagctaatattttaactgcagctggctataatgtaacacgtgaatattatattaatgatgctggtaatcaaattactaacttagcgcgttcgattgaaacacgtttctttgaagctttaggtgacaatagttattcaatgccagaagatggctataatggaaaagatattattgaaataggtaaagatttagcagagaaacaccctgaaattaaagattattctgaagaagcacgtttgaaagaatttagaaaattaggcgtagaatacgaaatggctaaattgaaaaatgatttagcagagttcaatacgcattttgataattggtttagtgaaacatctttatatgaaaaaggagaaattcttgaagttttagcaaaaatgaaagaattaggttatacgtatgaagctgatggcgctacatggttacgtacaactgattttaaagacgacaaagacagagtattaattaaaaatgacggtacatatacgtatttcttaccagatattgcgtaccacttcgataaagtaaaacgtggtaatgacattttaatcgatttatttggtgctgatcatcatggttatattaatcgtttgaaagcatctcttgaaacgtttggtgtagatagtaatcgtttagaaattcaaatcatgcaaatggttcgtttaatggaaaatggtaaagaagtgaagatgagtaaacgtactggtaatgcgattacattaagagaaattatggacgaagttggcgttgacgctgcacgttatttcttaactatgcgtagtcctgatagtcactttgattttgatatggaattagcgaaagagcaatctcaagacaatccagtttactatgctcaatatgcacatgcgcgtatttgttcaattttaaaacaagcgaaagagcaaggtattgaagtgactgctgcgaatgattttacaacgattactaatgaaaaagcgattgaattgttgaaaaaagtagctgatttcgaacctacaattgaaagtgctgctgagcatagatcggcacatagaattactaattatattcaagatttagcttctcatttccataaattctataatgctgaaaaagtgttaacagatgatattgaaaaaacaaaagcacatgttgctatgattgaagcggtcagaattacattgaaaaatgcattggcaatggtcggtgtaagcgcacctgaatcaatg

SEQ ID NO: 3230 - protein, 553 aa, Staphylococcus aureus
  MISC_FEATURE (1)..(553): arginyl-tRNA synthetase
MNIIDQVKQTLVEEIAASINKAGLADEIPDIKIEVPKDTKNGDYATNIAMVLTKIAKRNPREIAQAIVDNLDTEKAHVKQIDIAGPGFINFYLDNQYLTAIIPEAIEKGDQFGHVNESKGQNVLLEYVSANPTGDLHIGHARNAAVGDALANILTAAGYNVTREYYINDAGNQITNLARSIETRFFEALGDNSYSMPEDGYNGKDIIEIGKDLAEKHPEIKDYSEEARLKEFRKLGVEYEMAKLKNDLAEFNTHFDNWFSETSLYEKGEILEVLAKMKELGYTYEADGATWLRTTDFKDDKDRVLIKNDGTYTYFLPDIAYHFDKVKRGNDILIDLFGADHHGYINRLKASLETFGVDSNRLEIQIMQMVRLMENGKEVKMSKRTGNAITLREIMDEVGVDAARYFLTMRSPDSHFDFDMELAKEQSQDNPVYYAQYAHARICSILKQAKEQGIEVTAANDFTTITNEKAIELLKKVADFEPTIESAAEHRSAHRITNYIQDLASHFHKFYNAEKVLTDDIEKTKAHVAMIEAVRITLKNALAMVGVSAPESM

SEQ ID NO: 3231 - DNA, 426 bp, Staphylococcus aureus
gtgagtagtaaattggataaaaaagtaagtattcaaacaaagcaagtgttgaaacagcacaacgaaaaagaaaaatttgaatttactactgaaggaacttggcaacaaaggcaatctaactttattcggtatgtagaacaaattgaggatgcaacagttaatgttacaataaaagtggatgatgatagcgttaagttgattcgtaaaggcgacattaatatgaatttgcattttgttgaaggacaaacgacaacaactttttacgatatatcggctggacgaattccactagaagttaaaacattacgcattttacatttcgtaagtggagacggtggcaagctaaagattcattatgaattatatcaagataatgaaaaaatgggttcttatcaatatgaaattaactataaggagataggcgaa

SEQ ID NO: 3232 - protein, 142 aa, Staphylococcus aureus
  MISC_FEATURE (1)..(142): conserved hypothetical
VSSKLDKKVSIQTKQVLKQHNEKEKFEFTTEGTWQQRQSNFIRYVEQIEDATVNVTIKVDDDSVKLIRKGDINMNLHFVEGQTTTTFYDISAGRIPLEVKTLRILHFVSGDGGKLKIHYELYQDNEKMGSYQYEINYKEIGE

SEQ ID NO: 3233 - DNA, 978 bp, Staphylococcus aureus
  MISC_FEATURE (1)..(978): n = g, a, t, or c
ttgttcacagcacgttcctttttatttttaaagtcgagtgttaaactaggaataaataatttatattgtgtgttgtgtggggtgactaatatgaatgatatggataattcctttttaataacaacggaaattcaaagaaaatggattgaaaaattcaaagtaattagagatacatttaaggctaaagctgaatataatgatcaacatagccaatttccatataaaaatattgaatggttaattaaagaaggttatggaaaattaacgttaccaaaagcatatggtggtgaaggtgcgaccatagaagacatggttattttgcaatcatttttaggcgaacttgatggtgccacagcattatctattggttggcatgtgagtgtcgtaggacaaatttatgaacagaaattatggtctcaagatatgttggagcaatttgctgttgaaattaataatggtgcattagttaatagagcagttagtgaagctgaaatgggtagtccaacaagagggggaagaccaagtacacatgctgttaaagctgatgatgggtatattttaaatggtgtgaagacatatacatcaatgagtaaagcactaacacatattattgttgctgcttatatagaagaattagaaagtgttggttttttcttagtagacaggaatttgcctggtgttgaaattgccgataattgggacgtattaggtatgcgagcgacagaaagtcatgatttaatattaaatgatgtaaaagtaccattaaaacatttagtggaaacagagaaaagtaaagcgccaaatggttggatattgcatataccaagctgttatttaggtatagcacaagctgctagaaattatgctgtaaactttgcaatccaacatagccctaatagtattgaaggaacgattgcaacattgccaactgtgcaacacaaatttaagggcaaatatgtgaanacgtctagtatgtta

SEQ ID NO: 3234 - protein, 326 aa, Staphylococcus aureus
  MISC_FEATURE (1)..(326): Xaa = any amino acid
  MISC_FEATURE (1)..(326): hypothetical protein
LFTARSFLFLKSSVKLGINNLYCVLCGVTNMNDMDNSFLITTEIQRKWIEKFKVIRDTFKAKAEYNDQHSQFPYKNIEWLIKEGYGKLTLPKAYGGEGATIEDMVILQSFLGELDGATALSIGWHVSVVGQIYEQKLWSQDMLEQFAVEINNGALVNRAVSEAEMGSPTRGGRPSTHAVKADDGYILNGVKTYTSMSKALTHIIVAAYIEELESVGFFLVDRNLPGVEIADNWDVLGMRATESHDLILNDVKVPLKHLVETEKSKAPNGWILHIPSCYLGIAQAARNYAVNFAIQHSPNSIEGTIATLPTVQHKFKGKYVXTSSML

SEQ ID NO: 3235 - DNA, 105 bp, Staphylococcus aureus
atgaaagatagtgaaaatctcgtgttttttggttttgaggtgttgtttgtattttataaaatggcttacatatatgaagcgttgattaagtatggaattgttaat

SEQ ID NO: 3236 - protein, 35 aa, Staphylococcus aureus
MKDSENLVFFGFEVLFVFYKMAYIYEALIKYGIVN

SEQ ID NO: 3237 - DNA, 1008 bp, Staphylococcus aureus
atgagagcagcagttgtaacgaaagatcacaaagtaagtattgaggacaaaaagttaagagctttaaaacctggtgaagcgttggtacaaacggaatattgtggcgtttgtcataccgatttacatgttaagaatgctgattttggtgatgttacaggcgttactttaggtcatgaaggtattggtaaagtcatcgaagttgcggaagatgtagaatcattaaaaattggagaccgtgtgtctatcgcttggatgttcgaaagctgtggaagatgtgaatattgtacaacaggtcgtgaaacactttgccgtagtgtgaaaaatgctggttatacagtagatggtgcaatggctgaacaagttattgttactgcagactatgctgtgaaagtacctgaaaaattagatccagcagcagcgtcttctattacatgcgcaggtgtgacaacttataaagctgtaaaagtaagtaatgtaaaacctggacaatggttaggtgtttttggtataggtggtttaggtaacctagctttacaatatgctaaaaacgttatgggggctaaaattgttgccttcgacatcaatgatgataaattagcattcgcgaaagaattaggtgctgatgctattattaattctaaagatgttgatccagttgcagaagttatgaaattaactgataacaaaggattagatgcaacagtggtaacttcagttgctaagacgccatttaaccaagcggttgatgttgtaaaagctggtgcaagagttgttgccgttggtttacctgttgataaaatgaacttagatatcccaagattagtgcttgatggtattgaagtagtaggttcacttgttggtacaagacaagacttacgtgaagcgtttgaatttgctgctgaaaataaagtaacacctaaagttcaattaagaaaattagaagaaatcaatgatatttttgaagaaatggaaaatggtactataactggtagaatggttattaaattt

SEQ ID NO: 3238 - protein, 336 aa, Staphylococcus aureus
  MISC_FEATURE (1)..(336): alcohol dehydrogenase I
MRAAVVTKDHKVSIEDKKLRALKPGEALVQTEYCGVCHTDLHVKNADFGDVTGVTLGHEGIGKVIEVAEDVESLKIGDRVSIAWMFESCGRCEYCTTGRETLCRSVKNAGYTVDGAMAEQVIVTADYAVKVPEKLDPAAASSITCAGVTTYKAVKVSNVKPGQWLGVFGIGGLGNLALQYAKNVMGAKIVAFDINDDKLAFAKELGADAIINSKDVDPVAEVMKLTDNKGLDATVVTSVAKTPFNQAVDVVKAGARVVAVGLPVDKMNLDIPRLVLDGIEVVGSLVGTRQDLREAFEFAAENKVTPKVQLRKLEEINDIFEEMENGTITGRMVIKF

SEQ ID NO: 3239 - DNA, 534 bp, Staphylococcus aureus
ttgttatcgttaaatatggaggttatatcattgtctgagaaaaaaggctttaattttaatatcataaaaaatgaccctctagatggtcataaaggtacaaatattggttcaattagcttagacaatattgcaccagtttttatcgatgttgctaacaaagaagcatttattgatattggaggcatgcatgctcgtgccaaagttgaaaaaggtgtgaaatggattactgataaagctgctgttgaaggcgatgaagctaaagaatattggttgtgttgggtaacaacagaacgtaatgaacaaggaccatattacgctggtttaacagcgtgctatttattagtgaataaagcaattcgtcgtggttataaaagtatgcctgaacatgttaatatgatggataaatcaatgaaacatcatattatcatagatcaaattggtgacgagaataaagctattttaaaagactttttaatgaaccatgatgaaggtatgtggaagcattcttctgatgctttacatcaagcatttaat

SEQ ID NO: 3240 - protein, 178 aa, Staphylococcus aureus
  MISC_FEATURE (1)..(178): conserved hypothetical
LLSLNMEVISLSEKKGFNFNIIKNDPLDGHKGTNIGSISLDNIAPVFIDVANKEAFIDIGGMHARAKVEKGVKWITDKAAVEGDEAKEYWLCWVTTERNEQGPYYAGLTACYLLVNKAIRRGYKSMPEHVNMMDKSMKHHIIIDQIGDENKAILKDFLMNHDEGMWKHSSDALHQAFN

SEQ ID NO: 3241 - DNA, 1293 bp, Staphylococcus aureus
atgactaacgcatatgtagatttaaaattagtagaagaaaaagtttttaaagacccgatacatcgatatattcatgttgaagatcaattgatatgggatttaattaaaactaaggaattccaaaggttacgtcgaattagacaactaggaacactgtacctatcttttcacacagcagaacatagtcgctttggacattctttaggtgtgtatgaaatagttagacgattaattgatgagtcatttattggtcatgatgcatgggacaataaagatagaccgttggcattatgtgctgcattattacatgatttaggacatggtccattttcacatagttttgaaaaaatatttaatacagaccatgaagcatacacacaagcgattattactggagatactgaggtgaatgctgtattacgtaaagtggcgcctgagtttccaagagaagttgcggaagtaattaataaaacgcatcataataaattggtcatttcgatgatttcgtcacaaatcgatgcggatagaatggattatttacaacgtgatgcgtatttcacaggtgtatcatatggtgcttttgatatggagcgtattttaagattaatgcgaccttctaaagatgaagtactaatcaaagaaagtggtatgcatgcagttgaaaactttattatgagtcgttatcaaatgtattggcaaatttacttccacccagttagtcgtggtggagaagtgctgcttaataattgtttgaaacgcgcaaaacagctttataatgaaggctatgaatttaagttgcatccacatgattttattccattttttgaagagacagttacgattgaacaatatgttgaactcgatgaagcggtagttacgtattatttggaaaaatggacaaaagaagatgatgctattttaagtgatttagcaagtcgatttattaatcgagacttatttaaatatattccatttgatggctcaattattacaatatcagaactgcaagaactgtttgaagcaggtggtattaatccagattattattttgtgagtgaagcattttctgatttgccatatgactatgatcgaccggggtcaaatcgcaaaccgattcatttattaagacaagatggtacgattagagaaataagcaatcaatcattagtcattcatagtattacaggcattaatcgccaagactataaattatattatcctagagaaatggttgcaaagattaaagataagacaattagagaagctattgaaaatttgattaatgagcttaat

SEQ ID NO: 3242 - protein, 431 aa, Staphylococcus aureus
  MISC_FEATURE (1)..(431): conserved hypothetical
MTNAYVDLKLVEEKVFKDPIHRYIHVEDQLIWDLIKTKEFQRLRRIRQLGTLYLSFHTAEHSRFGHSLGVYEIVRRLIDESFIGHDAWDNKDRPLALCAALLHDLGHGPFSHSFEKIFNTDHEAYTQAIITGDTEVNAVLRKVAPEFPREVAEVINKTHHNKLVISMISSQIDADRMDYLQRDAYFTGVSYGAFDMERILRLMRPSKDEVLIKESGMHAVENFIMSRYQMYWQIYFHPVSRGGEVLLNNCLKRAKQLYNEGYEFKLHPHDFIPFFEETVTIEQYVELDEAVVTYYLEKWTKEDDAILSDLASRFINRDLFKYIPFDGSIITISELQELFEAGGINPDYYFVSEAFSDLPYDYDRPGSNRKPIHLLRQDGTIREISNQSLVIHSITGINRQDYKLYYPREMVAKIKDKTIREAIENLINELN

SEQ ID NO: 3243 - DNA, 474 bp, Staphylococcus aureus
atgttcaaggtaagacaagcaactgaaaaagatgttgttcaaattagagatgtcgcaactaaagcttggtttaatacatacttaaatatatacgctgcgacaacagttaatcacttgttagaagcttcatataatgaacatcatttaaagaaaagacttcaagaacaattattcttagtcgttgaagaaggtaatgacatcgttggctttgctaactttatttacggtgaagaattatatttatcagctcattatgttaaaccagaatcgcaacatacaggttatggtacagcattgttaaatgaaggattatcacgttttgaagataaatttgaaggtgtttacttagaagtagataataaaaatgaagaagcagtagcttactataaagagcaaggttttacaatcttacgctcttatgagccagaaatgtatggcgaaaagttagacttagcacttatgtacaaagcattt

SEQ ID NO: 3244 - protein, 158 aa, Staphylococcus aureus
  MISC_FEATURE (1)..(158): conserved hypothetical
MFKVRQATEKDVVQIRDVATKAWFNTYLNIYAATTVNHLLEASYNEHHLKKRLQEQLFLVVEEGNDIVGFANFIYGEELYLSAHYVKPESQHTGYGTALLNEGLSRFEDKFEGVYLEVDNKNEEAVAYYKEQGFTILRSYEPEMYGEKLDLALMYKAF

SEQ ID NO: 3245 - DNA, 534 bp, Staphylococcus aureus
atgattactgttttgtttggtgggagtagaccaaacggtaatactgcacaattaacaaaattcgctttgcaagatttagagtatcaatggattgacgtgacacaacatcagtttaaaccgatacgtgacgtgagacatacagcagagactattacttcatatgacgatgactatttgccgattctagataaaatattggctagtgatacaattatttttgcatcaccagtgtattggtatagcatttcagcaccattgaaagcatttatcgaacattggtcagaaacattacaagataaacgatatcctaattttaaggcacaaatggccgaaaaggattttagagttattttagttggtggagattgtccaaaaataaaagcgaagccagcaattacgcaaatgaaatatagtttagactttttaggtgccactttaaatggttatattattggaactgctgaaaagcctggtgacatcatgaaagacaactatgccttagcacgtgcaactgagtggaatagtatattgcaa

SEQ ID NO: 3246 - protein, 178 aa, Staphylococcus aureus
  MISC_FEATURE (1)..(178): conserved hypothetical
MITVLFGGSRPNGNTAQLTKFALQDLEYQWIDVTQHQFKPIRDVRHTAETITSYDDDYLPILDKILASDTIIFASPVYWYSISAPLKAFIEHWSETLQDKRYPNFKAQMAEKDFRVILVGGDCPKIKAKPAITQMKYSLDFLGATLNGYIIGTAEKPGDIMKDNYALARATEWNSILQ

SEQ ID NO: 3247 - DNA, 936 bp, Staphylococcus aureus
atgaagcaatttgtaaacttaggtaaatctgatgttgaagtgtttccaatcgcacttgggacgaacgcagtaggtgggcataatttatatccgaacttagatgaagaacaaggaaaagatgttgttcgtcaagccattaatcatggtattaatttattagatacggcatatatttatgggccagaacgatcagaagaattggttggagaagttgttaaagaatatccgcgagagcaaattaaaattgctacgaaagggtctcatgaatttgatgaaaatcaagaagtacatcagaacaatcaaccggaatatttaaaacaacaagttgagaatagtttgaaacgtctacaaactgattatatcgatttatattatattcattttccggataacaacactccgaaagatcaagcagttgcagcattacaagagcttaaggaacaagggaagattaaagcaattggtgtatcaaatttcacattagatcaacttaaagaagcaaataaagatggttacgttgatgttgtacagttagaatataatttattgcatcgcgaaaatgaggcagtattacaatattgtgttgatcaccaaatcacatttattccatatttcccattagcatccggtattttagctggaaaatatgatgagaacactaaatttagtgaccatcgtactacacgtcgtgattttaaaccaggtgtatttgaagaaaatgtgcgtcgcgtaaaagctttggaaagcatagctgcagcacatcaaacttcaattgcgaacattgtattagcattttatttaacgagaccagctatcgatgtgattattcctggtgcaaaacgtgcagaacaagtcgttgaaaatattaaagctgcagatatcgttttatcagatgatgagattcaatatatcgatgaactgtttccgattgaagac

SEQ ID NO: 3248 - protein, 312 aa, Staphylococcus aureus
  MISC_FEATURE (1)..(312): hypothetical protein
MKQFVNLGKSDVEVFPIALGTNAVGGHNLYPNLDEEQGKDVVRQAINHGINLLDTAYIYGPERSEELVGEVVKEYPREQIKIATKGSHEFDENQEVHQNNQPEYLKQQVENSLKRLQTDYIDLYYIHFPDNNTPKDQAVAALQELKEQGKIKAIGVSNFTLDQLKEANKDGYVDVVQLEYNLLHRENEAVLQYCVDHQITFIPYFPLASGILAGKYDENTKFSDHRTTRRDFKPGVFEENVRRVKALESIAAAHQTSIANIVLAFYLTRPAIDVIIPGAKRAEQVVENIKAADIVLSDDEIQYIDELFPIED

SEQ ID NO: 3249 - DNA, 624 bp, Staphylococcus aureus
atgttgctatgcgaatctaaaatcatcaataaaaacccaaaatatagaattattaaatataatgatgaatacttaatggtcgatataataagcacttggattagtttattttttccttttattaattggttcatcccaaaagaatacgtcaaaattagtagagaagagtttgaaaacttaaatattgttaaacctgctaaaaagaatgttttttggccagttgcaggtagctctgctttgctgggagttgcattaagaaaatatacacatttacttgacattcaacttgataaaaaattagttattgccatatgttgcatcacatttatagggattttaatattttatgtacgcctaattaaaaaatcatctttaaatatttataatactaaaaataaaaggtcaaaaatttttttaatacctacactaaaaaatgtttgtttcacattatttggatatattttatttggcggattgactatgctattcctagatgcactattatcaatgagttatcaaaacataatagtatattttgtttggattgcagttataatgggtttttttctagttaatatagctttaattatagataaaaacattcatgtcatacttaaaaaccaa

SEQ ID NO: 3250 - protein, 208 aa, Staphylococcus aureus
  MISC_FEATURE (1)..(208): conserved hypothetical
MLLCESKIINKNPKYRIIKYNDEYLMVDIISTWISLFFPFINWFIPKEYVKISREEFENLNIVKPAKKNVFWPVAGSSALLGVALRKYTHLLDIQLDKKLVIAICCITFIGILIFYVRLIKKSSLNIYNTKNKRSKIFLIPTLKNVCFTLFGYILFGGLTMLFLDALLSMSYQNIIVYFVWIAVIMGFFLVNIALIIDKNIHVILKNQ

SEQ ID NO: 3251 - DNA, 633 bp, Staphylococcus aureus
ttgctatgtgaatctaaagttatcaacaaaaatcctaagtatagagttattaaatatggtgatgaatatttaatgattgatttagtaagtacctggttaactttatttcttcctatgattaattggttaattccaaaaaaatatgtcaaaatcagtaaaaaagaatttgacgatttaaacattgtcaaacctgttaaaaataaagctttttggccagttgcaggtagtactattttgttcggagttacgtttagaaaatatattccttcacttaatattcaattagagaaaaacatggtgattgtaatatgttgtgcaatatttctgggtgttttaatactttttttatttctgaatcgtaagctaaggttggaaatttataataataactctagtaaagggaaaataattttatttccttcattaaaaaacttttgtttcacaatattttattattttttatttggcggtctttcaataatggctctaagtatgttattaactttaaatcctcaaaatataataggctttattggttggttggtaatgactgcaggtttctttctgttaaacatgtcatcgattattgacaaaaaaatttatgtattatctaaaactaacacggtggaaaaa

SEQ ID NO: 3252 - protein, 211 aa, Staphylococcus aureus
  MISC_FEATURE (1)..(211): conserved hypothetical
LLCESKVINKNPKYRVIKYGDEYLMIDLVSTWLTLFLPMINWLIPKKYVKISKKEFDDLNIVKPVKNKAFWPVAGSTILFGVTFRKYIPSLNIQLEKNMVIVICCAIFLGVLILFLFLNRKLRLEIYNNNSSKGKIILFPSLKNFCFTIFYYFLFGGLSIMALSMLLTLNPQNIIGFIGWLVMTAGFFLLNMSSIIDKKIYVLSKTNTVEK

SEQ ID NO: 3253 - DNA, 912 bp, Staphylococcus aureus
gtgaaagatttgaagataatagatgtgcttttgaaaaatatatctcaggttgtgttaattagtaataaatggacaggattatttatcttaataggattatttgtagccgattggacaattggattagcggctattgtaggtagcatcatcgcctatacttttgcgcgttttataaattatagtgaggcagagattaatgatgggttagctggatttaatccagtgctaactgccattgcgttaacaatctttttagataagtcaggattagatattgttataacaatgatagcaactttattaacgttaccagttgctgctgcagtgagagaagttttaagaccatataaagttccgatgctgacgatgccttttgtcattgtgacttggtttacaattttactttcaggacaggttaaatttgtagatacatcgttaaagttaatgcctcaaaacattgaaacggttaattttagcaacaatgatagaatacatttcattcagtcattatttgaaggattcagtcaagtatttatcgaagcgagtgtaattggtggcgtatgtattttaatcggcatattgatagcatcaagaaaagcaacactcttagctgttatagctagtttgttaagctttatcattgtagctctattaggtggtaattatgatgatattaatcagggattattcggttataactttgtattaatggcaatcgcactaggatatacatttaaaacagcgattaacccttatatttcgacttttttaggtgtgttattaacagtagtggtgcaactaggtacaacaacattgcttgaaccgtttggcttacctgcattaacattgccatttattatcgtgacatggattttattatttgctggtattaaacatgacaaagtagatgct

SEQ ID NO: 3254 - protein, 304 aa, Staphylococcus aureus
  MISC_FEATURE (1)..(304): hypothetical protein
VKDLKIIDVLLKNISQVVLISNKWTGLFILIGLFVADWTIGLAAIVGSIIAYTFARFINYSEAEINDGLAGFNPVLTAIALTIFLDKSGLDIVITMIATLLTLPVAAAVREVLRPYKVPMLTMPFVIVTWFTILLSGQVKFVDTSLKLMPQNIETVNFSNNDRIHFIQSLFEGFSQVFIEASVIGGVCILIGILIASRKATLLAVIASLLSFIIVALLGGNYDDINQGLFGYNFVLMAIALGYTFKTAINPYISTFLGVLLTVVVQLGTTTLLEPFGLPALTLPFIIVTWILLFAGIKHDKVDA

SEQ ID NO: 3255 - DNA, 300 bp, Staphylococcus aureus
ttgcattttacacaacgagagcaagacaaattaatgattgtagtggcggcggaagttgcacgtcgtcgtaaagcacgtggtttgaaactaaatcatcctgaggcattagctttaatcagcgatgaattattagaaggtgcacgcgatggtaagaccgttgcagagttaatgagttatggtagacaaattctaaacaaagaagatgtcatggatggtgtcgaacacatgattacagatatcgaaatcgaggctacgttccccgatggtactaagttaatcacagtacatcaccctattgtt

SEQ ID NO: 3256 - protein, 100 aa, Staphylococcus aureus
  MISC_FEATURE (1)..(100): urease gamma subunit
LHFTQREQDKLMIVVAAEVARRRKARGLKLNHPEALALISDELLEGARDGKTVAELMSYGRQILNKEDVMDGVEHMITDIEIEATFPDGTKLITVHHPIV

SEQ ID NO: 3257 - DNA, 648 bp, Staphylococcus aureus
gtggagacattgctttgtgaaactgaaaatattaataagaatcccaaatatagaattatcaaatacaaagatgaatatttgatgattgatttagtaagtacatggttagcactctttttcccaatgattaattggctgattccaaaaaagtacgtcaaaatcagcgaaaaagattttgaaactttaaacattgtgaagacagctaaaatcaattctttttggccagtggcaggaagtacggtcttatttggtgttatgttaagaaggtattcccatttatttatcgttaaatatgaatatagtatagtaattttaatttgttgcatcataatactaggtatttttctgttttttttatatttaaatcaaaagttaaagttacaaatctataatgaaaacaaaaataaaagcaataagataatcatatttcccactttaaagagtctttgtttatcaatagttttatatatttatttaggtggtggttcattctttactatttatatgttattgacgattgaagttcaaaatataatattatttataactttgtttgtaatatttttgtttttcttatttttaaatatgtgctcactatatgacaataaagttcatgtattatttaaatcaaatggaattgaaaagttt

SEQ ID NO: 3258 - protein, 216 aa, Staphylococcus aureus
  MISC_FEATURE (1)..(216): conserved hypothetical
VETLLCETENINKNPKYRIIKYKDEYLMIDLVSTWLALFFPMINWLIPKKYVKISEKDFETLNIVKTAKINSFWPVAGSTVLFGVMLRRYSHLFIVKYEYSIVILICCIIILGIFLFFLYLNQKLKLQIYNENKNKSNKIIIFPTLKSLCLSIVLYIYLGGGSFFTIYMLLTIEVQNIILFITLFVIFLFFLFLNMCSLYDNKVHVLFKSNGIEKF

SEQ ID NO: 3259 - DNA, 627 bp, Staphylococcus aureus
atgttgctttgcgatgtcagagtcatttataaaaatccgaaatacaaagtcattcaacataacggtgaatacttattagtcgatttagtaagcacttggttcgtgtacttttttcctttcattaattggttcattccaaaaaagtacgcgataattagcgaagaagaatttgaaaatttaaatgttgttaaaccaaataaaaataatgttttctggtcagttataggaagttcggttttgtttggagttactttaaggaaatacatacatgtttttgatgttcaattagataagctagttgtaatgatattgtgtgctctcgctttaatttgtgttatagttttttattttaacttaaatagaaagcttaagttaaaagtgtttgatacaaatattgaaaaaaataagagagttatattaataccaacgtttaaacttggctgttttttagttttcggatatattttcgctggaagtttttcaatattttcattaattgcccttatgacaatcgaacctcaaaatataataatatttatttattggattatgatgacaatgcttttctttttgttaaatatgacttcgataggtaatgaaaaagttcgcgttataatgaaaaataat

SEQ ID NO: 3260 - protein, 209 aa, Staphylococcus aureus
  MISC_FEATURE (1)..(209): conserved hypothetical
MLLCDVRVIYKNPKYKVIQHNGEYLLVDLVSTWFVYFFPFINWFIPKKYAIISEEEFENLNVVKPNKNNVFWSVIGSSVLFGVTLRKYIHVFDVQLDKLVVMILCALALICVIVFYFNLNRKLKLKVFDTNIEKNKRVILIPTFKLGCFLVFGYIFAGSFSIFSLIALMTIEPQNIIIFIYWIMMTMLFFLLNMTSIGNEKVRVIMKNN

SEQ ID NO: 3261 - DNA, 126 bp, Staphylococcus aureus
ttgacgacagagtcacaaaatataataatatttttaacttgggttattatcacgatgtttttctttttagtgaatatggcttcgataggtaataaaaatgttcatgttattttaagaataaacgag

SEQ ID NO: 3262 - protein, 42 aa, Staphylococcus aureus
LTTESQNIIIFLTWVIITMFFFLVNMASIGNKNVHVILRINE

SEQ ID NO: 3263 - DNA, 465 bp, Staphylococcus aureus
gtgctttgtgaatctagacaaatttataaaaatcctaaatatcgagttattagatataataatgaatatttcatggtcgatttagtaagtacttggattacttattttttccctatgattaattggtttttgcccaaaaaatacgcaaaaattagcgaaaatgaatttgaaaggttaaatatagtcgagcctgttaaaaataatgttttttggccggttgcaggaagttcagttctatttggaattatattgagaaagtacggtaacttctttaatgttcagtttgaaaaacaactagcaatcactgtattttttatcatgttaatagggatgttaattttttatttttatctaaataaaaaattaacattaaaaatttttaataccaacgtggttaataagaatagagttgtattaataccgactttcaaacaaggattgttaatagtttttgcgtactttttt

SEQ ID NO: 3264 - protein, 155 aa, Staphylococcus aureus
  MISC_FEATURE (1)..(155): conserved hypothetical
VLCESRQIYKNPKYRVIRYNNEYFMVDLVSTWITYFFPMINWFLPKKYAKISENEFERLNIVEPVKNNVFWPVAGSSVLFGIILRKYGNFFNVQFEKQLAITVFFIMLIGMLIFYFYLNKKLTLKIFNTNVVNKNRVVLIPTFKQGLLIVFAYFF

SEQ ID NO: 3265 - DNA, 639 bp, Staphylococcus aureus
gtggagacattgctttgcgaatctaaagttattaataaaaaccctaaatatcgaataatcaaatacgatagtgaatatttaatgattgatttggcaagtaattggattgtcttcttctttccatttattaactggctcataccgaaaacatatgtcaaaatcactaagaatgattatgaaaaattaaatattgtcaaaccagttaaaaataaatcgataggatggaccatattcgcgggtattgtgttacttggtggtactgtaagaagaaatacttatttatttgattttcaattagaagaactaattgtttggagcagctgtttcattgggtttttagagattatatttttttattgttatctaaataagaaattaacattaaatatttataatgaaagtaaaaataatgaacttaaattaagattattaccctcctttaaaaatatttgtttcacaattttttattacctatttactggtttcatgtcttatggggcattttacttgttggtatttgaaaatgtgcaaaatttaatcttatatgtttcttggcttttcatgactatgctatttatgtttatgaatatgcattcaattatagataaaaaagtacatatattcttaaagtctaataaa

SEQ ID NO: 3266 - protein, 213 aa, Staphylococcus aureus
  MISC_FEATURE (1)..(213): conserved hypothetical
VETLLCESKVINKNPKYRIIKYDSEYLMIDLASNWIVFFFPFINWLIPKTYVKITKNDYEKLNIVKPVKNKSIGWTIFAGIVLLGGTVRRNTYLFDFQLEELIVWSSCFIGFLEIIFFYCYLNKKLTLNIYNESKNNELKLRLLPSFKNICFTIFYYLFTGFMSYGAFYLLVFENVQNLILYVSWLFMTMLFMFMNMHSIIDKKVHIFLKSNK

SEQ ID NO: 3267 - DNA, 618 bp, Staphylococcus aureus
atgctatgcgaatctaaaatcatcaataaaaaccccaaatatagaattattaaatataatgatgagtacttaatgatcgatataataagcacttggattagtttgttttttccttttattaattggttcatccccaaaagatacgtcaaaattagtagagaagagtttgaaaatttaaatattgtgaaacctgctaaaaagaatgttttttggccagttgcaggtatctctactttattcgcagttacattaagaaagtatacacatttacttgacactcaacttgatagaaaattagttattgctatatgttgtatcacatttatagggattttaacattttatgtacgcctaattaaaaaatcatctttaaatatttataatactaaaaataaaaggtcaaaaattatcttaataccaacactaaaaaatttttgtttaacattgtttagaaatgctttttttattttatggacagtgattttctcatatgctctattatcaatgagttatcaaaacataatagtatattttgcttggattacagcaataatgggtttttttctagtgaatatagctttaattatagataaaaacattcatgtcatacttaaaaat

SEQ ID NO: 3268 - protein, 206 aa, Staphylococcus aureus
  MISC_FEATURE (1)..(206): conserved hypothetical
MLCESKIINKNPKYRIIKYNDEYLMIDIISTWISLFFPFINWFIPKRYVKISREEFENLNIVKPAKKNVFWPVAGISTLFAVTLRKYTHLLDTQLDRKLVIAICCITFIGILTFYVRLIKKSSLNIYNTKNKRSKIILIPTLKNFCLTLFRNAFFILWTVIFSYALLSMSYQNIIVYFAWITAIMGFFLVNIALIIDKNIHVILKN

SEQ ID NO: 3269 - DNA, 627 bp, Staphylococcus aureus
gtgctttgcgaatctagagtcattaatcaaaaccctaaatatagaattattaaatacaataatgaatatttcatggttgatttagtaagtacttggattgcttattttttgcccatgattaattggtttattcccaaaaagtacgcgaaaattagtagagaagaatttgaaagtttaaatattgtcaaacccgctaaaaataatactttctggcctgttgcaggatttgcagtgttattaacaaccttaacaagaaaatatatctatttgcttaacatccatttagaaaaagaaatagttatattaacatgctgtatgatacttctaggtgttttcgcattgtttatatatataaatacaaaattgaagttacatatttttgataaaaataaaagtaataacgaaaagatcatattaatacctacatttaaaaatatttgtttatccttatttgcttatatattatttggtggattgtcaacaatggctctgagtatgttagtaacttcatcccctcaaaatataatagaatttcttgctttaattggcatgactgcatgcttctttctactgaatatgtcatcggttctagataaaaaaattcatgttattttaaaaacaaataag

SEQ ID NO: 3270 - protein, 209 aa, Staphylococcus aureus
  MISC_FEATURE (1)..(209): conserved hypothetical
VLCESRVINQNPKYRIIKYNNEYFMVDLVSTWIAYFLPMINWFIPKKYAKISREEFESLNIVKPAKNNTFWPVAGFAVLLTTLTRKYIYLLNIHLEKEIVILTCCMILLGVFALFIYINTKLKLHIFDKNKSNNEKIILIPTFKNICLSLFAYILFGGLSTMALSMLVTSSPQNIIEFLALIGMTACFFLLNMSSVLDKKIHVILKTNK

SEQ ID NO: 3271 - DNA, 615 bp, Staphylococcus aureus
ttgctttgtgaaaccgaaattatcaataaaaatccgaaatacagagttattaagtatgatgatgagtatttaatggtcgatgtaataagaacttggcttgtatacttttttccatttattaattggttcattccaaaaaggtgcgccaaaattagtagagaagagtatgaaaaactgaacactgttaagccagttaaaaataaaaatttttggcctgttgtaggaggaacaatcctactaggtgctacttccagaaagtacatacacttacttaatattcaattagaaaaaagatcggttatatttatatgcttcgttgtatttctatgtattttaatcttttttgtgcttctgaatcgaaaattaaaattgaaagttttcgataataaaaaagaagaacaaaaaataattttagtaccaacattaaaaaatgctgttcttatattatatggctatttgttgattggaggcatgtcaatattagctttaagcatgttgctgacattagaaaaccagaatttaataacttttatagcttggggtatggggttaatgttgtttttcttgatgaatataacactcattgtcaataaaacagtcaaagttataaaaagg

SEQ ID NO: 3272 - protein, 205 aa, Staphylococcus aureus
  MISC_FEATURE (1)..(205): conserved hypothetical
LLCETEIINKNPKYRVIKYDDEYLMVDVIRTWLVYFFPFINWFIPKRCAKISREEYEKLNTVKPVKNKNFWPVVGGTILLGATSRKYIHLLNIQLEKRSVIFICFVVFLCILIFFVLLNRKLKLKVFDNKKEEQKIILVPTLKNAVLILYGYLLIGGMSILALSMLLTLENQNLITFIAWGMGLMLFFLMNITLIVNKTVKVIKR

SEQ ID NO: 3273 - DNA, 639 bp, Staphylococcus aureus
gtggagatattgctttgcgaggttagagttgtaaacaaaaatcccagatatagaattattaaatataaaaacgactatctgatgattgatttagtaagcacctggttagttttgttctttccgtttattaattggttaataccaaaaaaatatgtccaaatcagcagagaagattttgataatttaaatattgtcaaaccagttaaaaataaagctttatggccagctataggtagcatacttttatttggcactatgtttagagataaaatatatatacctgattctcatttagaaaaaaattgcgttattatcatttgttcggttttattattaagtattctagtgttttatatatatttaaatcagaaagtaaagttatctatctataatgatcggagtagcaatggaaaaattatgatttttccatcattcaagaatctttgctttgtactattttcttattttttctgtggtggattatcaatcatgttcttagatgttttgattagtttatctatccaaaatattatagtatttattgcttgggttattatgacaatgctatttttctttataaatatgtcttcaataatagacaaaaagattcatgttatatatttaaggtcatataaatat

SEQ ID NO: 3274 - protein, 213 aa, Staphylococcus aureus
  MISC_FEATURE (1)..(213): conserved hypothetical
VEILLCEVRVVNKNPRYRIIKYKNDYLMIDLVSTWLVLFFPFINWLIPKKYVQISREDFDNLNIVKPVKNKALWPAIGSILLFGTMFRDKIYIPDSHLEKNCVIIICSVLLLSILVFYIYLNQKVKLSIYNDRSSNGKIMIFPSFKNLCFVLFSYFFCGGLSIMFLDVLISLSIQNIIVFIAWVIMTMLFFFINMSSIIDKKIHVIYLRSYKY

SEQ ID NO: 3275 - DNA, 624 bp, Staphylococcus aureus
ttgctttttaatattaaggttattaataaaaatccgagatataaagtcgttcaatataatgatgagtatttgttaattgatttagtaagcacttggcttgtatacttttttccttttattaattggttcattcccaaaaggtatgcaaaacttagtgagaaggaacttgaaaatttaaatgttgataaacaaaataaaaataatattttctggccagttactggtagttcgtttttatttgtagttattttacggaaatatgtacatacgtttgaagttcaattagataataagattttaatatctttatgttttataggatttataggtattgcagcattttacatttacttaaataaaaagcttaaactaaagatatatgatgataatctagataatgaaaatagggttatattagtgcctacttttaaagatggaagttttatagttttcacatatctattattaggaggttgttctatattatttttaatatggctaatgactataaaacctcaaaatctactggtatttattatgtggattattattacaatttttttctttctaataagcatgggctcaattagtaataaaaaggtttatgccaaacttaaaaagcaa

SEQ ID NO: 3276 - protein, 208 aa, Staphylococcus aureus
  MISC_FEATURE (1)..(208): conserved hypothetical
LLFNIKVINKNPRYKVVQYNDEYLLIDLVSTWLVYFFPFINWFIPKRYAKLSEKELENLNVDKQNKNNIFWPVTGSSFLFVVILRKYVHTFEVQLDNKILISLCFIGFIGIAAFYIYLNKKLKLKIYDDNLDNENRVILVPTFKDGSFIVFTYLLLGGCSILFLIWLMTIKPQNLLVFIMWIIITIFFFLISMGSISNKKVYAKLKKQ

SEQ ID NO: 3277 - DNA, 408 bp, Staphylococcus aureus
atgataccaggagaaattattacaaaaagtacagaggttgaaattaataaccatcatcctgaaacagttatcgaagttgaaaatacaggagatcgaccaattcaagtgggctcacattttcatttttatgaagcaaatgcagcattagatttcgaacgtgaaatggcatatggaaaacatttagatattccagctggagcagctgttcgatttgaacctggggataaaaaagaagttcaattagttgaatatgctggcaaacgtaaaatttttggttttcgtggtatggtcaatggtcctatcgatgagtcacgtgtctatcgcccaactgatgaaaatgatgaatatgcaggtgtattcggagataacggtgctgaaaacgtgaataaaaaaggaggaaaaagatca

SEQ ID NO: 3278 - protein, 136 aa, Staphylococcus aureus
  MISC_FEATURE (1)..(136): urease beta subunit
MIPGEIITKSTEVEINNHHPETVIEVENTGDRPIQVGSHFHFYEANAALDFEREMAYGKHLDIPAGAAVRFEPGDKKEVQLVEYAGKRKIFGFRGMVNGPIDESRVYRPTDENDEYAGVFGDNGAENVNKKGGKRS

SEQ ID NO: 3279 - DNA, 1413 bp, Staphylococcus aureus
atgccgatgagtattgacatgtatttagacagatctcgaaaccaagcttcaagtgtggggaatttgagtcaaacaatgaattcaaattatgatgcgttggaaaaagcaattactcaatttattaatgatgatgcgcttaaagggaaagcgtatacgtcagctaagcaattttttagtacggtgttaattccattatcaacaagtatgaaaacattgagtgatttaacgaagcaagcttgcgataattttgtgtcacgttatacgagtgaggttgatagcatatctttaaaagaatcagagcttgaagaagatatcagatcattaagtcaacaaattacgcgatatgaaaatttgaataacaatttgaaaaagcatgcttccgataatcagcaagccatttcatcgaaccaacaaataatacgaacattaggtcaacaaaaacatgaattagaagagaagctacgcaaattgcgtgagtttaatcaaaaatcaccagaaatatttaaagaagttgaagaatttcaaaaaattgtccaacaaggacttacccaagcgcagaatttttggaacttttcaacaaatcaatttaatattccttcaggtaaagaacttgattgggccaaagcaagtcatgaaaaatatttgaaagttgctatggggaaaattgaacataaagcagagaaagaaactttaaataaagcagactttgctgttataaaggcatatgccaaagaacatccagaagacgatatcccgaaaagtatattgaaatatataaatgacaataaagacagtattaaaagagatataggattagatattacgtcaacacttttagagcaagacggtataaatgcaagtaaattcggtgtatttatcaatacagcaggtggagtgaaaggcccagcaggtccaaattcatttgtggaagtcaaacgtacatcaggtaatgtgtttatagaaaatggtagtaaatttgcaaaaggcggaaaatacctaggtaaaggtgttgctggtgtaggatttggtataggtatgtatgatgaccttgcaaatgatgataaaacatttggagaggcgttgtcgcataatggtatgacgcttgcagctggatctgcagggacagcagttggagctggattagcgacttttgttttaggaagtaatccagtaggatgggtgattttagcaggtttggctatgagtacagtatttgcattaggaacagatttaatttatcaaaataatatttttggattaaaagataaagtagactgggtagggcataaaatcgataatagtatagatgttgttaaaaaaactacagaaaaatccatggatagtgttgggaatgctgttagtgaagctaaaaatattattagcaatcatataaatccaatgaaatgggcgtgg

SEQ ID NO: 3280 - protein, 471 aa, Staphylococcus aureus
  MISC_FEATURE (1)..(471): conserved hypothetical
MPMSIDMYLDRSRNQASSVGNLSQTMNSNYDALEKAITQFINDDALKGKAYTSAKQFFSTVLIPLSTSMKTLSDLTKQACDNFVSRYTSEVDSISLKESELEEDIRSLSQQITRYENLNNNLKKHASDNQQAISSNQQIIRTLGQQKHELEEKLRKLREFNQKSPEIFKEVEEFQKIVQQGLTQAQNFWNFSTNQFNIPSGKELDWAKASHEKYLKVAMGKIEHKAEKETLNKADFAVIKAYAKEHPEDDIPKSILKYINDNKDSIKRDIGLDITSTLLEQDGINASKFGVFINTAGGVKGPAGPNSFVEVKRTSGNVFIENGSKFAKGGKYLGKGVAGVGFGIGMYDDLANDDKTFGEALSHNGMTLAAGSAGTAVGAGLATFVLGSNPVGWVILAGLAMSTVFALGTDLIYQNNIFGLKDKVDWVGHKIDNSIDVVKKTTEKSMDSVGNAVSEAKNIISNHINPMKWAW

SEQ ID NO: 3281 - DNA, 99 bp, Staphylococcus aureus
atgtgtcaatacttatgtttgaaaagtgttgaattaggtgtggttattgtgatgatttattgtttgaaagttgatgcattaacggtgagattgcacaat

SEQ ID NO: 3282 - protein, 33 aa, Staphylococcus aureus
MCQYLCLKSVELGVVIVMIYCLKVDALTVRLHN

SEQ ID NO: 3283 - DNA, 438 bp, Staphylococcus aureus
ttgaatttagaatttaacattgccgtgcatgtattagcttttttaactaagcatcattcagaaaaattcaatagtagttcattagcagaattaacttgtttaaatcctgttcaattacgacgcgtgacgactcaacttgtcgatttaaaaatgattgacacaatacgaggtaaagatggcggttatttagcaaatgatcaaagtgctgatgtctctctagcaacattatataaacattttgtcttagagaaagaacaccacacacgtctatttactggcgacgaaggcagtcactgtcaaattgctcgtaatattgcaactaccatgtcacattatcagcaagacgaacagaatatcattattaatttttataatggaaaaacaatcaaagatgtcattgaagacattcaaaaggaggatttatgtcatgaaaacata

SEQ ID NO: 3284 - protein, 146 aa, Staphylococcus aureus
  MISC_FEATURE (1)..(146): hypothetical protein
LNLEFNIAVHVLAFLTKHHSEKFNSSSLAELTCLNPVQLRRVTTQLVDLKMIDTIRGKDGGYLANDQSADVSLATLYKHFVLEKEHHTRLFTGDEGSHCQIARNIATTMSHYQQDEQNIIINFYNGKTIKDVIEDIQKEDLCHENI

SEQ ID NO: 3285 - DNA, 1320 bp, Staphylococcus aureus
atgaaaacatatgatttaattgtaataggatttgggaaagctggtaaaactttagcgaaatacgctgcatcaacaggtcaacacgtcgcagttatcgaacaatctccgaaaatgtatggaggcacttgtataaacataggatgtataccttcgaagacacttgtacatgatggattagaaggcaaatcttttgaagcaagttataaccgtaaaaacgatgttgtcaatgcgctaaacaataaaaattaccacttattagcagacgataacaacattgatgtactggattttaaagcgcagtttaaatctaatactgaagtgaatttattagatcaacatgacgatatcgtcgatagtattactgcacctcatatcattattaataccggtgctacctctgtcattcctaacattaaaggccttgatcaagctaaacacgtcttcgattcgacaggtttattaaacattagctatcaacctaagcacctcgttattgtaggtggcggttatatcgccttagaatttgcttcaatgtttgcgaatttaggtagtaaggtaacagtattagaacgtggcgaatcatttatgccacgcgaagatcaagatgtcgttgcatatggtattactgacttagaaaataaaggcattgcattgcatacaaatgttgaaacgactgaattgtcatctgacaatcatcatacaacagtccataccaacgttggtaactttgaggctgatgcagtacttttggctatcgggcgcaaaccgaatacggatttagctttagaaaatactgatatcgaattaggcgacagaggcgaaattaaagtcaatgctcatcttcaaacaactgtgccgcatatttatgctgcaggtgatgttaaaggcggacttcaatttacgtatatatctttagatgattatcgaattatcaaatcagcgttatatggtaatcagtcacgtacgactgacaatagaggcagcgtgccttatacagtatttatagatccaccattatcacgtgttggattaactagtaaagaagctgccgctcaacattatgattacactgaacatcaacttttagtaagtgctatacctcgtcataaaattaacaatgatccaagaggtttatttaaagtagtcattaataatgaaaataatatgattttaggtgctacattatatggtaagcaatctgaagaattaattaatataattaaacttgcgattgatcaaaacattccatataccgtattacgagataatatttatacgcatcctacgatggccgaatcatttaatgatttatttaatttc

SEQ ID NO: 3286 - protein, 440 aa, Staphylococcus aureus
  MISC_FEATURE (1)..(440): mercuric reductase
MKTYDLIVIGFGKAGKTLAKYAASTGQHVAVIEQSPKMYGGTCINIGCIPSKTLVHDGLEGKSFEASYNRKNDVVNALNNKNYHLLADDNNIDVLDFKAQFKSNTEVNLLDQHDDIVDSITAPHIIINTGATSVIPNIKGLDQAKHVFDSTGLLNISYQPKHLVIVGGGYIALEFASMFANLGSKVTVLERGESFMPREDQDVVAYGITDLENKGIALHTNVETTELSSDNHHTTVHTNVGNFEADAVLLAIGRKPNTDLALENTDIELGDRGEIKVNAHLQTTVPHIYAAGDVKGGLQFTYISLDDYRIIKSALYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 3287 - DNA, 351 bp, Staphylococcus aureus
gtgggtagcaatatgaaaaatacattccttatttgtgatgaatgtcaggcagtcaatataagaacgttacaaaagaagttggaaaaattagatcccgatgctgaaatcgtgataggttgtcaatcttattgtggacctggacgccgaaaaacattcacttttgttaataaccgcccactggctgcgcttactgaagaagaattaatcgaaaaagtttctcaacaattaaagaaaccacgtgatcctgaagaagaagagcgtttaagaaaacgacatgaagaacgtaaacgtcgtaaagaagaacaagatagaaagcttaaagaaaaattagaaaagcgaaaagcacaacaa

SEQ ID NO: 3288 - protein, 117 aa, Staphylococcus aureus
  MISC_FEATURE (1)..(117): conserved hypothetical
VGSNMKNTFLICDECQAVNIRTLQKKLEKLDPDAEIVIGCQSYCGPGRRKTFTFVNNRPLAALTEEELIEKVSQQLKKPRDPEEEERLRKRHEERKRRKEEQDRKLKEKLEKRKAQQ

SEQ ID NO: 3289 - DNA, 1074 bp, Staphylococcus aureus
atgattcaggtcaaagcacccggaaaactttatattgctggagaatatgctgtaacagaaccaggatataaatctgtacttattgcgttagatcgttttgtaactgctactattgaagaagcagaccaatataaaggtaccattcattcaaaagcattacatcataacccagttacatttagtagagatgaagatagtattgtcatttcagatccacatgcagcaaaacaattaaattatgtggtcacagctattgaaatatttgaacaatacgcgaaaagttgcgatatagcgatgaagcattttcatctgactattgatagtaatttagatgattcaaatggtcataaatatggattaggttcaagtgcagcagtacttgtgtcagttataaaagtattaaatgaattttatgatatgaagttatctaatttatacatttataaactagcagtgattgcaaatatgaagttacaaagtttaagttcatgcggagatattgctgtgagtgtatatagtggatggctagcgtatagtacttttgatcatgaatgggttaagcatcaaattgaagatactacggttgaagaagttttaatcaaaaactggcctggattgcacatcgaaccattacaagcacctgaaaatatggaagtacttatcggttggactggctcaccggcgtcatcaccacactttgttagcgaagtgaaacgtttgaaatcagatccttcattttacggtgacttcttagaagattcacatcgttgtgttgaaaaacttattcatgcttttaaaacaaataacattaaaggtgtgcaaaagatggtgcgtcagaatcgtacaattattcaacgtatggataaagaagctacagttgatatagaaactgaaaagctaaaatatttgtgtgatattgctgaaaagtatcacggcgcatctaaaacatcaggcgctggtggtggagactgtggtattacaattatcaataaagatgtagataaagaaaaaatttatgatgaatggacaaaacatggtattaaaccattaaaatttaatatttatcatgggcaa

SEQ ID NO: 3290 - protein, 358 aa, Staphylococcus aureus
  MISC_FEATURE (1)..(358): phosphomevalonate kinase
MIQVKAPGKLYIAGEYAVTEPGYKSVLIALDRFVTATIEEADQYKGTIHSKALHHNPVTFSRDEDSIVISDPHAAKQLNYVVTAIEIFEQYAKSCDIAMKHFHLTIDSNLDDSNGHKYGLGSSAAVLVSVIKVLNEFYDMKLSNLYIYKLAVIANMKLQSLSSCGDIAVSVYSGWLAYSTFDHEWVKHQIEDTTVEEVLIKNWPGLHIEPLQAPENMEVLIGWTGSPASSPHFVSEVKRLKSDPSFYGDFLEDSHRCVEKLIHAFKTNNIKGVQKMVRQNRTIIQRMDKEATVDIETEKLKYLCDIAEKYHGASKTSGAGGGDCGITIINKDVDKEKIYDEWTKHGIKPLKFNIYHGQ

SEQ ID NO: 3291 - DNA, 981 bp, Staphylococcus aureus
ttgattaaaagtggcaaagcacgtgcacatacgaatattgcacttataaaatattggggtaaaaaagatgaagcactaatcattccaatgaataatagcatatctgttacattagaaaaattttacactgaaacgaaagtcacttttaacgaccagttaacacaggatcaattttggttgaatggtgaaaaggttagtggcaaagaattagagaaaatttcaaaatatatggatattgtcagaaatagagctggcatcgattggtatgcagaaattgaaagcgacaattttgtaccaacagcagcagggttggcttcatcggcaagcgcatatgcagctttagcagcagcttgtaatcaagcgctagacatgcagctgtcagataaggatttatcgagattggcgcgaattggttcgggttctgcgtcgcgtagtatttatggtggatttgcagaatgggaaaaagggtatagtgatgagacgtcatatgccgttccacttgaatcgaatcattttgaagatgaccttgccatgatatttgttgtgattaatcaacattctaaaaaggtacctagtcgatatggtatgtcattgacacgaaacacatcaaggttttatcaatattggttagatcatattgatgaagatttagctgaagcaaaagcagcgattcaagacaaagattttaaacgccttggtgaagtaattgaagaaaatggtttgcgtatgcatgccacgaatctaggatcaacaccgccgttcacatatcttgtgcaagaaagttatgatgtcatggcgcttgttcacgaatgccgagaagcggggtatccgtgttattttacaatggatgcgggacctaatgtgaaaatacttgtagaaaagaaaaacaagcaacagattatagataaattattaacacagtttgataataaccaaattattgatagtgacattattgccacaggaattgaaataattgag

SEQ ID NO: 3292 - protein, 327 aa, Staphylococcus aureus
  MISC_FEATURE (1)..(327): mevalonate diphosphate
LIKSGKARAHTNIALIKYWGKKDEALIIPMNNSISVTLEKFYTETKVTFNDQLTQDQFWLNGEKVSGKELEKISKYMDIVRNRAGIDWYAEIESDNFVPTAAGLASSASAYAALAAACNQALDMQLSDKDLSRLARIGSGSASRSIYGGFAEWEKGYSDETSYAVPLESNHFEDDLAMIFVVINQHSKKVPSRYGMSLTRNTSRFYQYWLDHIDEDLAEAKAAIQDKDFKRLGEVIEENGLRMHATNLGSTPPFTYLVQESYDVMALVHECREAGYPCYFTMDAGPNVKILVEKKNKQQIIDKLLTQFDNNQIIDSDIIATGIEIIE

SEQ ID NO: 3293 - DNA, 918 bp, Staphylococcus aureus
atgacaagaaaaggatatggggaatcgacaggtaagattattttaataggagaacatgctgttacatttggagagcctgctattgcagtaccgtttaacgcaggtaaaatcaaagttttaatagaagccttagagagcgggaactattcgtctattaaaagcgatgtttacgatggtatgttatatgatgcgcctgaccatcttaagtctttggtgaaccgttttgtagaattaaataatattacagagccgctagcagtaacgatccaaacgaatttaccaccatcacgtggattaggatcgagtgcagctgtcgcggttgcttttgttcgtgcaagttatgattttttagggaaatcattaacgaaagaagaactcattgaaaaggctaattgggcagagcaaattgcacatggtaaaccaagtggtattgatacgcaaacgattgtatcaggcaaaccagtttggttccaaaaaggtcatgctgaaacgttgaaaacgttaagtttagacggctatatggttgttatagatactggtgtgaaaggttcaacaagacaagcagtagaagatgttcataaactttgtgaggaccctcagtacatgtcacatgtaaaacatatcggtaagttagttttacgtgcgagtgatgtgattgaacatcataactttgaagccttagcggatatttttaatgaatgtcatgcggatttaaaggcgttgacagttagtcatgataaaatagaacaattaatgaaaattggtaaagaaaatggtgcgattgctggaaaacttactggcgctggtcgtggtggaagtatgttattgcttgccaaagatttaccaacagcgaaaaatattgtaaaagctgtagaaaaagctggtgcagcacatacttggattgagaatttaggaggt

SEQ ID NO: 3294 - protein, 306 aa, Staphylococcus aureus
  MISC_FEATURE (1)..(306): mevalonate kinase
MTRKGYGESTGKIILIGEHAVTFGEPAIAVPFNAGKIKVLIEALESGNYSSIKSDVYDGMLYDAPDHLKSLVNRFVELNNITEPLAVTIQTNLPPSRGLGSSAAVAVAFVRASYDFLGKSLTKEELIEKANWAEQIAHGKPSGIDTQTIVSGKPVWFQKGHAETLKTLSLDGYMVVIDTGVKGSTRQAVEDVHKLCEDPQYMSHVKHIGKLVLRASDVIEHHNFEALADIFNECHADLKALTVSHDKIEQLMKIGKENGAIAGKLTGAGRGGSMLLLAKDLPTAKNIVKAVEKAGAAHTWIENLGG

SEQ ID NO: 3295 - DNA, 834 bp, Staphylococcus aureus
atggatttagcgagtaaatattttaatggcgtcaactggcgatatatcgatcattcttctggattagaacctatgcaatctttcgcattcgatgatacattttgcgaaagtgtgggcaaagatatatcagataatgttgtgcgtacttggattcatcaacatactgttattcttggtattcatgattcaagattgccgtttttaaaagatggcattgattatttaacgaatgagattggttataatgccattgttagaaattctggtggcttaggtgtcgttctagatcaaggtgtattaaatatatcgctgatgttcaaaggacaaacagaaacaacgattgatgaagcgtttactgtgatgtacctcttaattagcaaaatgttcgaaaatgagaatgttgatattgatacgatggaaattgaacattcttattgcccaggaaaatttgacttaagtatcgatggtaagaaatttgcaggcatatcgcaacgaagagttagaggcggtattgctgtacaaatttatctttgtgttgaaggctctggttcagaacgtgcattgatgatgcaaacattttatgaacatgctttaaaaggtgaagtgactaaatttaaatatcctgaaattgaaccatcttgtatggcctcattagagacattgcttaacaaaacgattactgttcaagatgtaatgtttttactattatatgcaatcaaagatcttggcggtgtattaaatatgacgccaattactcaagaagaatggcaaagatacgatacgtattttgataaaatgattgaaagaaacaagaaaatgatagatcaaatgcaa

SEQ ID NO: 3296 - protein, 278 aa, Staphylococcus aureus
  MISC_FEATURE (1)..(278): conserved hypothetical
MDLASKYFNGVNWRYIDHSSGLEPMQSFAFDDTFCESVGKDISDNVVRTWIHQHTVILGIHDSRLPFLKDGIDYLTNEIGYNAIVRNSGGLGVVLDQGVLNISLMFKGQTETTIDEAFTVMYLLISKMFENENVDIDTMEIEHSYCPGKFDLSIDGKKFAGISQRRVRGGIAVQIYLCVEGSGSERALMMQTFYEHALKGEVTKFKYPEIEPSCMASLETLLNKTITVQDVMFLLLYAIKDLGGVLNMTPITQEEWQRYDTYFDKMIERNKKMIDQMQ

SEQ ID NO: 3297 - DNA, 984 bp, Staphylococcus aureus
atggctgatttattaaatgtattaaaagacaaactttctggtaaaaacgttaaaatcgtattacctgaaggagaggacgaacgtgttctaacagctgcaacacaattacaagcaacagattatgttacaccaatcgtgttaggtgatgagactaaggttcaatctttagcgcaaaaacttgatcttgatatttctaatattgaattaattaatcctgcgacaagtgaattgaaagctgaattagttcaatcatttgttgaacgacgtaaaggtaaagcgactgaagaacaagcacaagaattattaaacaatgtgaactacttcggtacaatgcttgtttatgctggtaaagcagatggtttagttagtggtgcagcacattcaacaggcgacactgtgcgtccagctttacaaatcatcaaaacgaaaccaggtgtatcaagaacatcaggtatcttctttatgattaaaggtgatgaacaatacatctttggtgattgtgcaatcaatccagaacttgattcacaaggacttgcagaaattgcagtagaaagtgcaaaatcagcattaagctttggcatggatccaaaagttgcaatgttaagcttttcaacaaaagggtctgctaaatcagacgacgtgacaaaagttcaagaagctgtcaaattagcacaacaaaaagctgaagaagaaaaattagaagcaatcattgatggcgaattccaatttgatgctgcgattgtaccaggtgttgctgagaaaaaagcgccaggtgctaaattacaaggtgatgcaaatgtctttgtattcccaagtttagaagctggtaatattggttacaaaattgcacaacgtttaggtggatatgatgcagttggtccagtattacaaggtttaaattctccagtaaatgacttatcacgtggctgctcaattgaagatgtatacaatctttcaattattacagcagcgcaagccttacaa

SEQ ID NO: 3298 - protein, 328 aa, Staphylococcus aureus
  MISC_FEATURE (1)..(328): phosphotransacetylase
MADLLNVLKDKLSGKNVKIVLPEGEDERVLTAATQLQATDYVTPIVLGDETKVQSLAQKLDLDISNIELINPATSELKAELVQSFVERRKGKATEEQAQELLNNVNYFGTMLVYAGKADGLVSGAAHSTGDTVRPALQIIKTKPGVSRTSGIFFMIKGDEQYIFGDCAINPELDSQGLAEIAVESAKSALSFGMDPKVAMLSFSTKGSAKSDDVTKVQEAVKLAQQKAEEEKLEAIIDGEFQFDAAIVPGVAEKKAPGAKLQGDANVFVFPSLEAGNIGYKIAQRLGGYDAVGPVLQGLNSPVNDLSRGCSIEDVYNLSIITAAQALQ

SEQ ID NO: 3299 - DNA, 1713 bp, Staphylococcus aureus
atgagctttaaaatgacgcaaaatcaatatacgagcttatacggtccaactgttggagattccattcgtttaggtgatacgaatctatttgctcaaatagaaaaagactatgcggtttatggtgaagaagctacttttggtggtggtaaatctattagagacggtatggcgcaaaatcctcgtgtaacacgtgatgacgtgaacgttgcagaccttgtcatttctaatgccgttattatcgattacgataaagtggttaaagctgatataggcattaaaaatggttatattttcgccataggtaatgccggcaacccagatataatggataatgtcgacattattataggttcaacaacagatatcattgccgctgaaggtaaaatcgtcactgctggtggtattgatactcatgttcattttattaatcctgaacaagcagaggtcgcattagaaagtggtattacgactcatattggtggtggtactggtgcttcagaaggttctaaagcaacaactgtaactccaggtccatggcatattcatagaatgttagaagctgccgaaggtttaccgattaatgtcggttttacaggtaaaggacaagcaacaaatccaactgcactcattgaacaaatcaatgccggagcaattggattaaaagtacatgaagactggggtgcaacaccatctgctttgagtcatgcattagatgttgctgatgaatttgatgttcaaattgcattacatgcagatactttaaatgaagcaggatttatggaagacacaatggctgctgttaaagaccgtgtacttcatatgtaccatactgaaggtgctggtggcggtcatgcgcctgatttaattaaatccgctgcattttcaaatattttaccttcatctacaaatccaactttgccttatacacataatactgtagatgaacatttagatatggtaatgattactcaccatttaaatgcggctattcctgaagatatcgcattcgcagattcacgtattcgtaaagaaacgattgcagcagaagatgttctgcaagatatgggtgtattcagtatgattagttccgattcacaagcaatgggccgtgtaggtgaagtaattacacgaacatggcaagtagcacatcgcatgaaagaacaacgtggtcctttagatggtgattttgaacataatgataataatcgcatcaaacgttatatcgctaaatatacaattaacccagcaattacacatggtatttctgaatatgtaggatctatcgagccgggcaaactagctgacattgtcttatgggacccaattttctttggggttaaacctgaattagttgtaaagggcggattaattaactctgccgtaaatggcgatgcaaatggttctatacctacatctgaaccgatgaagtaccgtaaaatgtatggtcaatacggcggaaaccttacaagtacgtcaatgacattcgtgtctaaaactgcttatgaaaatggtatcaatcgtgcattaaatttaaaacgcatggtgcgtccagttaaaaatattagacaattatctaaagcagatatgaaaaataacagtgcaacacctaaattagacgttgatccacaaacatatgaagtatatgtagatggagaaaaaattacaagtaatgcagcaactgagttaccattaactcaaagatacttcttattc

SEQ ID NO: 3300 - protein, 571 aa, Staphylococcus aureus
  MISC_FEATURE (1)..(571): urease alpha subunit
MSFKMTQNQYTSLYGPTVGDSIRLGDTNLFAQIEKDYAVYGEEATFGGGKSIRDGMAQNPRVTRDDVNVADLVISNAVIIDYDKVVKADIGIKNGYIFAIGNAGNPDIMDNVDIIIGSTTDIIAAEGKIVTAGGIDTHVHFINPEQAEVALESGITTHIGGGTGASEGSKATTVTPGPWHIHRMLEAAEGLPINVGFTGKGQATNPTALIEQINAGAIGLKVHEDWGATPSALSHALDVADEFDVQIALHADTLNEAGFMEDTMAAVKDRVLHMYHTEGAGGGHAPDLIKSAAFSNILPSSTNPTLPYTHNTVDEHLDMVMITHHLNAAIPEDIAFADSRIRKETIAAEDVLQDMGVFSMISSDSQAMGRVGEVITRTWQVAHRMKEQRGPLDGDFEHNDNNRIKRYIAKYTINPAITHGISEYVGSIEPGKLADIVLWDPIFFGVKPELVVKGGLINSAVNGDANGSIPTSEPMKYRKMYGQYGGNLTSTSMTFVSKTAYENGINRALNLKRMVRPVKNIRQLSKADMKNNSATPKLDVDPQTYEVYVDGEKITSNAATELPLTQRYFLF

SEQ ID NO: 3301 - DNA, 750 bp, Staphylococcus aureus
atgagtcaagcagccgaaacattagatggttggtatagtctacatttattttatgcagttgattgggcatcattacgtatagttccaaaggacgaacgcgatgcacttgtcactgaatttcaatcatttttagaaaatacagcaactgtaagatcatcaaaatctggtgatcaagctatttataatataactggtcaaaaagcagatttgttattatggttcttacgtcctgaaatgaagtctttaaatcatattgaaaatgaatttaacaaattgcgcattgctgacttcctaatccctacatattcatatgtatcagtcattgaattgagcaattatttagctggtaaatctgatgaagatccttatgagaaccctcatatcaaagcaagattatacccagaattaccacattctgattatatttgtttctatccaatgaacaaacgtcgtaatgaaacttataactggtacatgttaactatggaagaacgccaaaaattaatgtatgaccatggtatgattggtagaaaatatgctggcaaaatcaaacaatttattactggttctgtagggtttgatgatttcgaatggggcgtaacattgttctcagatgacgtattacaattcaaaaaaattgtatacgaaatgcgctttgatgaaacaacagcacgatacggtgaattcggtagtttctttgtaggacatattattaacacaaacgaattcgatcaattctttgcgatttct

SEQ ID NO: 3302 - protein, 250 aa, Staphylococcus aureus
  MISC_FEATURE (1)..(250): conserved hypothetical
MSQAAETLDGWYSLHLFYAVDWASLRIVPKDERDALVTEFQSFLENTATVRSSKSGDQAIYNITGQKADLLLWFLRPEMKSLNHIENEFNKLRIADFLIPTYSYVSVIELSNYLAGKSDEDPYENPHIKARLYPELPHSDYICFYPMNKRRNETYNWYMLTMEERQKLMYDHGMIGRKYAGKIKQFITGSVGFDDFEWGVTLFSDDVLQFKKIVYEMRFDETTARYGEFGSFFVGHIINTNEFDQFFAIS

SEQ ID NO: 3303 - DNA, 762 bp, Staphylococcus aureus
atggacataaattcagaagaatacaaacaagaggtacttatcaaagacgttgtcatgcttgctgctcgcatactattagaatctggtgcagaaggtacgcgtgtagaagataccatgacacgtattgcaaaaaaacttggttacagtgaaagtaacagctttgttacaaacactgtcatccagtttacgttacattcggaatcgtttcctagaatatttagaattacctctcgagatacaaacttaataaaaatttctcaagctaataaaatttcgcgtcaaattacaaacaatgaaatttctttagccgaagcaaaaacgcaacttgaaaaaatatatgttgctaagcgtgacagcagtcttccctttaaaggttttgctgcagcaatgattgcaatgagtttcttatatttacaaggtggtagattgattgatgttttaactgcgatattagcaggtagtctaggatacctagtcactgagattttagatcgtaagttacacgcacagtttatcccagaattcattggttcattagttattgggattatcgccgttattggacatacacttattccaacaggtgacttggcaactattatcattgcggcagtcatgcctattgttcctggtgtattaataacaaacgcaatacaagatttatttggtggacacatgttgatgttcacaacgaaatcattagaagcattggttactgcgtttggcatcggtgctggcgttggtagcgtattaattttagta

SEQ ID NO: 3304 - protein, 254 aa, Staphylococcus aureus
  MISC_FEATURE (1)..(254): conserved hypothetical
MDINSEEYKQEVLIKDVVMLAARILLESGAEGTRVEDTMTRIAKKLGYSESNSFVTNTVIQFTLHSESFPRIFRITSRDTNLIKISQANKISRQITNNEISLAEAKTQLEKIYVAKRDSSLPFKGFAAAMIAMSFLYLQGGRLIDVLTAILAGSLGYLVTEILDRKLHAQFIPEFIGSLVIGIIAVIGHTLIPTGDLATIIIAAVMPIVPGVLITNAIQDLFGGHMLMFTTKSLEALVTAFGIGAGVGSVLILV

SEQ ID NO: 3305 - DNA, 450 bp, Staphylococcus aureus
atgttttggatcttaaactttatctttagctttttagcttcaatgttcttctgcgtcatttttgatgcacctagaaaattatatctatcatgtggtttcgttggtacgtgtggatggatggtttacaccttattcttcaacggctttaatgtgcacactatatactctagtttctttggtagtttagcattaggcttgttaagtcattatatggctcgtaaacaaaaagaacctgccatcatttttatggtaacgggtatcattccattagtacctggtggcttagcatacgatgctacaaaaaatttagtcttattaaatttcagtacagcaatcaataccatgctagaggttacacttattgcaggcgccatcgcattaggtttattattcgccgaccaaatttccaaattaattgtttctgggttcgtgaaatcttttaaacgatta

SEQ ID NO: 3306 - protein, 150 aa, Staphylococcus aureus
  MISC_FEATURE (1)..(150): conserved hypothetical
MFWILNFIFSFLASMFFCVIFDAPRKLYLSCGFVGTCGWMVYTLFFNGFNVHTIYSSFFGSLALGLLSHYMARKQKEPAIIFMVTGIIPLVPGGLAYDATKNLVLLNFSTAINTMLEVTLIAGAIALGLLFADQISKLIVSGFVKSFKRL

SEQ ID NO: 3307 - DNA, 1518 bp, Staphylococcus aureus
ttgggtatagaataccttcgaggtgagtttttatttatggaaaaaaagaataagcaaatagatagaggcgatttaaaacaaaacctatctgaaaagtttgtatgggcgattgcatatggttcatgtatcggatggggcgcattcatcttaccaggagactggattaagcagtcaggtccgattgcagcatcaattggtatagttattggtgcattattaatgatattaattgcggttagttatggcgcattagtagagagatttccagtatcagggggcgcgtttgcctttagtttcttaagtttcggcagatatgtgagtttcttctcatcatggtttttaacttttggttatgtctgtgtcgttgctttaaatgcgaccgcattcagtttactagttaaattcttattgccagatgtcttaaataatgggaaactatacaccattgcgggctgggacgtttatattacggaaatcattattgcgaccgtattactacttgtattcatgctagtaacgattcgtggcgcaagtgtatctggatcattacaatattatttctgtgtggcgatggtaatcgtcgtattattgatgttctttggttcattctttggtaataattttgcacttgaaaatttacaaccgttagctgaacctagcaaaggatggttagtgtctattgtggttattgtatccgtggcaccatgggcatatgttggatttgataatattccacaaacagcagaagagtttaactttgcaccaaacaagacatttaagcttatcgtgtacagtttattagcagcatcattaacttatgttgtcatgattttatacactggttggttatcaacaagtcatcaaagtttaaatgggcagttgtggttaacaggtgctgttacacaaacagcatttggttatattggattaggtgtattagcaattgcaattatgatgggtatatttactggtttaaatggattcttgatgagttcaagtcgcttgttattttctatgggacgttcaggtattatgccaacaatgtttagtaaattacatagtaaatacaaaacaccatatgtcgcaatcatattcctagtaggagtgtcgttaattgcaccttggctaggaagaactgcattgacttggattgtagatatgtcatctactggtgtatccattgcctactttattacatgtttgtctgcagcgaaattattcagttataacaaacaaagtaatacgtatgcaccggtttacaaaacgtttgctattatcggctcatttgtatcattcattttcttagcgttgttattagtgccaggttctcctgcagcactgactgcaccgtcttatattgcattacttggatggttaatcatcggtttaatattctttgtgattcgatatcctaaattgaaaaatatggataatgatgaattaagtcgcttgattttaaatagaagtgaaaatgaagttgatgatatgattgaagaacctgaaaaagaaaaaactaaa

SEQ ID NO: 3308 - protein, 506 aa, Staphylococcus aureus
  MISC_FEATURE (1)..(506): hypothetical protein
LGIEYLRGEFLFMEKKNKQIDRGDLKQNLSEKFVWAIAYGSCIGWGAFILPGDWIKQSGPIAASIGIVIGALLMILIAVSYGALVERFPVSGGAFAFSFLSFGRYVSFFSSWFLTFGYVCVVALNATAFSLLVKFLLPDVLNNGKLYTIAGWDVYITEIIIATVLLLVFMLVTIRGASVSGSLQYYFCVAMVIVVLLMFFGSFFGNNFALENLQPLAEPSKGWLVSIVVIVSVAPWAYVGFDNIPQTAEEFNFAPNKTFKLIVYSLLAASLTYVVMILYTGWLSTSHQSLNGQLWLTGAVTQTAFGYIGLGVLAIAIMMGIFTGLNGFLMSSSRLLFSMGRSGIMPTMFSKLHSKYKTPYVAIIFLVGVSLIAPWLGRTALTWIVDMSSTGVSIAYFITCLSAAKLFSYNKQSNTYAPVYKTFAIIGSFVSFIFLALLLVPGSPAALTAPSYIALLGWLIIGLIFFVIRYPKLKNMDNDELSRLILNRSENEVDDMIEEPEKEKTK

SEQ ID NO: 3309 - DNA, 366 bp, Staphylococcus aureus
atgaaattatttattattttaggtgcattaaacgcgatgatggctgtcggtacaggtgcatttggtgcgcatggtttacaaggaaaaataagtgatcactatttatcagtatgggaaaaagcaacgacgtatcaaatgtaccatggcttagcattattaattataggtgtaattagtggtacaacttcaatcaatgttaactgggctggctggttaatatttgctggtattattttctttagtggatcattatatattttagtattaactcaaattaaagttttaggtgcgattacgccaattggtggcgtattgttcatcattggatggataatgttaatcattgcgacattcaaatttgctggt

SEQ ID NO: 3310 - protein, 122 aa, Staphylococcus aureus
  MISC_FEATURE (1)..(122): conserved hypothetical
MKLFIILGALNAMMAVGTGAFGAHGLQGKISDHYLSVWEKATTYQMYHGLALLIIGVISGTTSINVNWAGWLIFAGIIFFSGSLYILVLTQIKVLGAITPIGGVLFIIGWIMLIIATFKFAG

SEQ ID NO: 3311 - DNA, 378 bp, Staphylococcus aureus
atgttgaatagagaaactttaatagcacgaattgagcaagaattagtacaagcagagcaggcacagcatgaccatgactttgaaaaacatatgtatgccatacatatattaacatctttatatgcttcaacatcaaatacaccacatattggtgaacaacaaatgaatcgtcgtattgctaaccataatcaaatgccacaatcacaaataacgcagccaactcatcaagtgacagttgctgaaattgaagcgatgggtggtaaagtaaatacgcattcagcacatcatcataataagtcatattcacaaccttcaaaccaacaacaaagattagcgacagatgatgacattggcaatggtgaatccatatttgatttt

SEQ ID NO: 3312 - protein, 126 aa, Staphylococcus aureus
  MISC_FEATURE (1)..(126): hypothetical protein
MLNRETLIARIEQELVQAEQAQHDHDFEKHMYAIHILTSLYASTSNTPHIGEQQMNRRIANHNQMPQSQITQPTHQVTVAEIEAMGGKVNTHSAHHHNKSYSQPSNQQQRLATDDDIGNGESIFDF

SEQ ID NO: 3313 - DNA, 654 bp, Staphylococcus aureus
atggaatggtcgcaaatttttcatgacataacaacgaaacatgactttaaagctatgcatgattttttagaaaaagaatattcgactgcaatcgtataccctgatagggaaaatatatatcaagcgtttgatttaacaccgtttgaaaatatcaaagttgttatattaggacaagacccgtatcatggtccaaaccaagcacatggattagcattttcagtgcaacctaacgcaaaattccctccatctttacgtaatatgtataaagaattagcagatgatattggatgcgttagacaaacaccgcatttacaagattgggcaagagaaggcgtcttgttattgaatacagttttaaccgtaagacagggtgaagcaaattctcatcgtgatattggttgggaaacatttactgatgaaattattaaagcagtgtctgattataaagaacatgttgtctttattttgtgggggaaacctgcacagcaaaaaataaagcttatcgatacatctaaacattgtattataaaatcagtgcatcctagtccactgtctgcatatagaggattctttggatcaaaaccgtattccaaagcgaatgcctatttagagtcagtaggaaaatcaccaattaattggtgtgaaagtgaggcg

SEQ ID NO: 3314 - protein, 218 aa, Staphylococcus aureus
  MISC_FEATURE (1)..(218): uracil-DNA glycosylase
MEWSQIFHDITTKHDFKAMHDFLEKEYSTAIVYPDRENIYQAFDLTPFENIKVVILGQDPYHGPNQAHGLAFSVQPNAKFPPSLRNMYKELADDIGCVRQTPHLQDWAREGVLLLNTVLTVRQGEANSHRDIGWETFTDEIIKAVSDYKEHVVFILWGKPAQQKIKLIDTSKHCIIKSVHPSPLSAYRGFFGSKPYSKANAYLESVGKSPINWCESEA

SEQ ID NO: 3315 - DNA, 450 bp, Staphylococcus aureus
atgattgttgaagaaatccaaggcaatattgccaatttgtcaaattcagaaaaacaaaagcacgtcgaaaaagtataccttgaaaattcagatcttgttaaacgtattcaaagagtcgttacagaccatggcactgaaataggcattcgtttaaaacaacctattgacttacaatatggagatattttatacgcagatgaccataatatgattattgtggatgttaattcagaagatcttttagtgattcaaccaagaacattgcaagaaatgggagatatagcccatcaattaggaaatcgtcatttgccagcacaatttacagagactgaaatgctagtacaatatgattatttagttgaagatttattaaaaagtttaggcatcccatatgttcgagaagaccgtaaagttaataaggctttcagacatatagggcattctcatgat

SEQ ID NO: 3316 - protein, 150 aa, Staphylococcus aureus
  MISC_FEATURE (1)..(150): urease accessory protein
MIVEEIQGNIANLSNSEKQKHVEKVYLENSDLVKRIQRVVTDHGTEIGIRLKQPIDLQYGDILYADDHNMIIVDVNSEDLLVIQPRTLQEMGDIAHQLGNRHLPAQFTETEMLVQYDYLVEDLLKSLGIPYVREDRKVNKAFRHIGHSHD

SEQ ID NO: 3317 - DNA, 828 bp, Staphylococcus aureus
atggctttaaagaaagttttaacaattgccggttctgacacaagtgctggcgcaggtatgcaagcagatttgaaaacgttccaagaattagatacgtatggcatggtcgctttaactgccatcgttactatggataaagatacatggtcacacgatgttacaccattaccaatggatgtatttgaaaaacaacttgaaacggctttatcaatcggacctgatgctattaaaacaggtatgttaggtactgaggagataatcaaacgtgctggagaagtatatgaggcatctaatgcacaatattttgtagtagatcctgtcatggtttgtaaaggcgaagatgaagtgcttaatcctggaaatactgaggcgatgattaaatatttactacctaaagcaacggtagtgacaccaaacttatttgaagcgggtcaattatcaggattaggtaaattaaattcaattgaagatatgaaaaaggctgcaacaattatctttgataaaggcgcacagcatgtcatcattaaaggtggcaaagctttagatcaagataaatcgtatgacttatactatgatggtcaaacattttatcaactaacaacagacatgttccaacaaagttataaccatggtgctggttgtacatttgctgcggcaacaactgcatatttagctaacggtaagtcaccgaaagaagctgtgattagcgcgaaagctttcgtcgcttctgctattaaaaacggttggaaaatgaatgattttgttggtcctgtggatcacggtgcatacaaccgtattgaacatatcgatgttgaagtaacagaggtt

SEQ ID NO: 3318 - protein, 276 aa, Staphylococcus aureus
  MISC_FEATURE (1)..(276): hypothetical protein
MALKKVLTIAGSDTSAGAGMQADLKTFQELDTYGMVALTAIVTMDKDTWSHDVTPLPMDVFEKQLETALSIGPDAIKTGMLGTEEIIKRAGEVYEASNAQYFVVDPVMVCKGEDEVLNPGNTEAMIKYLLPKATVVTPNLFEAGQLSGLGKLNSIEDMKKAATIIFDKGAQHVIIKGGKALDQDKSYDLYYDGQTFYQLTTDMFQQSYNHGAGCTFAAATTAYLANGKSPKEAVISAKAFVASAIKNGWKMNDFVGPVDHGAYNRIEHIDVEVTEV

SEQ ID NO: 3319 - DNA, 165 bp, Staphylococcus aureus
atgattatttatcgacagtatcaccatgaaggcgcaccagtttatgaaattataaccaaaacgtttcagcatgtttcaattaaatgtgacgattcatttagtgatactgaaatattcaaattgctctctttattacaagacgatatagatcatatgaaagttagt

SEQ ID NO: 3320 - protein, 55 aa, Staphylococcus aureus
  MISC_FEATURE (1)..(55): hypothetical protein
MIIYRQYHHEGAPVYEIITKTFQHVSIKCDDSFSDTEIFKLLSLLQDDIDHMKVS

SEQ ID NO: 3321 - DNA, 267 bp, Staphylococcus aureus
atggagtttaatgagatatggataaatgaatatttggcgctcgtaaatgatgataatccaatacataatgagattgtgccaggacaattagtgagtcaaatgatgctgatggctatgtcattagagacaaaccagtgtcaaattaactacgttaaacctattttaataaatgaaaatatcgaattcattgaacaacacgaacacgaaattatagcaattaatgacgatggagagattaaaataaaaatttctttgagcacaaaaaaa

SEQ ID NO: 3322 - protein, 89 aa, Staphylococcus aureus
  MISC_FEATURE (1)..(89): hypothetical protein
MEFNEIWINEYLALVNDDNPIHNEIVPGQLVSQMMLMAMSLETNQCQINYVKPILINENIEFIEQHEHEIIAINDDGEIKIKISLSTKK

SEQ ID NO: 3323 - DNA, 363 bp, Staphylococcus aureus
atgcagcattatttactcgattctaaccagcgattaaatgtgtcattttctaaggatagtgtggctgcatattatcagtgttttaaccaaccttatagaaaagaagtaccaccattaatgtgtgcgtcattatggccaaaatttgatttatttaaaaaatatgcaaatagcgaactgattttaacaaaatcagcaattaatcaaactcaaaagatagaagtagacacaatatatgtagggcatttagaagatattgaatgccgacagactcgcaatatcacacgttatacaatggctttaacattaactaaaaatgatcaacatgtcataacggttacacaaacttttattaaggcgatgaag

SEQ ID NO: 3324 - protein, 121 aa, Staphylococcus aureus
  MISC_FEATURE (1)..(121): hypothetical protein
MQHYLLDSNQRLNVSFSKDSVAAYYQCFNQPYRKEVPPLMCASLWPKFDLFKKYANSELILTKSAINQTQKIEVDTIYVGHLEDIECRQTRNITRYTMALTLTKNDQHVITVTQTFIKAMK

SEQ ID NO: 3325 - DNA, 1149 bp, Staphylococcus aureus
gtgaattataatatgaatcaagcagtcatagttgcagctaaacgaactgcatttgggaaatatggtggcactttaaaacatttagagccagaacaattgcttaaacctttattccaacattttaaagagaagtatccagaggtaatatctaaaatagatgatgtagttttaggtaatgttgttgggaatggtggcaatattgcaagaaaagcattgcttgaagcggggcttaaagattcaatacctggcgtcacaatcgatcggcaatgtgggtctggacttgaaagtgttcaatatgcatgtcgcatgatccaagccggagctggcaaggtatatattgcaggtggtgttgaaagtacaagtcgagcaccttggaaaatcaaacgaccgcattctgtgtacgaaacagcattacctgagttttatgagcgtgcatcatttgcacctgaaatgagcgacccatcaatgattcaaggtgctgaaaatgtggccaagatgtatgatgtttcaagagaattacaagatgaatttgcttatcgaagtcatcaattgacagcggaaaatgtaaagaatggaaatatttctcaggaaatattacctataaccgttaaaggagaaatattcaacactgatgaaagtctaaaatcacatattccgaaagataactttggccgatttaagcccgtgatcaaaggtgggaccgttaccgctgcgaatagttgtatgaaaaatgatggtgcagttttattgcttattatggaaaaagatatggcatacgaattaggtttcgagcatggtttattatttaaagatggtgttacggtaggtgttgattctaattttcctggcattggtccagtaccagccatttccaacttactaaaaagaaatcaattaacgatagaaaatattgaagtcattgaaattaacgaagcgttcagtgcacaggtagttgcctgccaacaagctttaaatatttcaaatacgcaattaaatatatggggtggtgcattagcatcaggtcatccatacggtgcaagcggtgcccaattagtgactcgattattttatatgtttgacaaagagactatgattgcatctatggggatagggggaggtctaggaaatgcagcattatttactcgattc

SEQ ID NO: 3326 - protein, 383 aa, Staphylococcus aureus
  MISC_FEATURE (1)..(383): acetyl-CoA
VNYNMNQAVIVAAKRTAFGKYGGTLKHLEPEQLLKPLFQHFKEKYPEVISKIDDVVLGNVVGNGGNIARKALLEAGLKDSIPGVTIDRQCGSGLESVQYACRMIQAGAGKVYIAGGVESTSRAPWKIKRPHSVYETALPEFYERASFAPEMSDPSMIQGAENVAKMYDVSRELQDEFAYRSHQLTAENVKNGNISQEILPITVKGEIFNTDESLKSHIPKDNFGRFKPVIKGGTVTAANSCMKNDGAVLLLIMEKDMAYELGFEHGLLFKDGVTVGVDSNFPGIGPVPAISNLLKRNQLTIENIEVIEINEAFSAQVVACQQALNISNTQLNIWGGALASGHPYGASGAQLVTRLFYMFDKETMIASMGIGGGLGNAALFTRF

SEQ ID NO: 3327 - DNA, 1377 bp, Staphylococcus aureus
ttgatgaacgtaattttagaacagttgaaaacacatactcaaaataaacctaatgacatagcattacatatcgatgatgaaacaattacatatagtcaactaaatgcccgcatcactagcgcagttgaatctttgcagaaatattcacttaaccctgtcgttgctattaatatgaaatcaccggtgcaaagtattatttgttatttagctttgcatcgtttacataaagtgcctatgatgatggaaggtaaatggcaaagtactatacatcgtcaattgattgaaaaatatggtattaaagatgtaattggagatacaggtctcatgcagaatatagactcaccgatgtttattgattcaacgcaattacagcactaccccaatttattacatattggttttacttcagggacaactggactgccaaaagcatattatcgtgatgaagattcatggttggcttcttttgaagttaatgaaatgttgatgttaaaaaatgaaaatgcaatagcagcccctggaccactatcgcactcgttaacattatatgcgttattgtttgctttaagttccggtcgtacttttataggacagaccacttttcatcctgaaaagttacttaatcaatgtcataaaatatcatcatacaaagttgctatgtttcttgttccaacgatgattaaatcattattgttagtttacaacaatgaacatacaatccaatcattttttagcagtggagataagctgcattcttctatttttaaaaagataaaaaatcaagcaaatgacataaatttgattgaattttttggtacatcggaaaccagttttatcagctataacttgaatcagcaagcaccagttgaatcagtaggtgtgctatttccaaatgtggaattgaaaacaacgaatcacgatcacaatggtataggaactatttgtataaaaagtaatatgatgtttagtggctatgtaagtgaacaatgtataaataatgatgaatggtttgttactaatgataatggctatgtaaaagagcagtatttatatttaacgggacgtcaacaggatatgttaattattggtggtcaaaatatatatccagcacatgttgaacgccttttaacgcaatcttcgagcattgatgaagcaattatcatcggtattccaaatgagcgttttggtcaaataggcgtattgctttattctggtgatgtgacacttacacataaaaatgtaaaacaatttttaaaaaagaaagtgaaacgctatgaaattccatcgatgattcatcatgtagaaaagatgtattacactgcaagtggtaaaattgctagagaaaaaatgatgtcgatgtatttgagaggtgaatta

SEQ ID NO: 3328 - protein, 459 aa, Staphylococcus aureus
  MISC_FEATURE (1)..(459): hypothetical protein
LMNVILEQLKTHTQNKPNDIALHIDDETITYSQLNARITSAVESLQKYSLNPVVAINMKSPVQSIICYLALHRLHKVPMMMEGKWQSTIHRQLIEKYGIKDVIGDTGLMQNIDSPMFIDSTQLQHYPNLLHIGFTSGTTGLPKAYYRDEDSWLASFEVNEMLMLKNENAIAAPGPLSHSLTLYALLFALSSGRTFIGQTTFHPEKLLNQCHKISSYKVAMFLVPTMIKSLLLVYNNEHTIQSFFSSGDKLHSSIFKKIKNQANDINLIEFFGTSETSFISYNLNQQAPVESVGVLFPNVELKTTNHDHNGIGTICIKSNMMFSGYVSEQCINNDEWFVTNDNGYVKEQYLYLTGRQQDMLIIGGQNIYPAHVERLLTQSSSIDEAIIIGIPNERFGQIGVLLYSGDVTLTHKNVKQFLKKKVKRYEIPSMIHHVEKMYYTASGKIAREKMMSMYLRGEL

SEQ ID NO: 3329 - DNA, 1410 bp, Staphylococcus aureus
gtgtatgaattcatggattttaataaagagaatattaacatggtggatgcaaagaaagctaaaaaaaccgttgttgcaaccggtatcggtaatgcaatggaatggttcgattttggtgtctatgcatatacaactgcgtacattggagcgaacttcttctctccagtagagaatgcagacattcgacaaatgttgactttcgcagcattagccattgcgtttttattaagaccaattggtggtgtcgtatttggtattattggtgacaaatatggacgtaaagttgtattaacatctacaattattttaatggcattttcaacattaaccattggattattgccaagctatgatcaaattggactttgggcaccaatactattattgcttgcaagagtactacaagggttttcaacaggtggagagtatgcgggggcaatgacatatgttgccgaatcatctccagataagcgtcgtaactcattaggtagtggactagaaattgggacattatcaggttacatagctgcttcaattatgattgctgtattaacattctttttaacagatgaacaaatggcatcatttggttggagaatcccattcttactcggtttattcctaggattattcggcttatatttacgtcgtaagctggaagaatcaccagttttcgaaaatgatgttgcaacacaaccagaaagagataacattaactttttacaaatcatcagattttattacaaagatatatttgtatgttttgtagctgttgtattcttcaatgttacaaactatatggtaactgcatatttaccaacctatttagaacaagttattaaattagatgcaacgacaacaagtgtattaattacttgtgtcatggcaataatgattccattagcattaatgtttggtaagttagcggataaaataggtgaaaagaaagtatttctaattggtactggtgggctaacattattcagtatcatcgcatttatgttattacattcacaatcatttgttgtaatagtaatcggtatatttatattaggatttttcttatcaacttacgaagcgacaatgccagggtcgttaccaacgatgttttacagtcatataagatatcgaactttatcagtaacatttaatatctctgtttcgatatttggtggtacgacgccattagttgcaacatggttagttacgaaaactggagatccattagcacctgcgtattatttaacagcaatcagtgttattggctttttagttattacattcttacatttaagtacagcaggaaaatctctaaaaggttcgtatccaaatgtagataacgagcaagatagagcttattatgcagaacatccaaaagaagcattatggtgggttaaagaacgtaagaat

SEQ ID NO: 3330 - protein, 470 aa, Staphylococcus aureus
  MISC_FEATURE (1)..(470): proline/betaine transporter
VYEFMDFNKENINMVDAKKAKKTVVATGIGNAMEWFDFGVYAYTTAYIGANFFSPVENADIRQMLTFAALAIAFLLRPIGGVVFGIIGDKYGRKVVLTSTIILMAFSTLTIGLLPSYDQIGLWAPILLLLARVLQGFSTGGEYAGAMTYVAESSPDKRRNSLGSGLEIGTLSGYIAASIMIAVLTFFLTDEQMASFGWRIPFLLGLFLGLFGLYLRRKLEESPVFENDVATQPERDNINFLQIIRFYYKDIFVCFVAVVFFNVTNYMVTAYLPTYLEQVIKLDATTTSVLITCVMAIMIPLALMFGKLADKIGEKKVFLIGTGGLTLFSIIAFMLLHSQSFVVIVIGIFILGFFLSTYEATMPGSLPTMFYSHIRYRTLSVTFNISVSIFGGTTPLVATWLVTKTGDPLAPAYYLTAISVIGFLVITFLHLSTAGKSLKGSYPNVDNEQDRAYYAEHPKEALWWVKERKN

SEQ ID NO: 3331 - DNA, 654 bp, Staphylococcus aureus
gtgttaatattgaagtttgacaattatatttttgattttgatggtacgttggcagacacgaaaaaatgtggtgaagtagcaacacaaagtgcatttaaagcatgtggcttaacggaaccatcatctaaagaaataacgcattatatgggaatacctattgaagaatcatttttaaaattagcagaccgaccattagatgaagcagcattagcaaagttaatcgatacatttagacatacatatcaatctattgaaaaggactatatttatgaatttgcgggtataactgaagccattacaagtttgtataaccaagggaaaaaacttttcgtggtgtctagtaagaagagtgatgtattagaaagaaatttatcggctattggattaaatcacttgattaccgaagctgttggatccgatcaagtaagtgcatataaaccaaatcctgaaggcatacacacaattgtgcaacgctacaatttaaatagccaacaaacggtgtatattggtgattcaacgtttgatgttgagatggcacaacgtgctggtatgcaatctgcagctgtcacttggggtgcacatgatgcaaggtcattacttcattcaaatccggattttattattaatgatccatcagaaattaataccgtatta

SEQ ID NO: 3332 - protein, 218 aa, Staphylococcus aureus
  MISC_FEATURE (1)..(218): hypothetical protein
VLILKFDNYIFDFDGTLADTKKCGEVATQSAFKACGLTEPSSKEITHYMGIPIEESFLKLADRPLDEAALAKLIDTFRHTYQSIEKDYIYEFAGITEAITSLYNQGKKLFVVSSKKSDVLERNLSAIGLNHLITEAVGSDQVSAYKPNPEGIHTIVQRYNLNSQQTVYIGDSTFDVEMAQRAGMQSAAVTWGAHDARSLLHSNPDFIINDPSEINTVL

SEQ ID NO: 3333 - DNA, 546 bp, Staphylococcus aureus
atggctaaatttagtgactatcaattaattctagatgaattaaagatgactttgtcacatgttgaagcggatgagttttcaacttttgcatccaaaatactacatgctgaacatatatttgtagctggcaaaggacgttcaggattcgtggcgaatagttttgcaatgcgcttaaatcagctcggcaaacaggcacatgttgttggagaatcaacgacacctgcgattaagtcgaatgatgtatttgtaattatctctggttcaggttccacggaacatttaagattattagcagacaaagcaaaatcagtaggtgctgacatcgtattaattactacaaataaagattctgcaataggcaatctagctgggacgaacatcgttttgcctgcaggtacaaaatatgatgaacaaggctcggcacaaccattaggaagtttgtttgaacaagcatctcaattatttttagatagtgttgtaatgggattgatgactgaaatgaatgttacggaacaaacgatgcaacaaaatcatgctaatttagaa

SEQ ID NO: 3334 - protein, 182 aa, Staphylococcus aureus
  MISC_FEATURE (1)..(182): conserved hypothetical
MAKFSDYQLILDELKMTLSHVEADEFSTFASKILHAEHIFVAGKGRSGFVANSFAMRLNQLGKQAHVVGESTTPAIKSNDVFVIISGSGSTEHLRLLADKAKSVGADIVLITTNKDSAIGNLAGTNIVLPAGTKYDEQGSAQPLGSLFEQASQLFLDSVVMGLMTEMNVTEQTMQQNHANLE

SEQ ID NO: 3335 - DNA, 630 bp, Staphylococcus aureus
gtggaattacaattagcaattgatttattaaacaaagaagacgcggctgagttagcaaataaagtaaaagattatgtagatatcgtagaaatcggtacgccaatcatttacaacgaaggtttaccagcagttaaacatatggcagacaacattagtaatgtaaaagtattagcagacatgaaaattatggatgcagctgattatgaagttagccaagcaattaaatttggcgcggatgtaattacaatactaggtgttgcagaagatgcatcaattaaagcagctattgaagaagctcataaaaataataaacaattactagttgatatgattgctgttcaagatttagaaaaacgtgcaaaagaactagatgaaatgggtgctgattatattgcagtacacactggttatgatttacaagcagaagggcaatcaccattagaaagtttaagaaccgttaaatctgttattaaaaattctaaagttgcagtagcaggtggaattaaaccagatacaattaaagatattgtcgctgaaagtcctgatcttgttattgttggtggcggaatcgcaaatgcagatgatccagtagaagctgcgaaacaatgtcgcgctgcaatcgaaggtaag

SEQ ID NO: 3336 - protein, 210 aa, Staphylococcus aureus
  MISC_FEATURE (1)..(210): hypothetical protein
VELQLAIDLLNKEDAAELANKVKDYVDIVEIGTPIIYNEGLPAVKHMADNISNVKVLADMKIMDAADYEVSQAIKFGADVITILGVAEDASIKAAIEEAHKNNKQLLVDMIAVQDLEKRAKELDEMGADYIAVHTGYDLQAEGQSPLESLRTVKSVIKNSKVAVAGGIKPDTIKDIVAESPDLVIVGGGIANADDPVEAAKQCRAAIEGK

SEQ ID NO: 3337 - DNA, 687 bp, Staphylococcus aureus
atgattgatcatacacacttaagattatttcagttctgtgattcacagtttccaacaggtgctttcagtcattcatttggtcttgaaacatatattcaacgaaatataattcatgacgatcatacttttattgcttggttaaaaatgtttttacaagagcaacttacctattctgatggtttagccatgcgtttagtttatgatgcattggaaaatgatgatacacaaaaagtattacacatagataaactgatgtttgttcaaaacttacctaaagaaacacgtgttggtgcaaaacaaatggggactcgcatggttaaattggctttagaactttataatagcccatggattgcttggtatcatcaacaaatgcaagataagaaagcaaagttaaatccagctatttgttttactatgctaggccatcatttaggtgtagatattgaaacgattattgattactatttatatcaaaatgtttcaagtttaactcaaaatgctgttcgtgctattccacttggacaaactgctggtcaaaagatagttactcacatgattccttatatagaaggaacaagaaagcagattttcgaattaaaagaagcagattttggcatgacagcgcctggtttagaactaaatcaaatggcgcatgagaacgtcaatgttagaattttcatatca

SEQ ID NO: 3338 - protein, 229 aa, Staphylococcus aureus
  MISC_FEATURE (1)..(229): urease accessory protein
MIDHTHLRLFQFCDSQFPTGAFSHSFGLETYIQRNIIHDDHTFIAWLKMFLQEQLTYSDGLAMRLVYDALENDDTQKVLHIDKLMFVQNLPKETRVGAKQMGTRMVKLALELYNSPWIAWYHQQMQDKKAKLNPAICFTMLGHHLGVDIETIIDYYLYQNVSSLTQNAVRAIPLGQTAGQKIVTHMIPYIEGTRKQIFELKEADFGMTAPGLELNQMAHENVNVRIFIS

SEQ ID NO: 3339 - DNA, 756 bp, Staphylococcus aureus
atgaaagtattaaacttaggatcgaaaaaacaagcatcattctatgttgcatgtgagttatataaagagatggcatttaatcagcactgtaaactaggtttagcaactggtggtacaatgacagatttgtatgaacaacttgttaagttgttaaataaaaatcagttaaacgtagacaatgtatccacgtttaatttagacgaatatgtaggtttaaccgcatcacatccgcaaagttatcactattatatggatgacatgcttttcaaacaatatccttattttaatagaaagaacattcatattccaaatggagatgccgatgatatgaatgcggaagcgtcaaaatataatgacgttttagaacaacaaggtcaacgtgatattcaaattttaggtattggtgaaaatggtcatattggatttaatgaacctggtacgccgtttgatagcgttactcatatcgttgatttgactgaaagtactattaaggctaatagtcgatattttaaaaacgaagatgatgttccaaagcaagccatttcgatgggacttgctaatattcttcaagccaaacgtatcattttactcgcatttggtgaaaagaaacgtgctgctattacacatttattaaatcaggaaatttctgttgatgttccagccacattacttcacaaacacccgaatgttgagatatatttagacgacgaagcttgcccgaaaaatgttgcgaaaattcatgtcgatgaaatggat

SEQ ID NO: 3340 - protein, 252 aa, Staphylococcus aureus
  MISC_FEATURE (1)..(252): probable
MKVLNLGSKKQASFYVACELYKEMAFNQHCKLGLATGGTMTDLYEQLVKLLNKNQLNVDNVSTFNLDEYVGLTASHPQSYHYYMDDMLFKQYPYFNRKNIHIPNGDADDMNAEASKYNDVLEQQGQRDIQILGIGENGHIGFNEPGTPFDSVTHIVDLTESTIKANSRYFKNEDDVPKQAISMGLANILQAKRIILLAFGEKKRAAITHLLNQEISVDVPATLLHKHPNVEIYLDDEACPKNVAKIHVDEMD

SEQ ID NO: 3341 - DNA, 366 bp, Staphylococcus aureus
gtgaacgtgttggaaccaattaaagaacaagaagttatagatttacttgcttcttttgaacataaacctgtgtatctgcatgttgaaacgacaaatggggcctatgcgaaccatttcgatcaacgtgtttttaatgctggtacttttttaagaaacatacaaataacatatacgcatgcacaactaaaaggtggtaataaagaaccttatcgcattggtcttaaactatcaaatggtggttgggtttatgtacaaggtctaacgcattttgaggtcaatgagcatgatgaatttttaattgcaggttttaattacgaaggtcaactcgctgcagcacttcaaattagtgagcgaccatttaattta

SEQ ID NO: 3342 - protein, 122 aa, Staphylococcus aureus
  MISC_FEATURE (1)..(122): conserved hypothetical
VNVLEPIKEQEVIDLLASFEHKPVYLHVETTNGAYANHFDQRVFNAGTFLRNIQITYTHAQLKGGNKEPYRIGLKLSNGGWVYVQGLTHFEVNEHDEFLIAGFNYEGQLAAALQISERPFNL

SEQ ID NO: 3343 - DNA, 699 bp, Staphylococcus aureus
gtgagcgaccatttaatttatagaggaggcatcaacatgactgacgaaagacatgtattagtaatatttccacatcctgatgatgaaaccttctcatctgcaggcacattagcaaattatatccaaaaaggcatacctgtaacatatgcatgtttaaccctaggacaaatgggcagaaatttaggtaatcccccatttgcaacacgcgaatcattaccaagtattcgtgagcgtgaactagaagaagcttgtaaagttatcggtattactgatttaagaaaaatgggtttacgtgacaaaactgtcgaatttgaaccctatgaacatatagatggtatgattaaatctttaatcgatgatacaaatccatcattgattatttcattttatcctggatatgcagtacatcctgatcacgaagcaacagcagacgctgtaattcgaacggttgaacgcatgcctaaagaagaacgccctcgtttaactttagttgcgttcagtaatgatgcaaccgaagctcttggagaacctgatattcaaaatgatattacagattttaaagaacttaaaattaaggcatttgaagcacatgcttctcaaacaggtccatttttaaaacaattagcaagtcctgaaatcgatggtaaacaacacagctttttaacagtcgaaccatattggacatatcactttaaatct

SEQ ID NO: 3344 - protein, 233 aa, Staphylococcus aureus
  MISC_FEATURE (1)..(233): conserved hypothetical
VSDHLIYRGGINMTDERHVLVIFPHPDDETFSSAGTLANYIQKGIPVTYACLTLGQMGRNLGNPPFATRESLPSIRERELEEACKVIGITDLRKMGLRDKTVEFEPYEHIDGMIKSLIDDTNPSLIISFYPGYAVHPDHEATADAVIRTVERMPKEERPRLTLVAFSNDATEALGEPDIQNDITDFKELKIKAFEAHASQTGPFLKQLASPEIDGKQHSFLTVEPYWTYHFKS

SEQ ID NO: 3345 - DNA, 876 bp, Staphylococcus aureus
atgactgaatttgatttatcgacacgagaaggtcgttggaaacactttggttccgtagatcctattgaaggcacgaaacctactactaagaacgaaatgacagatttacaaagtacacataaagattttttatttgaaatagaagaagttggtattaaaaacttagtgtaccctgtacttgttgaccagtatcaaacagctggcacatttagtttttcaacaagtttaacaaaagacgaaaaaggtattaatatgagccgtataatcgaaagtgttgaaaagcactatgataatggtattgaacttgaatttaatacactttatcaggtgttacgcactttacaaacgaatatgaaacaaaatgcggcaggcgttgatgtttctgggaaatggttctttgatcgctatagtccaaccacaaatattaaagcagttggtaatgccgatgtcacttatggattagcaattgacggtgataaagttacacgtaaagaacttactattgaagcaactgtcacaacgctatgcccttgttcaaaagaaataagtgagtattcagcgcacaaccaacgtggtgttgtcactgttaaaacatatattaataaagatcaagacatagttgatgactataaaaataaaattttagatgcaatggaagctaatgcaagttcaattctataccctattttaaaacgtcctgatgaaaaacgtgtgacagagcgtgcatatgaaaatccacgttttgtcgaagacttaattcgtttaattgccgcggacttagttgaatttgattggttagacggtttcgatatcgaatgtcgtaatgaagagtctatccatcaacatgatgctttcgctaaattaaagtatcgcaaa

SEQ ID NO: 3346 - protein, 292 aa, Staphylococcus aureus
  MISC_FEATURE (1)..(292): conserved hypothetical
MTEFDLSTREGRWKHFGSVDPIEGTKPTTKNEMTDLQSTHKDFLFEIEEVGIKNLVYPVLVDQYQTAGTFSFSTSLTKDEKGINMSRIIESVEKHYDNGIELEFNTLYQVLRTLQTNMKQNAAGVDVSGKWFFDRYSPTTNIKAVGNADVTYGLAIDGDKVTRKELTIEATVTTLCPCSKEISEYSAHNQRGVVTVKTYINKDQDIVDDYKNKILDAMEANASSILYPILKRPDEKRVTERAYENPRFVEDLIRLIAADLVEFDWLDGFDIECRNEESIHQHDAFAKLKYRK

SEQ ID NO: 3347 - DNA, 1488 bp, Staphylococcus aureus
atgaattattttgtaggtaatagtttaggtgttaatttaactgggatagagaaagcaattattaatcgtttaaatttatttaaagaaatgggaagaccagcgcaatgtgtatttctgtcatggaatagatatttatatagaaatgcccaaaattatattactagttctgactatattaatatgtatgatttcttccaagaagcaacatatttagaacgcaatgaaccatttgactggttgtcgtattggactgatgaatgtcattatactttaaaacatgttgaaaatagtcatgactttagaatatatgatcaagagcgtttcttaatgtatgcccattttcaagatcctaaatatcgtatattagattatgtaaatcattttgatagtcaaagacgaaaagtaaaacgtgatttttatgatgtgcgtggctttttaagttgtagtaggattcttgttgataaacaacaaacattatgtgaatttttctataatccagaaggtgacacaaaattagaaaagtatttttcttacaaggatggcaaaccagaagtacaaaaaattattgtttactatgctaacaaacaatatttctttaataatgaaacggaattaggcgcatttttcattaaacaactatatcaacatggggatttatttttcagtgatcgtaatgtgtacacagcacctattttcaacttaacgcctgagtcaatcccagtagtagctgtgcttcacagtacacacattaaaaatattgatgcattagattcatcgccatttaaaaatgtatataaagcgatgtttgaaaatttatctcgatatcgtgcaattatcgtttctactgagcagcaaaaattagatgttgaaaaacgtattaaccatactattccagttgttaatattcctgtcggctatagtgaaacaattgatacaccagtccaaacattagatcagcgcagtgttaaattaatttccgttgctcgttattcacctgaaaaacaattacatcaacaaattgaattaattaaacgcttagtatcgtatgtcccaaaaatagagcttcatatgtatggttttggttctgaaagtaaaaaattaaatgaattgatacaaaaatatggattggaaaatcatgtttacttacgcggctttttaagcaatctagaccaagaatatagcgatgcctatttgagtttaataacaagtaacatggaaggtttctctttagcgctacttgaatctttagcacatggtgttccagttattagttatgatattaaatatggacctaacgaactgattacttcagatttcaatggttatttaattactaaaaatgatgaagatgccctatttgataaagtaaaatatgtgattgatcatcctgaagtacagcaacgactgtcaaaaggtagtttggcaaaagcacaacaatatagtaaagcgtcgttaattaaacaatgggaccaatttgttcgtcttata

SEQ ID NO: 3348 - protein, 496 aa, Staphylococcus aureus
  MISC_FEATURE (1)..(496): hypothetical protein
MNYFVGNSLGVNLTGIEKAIINRLNLFKEMGRPAQCVFLSWNRYLYRNAQNYITSSDYINMYDFFQEATYLERNEPFDWLSYWTDECHYTLKHVENSHDFRIYDQERFLMYAHFQDPKYRILDYVNHFDSQRRKVKRDFYDVRGFLSCSRILVDKQQTLCEFFYNPEGDTKLEKYFSYKDGKPEVQKIIVYYANKQYFFNNETELGAFFIKQLYQHGDLFFSDRNVYTAPIFNLTPESIPVVAVLHSTHIKNIDALDSSPFKNVYKAMFENLSRYRAIIVSTEQQKLDVEKRINHTIPVVNIPVGYSETIDTPVQTLDQRSVKLISVARYSPEKQLHQQIELIKRLVSYVPKIELHMYGFGSESKKLNELIQKYGLENHVYLRGFLSNLDQEYSDAYLSLITSNMEGFSLALLESLAHGVPVISYDIKYGPNELITSDFNGYLITKNDEDALFDKVKYVIDHPEVQQRLSKGSLAKAQQYSKASLIKQWDQFVRLI

SEQ ID NO: 3349 - DNA, 1470 bp, Staphylococcus aureus
atgaattacattttaggaacaattttagaaagtaaaattacaggtgtagaaaaagcgcaaataaatagattgaagttgttcaaacaacacggcatatcttcaaaatgtgtatatgttaaatggaatccttattcatacacatatgcgaagcaacatcagattgaaaatgatgtatttacaatgtatgactattttcaaaaagcaatcaattataaaaagacaaagcaagttaactggatacagtattgggaaaagtcatgtaggtacacattgaaatttgtggaaaattcaaatgatgtcagaatatatgatgaagagcaatttgtaatgtatgctcattttttagataaacagtatcatcaattaaattatgtgaattattttgatcataaaagaagaaaagtaaaacgcgaattgtatgatggaagaggctttttaagttgttctcgaattttaggtgaaggacaacggattgtactcgaaaattactatacacctaatggggaaatcgtcatccaaaaatattttgacgatataaaagggaaaaacacgctcacaaaggttatcttaaatgaagaccagcatcaacaattttttgatacagaagatgaattagttcaatattttctccatcaattatgtaaaaataatgatcaaatcatattagatcgtcctcatgaattaggaaatgttatagcgggattaaatcaaagtattccagttattgttgtgctccatagtacacatttatccggtgccggtaatggtataaaaagtttttataaaacagtgtttaataatttaacacgttataaagcgattgttgtatcaacagaaaagcaatgccaagatatttcacaatatattgaaaataaaataccagttatcaatattccggttggctacgtggcaaatttaaagtatcaatttgacatcaatcaaaaggagaaaaatcatatcatatcaattgctcgcctcgttgaaaataaacaaattaaacatcaaattgaagtaatcaagcaattagtaacaaaacatcccaatattcaattgaatatttatggacatggaaatggtttgtcagaatatcgacaacttgtagaagattatcatttatcggaacatgttaaatttcatggttttaagacgcatattaatgaagagattgctaaagcagaactgatgttatcgacaagtaaaatggaaggttttggcttagcaattttagagtcgctttcagtaggtacaccagtgatcagttatgatgtagattatggtccatcagaactgattcaagatggatttaatggctatttagtacctcaaggtgacatcaatcaaatggttgaaaaggtcgaccaattactaaataatactcaaaaattgcaacagttttcaattaatagcatagaatctgcacaacagtacaatgcaactactatcagtacaaagtggcaaaatattttaaac

SEQ ID NO: 3350 - protein, 490 aa, Staphylococcus aureus
  MISC_FEATURE (1)..(490): hypothetical protein
MNYILGTILESKITGVEKAQINRLKLFKQHGISSKCVYVKWNPYSYTYAKQHQIENDVFTMYDYFQKAINYKKTKQVNWIQYWEKSCRYTLKFVENSNDVRIYDEEQFVMYAHFLDKQYHQLNYVNYFDHKRRKVKRELYDGRGFLSCSRILGEGQRIVLENYYTPNGEIVIQKYFDDIKGKNTLTKVILNEDQHQQFFDTEDELVQYFLHQLCKNNDQIILDRPHELGNVIAGLNQSIPVIVVLHSTHLSGAGNGIKSFYKTVFNNLTRYKAIVVSTEKQCQDISQYIENKIPVINIPVGYVANLKYQFDINQKEKNHIISIARLVENKQIKHQIEVIKQLVTKHPNIQLNIYGHGNGLSEYRQLVEDYHLSEHVKFHGFKTHINEEIAKAELMLSTSKMEGFGLAILESLSVGTPVISYDVDYGPSELIQDGFNGYLVPQGDINQMVEKVDQLLNNTQKLQQFSINSIESAQQYNATTISTKWQNILN

SEQ ID NO: 3351 - DNA, 4047 bp, Staphylococcus aureus
atgctaaacagagaaaataaaacggcaataacaaggaaaggcatggtatccaatcgattaaataaattttcgattagaaagtacacagtgggaacagcatcaattttagtaggtacaacattaatttttggtctggggaaccaagaagcaaaggctgcagaaagtactaataaagaattgaacgaagcgacaacttcagcaagtgataatcaatcgagtgataaagttgatatgcagcaactaaatcaagaagacaatactaaaaatgataatcaaaaagaaatggtatcatctcaaggtaatgaaacgacttcaaatgggaataaattaatagaaaaagaaagtgtacaatctaccactggaaataaagttgaagtttcaactgccaaatcagatgagcaagcttcaccaaaatctacgaatgaagatttaaacactaaacaaactataagtaatcaagaagcgttacaacctgatttgcaagagaataaatcagtggtaaatgttcaaccaactaatgaggaaaacaaaaaggtagatgccaaaactgaatcaactacattaaatgttaaaagtgatgctatcaagagtaatgatgaaactcttgttgataacaatagtaattcaaataatgaaaataatgcagatatcattttgccaaaaagtacagcacctaaacgtttgaatacaagaatgcgtatagcagcagtacagccatcatcaacagaggctaaaaatgttaatgatttaatcacatcaaatacaacattaactgtcgttgatgcagataaaaacaataaaatcgtaccagcccaagattatttatcattaaaatcacaaattacagttgatgacaaagttaaatcaggtgattatttcacaattaaatactcagatacagtacaagtatatggattgaatccggaagatattaaaaatattggtgatattaaagatccaaataatggtgaaacaattgcgactgcaaaacatgatactgcaaataatttaattacatatacatttacagattatgttgatcgatttaattctgtacaaatgggaattaattattcaatttatatggatgctgatacaattcctgttagtaaaaacgatgttgagtttaatgttacgataggtaatactacaacaaaaacaactgctaacattcaatatccagattatgttgtaaatgagaaaaattcaattggatcagcgttcactgaaacagtttcacatgttggaaataaagaaaatccagggtactataaacaaacgatttatgtaaatccatcggaaaattctttaacaaatgccaaactaaaagttcaagcttaccactcaagttatcctaataatatcgggcaaataaataaagatgtaacagatataaaaatatatcaagttcctaaaggttatacattaaataaaggatacgatgtgaatactaaagagcttacagatgtaacaaatcaatacttgcagaaaattacatatggcgacaacaatagcgctgttattgattttggaaatgcagattctgcttatgttgtaatggttaatacaaaattccaatatacaaatagcgaaagcccaacacttgttcaaatggctactttatcttcaacaggtaataaatccgtttctactggcaatgctttaggatttactaataaccaaagtggcggagctggtcaagaagtatataaaattggtaactacgtatgggaagatactaataaaaacggtgttcaagaattaggagaaaaaggcgttggcaatgtaactgtaactgtatttgataataatacaaatacaaaagtaggagaagcagttactaaagaagatgggtcatacttgattccaaacttacctaatggagattaccgtgtagaattttcaaacttaccaaaaggttatgaagtaaccccttcaaaacaaggtaataacgaagaattagattcaaacggcttatcttcagttattacagttaatggcaaagataacttatctgcagacttaggtatttacaaacctaaatacaacttaggtgactatgtctgggaagatacaaataaaaatggtatccaagaccaagatgaaaaaggtatatctggcgtaacggtaacattaaaagatgaaaacggtaacgtgttaaaaacagttacaacagacgctgatggcaaatataaatttactgatttagataatggtaattataaagttgaatttactacaccagaaggctatacaccgactacagtaacatctggtagcgacattgaaaaagactctaatggtttaacaacaacaggtgttattaatggtgctgataacatgacattagatagtggattctacaaaacaccaaaatataatttaggtaattatgtatgggaagatacaaataaagatggtaagcaggattcaactgaaaaaggtatttcaggcgtaacagttacattgaaaaatgaaaacggtgaagttttacaaacaactaaaacagataaagatggtaaatatcaatttactggattagaaaatggaacttataaagttgaattcgaaacaccatcaggttacacaccaacacaagtaggttcaggaactgatgaaggtatagattcaaatggtacatcaacaacaggtgtcattaaagataaagataacgatactattgactctggtttctacaaaccgacttacaacttaggtgactatgtatgggaagatacaaataaaaacggtgttcaagataaagatgaaaagggcatttcaggtgtaacagttacgttaaaagatgaaaacgacaaagttttaaaaacagttacaacagatgaaaatggtaaatatcaattcactgatttaaacaatggaacttataaagttgaattcgagacaccatcaggttatacaccaacttcagtaacttctggaaatgatactgaaaaagattctaatggtttaacaacaacaggtgtcattaaagatgcagataacatgacattagacagtggtttctataaaacaccaaaatatagtttaggtgattatgtttggtacgacagtaataaagacggcaaacaagattcaactgaaaaaggtatcaaagatgttaaagttactttattaaatgaaaaaggcgaagtaattggaacaactaaaacagatgaaaatggtaaatactgctttgataatttagatagcggtaaatacaaagttatttttgaaaagcctgctggcttaacacaaacagttacaaatacaactgaagatgataaagatgcagatggtggcgaagttgacgtaacaattacggatcatgatgatttcacacttgataacggatacttcgaagaagatacatcagacagcgattcagactcagatagtgactcagacagcgactcagactcagacagcgactcagactcagacagtgattcagattcagacagcgactcagattcagatagcgactcagattcggacagcgattcagactcagatagcgactcagattcagatagcgattcagactcagacagcgactcagattcagatagcgattcggactcagacagcgattcagactcagatagcgactcagactcagacagcgactcagattcagatagcgattcggactcagatagcgactcagattcagacagcgattcagactcagatagcgactcagattcagacagcgattcagactcagatagcgactcagactcagacagtgattcagattcagacagcgactcagactcagatagcgactcagattcggacagcgactcagactctgatagcgactcagactcagacagtgattcagacagcgattcagactcggatgcaggaaaacatacacctgttaaaccaatgagtactactaaagaccatcacaataaagcaaaagcattaccagaaacaggtagtgaaaataacggctcaaataacgcaacgttatttggtggattatttgcagcattaggttcattattgttattcggtcgtcgcaaaaaacaaaacaaa

SEQ ID NO: 3352 - protein, 1349 aa, Staphylococcus aureus
  MISC_FEATURE (1)..(1349): Ser-Asp rich
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 3353 - DNA, 2985 bp, Staphylococcus aureus
atgaataataaaaagacagcaacaaatagaaaaggcatgataccaaatcgattaaacaaattttcgataagaaagtattctgtaggtactgcttcaattttagtagggacaacattgatttttgggttaagtggtcatgaagctaaagcggcagaacatacgaatggagaattaaatcaatcaaaaaatgaaacgacagccccaagtgagaataaaacaactaaaaaagttgatagtcgtcaactaaaagacaatacgcaaactgcaactgcagatcagcctaaagtgacaatgagtgatagtgcaacagttaaagaaactagtagtaacatgcaatcaccacaaaacgctacagctaatcaatctactacaaaaactagcaatgtaacaacaaatgataaatcatcaactacatatagtaatgaaactgataaaagtaatttaacacaagcaaaagatgtttcaactacacctaaaacaacgactattaaaccaagaactttaaatcgcatggcagtgaatactgttgcagctccacaacaaggaacaaatgttaatgataaagtacatttttcaaatattgacattgcgattgataaaggacatgttaatcagactactggtaaaactgaattttgggcaacttcaagtgatgttttaaaattaaaagcaaattacacaatcgatgattctgttaaagagggcgatacatttacttttaaatatggtcaatatttccgtccaggatcagtaagattaccttcacaaactcaaaatttatataatgcccaaggtaatattattgcaaaaggtatttatgatagtacaacaaacacaacaacatatacttttacgaactatgtagatcaatatacaaatgttagaggtagctttgaacaagttgcatttgcgaaacgtaaaaatgcaacaactgataaaacagcttataaaatggaagtaactttaggtaatgatacatatagcgaagaaatcattgtcgattatggtaataaaaaagcacaaccgcttatttcaagtacaaactatattaacaatgaagatttatcgcgtaatatgactgcatatgtaaatcaacctaaaaatacatatactaaacaaacgtttgttactaatttaactggatataaatttaatccaaatgcaaaaaacttcaaaatttacgaagtgacagatcaaaatcaatttgtggatagtttcacccctgatacttcaaaacttaaagatgttactgatcaattcgatgttatttatagtaatgataataaaacagctacagtcgatttaatgaaaggccaaacaagcagcaataaacaatacatcattcaacaagttgcttatccagataatagttcaacagataatggaaaaattgattatactttagacactgacaaaactaaatatagttggtcaaatagttattcaaatgtgaatggctcatcaactgctaatggcgaccaaaagaaatataatctaggtgactatgtatgggaagatacaaataaagatggtaaacaagatgccaatgaaaaagggattaaaggtgtttatgtcattcttaaagatagtaacggtaaagaattagatcgtacgacaacagatgaaaatggtaaatatcagttcactggtttaagcaatggaacttatagtgtagagttttcaacaccagccggttatacaccgacaactgcaaatgtaggtacagatgatgctgtagattctgatggactaactacaacaggtgtcattaaagacgctgacaacatgacattagatagtggattctacaaaacaccaaaatatagtttaggtgattatgtttggtacgacagtaataaagatggtaaacaagattcgactgaaaaaggaattaaaggtgttaaagttactttgcaaaacgaaaaaggcgaagtaattggtacaactgaaacagatgaaaatggtaaataccgctttgataatttagatagtggtaaatacaaagttatctttgaaaaacctgctggcttaactcaaacaggtacaaatacaactgaagatgataaagatgccgatggtggcgaagttgatgtaacaattacggatcatgatgatttcacacttgataatggctactacgaagaagaaacatcagatagcgactcagattctgacagcgattcagactcagatagcgactcagattcagatagcgactcagattcagacagcgattcagacagcgactcagactcagatagcgattcagattcagacagcgactcagactcagacagcgattcagactcggatagcgactcagactcagatagcgactcagattcggatagcgactcagactcagatagcgattcagattcagatagcgattcggactcagacagtgattcagattcagactcagatagcgactcagattctgacagcgattcagactcagacagcgactcagactcagacagtgattcagattcagacagcgactcagattcagatagcgactcagactcagatagcgactcagattcagatagcgattcggactcagacaacgactcagattcagatagcgattcagattcagatagcgactcagattcggacagcgattcagactcagatagcgattcagactcagacagcgattcagattcagatagcgactcagactcagatagcgactcagactcggatagcgattcagattcagacagcgactcagattcagatagcgattcggactcagacaacgactcagattcagatagcgattcagattcagatgcaggtaaacatactccggctaaaccaatgagtacggttaaagatcagcataaaacagctaaagcattaccagaaacaggtagtgaaaataataattcaaataatggcacattattcggtggattattcgcggcattaggatcattattgttattcggtcgtcgtaaaaaacaaaataaa

SEQ ID NO: 3354 - protein, 995 aa, Staphylococcus aureus
  MISC_FEATURE (1)..(995): Ser-Asp rich
MNNKKTATNRKGMIPNRLNKFSIRKYSVGTASILVGTTLIFGLSGHEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTLFGGLFAALGSLLLFGRRKKQNK

SEQ ID NO: 3355 - DNA, 564 bp, Staphylococcus aureus
atgaaaggattaattattattggcagtgcacaagtgaattcacatacaagtgcactagcaagatacttaactgagcattttaaaacacatgatattgaagcggaaatattcgatttagcagaaaaaccgttaaatcaattagatttttcaggaacaacaccgtctattgatgaaatcaaacaaaatatgaaagatttaaaagagaaagcaatggcggcggactttttaatattaggaacgccaaactatcatggttcatattctggaatattgaaaaatgcattagatcatctaaatatggattattttaaaatgaaacctgtaggcttaataggaaatagtggtggtattgttagttcagagccattgtcacatttaagagtaatcgtcagaagtttactaggcattgctgtaccaactcaaatagcaacacatgattctgattttgctaaaaatgaagatggttcatattacttaaatgatagtgaattccaattacgagcaagattatttgtcgatcaaattgtatcttttgtgaataatagtccatatgaacatttaaaa

SEQ ID NO: 3356 - protein, 188 aa, Staphylococcus aureus
  MISC_FEATURE (1)..(188): conserved hypothetical
MKGLIIIGSAQVNSHTSALARYLTEHFKTHDIEAEIFDLAEKPLNQLDFSGTTPSIDEIKQNMKDLKEKAMAADFLILGTPNYHGSYSGILKNALDHLNMDYFKMKPVGLIGNSGGIVSSEPLSHLRVIVRSLLGIAVPTQIATHDSDFAKNEDGSYYLNDSEFQLRARLFVDQIVSFVNNSPYEHLK

SEQ ID NO: 3357 - DNA, 612 bp, Staphylococcus aureus
gtggcaaatccgattaaaattggtattggtggtcctgtaggtgcaggtaaaacacaattaattgaaaaagttgtaaaacgtctttcaaaagaaatgagtatcggcgttattacaaatgatatatatacaaaagaagacgaaaagatattagtaaattcaggagttctacctgaaagtcgtatcattggtgttgaaactggtggatgtcctcatactgcgattcgtgaagatgcatctatgaactttgcagcaatagacgaattattagaacgtcatgacgatatagaactaattttcatagaatctggtggcgataacttagcagcaacatttagtccagaacttgttgacttttcaatatatattatcgatgttgctcaaggtgaaaagattccacgtaaaggtggtcaaggtatgattaagtcagatttctttgtaattaacaaaactgatttagctccctatgtaggtgcatcattagaacaaatggctgaagatactaaagtatttcgtggtaaacgtccatttacttttactaacttaaaaaccgacgaaggtttggatgaagttatcgattggattgaacgcgacactttactcaaaggattatca

SEQ ID NO: 3358 - protein, 204 aa, Staphylococcus aureus
  MISC_FEATURE (1)..(204): urease accessory protein
VANPIKIGIGGPVGAGKTQLIEKVVKRLSKEMSIGVITNDIYTKEDEKILVNSGVLPESRIIGVETGGCPHTAIREDASMNFAAIDELLERHDDIELIFIESGGDNLAATFSPELVDFSIYIIDVAQGEKIPRKGGQGMIKSDFFVINKTDLAPYVGASLEQMAEDTKVFRGKRPFTFTNLKTDEGLDEVIDWIERDTLLKGLS

SEQ ID NO: 3359 - DNA, 867 bp, Staphylococcus aureus
atgataaaactaatagccactgatatggatggcacgctacttaatgcagcacatgaaatttctcaacctaatattgatgcgattaaatacgctcaagaacaagggataacggttgttatcgcgacaggtcgagcattttatgaagcacaagcaccagttgctgacacagatttaacagtaccatatatttgtttgaatggtgctgaagtacgtgatgaaactttcaatgtaatgagcacttcacaccttaataaatcgttagtacacaaaattacaaatgttttaaaagatgcaggtatttattatcaagtatacacgagtcgtgcgatttatactgaagatccacaaagagatttagacatttacatagatattgctgagcgtgcaggtcaacatgcaaacgttgagcgtattaaaaatggtattcaaagacgcatagataatggtacgttgaaagttgttgataattatgatgctattgaaaacatacctggtgaattaattatgaaaatattagcatttgatggaaatttagaaaaaattgacaaagctagtaaaattttagctgaatctccgaatttagctatatcatcatcttcgagaggaaatatagaaataacgcattcagatgcacaaaaaggtattgcgctagaaacaattgccgaaagattagggattgaaatgaaagaagtcatgtcaataggtgacaatttaaatgacttatcaatgttagagaaagttggctatccagttgcgatggaaaatggtgcagaagaagttaaaaaaatagcgaaatatgtcacagatacgaatgaaaatagtggtgttggaaaagctattatgaaattattacgtgaacaacaagtt

SEQ ID NO: 3360 - protein, 289 aa, Staphylococcus aureus
  MISC_FEATURE (1)..(289): conserved hypothetical
MIKLIATDMDGTLLNAAHEISQPNIDAIKYAQEQGITVVIATGRAFYEAQAPVADTDLTVPYICLNGAEVRDETFNVMSTSHLNKSLVHKITNVLKDAGIYYQVYTSRAIYTEDPQRDLDIYIDIAERAGQHANVERIKNGIQRRIDNGTLKVVDNYDAIENIPGELIMKILAFDGNLEKIDKASKILAESPNLAISSSSRGNIEITHSDAQKGIALETIAERLGIEMKEVMSIGDNLNDLSMLEKVGYPVAMENGAEEVKKIAKYVTDTNENSGVGKAIMKLLREQQV

SEQ ID NO: 3361 - DNA, 468 bp, Staphylococcus aureus
atgacaaatgatatatattttatgacattagcgattgaagaagctaaaaaagcagctcaactaggcgaagtacctataggtgctatcatcactaaagatgatgaagttatcgctagagcacataatttaagagaaacactacaacaaccaacggcgcatgctgaacatattgcaattgaacgtgcagccaaagtgttaggtagttggcgtttagaaggttgcacattatatgtaaccttagaaccatgtgtcatgtgcgcaggaacaattgtaatgagtcgcattccaagagtcgtctatggcgcagatgatcctaaaggtggttgtagtggcagtttaatgaatttattgcaacaatctaattttaatcatcgtgcaattgttgataaaggtgtacttaaagaagcatgtagcacattattaacaacattttttaaaaacttaagagccaataagaaatccaccaat

SEQ ID NO: 3362 - protein, 156 aa, Staphylococcus aureus
  MISC_FEATURE (1)..(156): hypothetical protein
MTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 3363 - DNA, 615 bp, Staphylococcus aureus
atgaacaaaccttttatagcaattgaaggtcctattggcgtaggtaaatcttcacttgcacacaaattaagtcaaactttagatttttatgaagaaaaagaaatcatcacagaaaatccatttttatcagacttttatgaagatatctctaaatggagttttcaaactgaaatgttctttttatgcaatagatataagcaatttcaagatgtaacacaactaaatcaaggtgtagttagtgattatcatatacataaaaataagatatttgctaaaaatactttgagttctgttgaatttcagaaattcagtaaaatttatgatattttaactgaagatatgattatgccgaatatgattatctttttagatgcagaccttgatgtgttaaaatctagaattgctaaacgtaaccgtagttttgagcatcaaatagaagatgaatatctgttaaagttaaaaaaagattatcgtgagtattatgagtccttacaaagtaatggttcaaatgtagttttaatcgatacaacttctattgattttcttaaaaatgaacaagattacgaagatatattacatattatattacctatgataggagatattaccaatgaa

SEQ ID NO: 3364 - protein, 205 aa, Staphylococcus aureus
  MISC_FEATURE (1)..(205): hypothetical protein
MNKPFIAIEGPIGVGKSSLAHKLSQTLDFYEEKEIITENPFLSDFYEDISKWSFQTEMFFLCNRYKQFQDVTQLNQGVVSDYHIHKNKIFAKNTLSSVEFQKFSKIYDILTEDMIMPNMIIFLDADLDVLKSRIAKRNRSFEHQIEDEYLLKLKKDYREYYESLQSNGSNVVLIDTTSIDFLKNEQDYEDILHIILPMIGDITNE

SEQ ID NO: 3365 - DNA, 660 bp, Staphylococcus aureus
atgaataattacggtattccacaaaatgccattataaccattgcaggtacagttggtgttggaaaatcaacactaacgcaagcacttgcagataaattaaactttaaaacgtcttttgaaaatgtcgaacataatccatatttagataaattttacagcgattttgaacgatggagtttccatttgcaaatttacttcttagctgaacgttttaaagaacaaaagcgtatgtttgaatatggtggtggctttgtccaagatcgatcaatttatgaagatgttgatatttttgcaaaaatgcatgaagaagaaggcacaatgagtaaagaagatttcaaaacatattcagacttatttaatgccatggtcatgacaccttattttcctaaacctgatgtaatgatttatttagaatgtaactatgatgaggtcattgatcgtattattgaacgtggtcgcgaaatggaaattaatacagaccctgaatactggaaaaagctatttaaacgctatgacgattggattaatagctttaatgcatgtccagttgtacgtatcaatattaatgaatatgatatccataaggaccccgaatctttaaatcctatgataaacaaaattgctcgaattattcaaacatatcgacaagtagatacacga

SEQ ID NO: 3366 - protein, 220 aa, Staphylococcus aureus
  MISC_FEATURE (1)..(220): hypothetical protein
MNNYGIPQNAIITIAGTVGVGKSTLTQALADKLNFKTSFENVEHNPYLDKFYSDFERWSFHLQIYFLAERFKEQKRMFEYGGGFVQDRSIYEDVDIFAKMHEEEGTMSKEDFKTYSDLFNAMVMTPYFPKPDVMIYLECNYDEVIDRIIERGREMEINTDPEYWKKLFKRYDDWINSFNACPVVRININEYDIHKDPESLNPMINKIARIIQTYRQVDTR

SEQ ID NO: 3367 - DNA, 690 bp, Staphylococcus aureus
ttgatatcaatggaatggatattatttgataaagatggtacgttaattgaatttgatagaagttgggaaaaaataggggtacgatttgtacaatcattgcttgagactttcccagtacataataaagaagctgctttaagacaactcggtgtcattaaagaatctattgatccaaaatcagtgatgggttcaggatctttacaacaaattatccaggcatttaatgatgtgacgggacaagatacaaccgactggtccaagtcaacaagtcaaaagctggtagatgaacgtattcctgaaattaattgggtagaaggtgttaaagaagcacttatcgatttgaaagcaaaaggctatcaacttggtattgttacgagtgatactaaaaaaggtgtagaacaatttttagcacataccaatgctacctcgttgttcgatttgatcatttctaccgaagcggatgcctatgagaagccaaatcctaaagtattatcgcctttatttgagcaatataatgtagatcctcagaaagtagctatagtaggagacactgctaatgatatgaagacagcaagtaatgcaaatttaggtatggcaataggtgtattaacaggtattgcaacaaaagaagaattacatgaagctgatattattttaaatagtgcggcagatattttagaagctttaaat

SEQ ID NO: 3368 - protein, 230 aa, Staphylococcus aureus
  MISC_FEATURE (1)..(230): conserved hypothetical
LISMEWILFDKDGTLIEFDRSWEKIGVRFVQSLLETFPVHNKEAALRQLGVIKESIDPKSVMGSGSLQQIIQAFNDVTGQDTTDWSKSTSQKLVDERIPEINWVEGVKEALIDLKAKGYQLGIVTSDTKKGVEQFLAHTNATSLFDLIISTEADAYEKPNPKVLSPLFEQYNVDPQKVAIVGDTANDMKTASNANLGMAIGVLTGIATKEELHEADIILNSAADILEALN

SEQ ID NO: 3369 - DNA, 171 bp, Staphylococcus aureus
ttggagagtcgttgtaccaaaatattaataaaaattgaatataatcatgaaaacaatatgcaaaagttaatcatgactaaaatccctttcaatgaagcgaagcatggtaataaattaagtttacaatgtttattgttaagtattgaaggggatttcacttattattatatt

SEQ ID NO: 3370 - protein, 57 aa, Staphylococcus aureus
LESRCTKILIKIEYNHENNMQKLIMTKIPFNEAKHGNKLSLQCLLLSIEGDFTYYYI

SEQ ID NO: 3371 - DNA, 1074 bp, Staphylococcus aureus
atgtcacaagcagttaaagttgaacgacgagaaacattaaaacaaaaaccaaatacatctcaactaggttttggtaaatattttactgattatatgttgagttatgattatgatgcagataaaggatggcatgatttgaagatagtaccttatggtcctattgaaatttcacctgctgcacaaggtgttcattatggtcaatcggtattcgaaggattaaaagcatataaaagagatggggaagttgcacttttccgtcctgaagaaaattttaagcgtcttaataactcgttagcacgattagaaatgcctcaagtagacgaagcagaattgttagaggggctaaaacaattagttgatattgaaagagattggattcctgaaggggaaggtcaatcattatatattcgtccatttgtttttgcaacagaaggggcacttggcgttggtgcatcacatcagtataaattattaattattttatctccttcaggtgcatattatggtggtgaaactttaaaaccaactaaaatctatgtagaagatgaatatgtgcgtgctgttcgtggcggtgtaggctttgcaaaagttgcaggtaactatgcggcaagtttattagcacaaactaatgcaaataaattaggttatgaccaagtattatggcttgatggtgttgaacagaaatatatcgaagaagttggtagcatgaacattttcttcgttgaaaatggcaaagtaattacaccagagttgaatggcagtattttacctggtattacacgtaaatctattatcgaattagctaaaaacttaggatatgaagtcgaagagcgccgcgtttcaatcgatgaattattcgaatcatatgataaaggtgagttaacagaagtatttggtagtggtactgcagcagttatttcacctgtgggtacattgagatacgaagatcgtgaaatcgttattaataataatgagactggtgaaattactcaaaaattatacgacgtctatactggtattcaaaatggtactttagaagataaaaatggttggagagtcgttgtaccaaaatat

SEQ ID NO: 3372 - protein, 358 aa, Staphylococcus aureus
  MISC_FEATURE (1)..(358): branched-chain amino acid
MSQAVKVERRETLKQKPNTSQLGFGKYFTDYMLSYDYDADKGWHDLKIVPYGPIEISPAAQGVHYGQSVFEGLKAYKRDGEVALFRPEENFKRLNNSLARLEMPQVDEAELLEGLKQLVDIERDWIPEGEGQSLYIRPFVFATEGALGVGASHQYKLLIILSPSGAYYGGETLKPTKIYVEDEYVRAVRGGVGFAKVAGNYAASLLAQTNANKLGYDQVLWLDGVEQKYIEEVGSMNIFFVENGKVITPELNGSILPGITRKSIIELAKNLGYEVEERRVSIDELFESYDKGELTEVFGSGTAAVISPVGTLRYEDREIVINNNETGEITQKLYDVYTGIQNGTLEDKNGWRVVVPKY

SEQ ID NO: 3373 - DNA, 963 bp, Staphylococcus aureus
atgaaaaaaattatgattactggtgcattaggacaaattggtacagaattagttgttaagtgcagagaaatttatgggacagataatgttcttgctacagatattagggaacctgaagcagactcacctgtacaaaatggaccatttgaaatcttagacgtaacagatcgtgaccgtatgtttgagttagttagggactttgaagcggatagtctaatgcatatggcagcattattatcagcaactgctgagaaaaatccaattctagcttgggatttaaatatgggtggattaatgaatgcattagaagctgcaagaacttataatttgcactttttcacaccaagttcaattggtgcatttggagactcaactcctaaagttaatacgccacaagtaacgattcagcaacctacgacaatgtatggtgtaaataaagtagctggagaattattgtgtcaatactatttcaaacgttttggtgtagatacaagaagtgttagattcccaggtttaatctcgcatgttaaagagccaggtggcggtactacagactatgctgttgaaatatacttcaaagcagtaagagagggtcattatacaagcttcatagataaaggcacgtatatggatatgatgtatatggatgatgcaattgaagcaattattaaacttatggaagcagacgacgctaaattagaaactagaaatggttataatttgagcgcaatgagttttgatccagagatggtaaaagaagcaattcaagaatactatcccaattttacattagattacgatgttgatcctattagacaaggtatcgctaatagttggccggattctattgatacaagctgttcacgtggcgaatggggatttgatcctaaatatgatttagcgagcatgactaaattaatgttagaagctattgaacaaaaagatactgttaaaaataataac

SEQ ID NO: 3374 - protein, 321 aa, Staphylococcus aureus
  MISC_FEATURE (1)..(321): hypothetical protein
MKKIMITGALGQIGTELVVKCREIYGTDNVLATDIREPEADSPVQNGPFEILDVTDRDRMFELVRDFEADSLMHMAALLSATAEKNPILAWDLNMGGLMNALEAARTYNLHFFTPSSIGAFGDSTPKVNTPQVTIQQPTTMYGVNKVAGELLCQYYFKRFGVDTRSVRFPGLISHVKEPGGGTTDYAVEIYFKAVREGHYTSFIDKGTYMDMMYMDDAIEAIIKLMEADDAKLETRNGYNLSAMSFDPEMVKEAIQEYYPNFTLDYDVDPIRQGIANSWPDSIDTSCSRGEWGFDPKYDLASMTKLMLEAIEQKDTVKNNN

SEQ ID NO: 3375 - DNA, 1638 bp, Staphylococcus aureus
atgatgtcttatagcattggaattgattatggaactgcttcaggccgtgtgtttttaattaatacaactaacggtcaagtagtatcaaaatttgtgaaaccatatacacatggtgtcattgagagtgaattaaatggtttgaaaataccacatacatatgcacttcaaaatagtaatgattatttagaaattatggaagaaggaatatcatatatagtacgtgaatcaaaaatagatccagacaatatagtaggtattggtatagactttacttcatctactattatttttactgacgaaaaccttaacccggtacataacttaaaacaatttaaaaacaatccacatgcgtatgtgaaactttggaaacatcatggtgcatataaagaggcagagaaattatatcaaactgctattgaaaataataataagtggttaggccattatggatataatgttagtagtgaatggatgattcccaaaataatggaggtcatgaatcgagcaccagaaattatggaaaaaacggcttatattatggaagcgggcgattggattgtaaataaattaactaataaaaatgtacgctcgaattgtggattaggtttcaaagcattttgggaagaagaaacagggtttcattatgatttatttgataaaatagaccccaaattatcaaaagtaattcaagataaagtatctgcaccggttgttaatattggtgaagcagtagggaaactggatgataaaatggcacagaaattaggattatcaaaagaaactatggtaagtccttttattattgatgcccatgctagtttattaggtattgggtctgaaaaagataaagaaatgactatggtgatgggaacaagcacatgccatcttatgttaaatgaaaagcaacatcaagtgccaggtatatcaggttctgtaaaaggagcaattattccagaattatttgcttatgaagcggggcaatcagcagtaggtgatttgtttgagtatgtcgctaagcaagcaccaaagtcatatgtagatgaagcagaaaatagaaatatgactgtatttgaattaatgaatgaaaagataaaacatcaaatgccaggtgaaagtgggctcattgctcttgattggcataatggaaatcgaagtgtattaagtgatagcaatttaacaggttgtatctttggattaactttacaaactaagcatgaggatatttatagagcatatttagaagctacagcatttggtactaagatgattatgcaacagtatcaagattggcatatggaagtagaaaaggtatttgcatgtggcggtatacctaaaaagaatgctgttatgatggatatctatgcgaatgtactgaataaaaaactaattgttatggatagtgagtatgcaccagcaataggcgcagcaatattaggtgcagtcagtggtggcgcacataattcaattaatgacgcagttgatgctatgaaagagccaattttatacgaaattaatccagaagcggaaaaagtacaaaggtatgaaacattatttaaagcttataaggctttacatgatatccatggttataaaaaagctaatataatgaaagatatccagagtttaagagttgaggga

SEQ ID NO: 3376 - protein, 546 aa, Staphylococcus aureus
  MISC_FEATURE (1)..(546): probable L-ribulokinase
MMSYSIGIDYGTASGRVFLINTTNGQVVSKFVKPYTHGVIESELNGLKIPHTYALQNSNDYLEIMEEGISYIVRESKIDPDNIVGIGIDFTSSTIIFTDENLNPVHNLKQFKNNPHAYVKLWKHHGAYKEAEKLYQTAIENNNKWLGHYGYNVSSEWMIPKIMEVMNRAPEIMEKTAYIMEAGDWIVNKLTNKNVRSNCGLGFKAFWEEETGFHYDLFDKIDPKLSKVIQDKVSAPVVNIGEAVGKLDDKMAQKLGLSKETMVSPFIIDAHASLLGIGSEKDKEMTMVMGTSTCHLMLNEKQHQVPGISGSVKGAIIPELFAYEAGQSAVGDLFEYVAKQAPKSYVDEAENRNMTVFELMNEKIKHQMPGESGLIALDWHNGNRSVLSDSNLTGCIFGLTLQTKHEDIYRAYLEATAFGTKMIMQQYQDWHMEVEKVFACGGIPKKNAVMMDIYANVLNKKLIVMDSEYAPAIGAAILGAVSGGAHNSINDAVDAMKEPILYEINPEAEKVQRYETLFKAYKALHDIHGYKKANIMKDIQSLRVEG

SEQ ID NO: 3377 - DNA, 876 bp, Staphylococcus aureus
atgtcacaagatgtaaatgaattaagtaagcaaccaacgccagataaagcagaagataacgcatttttcccatcaccatattcccttagtcaatatacagcacctaaaacagattttgatggtgttgaacacaaaggtgcctataaagatggtaaatggaaagtattgatgattgctgctgaagagcgatatgtattattggaaaatggaaaaatgttctctacgggtaatcatcctgttgaaatgttattacctttacatcatttaatggaagcaggttttgacgttgatgttgcgacattatctggttatccagttaaattagaattatgggctatgccaactgaagacgaggcagttataagtacttataataaattgaaagaaaaattaaaacagccaaaaaaattagcagatgtgattaaaaatgaattaggacctgattcagactatttatctgtctttatcccaggcggacatgctgcagttgttggtatttctgaaagtgaggacgttcaacaaacattagattgggcattagacaatgaccgctttatagttacattatgtcatggaccagcagcactactttcagcagggcttaacagagaaaaatctccattagaaggatactctgtttgtgtcttccctgactcattagatgaaggtgcaaatattgaaataggttatttacctggacgcttgaaatggttagttgctgatttattaactaaacaaggattaaaagtagttaacgacgatatgacaggaagaacgttaaaagatcgtaaattattaacaggtgacagtcctttagcttcaaatgagttaggaaaattagcagttaatgaaatgttaaatgcaatacaaaataaa

SEQ ID NO: 3378 - protein, 292 aa, Staphylococcus aureus
  MISC_FEATURE (1)..(292): conserved hypothetical
MSQDVNELSKQPTPDKAEDNAFFPSPYSLSQYTAPKTDFDGVEHKGAYKDGKWKVLMIAAEERYVLLENGKMFSTGNHPVEMLLPLHHLMEAGFDVDVATLSGYPVKLELWAMPTEDEAVISTYNKLKEKLKQPKKLADVIKNELGPDSDYLSVFIPGGHAAVVGISESEDVQQTLDWALDNDRFIVTLCHGPAALLSAGLNREKSPLEGYSVCVFPDSLDEGANIEIGYLPGRLKWLVADLLTKQGLKVVNDDMTGRTLKDRKLLTGDSPLASNELGKLAVNEMLNAIQNK

SEQ ID NO: 3379 - DNA, 834 bp, Staphylococcus aureus
atggatgaacaacaatggactgggcaacttgatttaacagtgtttttcgatggcaatcgatcagtatcaagagatattttctttgaaaaagcacttaaagtgatacgtccagtttatctaaatcaatctaccattcctacattttatatagtaaatgtaggtggtggctatttagatggagatcgttaccgtatgaatgtgaatgtcgaagataacgctaaagtgacattgacatctcaaggtgcaacaaaaatatacaagacaccttccaatcatgttgagcagtatcaaacttttaatttgaaagataacgcatatttagaatatgtcgctgatccaatcatcgcatatgaaaatgctaaattttatcaacacaatacgttcaatctcaataattctagttcattattttatactgatattttaactcctggttattcaaaaactggcgaagccttcaagtatcaatatatgcatttaataaatgaaatttatattgaagatgagttagtcacatatgataatttattattgaatcctaataaacaatcgatcaatgaaataggttatatggaacattactctcattatggctctgcttacttcatacacgaagatgttaaccaaaaactaatcgattcagtttatgaaaccattagttcttatagcaatacattcgattgtcgtgttgctatttctcaattgcctacacatggttttgcagttagaatttttgcttatcgcacacaaattatagagaaaatacttggaaccatccaaagctatatcgcagaaaatatttatgatcgtaaacttgattttctaagaaaatat

SEQ ID NO: 3380 - protein, 278 aa, Staphylococcus aureus
  MISC_FEATURE (1)..(278): urease accessory protein
MDEQQWTGQLDLTVFFDGNRSVSRDIFFEKALKVIRPVYLNQSTIPTFYIVNVGGGYLDGDRYRMNVNVEDNAKVTLTSQGATKIYKTPSNHVEQYQTFNLKDNAYLEYVADPIIAYENAKFYQHNTFNLNNSSSLFYTDILTPGYSKTGEAFKYQYMHLINEIYIEDELVTYDNLLLNPNKQSINEIGYMEHYSHYGSAYFIHEDVNQKLIDSVYETISSYSNTFDCRVAISQLPTHGFAVRIFAYRTQIIEKILGTIQSYIAENIYDRKLDFLRKY

SEQ ID NO: 3381 - DNA, 1185 bp, Staphylococcus aureus
gtggttcaatcattacatgagtttttagaggaaaatataaattatctaaaagaaaatggtttgtataatgaaatagatacaattgaaggtgcaaacggaccagaaatcaaaatcaatgggaaatcatacattaacttatcttcaaataattatttaggactagcaacaaatgaagatttgaaatcagctgcaaaagcagctattgatacacatggtgtaggtgcaggcgctgttcgtacaatcaatggtacattagatttacacgacgaattagaagaaacactagcaaaatttaaaggaacagaagctgcaatagcttatcaatcaggatttaattgtaatatggctgctatttcagctgtcatgaataaaaatgatgctattttatcagatgagcttaatcatgcatcaattattgatggatgtcgcttatctaaagctaaaattattcgagttaaccattcagacatggatgatttacgtgcgaaagcaaaagaagcagttgaatcaggtcaatacaataaagtgatgtatatcactgatggcgtttttagtatggatggtgatgtggctaaattacctgaaattgtagaaattgcagaagaatttggtttattaacttatgttgacgacgctcatggttcaggtgttatgggtaaaggcgctggtacggttaaacattttggtttacaagataaaatcgatttccaaataggtacgctttctaaagcaattggtgtcgttggcggttatgtagcaggtacaaaagagttaatagattggttaaaagcacaatcacgaccattcttattctctacatcattagcacctggggataccaaagcaataactgaagcagttaaaaagttaatggattcaactgaattacatgataaattatggaacaatgcacaatatttaaaaaatggattgtcaaaattaggatatgatacaggtgagtcagaaactccaattacaccagtaattattggtgatgaaaaaacaactcaagaatttagtaagcgtttaaaagacgaaggtgtctatgtgaaatctatcgttttcccaacagtaccaagaggtacaggacgtgtaagaaatatgcctacagctgcacatacaaaagacatgttagatgaagcaattgcggcttatgaaaaagtaggaaaagaaatgaagttgatt

SEQ ID NO: 3382 - protein, 395 aa, Staphylococcus aureus
  MISC_FEATURE (1)..(395): hypothetical protein
VVQSLHEFLEENINYLKENGLYNEIDTIEGANGPEIKINGKSYINLSSNNYLGLATNEDLKSAAKAAIDTHGVGAGAVRTINGTLDLHDELEETLAKFKGTEAAIAYQSGFNCNMAAISAVMNKNDAILSDELNHASIIDGCRLSKAKIIRVNHSDMDDLRAKAKEAVESGQYNKVMYITDGVFSMDGDVAKLPEIVEIAEEFGLLTYVDDAHGSGVMGKGAGTVKHFGLQDKIDFQIGTLSKAIGVVGGYVAGTKELIDWLKAQSRPFLFSTSLAPGDTKAITEAVKKLMDSTELHDKLWNNAQYLKNGLSKLGYDTGESETPITPVIIGDEKTTQEFSKRLKDEGVYVKSIVFPTVPRGTGRVRNMPTAAHTKDMLDEAIAAYEKVGKEMKLI

SEQ ID NO: 3383 - DNA, 1182 bp, Staphylococcus aureus
gtgataagggtgttagattggttccaactagcaaataataaagaaaataaaacaattcaactcagacgttatttacaccaatatcctgagttatcttttgaagaatttcaaacacatgattatattgttaaccaattaagccagttatcttgtgatattgaaactcctatcggccgcaatggtatcaaagccacatttaaaggcttgggcacaggacctaccattgcattaagagctgactttgatgcgttacctgtcgaggaattaaacgatgtgccttataagtctaaaaatccaggatgtatgcatgcgtgtgggcatgatggtcatacagcaattttacttactgtagcagagattttagatgaacataaacatttattagaaggtaatgttgtattaatattccagtacggtgaagaaatcatgccaggtggttctcaagaaatgatagatgctggatgtctggaaaatgtagatagaatttacggtacacatttatggagtggttatcctactggaactattcattcacgtgcgggggcaatcatggcctctccagatgaatttagcgtcacatttaaaggtcgtggtggtcatggtgccaaacctcatgaaaccattgacccaatagtaatcatggcagagttcattttaagtgcacaaaaaataatttcacgtacgatcgatccagttaaacaagctgtactttcatttggaatgattcaagcaggcaccacagatagcgttattcctgatcaagcattttgtaaaggtacagttagaactttcgattcagatatacagaatcatgtaatggacaaaatggataagcttctacaaggtttagcaatagcaaatgatattaactatgatttgaattatattaaagggtatttgcctgtccataataacgagaaagcatatcaagttattaaagaagcaacaaatgacttacatgtacgctttaatgaatcagatttaatgatgattggagaagatttttcacattatttgaaagtacgaccaggtgcattctttctgactggttgtggtaatgaaagtaaaggtattacagcgccacaccataatcccaaatttgatattgatgaaaaatcattaaaatacgctgtagctgtatttttaaaaatcatagaattagagcaagtatttaaaacaaat

SEQ ID NO: 3384 - protein, 394 aa, Staphylococcus aureus
  MISC_FEATURE (1)..(394): hypothetical protein
VIRVLDWFQLANNKENKTIQLRRYLHQYPELSFEEFQTHDYIVNQLSQLSCDIETPIGRNGIKATFKGLGTGPTIALRADFDALPVEELNDVPYKSKNPGCMHACGHDGHTAILLTVAEILDEHKHLLEGNVVLIFQYGEEIMPGGSQEMIDAGCLENVDRIYGTHLWSGYPTGTIHSRAGAIMASPDEFSVTFKGRGGHGAKPHETIDPIVIMAEFILSAQKIISRTIDPVKQAVLSFGMIQAGTTDSVIPDQAFCKGTVRTFDSDIQNHVMDKMDKLLQGLAIANDINYDLNYIKGYLPVHNNEKAYQVIKEATNDLHVRFNESDLMMIGEDFSHYLKVRPGAFFLTGCGNESKGITAPHHNPKFDIDEKSLKYAVAVFLKIIELEQVFKTN

SEQ ID NO: 3385 - DNA, 1182 bp, Staphylococcus aureus
atggcaaaagaaaaattcgatcgttctaaagaacatgccaatatcggtactatcggtcacgttgaccatggtaaaacaacattaacagcagcaatcgctactgtattagcaaaaaatggtgactcagttgcacaatcatatgacatgattgacaacgctccagaagaaaaagaacgtggtatcacaatcaatacttctcacattgagtaccaaactgacaaacgtcactacgctcacgttgactgcccaggacacgctgactacgttaaaaacatgatcactggtgctgctcaaatggacggcggtatcttagtagtatctgctgctgacggtccaatgccacaaactcgtgaacacattcttttatcacgtaacgttggtgtaccagcattagtagtattcttaaacaaagttgacatggttgacgatgaagaattattagaattagtagaaatggaagttcgtgacttattaagcgaatatgacttcccaggtgacgatgtacctgtaatcgctggttcagcattaaaagctttagaaggcgatgctcaatacgaagaaaaaatcttagaattaatggaagctgtagatacttacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacatctaaaacaactgttacaggtgttgaaatgttccgtaaattattagactacgctgaagctggtgacaacattggtgcattattacgtggtgttgctcgtgaagacgtacaacgtggtcaagtattagctgctcctggttcaattacaccacatactgaattcaaagcagaagtatacgtattatcaaaagacgaaggtggacgtcacactccattcttctcaaactatcgtccacaattctatttccgtactactgacgtaactggtgttgttcacttaccagaaggtactgaaatggtaatgcctggtgataacgttgaaatgacagtagaattaatcgctccaatcgcgattgaagacggtactcgtttctcaatccgtgaaggtggacgtactgtaggatcaggcgttgttactgaaatcattaaa

SEQ ID NO: 3386 - protein, 394 aa, Staphylococcus aureus
  MISC_FEATURE (1)..(394): translational elongation
MAKEKFDRSKEHANIGTIGHVDHGKTTLTAAIATVLAKNGDSVAQSYDMIDNAPEEKERGITINTSHIEYQTDKRHYAHVDCPGHADYVKNMITGAAQMDGGILVVSAADGPMPQTREHILLSRNVGVPALVVFLNKVDMVDDEELLELVEMEVRDLLSEYDFPGDDVPVIAGSALKALEGDAQYEEKILELMEAVDTYIPTPERDSDKPFMMPVEDVFSITGRGTVATGRVERGQIKVGEEVEIIGLHDTSKTTVTGVEMFRKLLDYAEAGDNIGALLRGVAREDVQRGQVLAAPGSITPHTEFKAEVYVLSKDEGGRHTPFFSNYRPQFYFRTTDVTGVVHLPEGTEMVMPGDNVEMTVELIAPIAIEDGTRFSIREGGRTVGSGVVTEIIK

SEQ ID NO: 3387 - DNA, 2145 bp, Staphylococcus aureus
atgcttagggcatcgccatatctatcgtatttattcagtaatataaactggaaggagaaaaaatacatggctagagaattttcattagaaaaaactcgtaatatcggtatcatggctcacattgatgctggtaaaacgactacgactgaacgtattctttattacactggccgtatccacaaaattggtgaaacacacgaaggtgcttcacaaatggactggatggagcaagaacaagaccgtggtattactatcacatctgctgcaacaacagcagcttgggaaggtcaccgtgtaaacattatcgatacacctggacacgtagacttcactgtagaagttgaacgttcattacgtgtacttgacggagcagttacagtacttgatgcacaatcaggtgttgaacctcaaactgaaacagtttggcgtcaggctacaacttatggtgttccacgtatcgtatttgtaaacaaaatggacaaattaggtgctaacttcgaatactctgtaagtacattacatgatcgtttacaagctaacgctgctccaatccaattaccaattggtgcggaagacgaattcgaagcaatcattgacttagttgaaatgaaatgtttcaaatatacaaatgatttaggtactgaaattgaagaaattgaaattcctgaagaccacttagatagagctgaagaagctcgtgctagcttaatcgaagcagttgcagaaactagcgacgaattaatggaaaaatatcttggtgacgaagaaatttcagtttctgaattaaaagaagctatccgccaagctactactaacgtagaattctacccagtactttgtggtacagctttcaaaaacaaaggtgttcaattaatgcttgacgctgtaattgattacttaccttcaccactagacgttaaaccaattattggtcaccgtgctagcaaccctgaagaagaagtaatcgcgaaagcagacgattcagctgaattcgctgcattagcgttcaaagttatgactgacccttatgttggtaaattaacattcttccgtgtgtattcaggtacaatgacatctggttcatacgttaagaactctactaaaggtaaacgtgaacgtgtaggtcgtttattacaaatgcacgctaactcacgtcaagaaatcgatactgtatactctggagatatcgctgctgcggtaggtcttaaagatacaggtactggtgatactttatgtggtgagaaaaatgacattatcttggaatcaatggaattcccagagccagttattcacttatcagtagagccaaaatctaaagctgaccaagataaaatgactcaagctttagttaaattacaagaagaagacccaacattccatgcacacactgacgaagaaactggacaagttatcatcggtggtatgggtgagcttcacttagacatcttagtagaccgtatgaagaaagaattcaacgttgaatgtaacgtaggtgctccaatggtttcatatcgtgaaacattcaaatcatctgcacaagttcaaggtaaattctctcgtcaatctggtggtcgtggtcaatacggtgatgttcacattgaattcacaccaaacgaaacaggcgcaggtttcgaattcgaaaacgctatcgttggtggtgtagttcctcgtgaatacattccatcagtagaagctggtcttaaagatgctatggaaaatggtgttttagcaggttatcctttaattgatgttaaagctaaattatatgatggttcataccatgatgtcgattcatctgaaatggccttcaaaattgctgcatcattagcacttaaagaagctgctaaaaaatgtgatcctgtaatcttagaaccaatgatgaaagtaactattgaaatgcctgaagagtacatgggtgatatcatgggtgacgtaacatctcgtcgtggacgtgttgatggtatggaacctcgtggtaatgcacaagttgttaatgcttatgtaccactttcagaaatgttcggttatgcaacatcattacgttcaaacactcaaggtcgcggtacttacactatgtacttcgatcactatgctgaagttccaaaatcaatcgctgaagatattatcaagaaaaataaaggtgaa

SEQ ID NO: 3388 - protein, 715 aa, Staphylococcus aureus
  MISC_FEATURE (1)..(715): translational elongation
MLRASPYLSYLFSNINWKEKKYMAREFSLEKTRNIGIMAHIDAGKTTTTERILYYTGRIHKIGETHEGASQMDWMEQEQDRGITITSAATTAAWEGHRVNIIDTPGHVDFTVEVERSLRVLDGAVTVLDAQSGVEPQTETVWRQATTYGVPRIVFVNKMDKLGANFEYSVSTLHDRLQANAAPIQLPIGAEDEFEAIIDLVEMKCFKYTNDLGTEIEEIEIPEDHLDRAEEARASLIEAVAETSDELMEKYLGDEEISVSELKEAIRQATTNVEFYPVLCGTAFKNKGVQLMLDAVIDYLPSPLDVKPIIGHRASNPEEEVIAKADDSAEFAALAFKVMTDPYVGKLTFFRVYSGTMTSGSYVKNSTKGKRERVGRLLQMHANSRQEIDTVYSGDIAAAVGLKDTGTGDTLCGEKNDIILESMEFPEPVIHLSVEPKSKADQDKMTQALVKLQEEDPTFHAHTDEETGQVIIGGMGELHLDILVDRMKKEFNVECNVGAPMVSYRETFKSSAQVQGKFSRQSGGRGQYGDVHIEFTPNETGAGFEFENAIVGGVVPREYIPSVEAGLKDAMENGVLAGYPLIDVKAKLYDGSYHDVDSSEMAFKIAASLALKEAAKKCDPVILEPMMKVTIEMPEEYMGDIMGDVTSRRGRVDGMEPRGNAQVVNAYVPLSEMFGYATSLRSNTQGRGTYTMYFDHYAEVPKSIAEDIIKKNKGE

SEQ ID NO: 3389 - DNA, 468 bp, Staphylococcus aureus
atgcctcgtaaaggatcagtacctaaaagagacgtattaccagatccaattcataactctaagttagtaactaaattaattaacaaaattatgttagatggtaaacgtggaacagcacaaagaattctttattcagcattcgacctagttgaacaacgcagtggtcgtgatgcattagaagtattcgaagaagcaatcaacaacattatgccagtattagaagttaaagctcgtcgcgtaggtggttctaactatcaagtaccagtagaagttcgtccagagcgtcgtactactttaggtttacgttggttagttaactatgcacgtcttcgtggtgaaaaaacgatggaagatcgtttagctaacgaaattttagatgcagcaaataatacaggtggtgccgttaagaaacgtgaggacactcacaaaatggctgaagcaaacaaagcatttgctcactaccgttgg

SEQ ID NO: 3390 - protein, 156 aa, Staphylococcus aureus
  MISC_FEATURE (1)..(156): 30S ribosomal protein S7
MPRKGSVPKRDVLPDPIHNSKLVTKLINKIMLDGKRGTAQRILYSAFDLVEQRSGRDALEVFEEAINNIMPVLEVKARRVGGSNYQVPVEVRPERRTTLGLRWLVNYARLRGEKTMEDRLANEILDAANNTGGAVKKREDTHKMAEANKAFAHYRW

SEQ ID NO: 3391 - DNA, 447 bp, Staphylococcus aureus
gtgggattaaaaagtgaagagaggaggacatatcacatgccaactattaaccaattagtacgtaaaccaagacaaagcaaaatcaaaaaatcagattctccagctttaaataaaggtttcaacagtaaaaagaaaaaatttactgacttaaactcaccacaaaaacgtggtgtatgtactcgtgtaggtacaatgacacctaaaaaacctaactcagcgttacgtaaatatgcacgtgtgcgtttatcaaacaacatcgaaattaacgcatacatccctggtatcggacataacttacaagaacacagtgttgtacttgtacgtggtggacgtgtaaaagacttaccaggtgtgcgttaccatattgtacgtggagcacttgatacttcaggtgttgacggacgtagacaaggtcgttcattatacggaactaagaaacctaaaaac

SEQ ID NO: 3392 - protein, 149 aa, Staphylococcus aureus
  MISC_FEATURE (1)..(149): 30S ribosomal protein S12
VGLKSEERRTYHMPTINQLVRKPRQSKIKKSDSPALNKGFNSKKKKFTDLNSPQKRGVCTRVGTMTPKKPNSALRKYARVRLSNNIEINAYIPGIGHNLQEHSVVLVRGGRVKDLPGVRYHIVRGALDTSGVDGRRQGRSLYGTKKPKN

SEQ ID NO: 3393 - DNA, 309 bp, Staphylococcus aureus
ttgttcaatgttaatatattaaaggttgatgcaagcagaactttggaggataaattattgtctaaggaaaaagttgcacgctttaacaaacaacattttgtagttggtcttaaagaaacgcttaaagcgttaaagaaagatcaagttacatctttgattattgctgaagacgttgaagtatatttaatgactcgcgtgttaagccaaatcaatcagaaaaatatacctgtatcttttttcaaaagcaaacatgctttgggtaaacatgtaggtattaacgtcaatgcgacaatagtagcattgattaaa

SEQ ID NO: 3394 - protein, 103 aa, Staphylococcus aureus
  MISC_FEATURE (1)..(103): hypothetical protein
LFNVNILKVDASRTLEDKLLSKEKVARFNKQHFVVGLKETLKALKKDQVTSLIIAEDVEVYLMTRVLSQINQKNIPVSFFKSKHALGKHVGINVNATIVALIK

SEQ ID NO: 3395 - DNA, 3582 bp, Staphylococcus aureus
ttggcttcacctgaaaaaatccgttcttggtcttttggtgaagttaaaaaacctgaaacaatcaactaccgtacattaaaacctgaaaaagatggtctattctgtgaaagaattttcggacctacaaaagactgggaatgtagttgtggtaaatacaaacgtgttcgctacaaaggcatggtctgtgacagatgtggagttgaagtaactaaatctaaagtacgtcgtgaaagaatgggtcacattgaacttgctgctccagtttctcacatttggtatttcaaaggtataccaagtcgtatgggattattacttgacatgtcaccaagagcattagaagaagttatttactttgcttcttatgttgttgtagatccaggtccaactggtttagaaaagaaaactttattatctgaagctgaattcagagattattatgataaatacccaggtcaattcgttgcaaaaatgggtgcagaaggtattaaagatttacttgaagagattgatcttgacgaagaacttaaattgttacgcgatgagttggaatcagctactggtcaaagacttactcgtgcaattaaacgtttagaagttgttgaatcattccgtaattcaggtaacaaaccttcatggatgattttagatgtacttccaatcatcccaccagaaattcgtccaatggttcaattagatggtggacgatttgcaacaagtgacttaaacgacttataccgtcgtgtaattaatcgaaataatcgtttgaaacgtttattagatttaggtgcacctggtatcatcgttcaaaacgaaaaacgtatgttacaagaagccgttgacgctttaattgataatggtcgtcgtggtcgtccagttactggcccaggtaaccgtccattaaaatctttatctcatatgttaaaaggtaaacaaggtcgtttccgtcaaaacttacttggtaaacgtgttgactattcaggacgttcagttattgcagtaggtccaagcttgaaaatgtaccaatgtggtttaccaaaagaaatggcacttgaactatttaaaccattcgtaatgaaagaattagttcaacgtgaaattgcaactaacattaaaaatgcgaagagtaaaatcgaacgtatggatgatgaagtttgggacgtattggaagaagtaattagagaacatcctgtattacttaaccgtgcaccaacacttcatagacttggtattcaagcatttgaaccaactttagttgaaggtcgtgcgattcgtctacatccacttgtaacaacagcttataacgctgactttgacggtgaccaaatggcggttcacgttcctttatcaaaagaggcacaagctgaagcaagaatgttgatgttagcagcacaaaacatcttgaaccctaaagatggtaaacctgtagttacaccatcacaagatatggtacttggtaactattaccttactttagaaagaaaagatgcagtaaatacaggcgcaatctttaataatacaaatgaagtattaaaagcatatgcaaatggctttgtacatttacacactagaattggtgtacatgcaagttcgttcaataatccaacatttactgaagaacaaaacaaaaagattcttgctacgtcagtaggtaaaattatattcaatgaaatcattccagattcatttgcttatattaatgaacctacgcaagaaaacttagaaagaaagacaccaaacagatatttcatcgatcctacaactttaggtgaaggtggattaaaagaatactttgaaaatgaagaattaattgaacctttcaacaaaaaattcttaggtaatattattgcagaagtattcaacagatttagcatcactgatacatcaatgatgttagaccgtatgaaagacttaggattcaaattctcatctaaagctggtattacagtaggtgttgctgatatcgtagtattacctgataagcaacaaatacttgatgagcatgaaaaattagtcgacagaattacaaaacaattcaaccgtggtttaatcactgaagaagaaagatataatgcagttgttgaaatttggacagatgcaaaagatcaaattcaaggtgaattgatgcaatcacttgataaaactaacccaatcttcatgatgagtgattcaggtgcccgtggtaacgcatctaactttacacagttagcaggtatgcgtggattgatggccgcaccatctggtaagattatcgaattaccaatcacatcttcattccgtgaaggtttaacagtacttgaatacttcatctcaactcacggtgcacgtaaaggtcttgccgatacagcacttaaaacagctgactcaggatatcttactcgtcgtcttgttgacgtggcacaagatgttattgttcgtgaagaagactgtggtactgatagaggtttattagtttctgatattaaagaaggtacagaaatgattgaaccatttatcgaacgtattgaaggtcgttattctaaagaaacaattcgtcatcctgaaactgatgaaataatcattcgtcctgatgaattaattacacctgaaattgctaagaaaattacagatgctggtattgaacaaatgtatattcgctcagcatttacttgtaacgcacgacatggtgtttgtgaaaaatgttacggtaaaaaccttgctactggtgaaaaagttgaagttggtgaagcagttggtacaattgcagcccaatctatcggtgaaccaggtacacagcttacaatgcgtacattccatacaggtggggtagcaggtagcgatatcacacaaggtcttcctcgtattcaagagattttcgaagcacgtaaccctaaaggtcaagcggtaattacggaaatcgaaggtgtcgtagaagatattaaattagcaaaagatagacaacaagaaattgttgttaaaggtgctaatgaaacaagatcataccttgcttcaggtacttcaagaattattgtagaaatcggtcaaccagttcaacgtggtgaagtattaactgaaggttctattgaacctaagaattacttatctgttgctggattaaacgcgactgaaagctacttattaaaagaagtacaaaaagtttaccgtatgcaaggtgtagaaatcgacgataaacacgttgaggttatggttcgacaaatgttacgtaaagttagaattatcgaagcaggtgatacgaagttattaccaggttcattagttgatattcataactttacagatgcaaatagagaagcatttaaacaccgtaagcgtcctgcaacagctaaaccagtattacttggtattactaaagcatcacttgaaacagaaagtttcttatctgcagcatcattccaagaaacaacaagagttcttacagatgcagcaattaaaggtaagcgtgatgacttattaggtcttaaagaaaacgtaattattggtaagttaattccagctggtactggtatgagacgttacagcgacgtaaaatacgaaaaaacagctaaaccagttgcagaagttgaatctcaaactgaagtaacggaa

SEQ ID NO: 3396 - protein, 1194 aa, Staphylococcus aureus
  MISC_FEATURE (1)..(1194): RNA polymerase beta-prime
LASPEKIRSWSFGEVKKPETINYRTLKPEKDGLFCERIFGPTKDWECSCGKYKRVRYKGMVCDRCGVEVTKSKVRRERMGHIELAAPVSHIWYFKGIPSRMGLLLDMSPRALEEVIYFASYVVVDPGPTGLEKKTLLSEAEFRDYYDKYPGQFVAKMGAEGIKDLLEEIDLDEELKLLRDELESATGQRLTRAIKRLEVVESFRNSGNKPSWMILDVLPIIPPEIRPMVQLDGGRFATSDLNDLYRRVINRNNRLKRLLDLGAPGIIVQNEKRMLQEAVDALIDNGRRGRPVTGPGNRPLKSLSHMLKGKQGRFRQNLLGKRVDYSGRSVIAVGPSLKMYQCGLPKEMALELFKPFVMKELVQREIATNIKNAKSKIERMDDEVWDVLEEVIREHPVLLNRAPTLHRLGIQAFEPTLVEGRAIRLHPLVTTAYNADFDGDQMAVHVPLSKEAQAEARMLMLAAQNILNPKDGKPVVTPSQDMVLGNYYLTLERKDAVNTGAIFNNTNEVLKAYANGFVHLHTRIGVHASSFNNPTFTEEQNKKILATSVGKIIFNEIIPDSFAYINEPTQENLERKTPNRYFIDPTTLGEGGLKEYFENEELIEPFNKKFLGNIIAEVFNRFSITDTSMMLDRMKDLGFKFSSKAGITVGVADIVVLPDKQQILDEHEKLVDRITKQFNRGLITEEERYNAVVEIWTDAKDQIQGELMQSLDKTNPIFMMSDSGARGNASNFTQLAGMRGLMAAPSGKIIELPITSSFREGLTVLEYFISTHGARKGLADTALKTADSGYLTRRLVDVAQDVIVREEDCGTDRGLLVSDIKEGTEMIEPFIERIEGRYSKETIRHPETDEIIIRPDELITPEIAKKITDAGIEQMYIRSAFTCNARHGVCEKCYGKNLATGEKVEVGEAVGTIAAQSIGEPGTQLTMRTFHTGGVAGSDITQGLPRIQEIFEARNPKGQAVITEIEGVVEDIKLAKDRQQEIVVKGANETRSYLASGTSRIIVEIGQPVQRGEVLTEGSIEPKNYLSVAGLNATESYLLKEVQKVYRMQGVEIDDKHVEVMVRQMLRKVRIIEAGDTKLLPGSLVDIHNFTDANREAFKHRKRPATAKPVLLGITKASLETESFLSAASFQETTRVLTDAAIKGKRDDLLGLKENVIIGKLIPAGTGMRRYSDVKYEKTAKPVAEVESQTEVTE

SEQ ID NO: 3397 - DNA, 3549 bp, Staphylococcus aureus
ttggcaggtcaagttgtccaatatggaagacatcgtaaacgtagaaactacgcgagaatttcagaagtattagaattaccaaacttaatagaaattcaaactaaatcttacgagtggttcctaagagaaggtttaatcgaaatgtttagagacatttctccaattgaagattttactggtaatttgtcattagagtttgtggattaccgtttaggagaaccaaaatatgatttagaagaatctaaaaaccgtgacgctacttatgctgcacctcttcgtgtaaaagtgcgtctaatcattaaagaaacaggagaagttaaagaacaagaagtctttatgggtgatttcccattaatgactgatacaggtacgttcgttatcaatggtgcagaacgtgtaatcgtatctcaattagttcgttcaccatccgtttatttcaatgaaaaaatcgacaaaaatggtcgtgaaaactatgatgcaacaattattccaaaccgtggtgcatggttagaatatgaaacagatgctaaagatgttgtatacgtacgtattgatagaacacgtaaactaccattaacagtattgttacgtgcattaggtttctcaagcgaccaagaaattgttgaccttttaggtgacaatgaatatttacgtaatactttagagaaagacggcactgaaaacactgaacaagcgttattagaaatctatgaacgtttacgtccaggtgaaccaccaactgttgaaaatgctaaaagtctattgtattcacgtttctttgatccaaaacgctatgacttagcaagcgtgggtcgttataaaacaaacaaaaaattacatttaaaacatcgtttatttaatcaaaaattagctgagccaattgtaaatactgaaactggtgaaattgtagttgaagaaggtacagtgcttgatcgtcgtaaaatcgacgaaatcatggatgtacttgaatcaaatgcaaacagcgaagtgtttgaattgcatggtagcgttatagacgagccagtagaaattcaatcaattaaagtatatgttcctaacgatgatgaaggtcgtacgacaactgtaattggtaatgctttccctgactcagaagttaaatgcattacaccagcagatatcattgcttcaatgagttacttctttaacttattaagcggtattggatatacagatgatattgaccatttaggtaaccgtcgtttacgttctgtaggtgaattactacaaaaccaattccgtatcggtttatcaagaatggaaagagttgtacgtgaaagaatgtcaattcaagatactgagtctatcacacctcaacaattaattaatattcgacctgttattgcatctattaaagaattctttggtagctctcaattatcacaattcatggaccaagcaaacccattagctgagttaacgcataaacgtcgtctatcagcattaggacctggtggtttaacacgtgaacgtgctcaaatggaagtacgtgacgttcactactctcactatggccgtatgtgtccaattgaaacacctgagggaccaaacattggattgattaactcattatcaagttatgcacgtgtaaatgaattcggctttattgaaacaccatatcgtaaagttgatttagatacacatgctatcactgatcaaattgactatttaacagctgacgaagaagatagctatgttgtagcacaagcaaactctaaattagatgaaaatggtcgtttcatggatgatgaagttgtatgtcgtttccgtggtaacaatacagttatggctaaagaaaaaatggattatatggatgtatcgccgaagcaagttgtttcagcagcgacagcatgtattccattcttagaaaatgatgactcaaaccgtgcattgatgggtgcgaacatgcaacgtcaagcagtgcctttgatgaatccagaagcaccatttgttggtacaggtatggaacacgttgcagcacgtgattctggtgcggctattacagctaagcacagaggtcgtgttgaacatgttgaatctaatgaaattcttgttcgtcgtctagttgaagagaacggcgttgagcatgaaggtgaattagatcgctatccattagctaaatttaaacgttcaaactcaggtacatgttacaaccaacgtccaatcgttgcagttggagatgttgttgagtataacgagattttagcagatggaccatctatggaattaggagaaatggcattaggtagaaacgtagtagttggtttcatgacttgggacggttacaactatgaggatgccgttatcatgagtgaaagacttgtgaaagatgacgtgtatacttctattcatattgaagagtatgaatcagaagcacgtgatactaagttaggacctgaagaaatcacaagagatattcctaatgtttctgaaagtgcacttaagaacttagacgatcgtggtatcgtttatattggtgcagaagtaaaagatggagatattttagttggtaaagtaacgcctaaaggtgtaactgagttaactgccgaagaaagattgttacatgcaatctttggtgaaaaagcacgtgaagttagagatacttcattacgtgtacctcacggcgctggcggtatcgttcttgatgtaaaagtattcaatcgtgaagaaggcgacgatacattatcacctggtgtaaaccaattagtacgtgtatatatcgttcaaaaacgtaaaattcatgttggtgataagatgtgtggtcgacatggtaacaaaggtgtcatttctaagattgttcctgaagaagatatgccttacttaccagatggacgtccgatcgatatcatgttaaatcctcttggtgtaccatctcgtatgaacatcggacaagtattagagctacacttaggtatggctgctaaaaatcttggtattcacgttgcatcaccagtatttgacggtgcaaacgatgacgatgtatggtcaacaattgaagaagctggtatggctcgtgatggtaaaactgtactttatgatggacgtacaggtgaaccattcgataaccgtatttcagtaggtgtaatgtacatgttgaaacttgcgcacatggttgatgataaattacatgcgcgttcaacaggaccatattcacttgttacacaacaaccacttggcggtaaagcgcaattcggtggacaacgttttggtgagatggaggtatgggcacttgaagcatatggtgctgcatacacattacaagaaatcttaacttacaaatccgatgatacagtaggacgtgtgaaaacatacgaggctattgttaaaggtgaaaacatctctagaccaagtgttccagaatcattccgagtattgatgaaagaattacaaagtttaggtttagatgtaaaagttatggatgagcaagataatgaaatcgaaatgacagacgttgatgacgatgatgttgtagaacgcaaagtagatttacaacaaaatgatgctcctgaaacacaaaaagaagttactgat

SEQ ID NO: 3398 - protein, 1183 aa, Staphylococcus aureus
  MISC_FEATURE (1)..(1183): RNA polymerase beta chain
LAGQVVQYGRHRKRRNYARISEVLELPNLIEIQTKSYEWFLREGLIEMFRDISPIEDFTGNLSLEFVDYRLGEPKYDLEESKNRDATYAAPLRVKVRLIIKETGEVKEQEVFMGDFPLMTDTGTFVINGAERVIVSQLVRSPSVYFNEKIDKNGRENYDATIIPNRGAWLEYETDAKDVVYVRIDRTRKLPLTVLLRALGFSSDQEIVDLLGDNEYLRNTLEKDGTENTEQALLEIYERLRPGEPPTVENAKSLLYSRFFDPKRYDLASVGRYKTNKKLHLKHRLFNQKLAEPIVNTETGEIVVEEGTVLDRRKIDEIMDVLESNANSEVFELHGSVIDEPVEIQSIKVYVPNDDEGRTTTVIGNAFPDSEVKCITPADIIASMSYFFNLLSGIGYTDDIDHLGNRRLRSVGELLQNQFRIGLSRMERVVRERMSIQDTESITPQQLINIRPVIASIKEFFGSSQLSQFMDQANPLAELTHKRRLSALGPGGLTRERAQMEVRDVHYSHYGRMCPIETPEGPNIGLINSLSSYARVNEFGFIETPYRKVDLDTHAITDQIDYLTADEEDSYVVAQANSKLDENGRFMDDEVVCRFRGNNTVMAKEKMDYMDVSPKQVVSAATACIPFLENDDSNRALMGANMQRQAVPLMNPEAPFVGTGMEHVAARDSGAAITAKHRGRVEHVESNEILVRRLVEENGVEHEGELDRYPLAKFKRSNSGTCYNQRPIVAVGDVVEYNEILADGPSMELGEMALGRNVVVGFMTWDGYNYEDAVIMSERLVKDDVYTSIHIEEYESEARDTKLGPEEITRDIPNVSESALKNLDDRGIVYIGAEVKDGDILVGKVTPKGVTELTAEERLLHAIFGEKAREVRDTSLRVPHGAGGIVLDVKVFNREEGDDTLSPGVNQLVRVYIVQKRKIHVGDKMCGRHGNKGVISKIVPEEDMPYLPDGRPIDIMLNPLGVPSRMNIGQVLELHLGMAAKNLGIHVASPVFDGANDDDVWSTIEEAGMARDGKTVLYDGRTGEPFDNRISVGVMYMLKLAHMVDDKLHARSTGPYSLVTQQPLGGKAQFGGQRFGEMEVWALEAYGAAYTLQEILTYKSDDTVGRVKTYEAIVKGENISRPSVPESFRVLMKELQSLGLDVKVMDEQDNEIEMTDVDDDDVVERKVDLQQNDAPETQKEVTD

SEQ ID NO: 3399 - DNA, 606 bp, Staphylococcus aureus
atgagtcattattacgatgaagatccaagtgtaattagcaatgaacaacgtattcaatatcaattaaaccatcataaaattgatttaataactgataacggagtgttttcgaaagataaagtagattatggttcagatgttcttgttcaaacttttttaaaagcgcatccacctggtccaagtaagcgaattgccgatgttggttgtggttacggaccaattggtttgatgattgctaaagtatcaccacatcattcaattacaatgctagatgttaatcacagagcgctagccttagttgaaaaaaacaaaaaattaaatggtattgataatgtgatcgtaaaggaaagtgatgctttgtctgctgtggaagacaaaagttttgattttattttaaccaatccaccaataagagcagggaaagaaaccgtgcatcgtatattcgagcaagcattacatagattagactcgaacggtgaactattcgttgtaattcagaagaagcaaggtatgccatctgcaaagaaaagaatgaatgaactttttggaaatgtagaagtggtaaataaagataaaggatattacattctgagaagtataaaagct

SEQ ID NO: 3400 - protein, 202 aa, Staphylococcus aureus
  MISC_FEATURE (1)..(202): conserved hypothetical
MSHYYDEDPSVISNEQRIQYQLNHHKIDLITDNGVFSKDKVDYGSDVLVQTFLKAHPPGPSKRIADVGCGYGPIGLMIAKVSPHHSITMLDVNHRALALVEKNKKLNGIDNVIVKESDALSAVEDKSFDFILTNPPIRAGKETVHRIFEQALHRLDSNGELFVVIQKKQGMPSAKKRMNELFGNVEVVNKDKGYYILRSIKA

SEQ ID NO: 3401 - DNA, 681 bp, Staphylococcus aureus
atgactactaaagaaaatattgatactcttcgaaagccaggtgcacaagccttaagtttagcatcattatttatgatacttttttcatgtctaactttcttttttggtttagattatgaaaggtttccaaattatttaaagataacgacaattatagaattaataattatcataattagtttacttcaatggattagatttatagatttcgaaaaggaaagcgcacagaaatataagaaaatatatgcccgatttttagttattataaatgtgctaactactatcaccgcagtatttgcaacatgtaacctttattattttgttgctgtacaaaatcattatgacctattcaattattggttgatgggtacgatttcaatcataattagttatttgttattagtaattggcggaatgttcacgttattaaaattacctaaagtaacaaaacgttggggtggtaaaactaaaacacatttcggtttattattaactgcgttgagctcatttatatatattgaaaaaattatcgaatatatattggttcctaatgtcgtagaatctaagtttataattattgtgagcatgttggttatcgctggagcacaatttgtggcatttcaatttattatgcaatacagtagattctatatttttgaattaaacactgaagatgatgac

SEQ ID NO: 3402 - protein, 227 aa, Staphylococcus aureus
  MISC_FEATURE (1)..(227): hypothetical protein
MTTKENIDTLRKPGAQALSLASLFMILFSCLTFFFGLDYERFPNYLKITTIIELIIIIISLLQWIRFIDFEKESAQKYKKIYARFLVIINVLTTITAVFATCNLYYFVAVQNHYDLFNYWLMGTISIIISYLLLVIGGMFTLLKLPKVTKRWGGKTKTHFGLLLTALSSFIYIEKIIEYILVPNVVESKFIIIVSMLVIAGAQFVAFQFIMQYSRFYIFELNTEDDD

SEQ ID NO: 3403 - DNA, 363 bp, Staphylococcus aureus
ttgaattattttaattctacagtagctccaacttcttctaattgttctttaagtttttcagcttcttctttaggtaaagcttctttgattactttaggagctccgtctactaattctttagcatcttttaatcctaaaccagttgcttctttaacagctttaacaactttgattttagatgaaccagctgaagttaactcaacgtcaaattcagttttttctgctgcagcgtcagcgccaccagctgcacctgctactgctactggagcagctgcagttacaccaaattcttcttcaattgcttttactaagtcgtttaattctaatactgacatttctttaatcgcttcaatgatttgttca

SEQ ID NO: 3404 - protein, 121 aa, Staphylococcus aureus
LNYFNSTVAPTSSNCSLSFSASSLGKASLITLGAPSTNSLASFNPKPVASLTALTTLILDEPAEVNSTSNSVFSAAASAPPAAPATATGAAAVTPNSSSIAFTKSFNSNTDISLIASMICS

SEQ ID NO: 3405 - DNA, 366 bp, Staphylococcus aureus
atggctaatcatgaacaaatcattgaagcgattaaagaaatgtcagtattagaattaaacgacttagtaaaagcaattgaagaagaatttggtgtaactgcagctgctccagtagcagtagcaggtgcagctggtggcgctgacgctgcagcagaaaaaactgaatttgacgttgagttaacttcagctggttcatctaaaatcaaagttgttaaagctgttaaagaagcaactggtttaggattaaaagatgctaaagaattagtagacggagctcctaaagtaatcaaagaagctttacctaaagaagaagctgaaaaacttaaagaacaattagaagaagttggagctactgtagaattaaaa

SEQ ID NO: 3406 - protein, 122 aa, Staphylococcus aureus
  MISC_FEATURE (1)..(122): 50S ribosomal protein
MANHEQIIEAIKEMSVLELNDLVKAIEEEFGVTAAAPVAVAGAAGGADAAAEKTEFDVELTSAGSSKIKVVKAVKEATGLGLKDAKELVDGAPKVIKEALPKEEAEKLKEQLEEVGATVELK

SEQ ID NO: 3407 - DNA, 498 bp, Staphylococcus aureus
atgtctgctatcattgaagctaaaaaacaactagttgatgaaattgctgaggtactatcaaattcagtttcaacagtaatcgttgactaccgtggattaacagtagctgaagttactgacttacgttcacaattacgtgaagctggtgttgagtataaagtatacaaaaacactatggtacgtcgtgcagctgaaaaagctggtatcgaaggcttagatgaattcttaacaggtcctactgctattgcaacttcaagtgaagatgctgtagctgcagcgaaagtaatttctggatttgctaaagatcatgaagcattagaaattaaatcaggcgttatggaaggcaatgttattacagcagaagaagttaaaactgttggttcattaccttcacacgatggtcttgtatctatgcttttatcagtattacaagctcctgtacgcaacttcgcttatgcggttaaagctattggagaacaaaaagaagaaaacgctgaa

SEQ ID NO: 3408 - protein, 166 aa, Staphylococcus aureus
  MISC_FEATURE (1)..(166): 50S ribosomal protein L10
MSAIIEAKKQLVDEIAEVLSNSVSTVIVDYRGLTVAEVTDLRSQLREAGVEYKVYKNTMVRRAAEKAGIEGLDEFLTGPTAIATSSEDAVAAAKVISGFAKDHEALEIKSGVMEGNVITAEEVKTVGSLPSHDGLVSMLLSVLQAPVRNFAYAVKAIGEQKEENAE

SEQ ID NO: 3409 - DNA, 690 bp, Staphylococcus aureus
atggctaaaaaaggtaaaaagtatcaagaagcagctagtaaagttgaccgtactcagcactacagtgttgaagaagcaattaaattagctaaagaaacaagcattgctaactttgacgcttctgttgaagttgcattccgtttaggaattgatacacgtaaaaatgaccaacaaatccgtggtgcagttgtattaccaaacggaactggtaaatcacaaagtgtattagtattcgctaaaggtgacaaaattgctgaagctgaagcagcaggtgctgactatgtaggtgaagcagaatacgttcaaaaaatccaacaaggttggttcgacttcgatgtagtagttgctacaccagacatgatgggtgaagttggtaaattaggtcgtgtattaggaccaaaaggtttaatgccaaaccctaaaactggaactgtaacaatggatgttaaaaaagctgttgaagaaatcaaagctggtaaagtagaatatcgtgctgaaaaagctggtatcgtacatgcatcaattggtaaagtttcatttactgatgaacaattaattgaaaacttcaatactttacaagatgtattagctaaagctaaaccatcatctgctaaaggtacatacttcaaatctgttgctgtaactacaacaatgggtcctggagttaaaattgatactgcaagtttcaaa

SEQ ID NO: 3410 - protein, 230 aa, Staphylococcus aureus
  MISC_FEATURE (1)..(230): 50S ribosomal protein L1
MAKKGKKYQEAASKVDRTQHYSVEEAIKLAKETSIANFDASVEVAFRLGIDTRKNDQQIRGAVVLPNGTGKSQSVLVFAKGDKIAEAEAAGADYVGEAEYVQKIQQGWFDFDVVVATPDMMGEVGKLGRVLGPKGLMPNPKTGTVTMDVKKAVEEIKAGKVEYRAEKAGIVHASIGKVSFTDEQLIENFNTLQDVLAKAKPSSAKGTYFKSVAVTTTMGPGVKIDTASFK

SEQ ID NO: 3411 - DNA, 429 bp, Staphylococcus aureus
gtgcacatcgtggctaaaaaagtagataaagttgttaaattacaaattcctgcaggtaaagcgaatccagcaccaccagttggtccagcattaggtcaagcaggtgtgaacatcatgggattctgtaaagagttcaatgcacgtactcaagatcaagcaggtttaattattccggtagaaatcagtgtttatgaagatcgttcatttacatttattacaaaaactccaccggctccagtattacttaaaaaagcagctggtattgaaaaaggttcaggcgaaccaaacaaaactaaagttgctacagtaactaaagatcaagtacgcgaaattgctaacagcaaaatgcaagacttaaacgctgctgacgaagaagcagctatgcgtattatcgaaggtactgcacgtagtatgggtatcgttgtagaa

SEQ ID NO: 3412 - protein, 143 aa, Staphylococcus aureus
  MISC_FEATURE (1)..(143): 50S ribosomal protein L11
VHIVAKKVDKVVKLQIPAGKANPAPPVGPALGQAGVNIMGFCKEFNARTQDQAGLIIPVEISVYEDRSFTFITKTPPAPVLLKKAAGIEKGSGEPNKTKVATVTKDQVREIANSKMQDLNAADEEAAMRIIEGTARSMGIVVE

SEQ ID NO: 3413 - DNA, 546 bp, Staphylococcus aureus
atgtctgaagaagttggcgcaaagcgttggtatgcagtgcatacatattctggatatgaaaataaagttaaaaagaatttagaaaaaagagtagaatctatgaatatgactgaacaaatctttagagtagtcataccggaagaagaagaaactcaagtaaaagatggcaaagctaaaacgactgttaaaaaaacattccctggatatgttttagtggaattaatcatgacagatgaatcatggtatgtggtaagaaatacaccaggcgttactggttttgtaggttctgcaggtgcagggtctaagccaaatccattgttaccagaagaagttcgcttcatcttaaaacaaatgggtcttaaagaaaagactatcgatgttgaactcgaagttggcgagcaagttcgtattaaatcaggtccatttgcgaatcaagttggtgaagttcaagaaattgaaacagataagtttaagctaacagtattagtagatatgtttggccgagaaacaccagtagaagttgaattcgatcaaatagaaaagctt

SEQ ID NO: 3414 - protein, 182 aa, Staphylococcus aureus
  MISC_FEATURE (1)..(182): transcription
MSEEVGAKRWYAVHTYSGYENKVKKNLEKRVESMNMTEQIFRVVIPEEEETQVKDGKAKTTVKKTFPGYVLVELIMTDESWYVVRNTPGVTGFVGSAGAGSKPNPLLPEEVRFILKQMGLKEKTIDVELEVGEQVRIKSGPFANQVGEVQEIETDKFKLTVLVDMFGRETPVEVEFDQIEKL

SEQ ID NO: 3415 - DNA, 216 bp, Staphylococcus aureus
ttgataatatgttcaaaggatttggaggttgagcagatggctaaaaaagaaagtttctttaaaggcgttaagtctgaaatggaaaaaacaagttggccgacgaaagaagagctatttaaatatactgtaattgtagtttctactgttatattcttcttagtctttttctatgccttagatttaggaattacagcattgaaaaatttattatttggt

SEQ ID NO: 3416 - protein, 72 aa, Staphylococcus aureus
  MISC_FEATURE (1)..(72): preprotein translocase
LIICSKDLEVEQMAKKESFFKGVKSEMEKTSWPTKEELFKYTVIVVSTVIFFLVFFYALDLGITALKNLLFG

SEQ ID NO: 3417 - DNA, 555 bp, Staphylococcus aureus
ttgacaactcaagacagtacaatcaaacgtaacaatgcaataaatgataaagacttcgaaaagttagtaatggatctacaaccattaattattcgacgcatcaaaacatttggatttaatcattatgatttagaagacttatatcaagaaatacttatacggatgtataggtcggtccaaacatttgattttagtggagagcagcctttcacaaattatgttcaatgtttaattacgtctgtaaagtatgattatttgagaaaatatttagctacaaataaaagaatggataatttgattaatgaatatagagttacgtatccatgtgcaataaagcgttttgatgttgaaaacaattatttgaataaattagcaattaaagagttgatttgtcagtttaagtatttgagtgcatttgaaaaagatgtcatgtatttaatgtgtgaacaatataagccgagagaaattgctcaattgatgcatgtaaaagagaaagtgatttataatgccatacaacgatgtaaaaataaaataaaacgttatttcaaaatgatt

SEQ ID NO: 3418 - protein, 185 aa, Staphylococcus aureus
  MISC_FEATURE (1)..(185): hypothetical protein
LTTQDSTIKRNNAINDKDFEKLVMDLQPLIIRRIKTFGFNHYDLEDLYQEILIRMYRSVQTFDFSGEQPFTNYVQCLITSVKYDYLRKYLATNKRMDNLINEYRVTYPCAIKRFDVENNYLNKLAIKELICQFKYLSAFEKDVMYLMCEQYKPREIAQLMHVKEKVIYNAIQRCKNKIKRYFKMI

SEQ ID NO: 3419 - DNA, 522 bp, Staphylococcus aureus
atgaaagaacgttacttaatcattgatggatacaatatgataggacaatcaccaacgctaagcgccattgcaaaagagaatttagaagaagctagaatgcaattaatagatgcaattgcaaattataatgcagttatttcagatgaaattatttgtgttttcgatgcttatgaccaatcgggtgttgaaagagaatacatgtatcatggcgttaaaacgatttttaccaaggaaaaagaaacagctgatagtttcatagaacgttatgtttatgaactttatgacaagcatactaagcatattacagttgtaacaagtgatatgagtgagcaacatgctatctttggatcaggtgcatatagaatatcatctcgcgaaatgtggagagatttaaaagaaaatgaaattgatgtgagtaaatcattagatgatataagtgaaaacaagccaagaactcgaattccgttatcttctgaaatccttgcagaatttgaaaaaatacgaagaggacatcataagaaa

SEQ ID NO: 3420 - protein, 174 aa, Staphylococcus aureus
  MISC_FEATURE (1)..(174): conserved hypothetical
MKERYLIIDGYNMIGQSPTLSAIAKENLEEARMQLIDAIANYNAVISDEIICVFDAYDQSGVEREYMYHGVKTIFTKEKETADSFIERYVYELYDKHTKHITVVTSDMSEQHAIFGSGAYRISSREMWRDLKENEIDVSKSLDDISENKPRTRIPLSSEILAEFEKIRRGHHKK

SEQ ID NO: 3421 - DNA, 744 bp, Staphylococcus aureus
gtggaagatacggttattgttggtaggcatgctgttagagaagcgattattactgggcatccgataaataagatattgattcaagaaggtattaaaaagcaacaaattaatgaaattttaaaaaatgcaaaagatcaaaaaatcattgttcaaactgtaccaaaatctaaattagattttttagcaaatgcaccacatcagggtgttgcagcgcttattgcaccatatgaatatgctgacttcgatcaatttttaaaacagcaaaaagaaaaagaaggtttattgacagtacttatattagacggcttagaagacccacataacttgggatcaattttaagaacagccgatgcaacgggagttgatggtgttattattcctaaacgtcgttcagttacactaacgcaaacagttgcaaaagcctcaacaggtgcaattgaacatgtaccagttattcgagtgacaaatttagctaaaactatcgatgaactaaaagataatggcttttgggtagctggcactgaagctaataatgcaacagattatagaaatctagaagcggacatgtcattggctattgtaattggtagcgaaggacagggtatgagtcgcctagtaagtgataaatgcgatttttatattaagattccaatggttggacatgtaaacagtttgaatgcttcggttgcagcaagtttaatgatgtacgaagtatttcgaaaaagacatgatgttggagaaata

SEQ ID NO: 3422 - protein, 248 aa, Staphylococcus aureus
  MISC_FEATURE (1)..(248): hypothetical protein
VEDTVIVGRHAVREAIITGHPINKILIQEGIKKQQINEILKNAKDQKIIVQTVPKSKLDFLANAPHQGVAALIAPYEYADFDQFLKQQKEKEGLLTVLILDGLEDPHNLGSILRTADATGVDGVIIPKRRSVTLTQTVAKASTGAIEHVPVIRVTNLAKTIDELKDNGFWVAGTEANNATDYRNLEADMSLAIVIGSEGQGMSRLVSDKCDFYIKIPMVGHVNSLNASVAASLMMYEVFRKRHDVGEI

SEQ ID NO: 3423 - DNA, 384 bp, Staphylococcus aureus
ttgctacaacaagatgtgcatcagaggagtggtttaataatgagtaaaattaatgacattaatgatttagtcaacgcaacatttcaagttaagaagtttttcagagatacaaaaaagaagttcaatttgaactatgaagaaatttatattttaaatcatattttaagaagtgagtctaacgaaatctcatctaaagagattgctaagtgctcagagttcaaaccttactatttaactaaagctttacaaaagctaaaagatttaaaattgttatcaaagaaaagaagtttacaagacgaaagaacagttattgtttatgttacagatacacaaaaagcaaatattcaaaaactgatttcagaattagaagaatgcattaaaaat

SEQ ID NO: 3424 - protein, 128 aa, Staphylococcus aureus
  MISC_FEATURE (1)..(128): staphylococcal accessory
LLQQDVHQRSGLIMSKINDINDLVNATFQVKKFFRDTKKKFNLNYEEIYILNHILRSESNEISSKEIAKCSEFKPYYLTKALQKLKDLKLLSKKRSLQDERTVIVYVTDTQKANIQKLISELEECIKN

SEQ ID NO: 3425 - DNA, 402 bp, Staphylococcus aureus
gtggataatcaacaagataatcacattaaattattgaatccattgaccttagcatatatgggagacgcagtcttagatcaatatgtacgtacctatatcgttttaaagcttaaaagtaagcctaataaactacatcaaatgtctaaaaaatatgtatctgccaaaagtcaggcgcaaacgttagaatatttaatggagcaagaatggtttacagacgaagaaatggatattttgaagcgagggcgtaacgcgaaaagtcatactaaagctaaaaacactgatgttcaaacatatcgtaaaagttcagcgatagaagcagtgataggttttctttatttagaaaaaagagaagaacgattagaggcattattaaataaaataataacaatagtaaacgaaagg

SEQ ID NO: 3426 - protein, 134 aa, Staphylococcus aureus
  MISC_FEATURE (1)..(134): cysteinyl-tRNA synthetase
VDNQQDNHIKLLNPLTLAYMGDAVLDQYVRTYIVLKLKSKPNKLHQMSKKYVSAKSQAQTLEYLMEQEWFTDEEMDILKRGRNAKSHTKAKNTDVQTYRKSSAIEAVIGFLYLEKREERLEALLNKIITIVNER

SEQ ID NO: 3427 - DNA, 1428 bp, Staphylococcus aureus
ttgaaaagactaggaatggagagattcaagatgattacattatataatacgcttacacgtcaaaaagaagtgttcaagcctatagaaccagggaaagtaaaaatgtatgtatgtggtcctactgtatataactacattcatattggtaacgcaagaccagcaattaattatgacgtagtgagacgttactttgaataccaaggatataatgtagaatatgtatcaaattttacagacgtagatgataaattaattaaacgttctcaagaattaaatcagtctgttcccgaaattgcagaaaaatatatcgctgcttttcatgaagatgttggtgcgttaaatgttagaaaagcgacttcaaatccaagggtaatggaccatatggatgacattattcaatttattaaagatttggtggatcaaggttatgcatatgaaagtggtggcgatgtttactttagaacacgtaaatttgaaggttatggtaaattaagtcatcaatccatagatgacttaaaagtgggtgctcgtatagatgcaggagagcataaagaagatgcacttgattttacattgtggaaaaaagcgaagcctggcgagattagttgggatagcccatttggtgaaggtagaccaggatggcatatagaatgttctgtaatggcatttcatgagctaggacctacaattgatatacatgcgggtggttcagatttacaatttccacatcatgaaaatgaaatagcacaatcagaagcacataatcatgcgccatttgctaattattggatgcataatggtttcattaatattgataatgaaaaaatgagtaaatcactaggcaactttattttagttcacgatattattaaagaagttgatccagatgtactaagattctttatgattagcgtacattatagaagcccaattaactataatctagaattggtagaatcagcacgtagtggactagagcgtattcgcaatagttatcaattaattgaagagcgcgcacaaattgctactaatattgaaaatcaacagacatatattgatcaaattgatgcgattttaaatcgttttgaaacagttatgaatgatgattttaatacagctaatgcaattacagcttggtatgatttagcaaaacttgcgaataaatatgtactagagaacacaacatcaacagaagtaattgataaatttaaagcagtttatcaaattttcagcgatgttttaggtgtaccgttaaaatctaaaaatgcagatgaattattggatgaagatgttgaaaaattaatcgaagagcgtaatgaagcaaggaaaaacaaagattttgcacgagcagatgaaattcgagacatgctgaaatcacaaaacattatattagaagacacacctcaaggggttagatttaaacgtgga

SEQ ID NO: 3428 - protein, 476 aa, Staphylococcus aureus
  MISC_FEATURE (1)..(476): cysteinyl-tRNA synthetase
LKRLGMERFKMITLYNTLTRQKEVFKPIEPGKVKMYVCGPTVYNYIHIGNARPAINYDVVRRYFEYQGYNVEYVSNFTDVDDKLIKRSQELNQSVPEIAEKYIAAFHEDVGALNVRKATSNPRVMDHMDDIIQFIKDLVDQGYAYESGGDVYFRTRKFEGYGKLSHQSIDDLKVGARIDAGEHKEDALDFTLWKKAKPGEISWDSPFGEGRPGWHIECSVMAFHELGPTIDIHAGGSDLQFPHHENEIAQSEAHNHAPFANYWMHNGFINIDNEKMSKSLGNFILVHDIIKEVDPDVLRFFMISVHYRSPINYNLELVESARSGLERIRNSYQLIEERAQIATNIENQQTYIDQIDAILNRFETVMNDDFNTANAITAWYDLAKLANKYVLENTTSTEVIDKFKAVYQIFSDVLGVPLKSKNADELLDEDVEKLIEERNEARKNKDFARADEIRDMLKSQNIILEDTPQGVRFKRG

SEQ ID NO: 3429 - DNA, 609 bp, Staphylococcus aureus
atggtatttgagcaggatccagcggcacgttcaacattagaagtcattacaacgtatgcaggtttacatgcagtttggagtcatttgattgcacataagttatacaaccaaaaaaaatatgttgcagcacgcgcgatatctcaaatttcaagatttttcacaggtatagaaatccatccaggtgctaaaattggaaagcgtctatttatagatcatggtatgggcgttgtaataggagaaacatgtacaattggtgataatgtgacaatctatcaaggcgtgacacttggtgggacagggaaagaaagagggaaaagacacccagatataggagacaatgttttaatagcagccggtgcgaaagttttaggaaatattaaaataaattcaaatgtaaatattggtgcaaattcagttgttttacaatcagttccaagttattcaacggttgttggtataccaggacatattgttaagcaagatggtgttcgagttggaaaaacatttgatcatcgccatctacctgatccaatttatgaacaaattaagcatttagaacgacaacttgaaaagactaggaatggagagattcaagatgattacattata

SEQ ID NO: 3430 - protein, 203 aa, Staphylococcus aureus
  MISC_FEATURE (1)..(203): Serine acetyltransferase
MVFEQDPAARSTLEVITTYAGLHAVWSHLIAHKLYNQKKYVAARAISQISRFFTGIEIHPGAKIGKRLFIDHGMGVVIGETCTIGDNVTIYQGVTLGGTGKERGKRHPDIGDNVLIAAGAKVLGNIKINSNVNIGANSVVLQSVPSYSTVVGIPGHIVKQDGVRVGKTFDHRHLPDPIYEQIKHLERQLEKTRNGEIQDDYII

SEQ ID NO: 3431 - DNA, 1461 bp, Staphylococcus aureus
gtgaaaaaaatgagcgatcgtataagagtaagatatgcaccaagtccaactgggtatcttcatattggtaatgcaagaacagcattattcaattacttgtatgctaaacattacaacggagattttgtgattcgaattgaagatactgataaaaaacgtaatttagaagatggagaaacatcacaatttgataatcttaaatggttaggattagattgggatgagtctgtagataaagacaatggctacggaccatatcgtcaatctgaacgtcaacatatctaccaaccattaatagatcagttactagcagaagataaagcatataaatgctatatgacagaagaagaattagaagctgaacgtgaagcgcaaatcgctcgtggtgaaatgcctcgctatggtggtcaacatgcgcatttgactgaagaacaacgtcaacaatttgaagcagaaggacgccaaccatcaattcgtttccgagtacctcaaaaccaaacgtattcatttgatgatatggtaaaaggaaatatttcatttgattcaaatggtattggtgactgggttatcgtaaaaaaagatggcattccaacgtacaattttgcagtagctatagatgatcattacatgcaaatttcagatgtaattcgtggtgatgatcatatttcaaacacgcctaaacaaattatgatttatgaagcatttggctgggagccacctcgttttggtcatatgtcattaattgttaatgaagaacgtaaaaagttaagtaaacgtgatgggcaaattttacaatttattgagcaatatcgtgacttaggttatttacctgaagcgttatttaattttattgcgttattaggttggtctcctgaaggtgaagaagaaatcttttctaaagaagaatttatcaaaatctttgatgaaaagcgtttgtcaaaatcaccagcatttttcgataagcaaaaattagcatgggttaataaccaatatatgaaacaaaaagatactgaaacagtattccaattagcattacctcatttaattaaagcaaatttgattcctgaggtgccgtcagaagaggatttatcttggggacgcaaattaattgcgctttatcaaaaagaaatgagttatgccggtgaaattgtacctttatcagaaatgttctttaaagaaatgccagctcttggtgaagaagaacaacaagtgattaatggagagcaagtaccagagttaatgacgcacttattcagtaaattagaagcacttgaaccatttgaagcggctgaaattaaaaagacaattaaagaagttcaaaaagaaacaggaataaaaggcaagcaattatttatgcctattcgtgttgctgtaacaggccaaatgcatggtcctgaattaccaaatacaattgaagtacttggtaaagaaaaagtgctaaaccgtttaaaacaatataag

SEQ ID NO: 3432 - protein, 487 aa, Staphylococcus aureus
  MISC_FEATURE (1)..(487): glutamyl-tRNA synthetase
VKKMSDRIRVRYAPSPTGYLHIGNARTALFNYLYAKHYNGDFVIRIEDTDKKRNLEDGETSQFDNLKWLGLDWDESVDKDNGYGPYRQSERQHIYQPLIDQLLAEDKAYKCYMTEEELEAEREAQIARGEMPRYGGQHAHLTEEQRQQFEAEGRQPSIRFRVPQNQTYSFDDMVKGNISFDSNGIGDWVIVKKDGIPTYNFAVAIDDHYMQISDVIRGDDHISNTPKQIMIYEAFGWEPPRFGHMSLIVNEERKKLSKRDGQILQFIEQYRDLGYLPEALFNFIALLGWSPEGEEEIFSKEEFIKIFDEKRLSKSPAFFDKQKLAWVNNQYMKQKDTETVFQLALPHLIKANLIPEVPSEEDLSWGRKLIALYQKEMSYAGEIVPLSEMFFKEMPALGEEEQQVINGEQVPELMTHLFSKLEALEPFEAAEIKKTIKEVQKETGIKGKQLFMPIRVAVTGQMHGPELPNTIEVLGKEKVLNRLKQYK

SEQ ID NO: 3433 - DNA, 1071 bp, Staphylococcus aureus
gtgaatatcgttaaactaatggttattattatttacttaattattgggagcgcattaggaataattattattcctgaaattgcaaatgatcttggattacaaaactccagctttttaaaaaatcactatgtagatggcattatcggtagtatttttatgttcttaatttttggtgtatttattagacgagttactaacgctataaaaggtttagaacattttattatgcgtagaagtgctgttgaaatactattcgcaacaataggtttaataatcggattacttatttctgttatggtgtcgtttatattagaatcaattggcaactctatttttaatcatttcattcctgtcataattacgatattactatgttatttcggtttccaatttggccttaaaaaacgagatgaaatgttaatgtttttacctgagaatatagcgcgttccatgtcacaacatactaaaagtgctacgccaaaaattatcgacacaagcgcaattattgatggtcgtattttagaagtcattcgttgcggttttatcgatggcaatattttaattccacaaggtgttattaatgaattacaaattgttgcagattcaaatgacagtgttaaacgtgaaaagggtaaaagaggcttagatattttaaatgaattgtatgatttagactatcctacaaaggttatacatccaactaaaacacatagtgatattgatacgatgttattaaaattagcaaaacaatatcatgcaagtattataacgacagatttcaacctaaataaagtttgtcatgtacatggtatcaaagcattaaatgttaatgatttatcagaagcaatcaaacctaatgtacatcaaggtgatcaactgcatattttactgacaaaaatgggtaaggagcctggtcaggcagtaggatatctagatgatggtacgatggtagttgttgataatgctaaaaatcttattggcagtcatgtcaatttagaagtagtcagcttattgcaaacatcttcaggaagaattgtttttgctaaaaaaatcgaagatacagtatcatta

SEQ ID NO: 3434 - protein, 357 aa, Staphylococcus aureus
  MISC_FEATURE (1)..(357): conserved hypothetical
VNIVKLMVIIIYLIIGSALGIIIIPEIANDLGLQNSSFLKNHYVDGIIGSIFMFLIFGVFIRRVTNAIKGLEHFIMRRSAVEILFATIGLIIGLLISVMVSFILESIGNSIFNHFIPVIITILLCYFGFQFGLKKRDEMLMFLPENIARSMSQHTKSATPKIIDTSAIIDGRILEVIRCGFIDGNILIPQGVINELQIVADSNDSVKREKGKRGLDILNELYDLDYPTKVIHPTKTHSDIDTMLLKLAKQYHASIITTDFNLNKVCHVHGIKALNVNDLSEAIKPNVHQGDQLHILLTKMGKEPGQAVGYLDDGTMVVVDNAKNLIGSHVNLEVVSLLQTSSGRIVFAKKIEDTVSL

SEQ ID NO: 3435 - DNA, 1362 bp, Staphylococcus aureus
ttggccaagaaaaaagtgatttttgaatgtatggcttgtggttatcaatctcctaaatggatggggaaatgtcctaattgtggcgcttggaatcaaatggaggaaattgttgaaaaagcagccaatcctaaacatggagttaaaaccaaggaattagcaggtaaagtacaaaaattaaatagtattaaacatgaaacaacgccgagagtgttaacagattcagcagaattcaaccgtgtattaggtggaggtattgtgagcggatcgttagtacttattggtggggatccaggtattggtaagtcaacgttacttttacaaatttgtgcatcgttatctcaaaagaaaaaagtactatatattactggagaagaatcgcttagtcagactaaattacgtgcagagcgattagatgaagattcaagtgaattgcaagtattagctgaaacagatcttgaagttatttatcaaacagtaaaagaagaacaacctgatttattagtagtggattcgattcaaacaatatatcatcctgaaatcagctctgcgccaggttctgtttcacaagttcgtgaaagtacacaaagtttaatgaatattgctaaacaaatgaacattgcaacttttatagtgggtcatgtaacgaaagaaggtcaaattgctggcccaagattgctagaacacatggttgatactgtgctttattttgaaggcgatgaacaccacgcatatcgaattttgcgagctgttaaaaaccgttttggttcaacgaatgaaatgggaatcttcgaaatgaagcaaagtggattaaaaggtgtaaataatccatctgaaatgtttttagaagaacgttcaacaaatgttccaggttcaacaattgttgcaaccatggagggaaccagaccacttttaatagaagttcaagcgctggtaactccaacgacttttaacaatccgagacgaatggcaacagggattgatcataatcgattaagtttgttgatggctgttttggaaaagaaagaaaattatctattacaacaacaagatgcttatatcaaagtagctggcggtgtaaagttaacggagccagcagttgatttaagtgtaattgtagcaactgcatctagctttaaagataaagctgtcgacggattagattgctatattggagaagttggtttaacgggtgaggtacgtcgtgtatctcggatagaacaacgcgtgcaagaggctgcaaaactaggtttcaaacgtgtaattattcctaaaaataatataggcggatggacatatcctgaaggtatacaagtaataggtgtaactactgtacatgaagtattgtcatttgctcttcattca

SEQ ID NO: 3436 - protein, 454 aa, Staphylococcus aureus
  MISC_FEATURE (1)..(454): DNA repair protein
LAKKKVIFECMACGYQSPKWMGKCPNCGAWNQMEEIVEKAANPKHGVKTKELAGKVQKLNSIKHETTPRVLTDSAEFNRVLGGGIVSGSLVLIGGDPGIGKSTLLLQICASLSQKKKVLYITGEESLSQTKLRAERLDEDSSELQVLAETDLEVIYQTVKEEQPDLLVVDSIQTIYHPEISSAPGSVSQVRESTQSLMNIAKQMNIATFIVGHVTKEGQIAGPRLLEHMVDTVLYFEGDEHHAYRILRAVKNRFGSTNEMGIFEMKQSGLKGVNNPSEMFLEERSTNVPGSTIVATMEGTRPLLIEVQALVTPTTFNNPRRMATGIDHNRLSLLMAVLEKKENYLLQQQDAYIKVAGGVKLTEPAVDLSVIVATASSFKDKAVDGLDCYIGEVGLTGEVRRVSRIEQRVQEAAKLGFKRVIIPKNNIGGWTYPEGIQVIGVTTVHEVLSFALHS

SEQ ID NO: 3437 - DNA, 2454 bp, Staphylococcus aureus
atgttatttggtagattaactgagcgtgcacagcgcgtattagcacatgcccaagaagaagcaattcgtttaaatcattcaaatataggaacagaacacctattattggggttaatgaaagaacctgaaggaattgctgcaaaagtattagaaagttttaatatcactgaagataaagtaattgaagaagttgaaaaattaatcggacatggtcaagatcatgttggtacattgcattatacacctagagctaaaaaagtcattgaattatcgatggatgaagctagaaaattacatcacaattttgttggaacggaacatattttattaggcttgattcgtgaaaatgaaggtgttgcagcaagagtttttgcaaatctagatttaaatattactaaagcacgtgcacaagttgtgaaagctttaggaaaccctgaaatgagtaataaaaatgcacaagctagtaagtcaaataatactccaactttagatagtttagctcgtgacttaacagtcattgccaaagacggtacattagatcctgttataggacgtgataaagaaattacacgtgtaattgaagtattaagtagacgtacgaaaaacaatcctgtgcttattggagagccaggtgttggtaaaactgctattgctgaaggtttagcgcaagccatagtgaataatgaggtaccagagacattaaaagataagcgtgttatgtctttagatatgggaacagtagttgcaggtactaaatatcgtggtgaatttgaagagcgtctgaaaaaggttatggaagaaatccaacaagcaggtaatgtcatcctatttattgatgagttgcatactttagttggtgctggtggtgctgaaggtgctatcgatgcttcgaatattttgaagccggcattagcacgtggtgaattacaatgtattggtgctactacattagatgaatatcgcaaaaatattgaaaaagacgcggctttagaacgtcgtttccaacctgtacaagttgatgaaccttcagtagtagatacagttgctattttaaaaggattaagagatcgttacgaagcacaccatcgtattaatatttcagacgaagctattgaagcagctgttaaattaagtaacagatacgtttcagatcgtttcttaccagataaagcaattgatttaattgatgaagcaagttctaaagtaagacttaagagtcatacgacacctaataatttaaaagaaattgaacaagaaattgaaaaagttaaaaatgaaaaagatgccgcagtacatgctcaagagtttgaaaatgctgctaacctgcgtgataaacaaacaaaacttgaaaagcaatatgaagaagctaaaaatgaatggaagaatgcacaaaatggcatgtcaacttcattgtcagaagaagatattgctgaagttattgcaggatggacaggtatcccattaactaaaatcaatgaaacagaatctgaaaaacttcttagtctagaagatacattacatgagagagttattgggcaaaaagatgctgttaattcaatcagtaaagcggttagacgtgcccgtgcagggttaaaagatcctaaacgaccaattggtagctttatcttccttggaccaactggtgttggtaaaactgaattagctagagctttagctgaatcaatgtttggcgatgatgatgcgatgatccgtgtagacatgagtgaatttatggaaaaacacgcagtgagccgattagttggtgctcctccaggatatgttggtcatgatgatggtggacaattaactgaaaaagttagacgtaaaccatattctgtaattttatttgatgaaattgaaaaagctcatccagatgtatttaatattctattacaagttttagatgatggacatttgacagatacaaaaggacgtacagttgatttcagaaatacaattatcataatgacatcaaacgttggggcacaagaattacaagatcaacgatttgctggattcggtggttcaagtgatggacaagattatgaaacaattcgaaaaacgatgttaaaagaattaaaaaattcattccgtccagaatttttaaaccgtgtagatgatatcattgtattccataaactaacaaaagaagaattaaaagaaattgtaacaatgatggttaataaattaacaaatcgattatctgaacaaaacataaatattattgtaactgataaagcgaaagacaaaatcgcagaagaaggatatgatccagaatatggtgcaagaccattaattagagcgatacaaaaaactatcgaagataatttaagtgaattaatattagatggtaatcaaattgaaggtaagaaagttacagtagatcatgatggtaaagagtttaaatatgacattgctgaacaaacttcagaaactaaaacaccatcgcaagca

SEQ ID NO: 3438 - protein, 818 aa, Staphylococcus aureus
  MISC_FEATURE (1)..(818): endopeptidase
MLFGRLTERAQRVLAHAQEEAIRLNHSNIGTEHLLLGLMKEPEGIAAKVLESFNITEDKVIEEVEKLIGHGQDHVGTLHYTPRAKKVIELSMDEARKLHHNFVGTEHILLGLIRENEGVAARVFANLDLNITKARAQVVKALGNPEMSNKNAQASKSNNTPTLDSLARDLTVIAKDGTLDPVIGRDKEITRVIEVLSRRTKNNPVLIGEPGVGKTAIAEGLAQAIVNNEVPETLKDKRVMSLDMGTVVAGTKYRGEFEERLKKVMEEIQQAGNVILFIDELHTLVGAGGAEGAIDASNILKPALARGELQCIGATTLDEYRKNIEKDAALERRFQPVQVDEPSVVDTVAILKGLRDRYEAHHRINISDEAIEAAVKLSNRYVSDRFLPDKAIDLIDEASSKVRLKSHTTPNNLKEIEQEIEKVKNEKDAAVHAQEFENAANLRDKQTKLEKQYEEAKNEWKNAQNGMSTSLSEEDIAEVIAGWTGIPLTKINETESEKLLSLEDTLHERVIGQKDAVNSISKAVRRARAGLKDPKRPIGSFIFLGPTGVGKTELARALAESMFGDDDAMIRVDMSEFMEKHAVSRLVGAPPGYVGHDDGGQLTEKVRRKPYSVILFDEIEKAHPDVFNILLQVLDDGHLTDTKGRTVDFRNTIIIMTSNVGAQELQDQRFAGFGGSSDGQDYETIRKTMLKELKNSFRPEFLNRVDDIIVFHKLTKEELKEIVTMMVNKLTNRLSEQNINIIVTDKAKDKIAEEGYDPEYGARPLIRAIQKTIEDNLSELILDGNQIEGKKVTVDHDGKEFKYDIAEQTSETKTPSQA

SEQ ID NO: 3439 - DNA, 1020 bp, Staphylococcus aureus
gtgaggtgcaacatgatgacgcataatattcatgataatatcagccaatggatgaaaagtaatgaagaaacaccaattgttatgtcttctagaattcggttagcgcgtaatttagaaaatcatgtgcatccactaatgtatgctactgaaaatgatggatttagagttataaatgaggtacaagatgccttgccaaactttgaattaatgcgtcttgatcaaatggatcaacaaagtaaaatgaaaatggttgcaaagcatttgattagtcctgaactaataaaacaaccagcagccgcagtattagtgaatgacgatgaatctttaagtgtcatgataaatgaagaggaccatattcgtattcaagctatgggaactgacacgacattacaggctttatataatcaagcttcatcaattgatgatgaattagatcgaagccttgatataagttatgatgaacaacttggttatttaactacatgtcctaccaatataggtactggtatgagagcaagcgtgatgctacatttgccaggtctatctattatgaaaagaatgacacggattgctcaaaccattaatcgttttggatatacaatcagaggtatttacggtgaaggttcgcaagtttatggacatacttatcaagtatccaaccaacttacacttggtaaatctgagttagaaatcatagaaacattaacagaagttgttaatcaaatcattcatgaagaaaaacaaatacgacaaaagttagacacttataatcaattagaaacacaagaccgtgtttttcgctcgctaggtattttacaaaactgtagaatgataactatggaagaggcttcttatagattaagcgaagttaaacttggtatagatttaaattacattgaattacaaaactttaaatttaatgaattgatggtagctatacagtcaccatttttattagatgaagaagatgacaaatctgtaaaagaaaaacgagcagatatactaagagaacatataaag

SEQ ID NO: 3440 - protein, 340 aa, Staphylococcus aureus
  MISC_FEATURE (1)..(340): hypothetical protein
VRCNMMTHNIHDNISQWMKSNEETPIVMSSRIRLARNLENHVHPLMYATENDGFRVINEVQDALPNFELMRLDQMDQQSKMKMVAKHLISPELIKQPAAAVLVNDDESLSVMINEEDHIRIQAMGTDTTLQALYNQASSIDDELDRSLDISYDEQLGYLTTCPTNIGTGMRASVMLHLPGLSIMKRMTRIAQTINRFGYTIRGIYGEGSQVYGHTYQVSNQLTLGKSELEIIETLTEVVNQIIHEEKQIRQKLDTYNQLETQDRVFRSLGILQNCRMITMEEASYRLSEVKLGIDLNYIELQNFKFNELMVAIQSPFLLDEEDDKSVKEKRADILREHIK

SEQ ID NO: 3441 - DNA, 564 bp, Staphylococcus aureus
gtgctttgtgaaaattgtcaacttaatgaagcggaattaaaagttaaagttacaagtaaaaataaaacagaagaaaaaatggtgtgtcaaacttgtgctgaggggcaccatccgtggaatcaagctaatgaacaacctgaatatcaagaacatcaagataatttcgaagaagcatttgttgttaagcaaattttacaacatttagctacgaaacatggaattaattttcaagaagtagcgtttaaagaagaaaaacgttgcccatcatgtcatatgactttgaaagatattgcacatgttggtaaatttgggtgtgctaattgttatgcaacatttaaagatgacatcattgatatcgtccgcagagttcaaggtggacaatttgagcacgttggaaagacaccacattcttcacataaaaagatagctttaaagcgaaaaatcgaagaaaagaatgaatatttgaaaaaacttattgaaatccaagattttgaggaagcagccattgttagagatgaaattaaagcactaaaagctgagagtgaggtgcaacatgatgacgca

SEQ ID NO: 3442 - protein, 188 aa, Staphylococcus aureus
  MISC_FEATURE (1)..(188): conserved hypothetical
VLCENCQLNEAELKVKVTSKNKTEEKMVCQTCAEGHHPWNQANEQPEYQEHQDNFEEAFVVKQILQHLATKHGINFQEVAFKEEKRCPSCHMTLKDIAHVGKFGCANCYATFKDDIIDIVRRVQGGQFEHVGKTPHSSHKKIALKRKIEEKNEYLKKLIEIQDFEEAAIVRDEIKALKAESEVQHDDA

SEQ ID NO: 3443 - DNA, 468 bp, Staphylococcus aureus
gtgatatacatgcacaatatgtctgacatcatagaacaatacatcaaacgtttatttgaagagtcgaatgaagatgtcgttgaaattcagagagcgaatatcgcacagcgttttgattgcgtaccatcacaattaaattatgtaatcaaaacacgattcactaatgaacatggttatgaaatcgaaagtaaacgtggtggtggtggttacatccgaatcactaaaattgaaaataaagatgcaacaggttatattaatcatttgcttcagctgattggaccttctatttctcaacaacaagcttattatattattgatgggcttttagataaaatgttaataaatgaacgtgaagctaaaatgattcaagcagttattgatagagaaacgctatcaatggatatggtttctagagatattattagagcaaatattttaaaacgtttgttaccagttataaattattac

SEQ ID NO: 3444 - protein, 156 aa, Staphylococcus aureus
  MISC_FEATURE (1)..(156): transcription repressor of
VIYMHNMSDIIEQYIKRLFEESNEDVVEIQRANIAQRFDCVPSQLNYVIKTRFTNEHGYEIESKRGGGGYIRITKIENKDATGYINHLLQLIGPSISQQQAYYIIDGLLDKMLINEREAKMIQAVIDRETLSMDMVSRDIIRANILKRLLPVINYY

SEQ ID NO: 3445 - DNA, 264 bp, Staphylococcus aureus
gtgctaggaataattgagtatcaagttcaaggtgagaatgaatttgaaggggcatttatagcaacaaatgaaagattaattatgaatgtagatatgaatggccaattttattatagaagtattagttataatgaaatagagaagatagattatgatggtcaaactataatgttcaaatttaatattggtaatgtcccaatgcatgatattaaaagtgctaacgttgaaatgtttgttgaatatgtaaaacaacatatgatagta

SEQ ID NO: 3446 - protein, 88 aa, Staphylococcus aureus
  MISC_FEATURE (1)..(88): conserved hypothetical
VLGIIEYQVQGENEFEGAFIATNERLIMNVDMNGQFYYRSISYNEIEKIDYDGQTIMFKFNIGNVPMHDIKSANVEMFVEYVKQHMIV

SEQ ID NO: 3447 - DNA, 1212 bp, Staphylococcus aureus
atgcatattctaattgggattatcggaattatcttctttttagcacttgcgtttctatttagctcagacaggaaaaatattcgctggaaatatgtaggaattttacttgcaattcagcttatctttgcatttatcttgcttaaaactacaatgggaatcaaggttattggtggtatttcaaacggttttaactacttattattaaaagcagcagatggtgttaactttgtattcggtggtattcaatatatcgatcctaagcaaccaccattcttcttcagtgtattattacctatcgtatttatttcagcgattatcggtatccttcaatacacaaagattttacctttaatcattaatgttttaggattcttaatttctaaaattaatggtatgggacgtttagaatcatacaatgcagttgctgcagcaattttgggacaatctgaagtatttatttcaattaaaaaacaattaccatacatacctaagcaacgtttatacacattaacagcttcagcaatgtcgactgtttctgcttcaattatcggtgcatactttaccttaattgaacctaaatatgttgtaacggctgttgtcttaaacttatttggtggtttcatcatcgcttcaattattaacccttataaagttaatgaagaagatgacaaattattagttgaagaaactgaagaaagacaacaatcattcttcgaaatgctaggagaatatattttagatggatttaaagtagctgtcattgtaggcgcaatgttaatcggatacattgccattatcgctctattaaatggaattgtaagcaatatctttagtacagtttcaggtggcgctatttcttgggatttccaaacattaattggttttgtctttgcaccatttgcattcttagtcggtgtgccatggcaagatgcagttcaagccggttcagttatggcgacaaaactattatctaacgaatttgtagcaatgcaagcacttggtaaacttagtgatttatctgaacacgcaaaaggtgttacatctgtattcttagtatcatttgctaactttagctctatcggtattatttcaggtgcgattaaatcacttaatgacaaaaaaggagatacagttgcccgctttggtttgaaattattattcggtgcaacactagtatctttcatttcagctgcaatcgctggattctttatt

SEQ ID NO: 3448 - protein, 404 aa, Staphylococcus aureus
  MISC_FEATURE (1)..(404): pyrimidine nucleoside
MHILIGIIGIIFFLALAFLFSSDRKNIRWKYVGILLAIQLIFAFILLKTTMGIKVIGGISNGFNYLLLKAADGVNFVFGGIQYIDPKQPPFFFSVLLPIVFISAIIGILQYTKILPLIINVLGFLISKINGMGRLESYNAVAAAILGQSEVFISIKKQLPYIPKQRLYTLTASAMSTVSASIIGAYFTLIEPKYVVTAVVLNLFGGFIIASIINPYKVNEEDDKLLVEETEERQQSFFEMLGEYILDGFKVAVIVGAMLIGYIAIIALLNGIVSNIFSTVSGGAISWDFQTLIGFVFAPFAFLVGVPWQDAVQAGSVMATKLLSNEFVAMQALGKLSDLSEHAKGVTSVFLVSFANFSSIGIISGAIKSLNDKKGDTVARFGLKLLFGATLVSFISAAIAGFFI

SEQ ID NO: 3449 - DNA, 558 bp, Staphylococcus aureus
atgaaaataggtgtattagcattacaaggtgcagtacgtgaacatattagacatattgaattaagtggtcatgaaggtattgcagttaaaaaagttgaacaattagaagaaatcgagggcttaatattacctggtggcgagtctacaacgttacgtcgattaatgaatttatatggatttaaagaggctttacaaaattcaactttacctatgtttggtacatgcgcaggattaatagttctagcgcaagatatagttggtgaagaaggataccttaacaagttgaatattactgtacaacgaaactcattcggtagacaagttgacagctttgaaacagaattagatattaaaggtatcgctacagatattgaaggtgtctttataagagccccacatattgaaaaagtaggtcaaggcgtagatatcctatgtaaggttaatgagaaaattgtagctgttcagcaaggtaaatatttaggcgtatcattccatcctgaattaacagatgactatagagtaactgattactttattaatcatattgtaaaaaaagca

SEQ ID NO: 3450 - protein, 186 aa, Staphylococcus aureus
  MISC_FEATURE (1)..(186): conserved hypothetical
MKIGVLALQGAVREHIRHIELSGHEGIAVKKVEQLEEIEGLILPGGESTTLRRLMNLYGFKEALQNSTLPMFGTCAGLIVLAQDIVGEEGYLNKLNITVQRNSFGRQVDSFETELDIKGIATDIEGVFIRAPHIEKVGQGVDILCKVNEKIVAVQQGKYLGVSFHPELTDDYRVTDYFINHIVKKA

SEQ ID NO: 3451 - DNA, 885 bp, Staphylococcus aureus
atgagtaaaattattggatcagacagagtcaaaagaggtatggctgaaatgcaaaaaggcggcgttattatggatgtcgttaatgctgagcaagcaagaattgcagaagaagctggcgcggtagcagttatggcattagaacgagtaccttctgatattagagctgctggtggtgttgcacgtatggcaaaccctaaaattgtagaagaagtaatgaatgctgtttctattccagtcatggctaaagcacgtattggtcatatcactgaagcaagagtattagaggcgatgggtgttgactatattgatgaatcagaagtgttaacaccagcagatgaggaatatcacttaagaaaagatcaatttacagtaccatttgtatgtggatgtcgtaatttaggtgaagctgcgcgtagaattggtgaaggtgctgctatgttacgtactaaaggtgaaccaggtacaggtaatattgttgaagctgtaagacatatgagacaagttaattcagaagttagtcgattgactgtaatgaatgatgatgagattatgacttttgcgaaagatatcggtgcgccttatgaaattttaaaacaaattaaagacaatggtcgtttaccggtagttaactttgcagctggtggcgttgcgactcctcaagatgctgctttaatgatggaattaggtgctgacggtgtattcgttggatcaggtatttttaaatcagaagatccagaaaaatttgctaaagcaattgttcaagcaacaacacattaccaagactatgaactaattggaagattagcaagtgaacttggcactgctatgaaaggtttagatatcaatcaattatcattagaagaacgtatgcaagagcgtggttgg

SEQ ID NO: 3452 - protein, 295 aa, Staphylococcus aureus
  MISC_FEATURE (1)..(295): conserved hypothetical
MSKIIGSDRVKRGMAEMQKGGVIMDVVNAEQARIAEEAGAVAVMALERVPSDIRAAGGVARMANPKIVEEVMNAVSIPVMAKARIGHITEARVLEAMGVDYIDESEVLTPADEEYHLRKDQFTVPFVCGCRNLGEAARRIGEGAAMLRTKGEPGTGNIVEAVRHMRQVNSEVSRLTVMNDDEIMTFAKDIGAPYEILKQIKDNGRLPVVNFAAGGVATPQDAALMMELGADGVFVGSGIFKSEDPEKFAKAIVQATTHYQDYELIGRLASELGTAMKGLDINQLSLEERMQERGW

SEQ ID NO: 3453 - DNA, 1380 bp, Staphylococcus aureus
ttgaaaaacactttataccatcaactttatgaaaaattaaaaaaacaaataattgaaggtcaatttaaagaaggcgataaattttattctaaaagacaattaagcaaacatttatctattagccaaacaaccgtagagcatgcatatcaacttctattagacgaaggttacatttattcaagacctcgctctggatattttgtgtccgaaattgaatctttaacaattttaaacaatcaacctatcccctctctttttgatgatgattcatataaaccaaaagcgagtgatgaagcttatgattatgcttttaatttggatgaaatagatacgaaacatttccctatagaacttttcagaaagtattccaaagatctttatgatacaaatcatttaaatcaattacgtagaggacattttcaaggagaattacatttgcggtttcaactggcattttatttatttactaatcgtggcgtaatttgtgatcctaatcaaattataattggctcatctaccgaacaattagtaaatcaattagtcgatttactttatacttcaacatttattatcgaaaaacctagttatccaccaatcaaaaatattttagataaaaaacaagttgaatatgaacaaattgaagttgaagataatggaataaacgtagatgaagttattaaatcacaaaaaaatatagtatatataacgccttcccatcaatttccaactggatatgtgatggacttaaaaaaacgaactcaattaatacaatgggctcaagaaaaagaagaacgatttattatagaagatgattatgattccgagtttagatatttcggcaaacccattccagcaattcaaggtctatattcaagaggagaaaaagtgatttatatcagtacattttcaaagtctatttttcctagctgtcgagttgcatatatggtgttaccctattctataatgaaaaaatatcattctcaaaatcacattgaaggcaacactgtacctgttcatatgcaaaaccttattgcaacgtttatatcttccggtggttttgaaaggcatttaaataaaatgagacgaatttatcgtagaaaactaacctatattttaaaaagattgaaaccttacaaagagcagcttgatattcaaggtgctgaaacgggtatgcattttacaattacagtaaaaaatggattaacattacaagagtgtcttgatagagcaaacaaagtaaagttaaaattacaagtttataattttgatgatgatcaagactataagaaaacccctaaatttatattaggctttggcggtatagacgatgatgctttaaaaccgcatgtagacgctctaataaaatcattaattataaag

SEQ ID NO: 3454 - protein, 460 aa, Staphylococcus aureus
  MISC_FEATURE (1)..(460): hypothetical protein
LKNTLYHQLYEKLKKQIIEGQFKEGDKFYSKRQLSKHLSISQTTVEHAYQLLLDEGYIYSRPRSGYFVSEIESLTILNNQPIPSLFDDDSYKPKASDEAYDYAFNLDEIDTKHFPIELFRKYSKDLYDTNHLNQLRRGHFQGELHLRFQLAFYLFTNRGVICDPNQIIIGSSTEQLVNQLVDLLYTSTFIIEKPSYPPIKNILDKKQVEYEQIEVEDNGINVDEVIKSQKNIVYITPSHQFPTGYVMDLKKRTQLIQWAQEKEERFIIEDDYDSEFRYFGKPIPAIQGLYSRGEKVIYISTFSKSIFPSCRVAYMVLPYSIMKKYHSQNHIEGNTVPVHMQNLIATFISSGGFERHLNKMRRIYRRKLTYILKRLKPYKEQLDIQGAETGMHFTITVKNGLTLQECLDRANKVKLKLQVYNFDDDQDYKKTPKFILGFGGIDDDALKPHVDALIKSLIIK

SEQ ID NO: 3455 - DNA, 96 bp, Staphylococcus aureus
  MISC_FEATURE (1)..(96): n = g, a, t, or c
atgagcaattacacggttaagattaaaaattcagcgaaatcagatttaaagaaaataaaacattcttatttaaagaagtcatttttagaaannnnn

SEQ ID NO: 3456 - protein, 32 aa, Staphylococcus aureus
  MISC_FEATURE (1)..(32): Xaa = any amino acid
  MISC_FEATURE (1)..(32): conserved hypothetical
MSNYTVKIKNSAKSDLKKIKHSYLKKSFLEXX

SEQ ID NO: 3457 - DNA, 255 bp, Staphylococcus aureus
atgattatcactagccctacagaagcgagaaaagatttttatcaattactaaaaaatgttaataataatcacgaaccaatttatattagtggcaataatgccgaaaataatgctgtgattataggtttagaagattggaaaagtatacaagagacaatatatcttgaatctactggtacaatggacaaagtaagagaaagagaaaaagataatagtggtacaacaaatatagatgatattgattgggataatctt

SEQ ID NO: 3458 - protein, 85 aa, Staphylococcus aureus
  MISC_FEATURE (1)..(85): hypothetical protein
MIITSPTEARKDFYQLLKNVNNNHEPIYISGNNAENNAVIIGLEDWKSIQETIYLESTGTMDKVREREKDNSGTTNIDDIDWDNL

SEQ ID NO: 3459 - DNA, 147 bp, Staphylococcus aureus
atgagtttttttaagcggattcctcacaaaattttaaaaatatttaagcctgaaaatgataaagcggtagggaacgtagtgtgttccactgctgatttctttttgagcattataggcggtatgttggaagaaaagaacaaaagtttg

SEQ ID NO: 3460 - protein, 49 aa, Staphylococcus aureus
MSFFKRIPHKILKIFKPENDKAVGNVVCSTADFFLSIIGGMLEEKNKSL

SEQ ID NO: 3461 - DNA, 453 bp, Staphylococcus aureus
ttgaaaaaattatgttcattaattgtagtagcattagtttgtatcattgcattatcagcttgtggtaaagaacaaaccaaaacatatgaaggtgatgttagtggtaaacatgtactaacttctatcacatataaagatgataaagttttaaaacagtctacaatcaacacaattaaatatgacgatctaggtatggataaagacgaagccaaaaagttattcgccaaatctgaaagtattttcaaagaccttaaaggcgtaaaatacaaagtagactataaagataaaaaagcaattgaacacttagacatagattacacagaagttgacatgaaaaaattaaataaacgtcttggtgtttcgactaaagaaaataaagatattagttttgaaaaacttgaaaagcaattaaagcacagaggtttaaaagaaaaagataaaatggacgacaaa

SEQ ID NO: 3462 - protein, 151 aa, Staphylococcus aureus
  MISC_FEATURE (1)..(151): conserved hypothetical
LKKLCSLIVVALVCIIALSACGKEQTKTYEGDVSGKHVLTSITYKDDKVLKQSTINTIKYDDLGMDKDEAKKLFAKSESIFKDLKGVKYKVDYKDKKAIEHLDIDYTEVDMKKLNKRLGVSTKENKDISFEKLEKQLKHRGLKEKDKMDDK

SEQ ID NO: 3463 - DNA, 1593 bp, Staphylococcus aureus
ttggggggaggtattgtaatgacgtttcttacagtcatgcaatttatagttaacattatcgttgtaggattcatgcttacggttattgttatcgggcttatttggttaattaaagataaaagacaatcacaacatagtgtattaaggaattatcctttactagcacgtattagatatatttcagaaaaaatgggaccggaattacgtcagtatttattttctggggataatgaagggaaacctttttcacgtaatgattataaaaatatcgttttggctggaaaatataactctcgtatgaccagcttcggtactactaaagattatcaagacggcttttacatacagaacacaatgtttccgatgcaacgtaatgagatttcagtagataatacaacattgttatcaacattcatttataaaatcgcgaatgagcgtttatttagtcgtgaagaatatcgtgtgccgacaaagattgatccgtattacttaagtgatgaccatgcaataaaattaggtgaacatttaaaacatccatttattttaaaacgtatcgtaggacaatctggtatgagttatggcgctttaggaaaaaatgccattacagctttatctaaaggtctagctaaagcgggcacttggatgaatacaggtgaaggtggcttatcagaatatcatttaaaaggtaatggggatatcattttccaaattggtcccggtttatttggtgttcgtgataaagaaggtaattttagtgaaggtttatttaaagaggttgcacagttatctaacgtacgcgcatttgagctgaagttggcacaaggtgctaagactcgtggtggtcatatggaagctgaaaaggtaaacgaagaaattgctaaaatccgaaatgttgaaccttataaaacaatcaattcacctaaccgttacgaatttattcataatgctgaagatttgattcgtttcgtcgatcagttgcagcaattaggtcaaaaaccagtaggattcaaaattgtagtaagcaaagtttcagaaattgaaacacttgtacgtacgatggtggaactagataagtatccaagctttattacgattgatggtggtgaaggtggtactggtgcaacattccaagaattacaagatggtgttggcttaccgctatttacagctctacctattgtgtctggcatgttagaaaaatatggtattcgagataaagtgaaattggcggcatctggtaagttagtgacaccagataaaattgcgattgcactaggtttaggtgcagattttgtaaatatcgcacgtgggatgatgattagtgtcggttgtataatgagtcaacaatgtcacatgaatacgtgtcctgtaggtgttgcaacgacagatgcgaagaaagaaaaagcattgattgttggagaaaagcaatatcgtgtcacaaactatgtaacaagtttgcatgaaggcttattcaatattgcagcagctgttggcgtatccagtcctacagaaattactgctgatcatattgtatatcgaaaagtcgatggtgagttacaaacgatacatgattataaattaaaactcattagt

SEQ ID NO: 3464 - protein, 531 aa, Staphylococcus aureus
  MISC_FEATURE (1)..(531): hypothetical protein
LGGGIVMTFLTVMQFIVNIIVVGFMLTVIVIGLIWLIKDKRQSQHSVLRNYPLLARIRYISEKMGPELRQYLFSGDNEGKPFSRNDYKNIVLAGKYNSRMTSFGTTKDYQDGFYIQNTMFPMQRNEISVDNTTLLSTFIYKIANERLFSREEYRVPTKIDPYYLSDDHAIKLGEHLKHPFILKRIVGQSGMSYGALGKNAITALSKGLAKAGTWMNTGEGGLSEYHLKGNGDIIFQIGPGLFGVRDKEGNFSEGLFKEVAQLSNVRAFELKLAQGAKTRGGHMEAEKVNEEIAKIRNVEPYKTINSPNRYEFIHNAEDLIRFVDQLQQLGQKPVGFKIVVSKVSEIETLVRTMVELDKYPSFITIDGGEGGTGATFQELQDGVGLPLFTALPIVSGMLEKYGIRDKVKLAASGKLVTPDKIAIALGLGADFVNIARGMMISVGCIMSQQCHMNTCPVGVATTDAKKEKALIVGEKQYRVTNYVTSLHEGLFNIAAAVGVSSPTEITADHIVYRKVDGELQTIHDYKLKLIS

SEQ ID NO: 3465 - DNA, 1164 bp, Staphylococcus aureus
atgaataaacagatttttgtcttatattttaatattttcttgatttttttaggtatcggtttagtaataccagtcttgcctgtttatttaaaagatttgggattaactggtagtgatttaggattactagttgctgcttttgcgttatctcaaatgattatatcgccgtttggtggtacgctagctgacaaattagggaagaaattaattatatgtataggattaattttgttttcagtgtcagaatttatgtttgcagttggccacaatttttcggtattgatgttatcgagagtgattggtggtatgagtgctggtatggtaatgcctggtgtgacaggtttaatagctgacatttcaccaagccatcaaaaagcaaaaaactttggctacatgtcagcgattatcaattctggattcattttaggaccagggattggtggatttatggcagaagtttcacatcgtatgccattttactttgcaggagcattaggtattctagcatttataatgtcaattgtattgattcacgatccgaaaaagtctacgacaagtggtttccaaaagttagagccacaattgctaacgaaaattaactggaaagtgtttattacaccagttattttaacacttgtattatcgtttggtttatctgcatttgaaacattgtattcactatacacagctgacaaggtaaattattcacctaaagatatttcgattgctattacgggtggcggtatatttggggcacttttccaaatctatttcttcgataaatttatgaagtatttctcagagttaacatttatagcttggtcattattatattcagttgttgtcttaatattattagtttttgctaatgactattggtcaataatgttaatcagttttgttgtcttcataggttttgatatgatacgaccagccattacaaattatttttctaatattgctggagaaaggcaaggctttgcaggcggattgaactcgacattcactagtatgggtaatttcataggtcctttaatcgcaggtgcgttatttgatgtacacattgaagcaccaatttatatggctataggtgtttcattagcaggtgttgttattgttttaattgaaaagcaacatagagcaaaattgaaagaacaaaatatg

SEQ ID NO: 3466 - protein, 388 aa, Staphylococcus aureus
  MISC_FEATURE (1)..(388): quinolone resistance
MNKQIFVLYFNIFLIFLGIGLVIPVLPVYLKDLGLTGSDLGLLVAAFALSQMIISPFGGTLADKLGKKLIICIGLILFSVSEFMFAVGHNFSVLMLSRVIGGMSAGMVMPGVTGLIADISPSHQKAKNFGYMSAIINSGFILGPGIGGFMAEVSHRMPFYFAGALGILAFIMSIVLIHDPKKSTTSGFQKLEPQLLTKINWKVFITPVILTLVLSFGLSAFETLYSLYTADKVNYSPKDISIAITGGGIFGALFQIYFFDKFMKYFSELTFIAWSLLYSVVVLILLVFANDYWSIMLISFVVFIGFDMIRPAITNYFSNIAGERQGFAGGLNSTFTSMGNFIGPLIAGALFDVHIEAPIYMAIGVSLAGVVIVLIEKQHRAKLKEQNM

SEQ ID NO: 3467 - DNA, 420 bp, Staphylococcus aureus
atgaaattgcaaaaaagtaatcatactatactactagtgttggaaaaaggagaagatatcgttgaatgtataacaacctttgcagatgaccaagacttaacatttacatctgtcagcggcattggtgcatgtgatgacgttgtattaaaatttttcaatttaacaacgaaacaatacgaagaaaaacatattactgagccactggaattgacgagcttattaggtaatatttctcgtctagacaatggtcattttgcacatttgcatgctactttcggtactcaatcatatgaaacttttagcggacatctcgctaaagcaattgtttctgcaactgctgaaatcattcttactgtaactgatttggacattcaacgttcattcaaagatgcagtcggtttaaatttacttgatcctcaa

SEQ ID NO: 3468 - protein, 140 aa, Staphylococcus aureus
  MISC_FEATURE (1)..(140): conserved hypothetical
MKLQKSNHTILLVLEKGEDIVECITTFADDQDLTFTSVSGIGACDDVVLKFFNLTTKQYEEKHITEPLELTSLLGNISRLDNGHFAHLHATFGTQSYETFSGHLAKAIVSATAEIILTVTDLDIQRSFKDAVGLNLLDPQ

SEQ ID NO: 3469 - DNA, 747 bp, Staphylococcus aureus
atgtcaaatacaaataaacattacatagaagaagaatacgctaccgaacaatcgcgttttttcaaacgtgatattggatttattttcctttacatatttttggttaacatcttgccgatcattatcgtctttttaacttttgggttagtagctgtattcactcaacaagctccgtggggtttctcttttcctatttcaatgaacattagctatttactcgcagttattatttcactagctatttttcgtctgatgcatgaagatgcgtttattccaatgatacgttcgcaaatcgttgctagtgctaaatataaatggcatattcttatatcatttacactaagtgtcgtactctttttacttttaaatcatttcaatattttcgcactaaatgtagattcctttactgtctttgacatttacccgctcattaaagggtatggttccatcagtttaatagctatattttcgttaaccattatattaaatactttgatttgtcaacttattttccgtcatattttaattcaagaattaagcagattaatacctttaaagattacaatagtattgtccattatccttgaaactctgttctactatccatacattaatacatggtgggaattcattccagcattgatactagcaggtagtgcgacttacttatatttaaaatcataccgtaattttatggtgagctatttctatcaattagcagttatactcgttttgcatattttcatg

SEQ ID NO: 3470 - protein, 249 aa, Staphylococcus aureus
  MISC_FEATURE (1)..(249): hypothetical protein
MSNTNKHYIEEEYATEQSRFFKRDIGFIFLYIFLVNILPIIIVFLTFGLVAVFTQQAPWGFSFPISMNISYLLAVIISLAIFRLMHEDAFIPMIRSQIVASAKYKWHILISFTLSVVLFLLLNHFNIFALNVDSFTVFDIYPLIKGYGSISLIAIFSLTIILNTLICQLIFRHILIQELSRLIPLKITIVLSIILETLFYYPYINTWWEFIPALILAGSATYLYLKSYRNFMVSYFYQLAVILVLHIFM

SEQ ID NO: 3471 - DNA, 1191 bp, Staphylococcus aureus
atgaaaggtgcaatggcttggccctttttgagattatatatattaacattgatgttctttagtgccaatgcaatcttaaacgtgtttatacctttacgagggcatgatttaggcgcaacgaatacggttatcggtatcgttatgggggcatacatgttaacagcaatggtatttcgaccatgggcaggacaaattattgctcgtgtcggtcccattaaagtattaagaattattttgattatcaatgccatagctttaattatttatggttttactggcttagaaggttatttcgtagcacgtgttatgcaaggtgtgtgtacggcattcttttctatgtctttacagctaggtattattgatgcattaccagaggaacatcgttctgaaggtgtatcattgtactcgctattttcaacgattccaaacttaatcggaccattagttgccgtaggtatttggaatgcaaataatatttcactatttgcaattgtcattatctttatcgcattaacaacaacattctttggctatcgcgtgacctttgctgaacaggaacccgatacgtcagataagattgaaaaaatgccgtttaacgctgtaactgtttttgcgcaatttttcaaaaataaagagttgttgaacagtggtattatcatgattgttgcatcgattgtatttggtgcagttagtacatttgtaccgttatacacagtgagtttaggattcgcgaatgcgggaatctttttgacaatacaggccatcgcagttgttgcggcaagattttacttaaggaaatacattccgtcagatggtatgtggcatcctaaatatatggtatctgtactatcattattagtaatcgcgtcatttgtagtggcatttggtccgcaagtaggtgcaattattttctatggtagtgcgatattaataggaatgacgcaagcaatggtgtacccaacattaacatcatacttaagcttcgtcttaccaaaagtaggtcgtaatatgttgttaggtttatttattgcctgtgcagacttaggtatatcgttaggtggcgcattgatgggacctatttccgatttagtaggatttaaatggatgtatctaatttgtggtatgttagtcattgtaataatgattatgagtttcttgaaaaagccaacaccacgtccagcgagtagtctt

SEQ ID NO: 3472 - protein, 397 aa, Staphylococcus aureus
  MISC_FEATURE (1)..(397): hypothetical protein
MKGAMAWPFLRLYILTLMFFSANAILNVFIPLRGHDLGATNTVIGIVMGAYMLTAMVFRPWAGQIIARVGPIKVLRIILIINAIALIIYGFTGLEGYFVARVMQGVCTAFFSMSLQLGIIDALPEEHRSEGVSLYSLFSTIPNLIGPLVAVGIWNANNISLFAIVIIFIALTTTFFGYRVTFAEQEPDTSDKIEKMPFNAVTVFAQFFKNKELLNSGIIMIVASIVFGAVSTFVPLYTVSLGFANAGIFLTIQAIAVVAARFYLRKYIPSDGMWHPKYMVSVLSLLVIASFVVAFGPQVGAIIFYGSAILIGMTQAMVYPTLTSYLSFVLPKVGRNMLLGLFIACADLGISLGGALMGPISDLVGFKWMYLICGMLVIVIMIMSFLKKPTPRPASSL

SEQ ID NO: 3473 - DNA, 756 bp, Staphylococcus aureus
gtgatgtacatgattaaaattaaagatgttgaaaagtcatatcaaagcgcacatgtttttaagcgtcgtcgaacacctatcgtgaaaggtgtgtcatttgagtgtccaatcggtgcgacgattgcgattatcggagaaagtggtagcggtaaatcgacgttgagtcgtatgatattaggtattgagaaaccggataaaggttgtgtaaccttaaatgatcaaccgatgcataagaagaaagtgagacgtcatcaaattggtgctgtatttcaagattatacgtcatcattacatccatttcagactgttagagaaatcttatttgaagtgatgtgtcaatgtgatggacaacctaaagaagttatggaagtccaagcaattacattgttggaagaagtcggtctatctaaggcatacatggataaatatcctaatatgttatcaggtggagaggcgcaacgtgttgcgattgcgcgtgcaatatgtattaaccctaaatatattttgtttgatgaagccattagttcactcgacatgtcaattcaaacacaaatattagatttattgattcatttacgtgaaacgcgtcagttgagttatatttttatcacacatgatattcaagctgccacgtatttatgtgatcaattaattatttttaaaaacggaaaaatagaagaacaaattccgacaagcgcattgcataaaagtgacaatgcttatacaagagaattaatagaaaaacaactatcattc

SEQ ID NO: 3474 - protein, 252 aa, Staphylococcus aureus
  MISC_FEATURE (1)..(252): oligopeptide transporter
VMYMIKIKDVEKSYQSAHVFKRRRTPIVKGVSFECPIGATIAIIGESGSGKSTLSRMILGIEKPDKGCVTLNDQPMHKKKVRRHQIGAVFQDYTSSLHPFQTVREILFEVMCQCDGQPKEVMEVQAITLLEEVGLSKAYMDKYPNMLSGGEAQRVAIARAICINPKYILFDEAISSLDMSIQTQILDLLIHLRETRQLSYIFITHDIQAATYLCDQLIIFKNGKIEEQIPTSALHKSDNAYTRELIEKQLSF

SEQ ID NO: 3475 - DNA, 813 bp, Staphylococcus aureus
atgacattgttaacagttaaacatttgacgattacagatacctggacagatcaaccactcgtgagtgatgtgaattttacattaactaagggtgaaactttaggcgttattggagaaagtggtagtggtaaatcaatcacttgtaaatcgattattggtttgaatcccgaacgactcggggtgacaggtgaaattatctttgatggtacatcaatgttgtcattatctgaatcgcaattgaaaaagtaccgtggtaaagacattgcgatggtcatgcaacaaggtagtcgtgcctttgacccatcaactactgtcggtaaacaaatgtttgagactatgaaagtacatacgtcaatgtctacacaagaaattgaaaagacattgattgaatatatggattatttaagtttgaaagatcctaaacgtatattaaaatcatacccttacatgttatcaggaggaatgttacagcgattgatgattgctttagcgttagctttgaaaccaaagttaatcattgctgatgagccgacaacggctttagatacaattacacaatatgatgtactggaagcatttatagatattaaaaaacactttgactgtgcgatgattttcatttcacatgatttaacggttattaacaagattgcagaccgtgttgttgtgatgaaaaatggtcagcttattgaacaagggacacgtgaatcagtcttgcatcatccagaacatgtttatacgaagtatttattatcaacgaagaagaagattaatgatcattttaaacatgtgatgaggggtgatgtacatgat

SEQ ID NO: 3476 - protein, 271 aa, Staphylococcus aureus
  MISC_FEATURE (1)..(271): oligopeptide transporter
MTLLTVKHLTITDTWTDQPLVSDVNFTLTKGETLGVIGESGSGKSITCKSIIGLNPERLGVTGEIIFDGTSMLSLSESQLKKYRGKDIAMVMQQGSRAFDPSTTVGKQMFETMKVHTSMSTQEIEKTLIEYMDYLSLKDPKRILKSYPYMLSGGMLQRLMIALALALKPKLIIADEPTTALDTITQYDVLEAFIDIKKHFDCAMIFISHDLTVINKIADRVVVMKNGQLIEQGTRESVLHHPEHVYTKYLLSTKKKINDHFKHVMRGDVHD

SEQ ID NO: 3477 - DNA, 867 bp, Staphylococcus aureus
atgataattttaaaacgattattacaagataaaggtgcagtaattgctttaggcattattgtattatatgtctttttaggattagcagcaccacttgtgacattttatgatcctaaccatatcgatacagcaaacaaatttgctggcatgagttttcaacatctactaggtactgaccatttaggtagagatattttaactaggttaatttatgcgattagaccaagtttgttatatgtctttgttgcgctatttgtttctgtacttattggatctattttaggattcttatcaggatatttccaagggtttgttgacgccttaatcatgcgtgcgtgtgatgttatgttggcattcccaagttatgttgtaacgttagcattaattgcattgtttggaatgggtgccgaaaatattatcatggcatttattttgacgcgttgggcatggttctgtcgtgttatacgtacaagtgttatgcagtacactgcttctgaccatgtaagatttgctaaaacaatcggtatgaatgatatgaaaattattcacaaacatattatgccattaacattagcagatattgctatcatctctagtagctcgatgtgttcaatgatcttgcaaatatctggcttttcatttttaggattaggtgtcaaagcgcctactgcagagtggggcatgatgcttaacgaagctagaaaagtgatgtttacacatcctgaaatgatgtttgcgccaggtattgccatagtgattatagtgatggcatttaacttcttatccgatgctttacaaattgctattgatccccgcatctcttctaaagataaacttcgttctgtgaaaaaaggagtggtgcaatca

SEQ ID NO: 3478 - protein, 289 aa, Staphylococcus aureus
  MISC_FEATURE (1)..(289): oligopeptide transporter
MIILKRLLQDKGAVIALGIIVLYVFLGLAAPLVTFYDPNHIDTANKFAGMSFQHLLGTDHLGRDILTRLIYAIRPSLLYVFVALFVSVLIGSILGFLSGYFQGFVDALIMRACDVMLAFPSYVVTLALIALFGMGAENIIMAFILTRWAWFCRVIRTSVMQYTASDHVRFAKTIGMNDMKIIHKHIMPLTLADIAIISSSSMCSMILQISGFSFLGLGVKAPTAEWGMMLNEARKVMFTHPEMMFAPGIAIVIIVMAFNFLSDALQIAIDPRISSKDKLRSVKKGVVQS

SEQ ID NO: 3479 - DNA, 933 bp, Staphylococcus aureus
atgttcaaatttatcttaaaacgtattgcgctcatgtttccattgatgattgtagtaagttttatgacatttctattgacgtatattacaaatgaaaatccagctgtgacaattttacatgcacaagggacgccaaatgtaacaccagagttgattgcagaaacgaatgagaagtacggtttcaatgatccattattaattcaatataaaaattggttacttgaagcgatgcaatttaattttggtacaagctacattacaggtgacccagttgctgaacgtattggtccagcatttatgaatacattgaaattaacaataatttcaagtgttatggtgatgattacatcaattattttaggtgtagttagtgcattaaaaagaggaaagttcactgatcgtgcgatacgttcagtggctttctttctaactgcattaccatcatattggatagcttcaatacttattatttacgtttcagtgaagttaaacatattgccgacttctggattaacaggtccagaaagttacatattgccagtgatcgttattacgattgcctatgctggtatttactttagaaatgttagacgctcgatggtggaacaattaaatgaagattatgtactttatttaagagcaagcggtgtgaaatctatcacattaatgttgcatgtgttgcgtaatgctttacaagttgcggtatcaatcttttgtatgtctataccaatgataatgggtggactagttgttatcgagtatatctttgcatggcctggactaggtcaattaagtttaaaagcaatacttgaacacgattttccagtcattcaagcatatgtattaattgtagcggtattatttattgtatttaatacattagcagatatcattaatgcgctattaaatccaagattaagggagggcgcacga

SEQ ID NO: 3480 - protein, 311 aa, Staphylococcus aureus
  MISC_FEATURE (1)..(311): oligopeptide transporter
MFKFILKRIALMFPLMIVVSFMTFLLTYITNENPAVTILHAQGTPNVTPELIAETNEKYGFNDPLLIQYKNWLLEAMQFNFGTSYITGDPVAERIGPAFMNTLKLTIISSVMVMITSIILGVVSALKRGKFTDRAIRSVAFFLTALPSYWIASILIIYVSVKLNILPTSGLTGPESYILPVIVITIAYAGIYFRNVRRSMVEQLNEDYVLYLRASGVKSITLMLHVLRNALQVAVSIFCMSIPMIMGGLVVIEYIFAWPGLGQLSLKAILEHDFPVIQAYVLIVAVLFIVFNTLADIINALLNPRLREGAR

SEQ ID NO: 3481 - DNA, 1596 bp, Staphylococcus aureus
atgagaaaactaactaaaatgagtgcaatgttacttgcatcagggctaattttaactggttgtggcggtaataaaggtttagaggagaaaaaagaaaacaagcaattaacgtatacgacggttaaagatatcggtgatatgaatccgcatgtttacggtggatcaatgtctgctgaaagtatgatatacgagccgcttgtacgtaacacgaaagatggtattaagcctttactagctaaaaagtgggatgtgtctgaagatgggaagacatacacgttccatttgagagatgacgttaaattccatgatggtacgccatttgatgctgacgcagttaagaaaaatattgacgcagttcaagaaaacaaaaaattgcattcttggttaaagatttcgacattaattgacaatgttaaagttaaagataagtacacggttgaattgaatttgaaagaagcatatcaacctgcattggctgaattagcgatgcctcgtccatatgtatttgtgtctccaaaagactttaaaaacggtacaacaaaagatggcgttaaaaagttcgatggtactggtccatttaaattaggtgaacacaaaaaagatgagtctgcagactttaacaaaaatgatcaatactggggcgaaaagtctaaacttaacaaagtacaagcaaaagtaatgcctgctggtgaaacagcattcctatcaatgaaaaaaggtgaaacgaactttgccttcacagatgatagaggtacagatagcttagacaaagactctttaaaacaattgaaagatacaggtgactatcaagttaagcgtagtcaacctatgaatacgaaaatgttagttgtcaattctggtaaaaaagataacgctgtgagtgacaaaacagtcagacaagcgattggtcatatggtaaacagagataaaattgccaaagaaattttagatggtcaagaaaaaccagcaactcaattatttgcgaaaaatgtaacagacattaatttcgatatgccaacacgtaagtatgaccttaaaaaagcagaatcattattagatgaagctggttggaagaaaggtaaagacagcgatgttcgtcaaaaagatggtaaaaaccttgaaatggcaatgtactatgacaaaggttcttcaagtcaaaaagaacaagcagaatacttacaagcagaatttaagaaaatgggtattaagttaaacatcaatggcgaaacatcagataaaattgctgaacgtcgtacttctggtgattatgacttaatgttcaaccaaacttggggattattgtacgatccacaaagtactattgcagcatttaaagagaaaaatggttatgaaagtgcaacatcaggcattgagaacaaagataaaatatacaacagcattgatgacgcatttaaaatccaaaacggtaaagagcgttcagacgcttataaaaacattttgaaacaaattgatgatgaaggtatctttatccctatttcacacggtagtatgacagttgttgcaccaaaagatttagaaaaagtatcattcacacaatcacagtatgaattaccattcaatgaaatgcagtataaa

SEQ ID NO: 3482 - protein, 532 aa, Staphylococcus aureus
  MISC_FEATURE (1)..(532): oligopeptide transporter
MRKLTKMSAMLLASGLILTGCGGNKGLEEKKENKQLTYTTVKDIGDMNPHVYGGSMSAESMIYEPLVRNTKDGIKPLLAKKWDVSEDGKTYTFHLRDDVKFHDGTPFDADAVKKNIDAVQENKKLHSWLKISTLIDNVKVKDKYTVELNLKEAYQPALAELAMPRPYVFVSPKDFKNGTTKDGVKKFDGTGPFKLGEHKKDESADFNKNDQYWGEKSKLNKVQAKVMPAGETAFLSMKKGETNFAFTDDRGTDSLDKDSLKQLKDTGDYQVKRSQPMNTKMLVVNSGKKDNAVSDKTVRQAIGHMVNRDKIAKEILDGQEKPATQLFAKNVTDINFDMPTRKYDLKKAESLLDEAGWKKGKDSDVRQKDGKNLEMAMYYDKGSSSQKEQAEYLQAEFKKMGIKLNINGETSDKIAERRTSGDYDLMFNQTWGLLYDPQSTIAAFKEKNGYESATSGIENKDKIYNSIDDAFKIQNGKERSDAYKNILKQIDDEGIFIPISHGSMTVVAPKDLEKVSFTQSQYELPFNEMQYK

SEQ ID NO: 3483 - DNA, 1299 bp, Staphylococcus aureus
atgtctaaattattaatgataggcactggtccggtcgcaatccaattagcgaatatttgctatttaaaatcagattatgagattgatatggttggacgtgcctcaacatcagaaaaatcaaaacgcttatatcaagcgtataaaaaagagaaacaatttgaagtcaaaatacaaaacgaggcgcatcaacatctggaaggtaagtttgaaattaatcgtttgtataaagatgttaaaaacgttaagggtgaatacgaaacggttgtcatggcatgcacagcagatgcttattatgacacactacagcaattgtcgttagaaactttgcaaagtgtcaaacatgtcattttaatatcaccgacatttggttcgcaaatgattgtcgaacaatttatgtctaaatttaataaagatatcgaagtgatttcattctcaacttatcttggcgatacacgtattgttgataaagaagcgcctaatcatgtgttgacaacaggtgtaaaaaagaaattgtacatgggatcgacacattcaaactcaacaatgtgtcaacgaatctctgctttagctgagcaattgaagattcaattagaagtcgttgaatcgccactgcatgctgaaacgcgaaacagttcgctttatgtgcacccaccactatttatgaatgacttttcattgaaagccattttcgaaggaacagatgtaccggtttatgtgtataagttatttcctgaaggaccgataacgatgacactaatccgtgaaatgcgtttaatgtggaaggaaatgatggttattttacaagcatttagagtgccgtcagtcaacctgcttcaatttatggtgaaggaaaattatccagtacgtcctgaaactttggatgaaggtgatattgagcatttcgaaatcttgccagatatcttacaagaatatctgctttatgtaagatataccgcaatcctcattgatccattttcacagccagacgaaaacggacattactttgatttttcagctgtaccatttaagcaagtctataaaaatgaacaggatgttgttcaaattccaagaatgccaagtgaagattattacagaacggcgatgattcagcatattgggaaaatgctaggtatcaaaacgccaatgattgatcagttcctaactcgctatgaagcaagttgccaggcgtacaaggatatgcatcaagatcaacacttatcttctcaatttaatacaaatctatttgaaggagataaagcactcgtcacaaaatttttggaaatcaatagaacgctttca

SEQ ID NO: 3484 - protein, 433 aa, Staphylococcus aureus
  MISC_FEATURE (1)..(433): conserved hypothetical
MSKLLMIGTGPVAIQLANICYLKSDYEIDMVGRASTSEKSKRLYQAYKKEKQFEVKIQNEAHQHLEGKFEINRLYKDVKNVKGEYETVVMACTADAYYDTLQQLSLETLQSVKHVILISPTFGSQMIVEQFMSKFNKDIEVISFSTYLGDTRIVDKEAPNHVLTTGVKKKLYMGSTHSNSTMCQRISALAEQLKIQLEVVESPLHAETRNSSLYVHPPLFMNDFSLKAIFEGTDVPVYVYKLFPEGPITMTLIREMRLMWKEMMVILQAFRVPSVNLLQFMVKENYPVRPETLDEGDIEHFEILPDILQEYLLYVRYTAILIDPFSQPDENGHYFDFSAVPFKQVYKNEQDVVQIPRMPSEDYYRTAMIQHIGKMLGIKTPMIDQFLTRYEASCQAYKDMHQDQHLSSQFNTNLFEGDKALVTKFLEINRTLS

SEQ ID NO: 3485 - DNA, 816 bp, Staphylococcus aureus
atgaataactttaataatgaaatcaaattgatattacaacaatatttagaaaagtttgaagcgcattacgagcgtgtattacaagacgatcaatatatcgaagcattagaaacattgatggatgactatagtgaatttattttaaatcctatttatgaacaacaatttaatgcttggcgtgacgttgaagaaaaagcacaattaataaaatcactgcaatatattacagcgcagtgtgttaaacaagtggaagtcattagagcgagacgtctattagacggacaggcgtctaccacaggttactttgacaatatagaacattgtattgatgaagagtttggacaatgtagtatagctagcaatgacaaattattgttagttggttcaggtgcatatccaatgacgttaattcaagtagcaaaagaaacaggtgcttcagttatcggtattgatattgatccacaagccgttgacctagggcgcagaatcgttaacgtcttagcaccaaatgaagatataacaattacggatcaaaaggtatctgaacttaaagatatcaaagatgtgacgcatatcatattcagctcgacaattcctttaaagtacagcattttagaagaattatatgatttaacaaatgaaaatgtcgtagttgcaatgcgctttggtgatggcatcaaagcaatatttaattatccgtcacaagaaacagcggaagataagtggcaatgtgtgaataaacatatgagaccacagcaaatttttgatatagcactttataaaaaagcagctataaaggtaggtattacggatgtc

SEQ ID NO: 3486 - protein, 272 aa, Staphylococcus aureus
  MISC_FEATURE (1)..(272): conserved hypothetical
MNNFNNEIKLILQQYLEKFEAHYERVLQDDQYIEALETLMDDYSEFILNPIYEQQFNAWRDVEEKAQLIKSLQYITAQCVKQVEVIRARRLLDGQASTTGYFDNIEHCIDEEFGQCSIASNDKLLLVGSGAYPMTLIQVAKETGASVIGIDIDPQAVDLGRRIVNVLAPNEDITITDQKVSELKDIKDVTHIIFSSTIPLKYSILEELYDLTNENVVVAMRFGDGIKAIFNYPSQETAEDKWQCVNKHMRPQQIFDIALYKKAAIKVGITDV

SEQ ID NO: 3487 - DNA, 618 bp, Staphylococcus aureus
ttgatgcaatctcgatacatcgctagaatttactttttaattttatttatcgtctccctttttgagactaaaatttttcaatttatgactttaaatttgtttttagcatatataccttttgagcttagtctattattacgattattcaaaccgaataaaaagtatgaatggccactctttatcatatatagttttatatttgtgttacttttaccaaatacattttatatggtaactgatttaatccatttgaaccaatttcaattcaacttttacgcaggactaaatttaagtgagtggaaatactttacctatttactgcttggtgtcttcttagcggtttatgtgatgattttaatctattttgaaatactaacattgacttctcaccgttggcttaatagattaattgttgtcgtgctaatgtttttaaatggattcggaatttatattggtcgtttcttacgcttacattccgtttatttctttaatgagcccttacatgttctaaatcacattctagaaagtctaacgcttaaaactgctatgtttgtatgttttatggttgtcatgcaagcagcaattctattatttggaaaaggagtgcgtttgaacaag

SEQ ID NO: 3488 - protein, 206 aa, Staphylococcus aureus
  MISC_FEATURE (1)..(206): conserved hypothetical
LMQSRYIARIYFLILFIVSLFETKIFQFMTLNLFLAYIPFELSLLLRLFKPNKKYEWPLFIIYSFIFVLLLPNTFYMVTDLIHLNQFQFNFYAGLNLSEWKYFTYLLLGVFLAVYVMILIYFEILTLTSHRWLNRLIVVVLMFLNGFGIYIGRFLRLHSVYFFNEPLHVLNHILESLTLKTAMFVCFMVVMQAAILLFGKGVRLNK

SEQ ID NO: 3489 - DNA, 819 bp, Staphylococcus aureus
atgaatcggcaggttatagaattttctaagtataatccttcggggaatatgacgatacttgttcattcaaaacatgatgctagtgaatatgcatctatcgccaatcagttgatggccgcaacacatgtatgctgtgaacaggtaggctttatagaatcaacacaaaatgatgatggtaatgattttcacttagttatgagcggtaatgaattttgcggtaatgcgacgatgtcatatatacatcatttgcaggaaagtcatttgcttaaagaccaacagtttaaggtgaaggtgtctggctgttcggatttagtgcaatgcgcaattcatgattgccaatactatgaagttcaaatgccacaagcccatcgtgttgtgccaacaacaattaatatgggtaatcattcatggaaagcaatagaaattatttatgaaacatatgtacattatgtgattccagttaaacaagtaacaacagaaattcaacatttggttgaagcgtttgtgcgtgagcaacaatggagtcacaaatataaaacagtaggtatgatgctttttgatgaacaacgtcaatttttacagccattaatctatataccagaaattcaaagtttaatttgggaaaatagctgtggttctggtacagcatcaattggggtttttaataattatcaacgtaatgacgcatgcaaagattttacagtacatcagccagggggcagtattttagtgacatcaaagcgatgtcatcaattgggatatcaaacttcaattaaaggacaggttacaactgtagctacaggaaaagcatatatagaa

SEQ ID NO: 3490 - protein, 273 aa, Staphylococcus aureus
  MISC_FEATURE (1)..(273): hypothetical protein
MNRQVIEFSKYNPSGNMTILVHSKHDASEYASIANQLMAATHVCCEQVGFIESTQNDDGNDFHLVMSGNEFCGNATMSYIHHLQESHLLKDQQFKVKVSGCSDLVQCAIHDCQYYEVQMPQAHRVVPTTINMGNHSWKAIEIIYETYVHYVIPVKQVTTEIQHLVEAFVREQQWSHKYKTVGMMLFDEQRQFLQPLIYIPEIQSLIWENSCGSGTASIGVFNNYQRNDACKDFTVHQPGGSILVTSKRCHQLGYQTSIKGQVTTVATGKAYIE

SEQ ID NO: 3491 - DNA, 363 bp, Staphylococcus aureus
atgttaaaagaaaaagaaagttttagattgctatatcaagctataagagagattgcagataaaattggagataatcagttagaaactaattccgttagtttattattattggactttgattttgaacatgaagtatttgatgaattgtatcttgtgattttaaaatatttaaatacagtaagtatagagaacataagtcatagtgagcttttgaatttaatagaaaatacgattccagaagatcgagagattaacacgtttgtaaaaaataaaataataattggctttgctaataattacttccctgaattacaagtattagcaaacgaaataaaatctgatatggctagttcattaaaacaa

SEQ ID NO: 3492 - protein, 121 aa, Staphylococcus aureus
MLKEKESFRLLYQAIREIADKIGDNQLETNSVSLLLLDFDFEHEVFDELYLVILKYLNTVSIENISHSELLNLIENTIPEDREINTFVKNKIIIGFANNYFPELQVLANEIKSDMASSLKQ

SEQ ID NO: 3493 - DNA, 717 bp, Staphylococcus aureus
ttggcggtagacatagctgaagcggtatcggagactgtcgataaaattaaaagtaatggtgacaatgcgaaggcgtataatgtggataatgcaagcgaacaacaagtggtagactttgtgtctgacataaaggaacagtttggaagaatcgatgtgttgtttaataatgccggtgtggataatgcggctgatagaattcatgagtatccaatagatgtgtatgacaagattatgaatgtagatatgcgtgggacatttttaatgacgaaaatgatgttacctttaatgatgaatcaaggtggctctattgttaatacgtcttcattttccggacaagcagcagacttgtatcgctctggatataatgctgcgaaaggtgcagtgattaattttacaaaatcaatcgcaattgagtatggccgtgatagcattcgagccaatgcgattgcaccaggtacaattgaaaccccgttagtagataaactgacaggtacgagtgaggatgatgcaggtaaaacatttagagaaaatcaaaaatggatgactccgctgggacgtttaggtaaaccagaagaagttgctaaattagtagtcttcttagcatctgacgacagttcattcataactggagagacgattcgaattgatggtggtgtgatggcttacacatggcctggcgagatgttaagtgatgattcgtggaagcggacattggaa

SEQ ID NO: 3494 - protein, 239 aa, Staphylococcus aureus
  MISC_FEATURE (1)..(239): hypothetical protein
LAVDIAEAVSETVDKIKSNGDNAKAYNVDNASEQQVVDFVSDIKEQFGRIDVLFNNAGVDNAADRIHEYPIDVYDKIMNVDMRGTFLMTKMMLPLMMNQGGSIVNTSSFSGQAADLYRSGYNAAKGAVINFTKSIAIEYGRDSIRANAIAPGTIETPLVDKLTGTSEDDAGKTFRENQKWMTPLGRLGKPEEVAKLVVFLASDDSSFITGETIRIDGGVMAYTWPGEMLSDDSWKRTLE

SEQ ID NO: 3495 - DNA, 1539 bp, Staphylococcus aureus
ttgatgacatcaaaacatcaacaaaaggggtctatcgtcaatcgtttcttgaatagtgttgaaaaaatcggaaataaattgccagatcctagcgtcttattctttttaatgtgtgtgggcttagccattatgacatgggttatctcattatttaatgtatctgttaagcatccaggtacgcatcaaaccatttatattaaaaatataattagccatgatggatttacgatgataatgaatgatacgattaaaaatttctcagagttcccagcattaggcttagtactagcagtgatgattggtattggtgttgcagagaaaacaggatacttcgataagttaatgatttctgttgtgaatcgcgcaccacgtttcttaattttaccgactattatattaattggtattttaggtagtacagccggcgatgctgcgacaattatcttgccgccgcttgcagcaatgctttttattaaaattggctatcaccctatcgctggactaacgatggcatatgcttccgctgttggaggatttgcagcaaatatagttgttggtatgcaagatgctttggtctattcatttacagaaccggcaacacgtatcgtttcagattctattaaaacaaacgttgctatgaactggtactttatcgcagcgagtgtcgttgtattacttcctacgatattgctagttacaactaagctcattattcctagattaggaaaatatgatgacagtttaatgcatgatgaccatgaagaaacatcttcacatattactgacaaagaagcacatgctttaaaatgggcaaatatcagtttcatagtcacaattattttattaattattacagccattcctgaacatagctttttaagaaatgctaaaacaggcagcttactagacgatgcgccattaattaacggtgtcggattaattattcttgtcgtatttttagtacctggattagtttatgggattttaagcaaagaaattaaaaatacaaaagacttaggtaaaatgttcggcgatgctgtaggatcaatgggaacatttatcgttattgtgttttttgcagcacagctacttgcgtatttaaagtggagtaatttaggaattatcgctgctgttaaaggtgccaaattattagaacatcaaaacggtattgtattgatactaggtattattgtactgagtgcaatggtcaacatgttaatcggaagcgcatcggctaaatggggtattttaggaccgatattcgtaccaatgttaatccttatcggctttcatcccgcattcacacaagtcatttaccgtgtaggcgattcaattaccaatccaattacaccgatgatgccgtacttacctttattattaacttatgcacaaaaatacgataaacgcatgaaactcggagccttactttctagtttaatgccgtattcaatcgcgctaagtattgtatggacagtatttgtcatcatttggttcctattaggtatccctgttggaccaggtggaccgatattcgttaaa

SEQ ID NO: 3496 - protein, 513 aa, Staphylococcus aureus
  MISC_FEATURE (1)..(513): hypothetical protein
LMTSKHQQKGSIVNRFLNSVEKIGNKLPDPSVLFFLMCVGLAIMTWVISLFNVSVKHPGTHQTIYIKNIISHDGFTMIMNDTIKNFSEFPALGLVLAVMIGIGVAEKTGYFDKLMISVVNRAPRFLILPTIILIGILGSTAGDAATIILPPLAAMLFIKIGYHPIAGLTMAYASAVGGFAANIVVGMQDALVYSFTEPATRIVSDSIKTNVAMNWYFIAASVVVLLPTILLVTTKLIIPRLGKYDDSLMHDDHEETSSHITDKEAHALKWANISFIVTIILLIITAIPEHSFLRNAKTGSLLDDAPLINGVGLIILVVFLVPGLVYGILSKEIKNTKDLGKMFGDAVGSMGTFIVIVFFAAQLLAYLKWSNLGIIAAVKGAKLLEHQNGIVLILGIIVLSAMVNMLIGSASAKWGILGPIFVPMLILIGFHPAFTQVIYRVGDSITNPITPMMPYLPLLLTYAQKYDKRMKLGALLSSLMPYSIALSIVWTVFVIIWFLLGIPVGPGGPIFVK

SEQ ID NO: 3497 - DNA, 510 bp, Staphylococcus aureus
atgttatacagaatttcaaattctatccaatattgttcgaagtgtagtatcactggattggtattaaacaatgtaaaggagagattgcaaatgccgtataattacaagaaacaaaatggagagttaatgtctgtaatgagccaaggtgaaaagtttattcatcaatcacccgttaatgatgaacttagtgcattgattaagttattaatttctaaaattaacggttgtcattattgtgttgatatccataaaaaagaattaaaggaattgggtgtaacacaaatgaaaattgatgaagtcttgagttttagacatttagatttatttactgatcaagaaaaagtgacgcttgaatttgcagaaatgttaaattcaatcaaagactttaagaagtttgaaattattgaccggctaaaatcattttatgatgaagaacaaattattgatcttgtctttgttgtaaaccaaattaacggttggaacagattaaatattattagtgatagacta

SEQ ID NO: 3498 - protein, 170 aa, Staphylococcus aureus
  MISC_FEATURE (1)..(170): conserved hypothetical
MLYRISNSIQYCSKCSITGLVLNNVKERLQMPYNYKKQNGELMSVMSQGEKFIHQSPVNDELSALIKLLISKINGCHYCVDIHKKELKELGVTQMKIDEVLSFRHLDLFTDQEKVTLEFAEMLNSIKDFKKFEIIDRLKSFYDEEQIIDLVFVVNQINGWNRLNIISDRL

SEQ ID NO: 3499 - DNA, 417 bp, Staphylococcus aureus
atgtccaaaaaacatgtttttataattattggtgtcatattgtgtatatgtacagtttctacggtcatgcattttaaaatgaaatatgatgaaaaagaaaaacaaaaagcgatttactacaaagaacaacaagaacgtattacactctatcttaagcataatactaaagaaacgaacacgattaaatctgtacatttcacaaacttggaaacaagtcctatgggaagtgctgtgattgaaggatacatcaatgaaaataaagaagatgattttactgcttatgcatcgcctgaacataattatcaatttggtggcgctatgataaaaagtgaaggagtagataaattattaaaaccagcacatgaaagaaaatcaccagaaaaaatcaaagaagaattagataaaaaagaaggccac

SEQ ID NO: 3500 - protein, 139 aa, Staphylococcus aureus
  MISC_FEATURE (1)..(139): hypothetical protein
MSKKHVFIIIGVILCICTVSTVMHFKMKYDEKEKQKAIYYKEQQERITLYLKHNTKETNTIKSVHFTNLETSPMGSAVIEGYINENKEDDFTAYASPEHNYQFGGAMIKSEGVDKLLKPAHERKSPEKIKEELDKKEGH

SEQ ID NO: 3501 - DNA, 417 bp, Staphylococcus aureus
atgtcgaaaaagaaaattttaatattaactagtattatgttaatcatattaattagtgttgcaggtatctatttaaaagtgaaatatgacgaaaaagaaaaacaaaaagcaatatactataaagaacaacaagcgcgcattacactttatctcaagcataacactaaagaaccgaatacaatcaaatctgtacatttcacaaactcggaaacaagtcctatgggaagtgctgtgattgaaggttacataaatgaaaacaaaaaagataattttactgcttatgctacaccagaacataattatcaatttggtggtgctatgatagaaagtgaaaaattaagcgagttactaaagccagccaatcagttaaaatcaccagatgatataaaaaaagaactaaataaaaagaagagtcac

SEQ ID NO: 3502 - protein, 139 aa, Staphylococcus aureus
  MISC_FEATURE (1)..(139): hypothetical protein
MSKKKILILTSIMLIILISVAGIYLKVKYDEKEKQKAIYYKEQQARITLYLKHNTKEPNTIKSVHFTNSETSPMGSAVIEGYINENKKDNFTAYATPEHNYQFGGAMIESEKLSELLKPANQLKSPDDIKKELNKKKSH

SEQ ID NO: 3503 - DNA, 483 bp, Staphylococcus aureus
atgttcataattatagattataaaaattttttcattttccaccacattttaggagttactttaatgaacaaaaaacatgtttttataattattggtgtcattttatgtatatgtatagttgcatcagtcatttatttaaaagtgaaatatgacgaaaaagaaaaacaaaaagcaatatactataaagaacaacaggagcgtattacactctatcttaagcataatactaaagaacccaataccatcaaaactgtacatttcacaagtttaaaaagaggacctatgggcgatgcagtaattgaaggttacataaatgaaaataaagaagatgattttgttgcatatgggtctccagaacataattatcaatttggtggaagtttaatcaaaagtaaaaatttaagcacgttattaaaaccagtacatcaaaccaaatcacctgatgagataaaaaaggaattagagtctaaaaagaacgaccgc

SEQ ID NO: 3504 - protein, 161 aa, Staphylococcus aureus
  MISC_FEATURE (1)..(161): hypothetical protein
MFIIIDYKNFFIFHHILGVTLMNKKHVFIIIGVILCICIVASVIYLKVKYDEKEKQKAIYYKEQQERITLYLKHNTKEPNTIKTVHFTSLKRGPMGDAVIEGYINENKEDDFVAYGSPEHNYQFGGSLIKSKNLSTLLKPVHQTKSPDEIKKELESKKNDR

SEQ ID NO: 3505 - DNA, 693 bp, Staphylococcus aureus
atgacagtattaacagataaagtagcagtagttacaggtgcaggtagtggtattggagaagcaattgcaacattactacatgaagaaggggcaaaagttgtcttagcaggtagaaataaagaaaaattacaaaacgtagcgaatcaattgtcacaagatagtgtgaaggtagtgccaacagatgtaacgaataaagaagaagtcgatgaattgataaaaattgcacaacaaacattcggtggtttggatattgttatcaatagtgcggggcaaatgttgtcgtctaagattactgattatcaagtagatgagtgggatagtatgattgatgtgaatatcaaaggcactttatatacggcacaggctgcattaccaactatgttagaacaatcaagtggccatcttattaacattgcatctatttctggctttgaagtaacgaaaagtagtacgatttatagtgcgacgaaagcagcagttcacactattactcaaggattagaaaaagagttggcaaagacaggcgttaaagtaacaagcatttctccaggaatggtagatacagccataactgccgcatacaatccaacagatcgtaaaaaacttgaaccacaagatattgcagaagcagtattatatgcattaacacaaccaaagcacgttaacgtgaatgaaattacagtgcgtcctgta

SEQ ID NO: 3506 - protein, 231 aa, Staphylococcus aureus
  MISC_FEATURE (1)..(231): hypothetical protein
MTVLTDKVAVVTGAGSGIGEAIATLLHEEGAKVVLAGRNKEKLQNVANQLSQDSVKVVPTDVTNKEEVDELIKIAQQTFGGLDIVINSAGQMLSSKITDYQVDEWDSMIDVNIKGTLYTAQAALPTMLEQSSGHLINIASISGFEVTKSSTIYSATKAAVHTITQGLEKELAKTGVKVTSISPGMVDTAITAAYNPTDRKKLEPQDIAEAVLYALTQPKHVNVNEITVRPV

SEQ ID NO: 3507 - DNA, 279 bp, Staphylococcus aureus
gtgacatatcatgagcgtgttttagcattaagagcagaaagtaaaagaaccgcatttgattttcgattcgaagatttatttagcaaagaagaatggctaagtatgtctcttgcagaaagacaaaaagctgaaaaagcatttcgacacgaagttaaaaatatggacgatgtaagaatgcccttctcaagtgtccatgacgcccaagtaaaattatataatgttgtatattcttataacggcattaaacgtaattttaaacaagttgaaaatgaaggattc

SEQ ID NO: 3508 - protein, 93 aa, Staphylococcus aureus
  MISC_FEATURE (1)..(93): hypothetical protein
VTYHERVLALRAESKRTAFDFRFEDLFSKEEWLSMSLAERQKAEKAFRHEVKNMDDVRMPFSSVHDAQVKLYNVVYSYNGIKRNFKQVENEGF

SEQ ID NO: 3509 - DNA, 282 bp, Staphylococcus aureus
gtgacaataaatataatcgttttaatagtatctatcattgtctttcaattgattattggacacatatggcatgatattggtttaagttatttaagaagtatcttactcatgatgctgccatttggactaggtgtatttatacaacaagtgtcgtattacgaacgacaatatcctaaatggcaagtgcctcaaaacataaaagttagattgaaatatatttatctcgctacgtttttagagtatgtcgtactatacctcactttatttacggacatactaaga

SEQ ID NO: 3510 - protein, 94 aa, Staphylococcus aureus
  MISC_FEATURE (1)..(94): hypothetical protein
VTINIIVLIVSIIVFQLIIGHIWHDIGLSYLRSILLMMLPFGLGVFIQQVSYYERQYPKWQVPQNIKVRLKYIYLATFLEYVVLYLTLFTDILR

SEQ ID NO: 3511 - DNA, 198 bp, Staphylococcus aureus
gtgatgattatgagaaaagagattgaagcgcttattttctcagacgtaagtagctatgatatttacgtgaacactggtgtaaatcaaggattaattggtgacatcaaagatggttacctaactattgattctatgccttacattgatgctgagcgtttgtatcactttgctatggaacgtaaatcgttagtcactaac

SEQ ID NO: 3512 - protein, 66 aa, Staphylococcus aureus
  MISC_FEATURE (1)..(66): hypothetical protein
VMIMRKEIEALIFSDVSSYDIYVNTGVNQGLIGDIKDGYLTIDSMPYIDAERLYHFAMERKSLVTN

SEQ ID NO: 3513 - DNA, 795 bp, Staphylococcus aureus
atgatgattcattcaaagaaattaacgctcggtatatgcttggtattactcattatattgattgtaggttatgtcattatgacaaaaacaaatggtcgaaacgcccaaattaaagacacatttaatcaaacattaaaattatatccaaccaaaaatctcgatgatttttacgataaagaaggctttcgagatcaagaatttaaaaagggtgataaaggtacttggatagttaattctgaaatggtaatcgagccaaaaggtaaggatatggaaacgagaggaatggtgctctatatcaatcgcaatactagaaccacaaaagggtattattttataagtgaaatgacagatgacagtaacggcagaccaaaggatgatgaaaaaaggtatccggtaaaaatggaacataataaaatcataccaacgaagccactaccgaatgacaagttaaaaaaagagattgaaaactttaagttctttgtacaatatggcaactttaaagatattaatgattataaagatggtgatatttcatataatcctaatgtaccaagttattcggcaaaatatcaattgaataatgatgattataatgtccaacagttaagaaaaagatatgatattccaaccaaacaagcgccgaaactattattgaaaggcgatggagatttaaaaggttcatccgtaggttctagaagtcttgaatttacctttgtcgaaaataaagaagaaaacatttattttacagattctgtacaatatactccaagtgaggatacaaggtatgagtcaaac

SEQ ID NO: 3514 - protein, 265 aa, Staphylococcus aureus
  MISC_FEATURE (1)..(265): hypothetical protein
MMIHSKKLTLGICLVLLIILIVGYVIMTKTNGRNAQIKDTFNQTLKLYPTKNLDDFYDKEGFRDQEFKKGDKGTWIVNSEMVIEPKGKDMETRGMVLYINRNTRTTKGYYFISEMTDDSNGRPKDDEKRYPVKMEHNKIIPTKPLPNDKLKKEIENFKFFVQYGNFKDINDYKDGDISYNPNVPSYSAKYQLNNDDYNVQQLRKRYDIPTKQAPKLLLKGDGDLKGSSVGSRSLEFTFVENKEENIYFTDSVQYTPSEDTRYESN

SEQ ID NO: 3515 - DNA, 285 bp, Staphylococcus aureus
gtgggacttgattttagtggtttaccagatttagcagtattggaacaaatgaaggaaaaagaacagattagtgaggttattgcgcctgaacatgttcgtatgcatcatgatcatcaaaataagctgaaaagtgatgagaaaatattacttgaccaaatggtaagtcatttcaaaaaatttgaagatgattttaaaaatgcggcacaaggggcttgggtgaaaaatgccacagacgaattaaaagatattagtaatgatttagaaaaaattcaagatattaaagta

SEQ ID NO: 3516 - protein, 95 aa, Staphylococcus aureus
  MISC_FEATURE (1)..(95): hypothetical protein
VGLDFSGLPDLAVLEQMKEKEQISEVIAPEHVRMHHDHQNKLKSDEKILLDQMVSHFKKFEDDFKNAAQGAWVKNATDELKDISNDLEKIQDIKV

SEQ ID NO: 3517 - DNA, 324 bp, Staphylococcus aureus
atgtttactacgtataaaaatattaatgaacttgaaaatgcctatgatgaagaaagaaaacaattgaatgatgcattcaatcaaattgatgaattaagacatcaaacacgcaagaaatgtgaacaaatgtatgatcatttcttatatctcaaacataaaatgaattatagtgaagacgctatgatcaggatgacacgtattatagaatctttcgatagagaaacgaatcaacgtatccgacatcacgaaatgaaattagaagattataaagatgagttaagaagagaatatctaaaacaatctgacagaattgaaggagatgaa

SEQ ID NO: 3518 - protein, 108 aa, Staphylococcus aureus
  MISC_FEATURE (1)..(108): hypothetical protein
MFTTYKNINELENAYDEERKQLNDAFNQIDELRHQTRKKCEQMYDHFLYLKHKMNYSEDAMIRMTRIIESFDRETNQRIRHHEMKLEDYKDELRREYLKQSDRIEGDE

SEQ ID NO: 3519 - DNA, 291 bp, Staphylococcus aureus
atgtatcacgcgatggcacataaatttggagacaactggaaaaaagcgcaagaagttggaaatgaaattggtgaaaaattaacctctgaagaggttatagatgaattaagaaaaggtggcgcgtatgaaagtaaacttgaaacagatcccaaaagaaaaattgatgataagataaagaaattaaatgatgtttataaaaattgtaatggctatatcgcaaaaattaaacagagtatcgaagcaattgtttctaatgaccaaatgttagcgagccagattgatgggatgatg

SEQ ID NO: 3520 - protein, 97 aa, Staphylococcus aureus
  MISC_FEATURE (1)..(97): hypothetical protein
MYHAMAHKFGDNWKKAQEVGNEIGEKLTSEEVIDELRKGGAYESKLETDPKRKIDDKIKKLNDVYKNCNGYIAKIKQSIEAIVSNDQMLASQIDGMM

SEQ ID NO: 3521 - DNA, 1110 bp, Staphylococcus aureus
atgagtcaaacggaatatcaaataaaatctggcaatataaaaggtaactctgaagaaacaagtacagtatctaatataagttatgaaatagaaaacgcaaataacagtggtttaaaacaaaataaaattgataaacaaattaaaaagttacaagaaaaaaataaattccctaaaaatctttcatatcttaaaagttatacggaccccaaaacaggcacgactacaagcgcctttttaaataaagacactggcaaagttactttaggtatgacaggtactaatgtacacaaagacgcaatattaaaacaaacatttggtgttccttcttatcaaggatatatagacgtgagtgaaacgctaaaagatattggggccgatgtcaatattggccttcattccgtcacagataaagatccacattataaaaatacccaagactttatcaaaaatatcaaaaaagactatgatattgatattattaccggacattcgctgggcggtagagatgcgatgattttaggtatgagtaatgatattaaacatatcgttgtgtataatccagctccattagcgatcaaagatgtgagcggcctttatgccgatcaagaagaacttaaaaaattgattgaaaagtacgatggtcacattgtaagatttgtgtctgatgaagacgaattagatgcaggtgtccgcaatcatttatatgaaactgctggagaaaaaatagtacttaaaaatggagaaggccatgcaatgagtggtattttaatgagcagaacacaggctataatcttagctgaattaaacaaagttaaaggctaccaagacgaaaataataaagcattaaaatccgttcgtaaacaaacgaggcatagattacataaagtagagacgttaagagcgaattggattcaaacaacgggtggatcactctcttcctcccaacaacaattattagaagctttaacagcactaaccattgccgaaggcttaaatcaattagtgaatgaagaaagccaacatttgaaaaaatgtatcacgcgatggcacataaatttggagacaactggaaaaaagcgcaagaagttggaaatgaaattggtgaaaaat

SEQ ID NO: 3522 - protein, 370 aa, Staphylococcus aureus
  MISC_FEATURE (1)..(370): hypothetical protein
MSQTEYQIKSGNIKGNSEETSTVSNISYEIENANNSGLKQNKIDKQIKKLQEKNKFPKNLSYLKSYTDPKTGTTTSAFLNKDTGKVTLGMTGTNVHKDAILKQTFGVPSYQGYIDVSETLKDIGADVNIGLHSVTDKDPHYKNTQDFIKNIKKDYDIDIITGHSLGGRDAMILGMSNDIKHIVVYNPAPLAIKDVSGLYADQEELKKLIEKYDGHIVRFVSDEDELDAGVRNHLYETAGEKIVLKNGEGHAMSGILMSRTQAIILAELNKVKGYQDENNKALKSVRKQTRHRLHKVETLRANWIQTTGGSLSSSQQQLLEALTALTIAEGLNQLVNEESQHLKKCITRWHINLETTGKKRKKLEMKLVKN

SEQ ID NO: 3523 - DNA, 786 bp, Staphylococcus aureus
atgatgattcattcaaagaaattaacgctcggtatatgtttggtattactcattatattgattggaggttgtgtcattatgacaaaaacaaatggtcgaaacgctcaaattaaagaaaatttcaacaaaacattaagtgtatatctaaccaagaatctcgatgatttttacgataaggaaggttttcgagatcaagaatttgataaaagagataaagggacttggattatttattctgaaatggttatcgaaccaaaagggaaaaatatggaatcgagaggaatggtgctctatatcaatcgcaatactagaacaacgaagggtaattttattgtcaccgaaataactgaagatagtaaaggatattcacgtagtaaagaaaaaaaatatcctgtcaagatggaaaataatcgaattattccaacaaagcctataccggatgacaagttaaaaaaagagattgaaaactttaagttctttgtacaatatggaaattttaaagattttaaagattataaaaatggtgatatttcatataatcctaatgtgccaagttattctgcaaagtatcaattgaataatgatgactataatgttcaacagttaagaaaacgatatcatattccaaccaaacaagcgcccgaattaaaattgaaaggatccggcaatttaaaaggctcatccgtaggatctaaggatctagaatttacgtttgtagaaaatcaagaagagaatatctatttttcagattcggtcgaatttacacctagcgaggatgataaatca

SEQ ID NO: 3524 - protein, 262 aa, Staphylococcus aureus
  MISC_FEATURE (1)..(262): hypothetical protein
MMIHSKKLTLGICLVLLIILIGGCVIMTKTNGRNAQIKENFNKTLSVYLTKNLDDFYDKEGFRDQEFDKRDKGTWIIYSEMVIEPKGKNMESRGMVLYINRNTRTTKGNFIVTEITEDSKGYSRSKEKKYPVKMENNRIIPTKPIPDDKLKKEIENFKFFVQYGNFKDFKDYKNGDISYNPNVPSYSAKYQLNNDDYNVQQLRKRYHIPTKQAPELKLKGSGNLKGSSVGSKDLEFTFVENQEENIYFSDSVEFTPSEDDKS

SEQ ID NO: 3525 - DNA, 774 bp, Staphylococcus aureus
atgatgattcactcaaaaaggttgaggctctggctgtatttagtattattagctgtttttataggggcttgcggaatgaaaaaggaagaaagcagtaaagataaacaaattaaagaaaacttcaacaaaacgttgagcctgtatccaactaaaaatcttgaagacttttatgataaggaaggctttcgagatcaagagtttgaaaagggcgacaaaggcacttggataattcactctaaaatgacaatagaaacaaatggaaagaatatggaatccagaggattggtcctgtatgtagaccgcaataccagaacgacaaaaggtgaatttattgtgagggaattatgggaagataaaaaaggatactcacgtagtaaagaaaaagaatatccagtaaaaatggaacataataaaattatcccaaccaaaccgatagctgatgataaattaagaaaagaaatcgaaaactttaaattctttgtacaatacggtgactttaaagatattaatgattataaagatggtgacatttcatataatccgaatgtgccaagttattcagcaaagtatcaattaagtaatgatgactacaatgtgaagcaacttagaaagaggtatgatataccaactaagaaagcacctaaattattaataaaaggcgatggtgatttaaaaggatcatctataggacacaaaaatttagagtttacatttatagaaaataaagaagaaaacatctattttacggatagtattaatttcaaacctactgaa

SEQ ID NO: 3526 - protein, 258 aa, Staphylococcus aureus
  MISC_FEATURE (1)..(258): hypothetical protein
MMIHSKRLRLWLYLVLLAVFIGACGMKKEESSKDKQIKENFNKTLSLYPTKNLEDFYDKEGFRDQEFEKGDKGTWIIHSKMTIETNGKNMESRGLVLYVDRNTRTTKGEFIVRELWEDKKGYSRSKEKEYPVKMEHNKIIPTKPIADDKLRKEIENFKFFVQYGDFKDINDYKDGDISYNPNVPSYSAKYQLSNDDYNVKQLRKRYDIPTKKAPKLLIKGDGDLKGSSIGHKNLEFTFIENKEENIYFTDSINFKPTE

SEQ ID NO: 3527 - DNA, 2859 bp, Staphylococcus aureus
atgagtagattactaaatgatttcaatcaatctttacataaagggtttatagacaaacatatttctcataaagggaattatacaccgaagcttttagtaaataataaaaatgaaaaagttctttcaacaattatagatgaacttcaaaaatgtgaaacgttttatttttctgtggcttttataacagaaagcggtttagccagcttaaaggctcaactattagatttaagcaataagggtgttaaagggaaaatattaacatctaattacttagggtttaatagtcctaaaatgtatggagaattacttaaattaaaaaatgtagaggtaagattaactgatattgctggattccatgccaaaggatatatttttgagcataaggattatagttctatggtaataggaagctctaatttaacatctaatgcgttaaaggttaattatgagcataatgttttactgtctactatgaaaaatggcgatttagttgatagtgtaaaaagtgaatttgacttgttatggcaaaagagtaccccactgactgagcaatggattaattcatataaagaatcatttgagtaccgttccttagaaaaattagcggaggttgaacaaactcaaatgctgctagctgataaggtgaaaaaatcagtggaaattgtacccaatttaatgcaagcagaagcattaaggtcattaaaagctattagggataaagccaaagataaggcgttaataatatctgcaactggtacaggtaaaacgattttatgtgcattagatgttagagaagtaaaccctaataaatttttatttattgttcataatgaggggattttaaatagagctaaggaagaatttaaaaaagtattacctataaaaaatgatagtgattttggattgttgacaggaaaacatagagatgtcgatgccaaatatttatttgcaaccattcaaacattatctagagatgataattttaagcaatttgatgaaaatgaatttgattatattgtttttgatgaagcacatcgttctgctgcatctacttatcaacgagtatttaactacttcaaacctaagttcatgctgggaatgactgctacaccagaaagatcagatgaattaagtatatttgaactgtttgattataatattgcatatgaaataaggttacaagcagcattagaaagtgatattttatgtccatttcattattttggtgtgactgattatgtacatcaaggtattaaagaagatgatgtaactaaactgagatatttaacttctgatgaaagagttaattatattattcaaaagacagattactatggatattcaggtgaaattttacaaggattgatttttgtaagtagcaaaaaagaagcttatgatttagcggataaactaagttcaaaagggattaaaagtgttgctttaacaggagatgatagtgttaattatcgccaaattgtaatagaaaaattaaaagaaggtaagattaactatattataactgtagatctttttaacgaaggtattgatattccagaagtcaatcaagttgtaatgttgagaccaacagagtctagtattatattcattcagcaacttggtagaggattaagaaaaagttcaaataaagagtatgttacagtaattgattttattggtaattataagacaaattatttaattccgattgcgctttctggggatcaatcgcaaaataaagataattataagaagtttttaacgaataacgattcgattaatggagtatctacaattaattttgaagaagttgctaaaaaacagatttacaattcattggatgcagtatcattaaatcaaaataaattaatattaaaagcttatgaagaagttgaaaatagattgggacacatgccgttactaatggatttcatacaacaacattctatagatccaagcgttatattttctaaatttagtaattattacgagttcttagtgagatataaaaaaatagatacattattgacggaaaatgaatctaaaaatctggttttcttttcaaggcaaatagcacctggattgaaaagaatcgatagtttagttttagaagaacttttaaaaaatgaattaacatatgatgaattaaaaaataaaatgttgaacgaagttaaggatataacagaagatgatatagatacttcattaagaattttagatttttcattttacaacgcaggaattgaaaaaatctatggaagtcccattatagaacgtaatgaaagaatgataagactaagcgatgcatttactaatgctctaagtaatcaaacatttaatatgtttttagaagatcttattgaattatcaaagtataacaatgaaaaataccaaaaaggtaaaaatggactgattttatataataaatattcaagagaagattttagtaaaatatttaattggaataaaaatggttcgtctgtaatcatgggatacatgataaaaagccaagaaatgccaatatttatcacttatgataagcatgaggatataagtgatagcacaaaatatgaagatgaatttttaagtcaagatgaattaaaatggtttactaaatctaatagaacgctagaatcaaaagaagttcagaaaattttgtcccatagagcaaaaggaattaaaatgtatatttttgtacagaaaaaagatgatgatggtatatatttttattatttaggaactgctggatatatagaaggttcagaaaagcaagataaaatgccgaatggttcaaacgtagtaacgatggatttagcactggataaagctgtaagagatgatatatatcgttatctaacaaat

SEQ ID NO: 3528 - protein, 953 aa, Staphylococcus aureus
  MISC_FEATURE (1)..(953): conserved hypothetical
MSRLLNDFNQSLHKGFIDKHISHKGNYTPKLLVNNKNEKVLSTIIDELQKCETFYFSVAFITESGLASLKAQLLDLSNKGVKGKILTSNYLGFNSPKMYGELLKLKNVEVRLTDIAGFHAKGYIFEHKDYSSMVIGSSNLTSNALKVNYEHNVLLSTMKNGDLVDSVKSEFDLLWQKSTPLTEQWINSYKESFEYRSLEKLAEVEQTQMLLADKVKKSVEIVPNLMQAEALRSLKAIRDKAKDKALIISATGTGKTILCALDVREVNPNKFLFIVHNEGILNRAKEEFKKVLPIKNDSDFGLLTGKHRDVDAKYLFATIQTLSRDDNFKQFDENEFDYIVFDEAHRSAASTYQRVFNYFKPKFMLGMTATPERSDELSIFELFDYNIAYEIRLQAALESDILCPFHYFGVTDYVHQGIKEDDVTKLRYLTSDERVNYIIQKTDYYGYSGEILQGLIFVSSKKEAYDLADKLSSKGIKSVALTGDDSVNYRQIVIEKLKEGKINYIITVDLFNEGIDIPEVNQVVMLRPTESSIIFIQQLGRGLRKSSNKEYVTVIDFIGNYKTNYLIPIALSGDQSQNKDNYKKFLTNNDSINGVSTINFEEVAKKQIYNSLDAVSLNQNKLILKAYEEVENRLGHMPLLMDFIQQHSIDPSVIFSKFSNYYEFLVRYKKIDTLLTENESKNLVFFSRQIAPGLKRIDSLVLEELLKNELTYDELKNKMLNEVKDITEDDIDTSLRILDFSFYNAGIEKIYGSPIIERNERMIRLSDAFTNALSNQTFNMFLEDLIELSKYNNEKYQKGKNGLILYNKYSREDFSKIFNWNKNGSSVIMGYMIKSQEMPIFITYDKHEDISDSTKYEDEFLSQDELKWFTKSNRTLESKEVQKILSHRAKGIKMYIFVQKKDDDGIYFYYLGTAGYIEGSEKQDKMPNGSNVVTMDLALDKAVRDDIYRYLTN

SEQ ID NO: 3529 - DNA, 399 bp, Staphylococcus aureus
gtgagtcttatgaaaaaagtaatcaatgtagtaggagctattattttttctgataacaaaattctttgtgcacagagaagtgaaaaaatgagtctgcctttaatgtgggaatttcctggcggtaaggttgaaaagaatgaaactgaaaaagacgctttgattagagaaattagagaagaaatgaaatgtgatttaattgttggagacaaagttataactacagaacatgaatatgattttggaattgttaggttaacaacatacaaatgtactttaaacaaagagttaccaactctaactgaacataagagtattgaatggttgtcaataaacgaacttgataaattaaattgggccccagcggatataccagccgttaataaaattatgactgaggga

SEQ ID NO: 3530 - protein, 133 aa, Staphylococcus aureus
  MISC_FEATURE (1)..(133): hypothetical protein
VSLMKKVINVVGAIIFSDNKILCAQRSEKMSLPLMWEFPGGKVEKNETEKDALIREIREEMKCDLIVGDKVITTEHEYDFGIVRLTTYKCTLNKELPTLTEHKSIEWLSINELDKLNWAPADIPAVNKIMTEG

SEQ ID NO: 3531 - DNA, 1806 bp, Staphylococcus aureus
atgcattttcatacacatctattatataatacttgtgaaaagtattgtcttggggctgtgtttttttacttttggggcgtatttctttataattcattacataaatgtaagggctttagttttcatgttttattaagtctaactgagattttgaaaggatgtttagcaacaatggataaagaattatggatagaacgagctaatgatagtttagttaaacatttttatgagcagcaatctgacattgaacagcgagaaggttttgaaagtaaattaacatttggtactgcgggtatacgcggaaaattcggtcttggtgaaggtcgacttaataagtttactattgaaaaattggcattaggtttagcgcgttatttaaatgcccaaacaaacagtccaacaatagtcattcattatgatattagacatctttcaactgaattcgcccaaataattgctaatgtattagcaaaccatcaaataacagtttatttacctgatacatataaaacgacaccggaattatcgttcgcggtgcgcaatcttaatactactgctggcattatgattacagcaagtcataatccgaaagactataacggcatcaaagtatatggttctgatggtgcgcaattatcgactgatgcatctgagcttgcaagtcgttatatcgaagaagttggcgatccattacagattgatatacctatttctaaacaaaatacatcttatatcaagccttttccgaaatctgtaactgatgactatatgaaacacattcaaaatatgattggctatattcctaaatctgatttacaagttgtgttcactagtttgcatggtacaagtgttccgattgtacctgagttattacaatctttgaatttcaatcaatttaatcttgtagaagcacaatgtaaacctgatccgaatttcagctcagttcaaagtgctaatcctgaagatcatcgcgcttttgatcaagcagtcgaacttgcaaataaaagtcatgcagacttattaatatcaactgaccctgatgcagatcgacttggtattgctgaacgtgatgcacacggtcatatcacatattttaatggcaaccaaattggtgcgctgttacttaattatcgtattcaacaaacgtctcaattacgtcaccgcttaatgattcaatctattgtaagtagtgagttaacaaagtcattagcacgctataataatgttgaatacaaagaggtgctgacgggctttaaatttattgctcaggaaataagacaactggatgatcatcaaaatatgattttcgcatttgaagagagttacggttttctatcagagccttttgtacgtgataaagatgccgtacaaattgtgccactcattataaaatacgcttctgagttaaaattatatggcaaaacattgaaagatgaattagaacagatttatcaaactgttggtagacatgaggatacattattctcgcatacgctagaaggatttgaagggaaaaagaaaattaatgcaataatgaccaaattccgttcaaatccaccgcaagagattcaaggactcaaagtgaaagcaattgaagattatttaactagcgaggtttatcatttggataaagatacaacgtcgcagattaattctcctaaatcaaatgttattcgtgtcttatttgacgaaggatttatcgctttacgtccttctggtactgaacctaaaattaaattatatgtgtcgttaaaatgtccgaattttgatgatgtagctcaaaaaattaatgcgatgatttttagc

SEQ ID NO: 3532 - protein, 602 aa, Staphylococcus aureus
  MISC_FEATURE (1)..(602): hypothetical protein
MHFHTHLLYNTCEKYCLGAVFFYFWGVFLYNSLHKCKGFSFHVLLSLTEILKGCLATMDKELWIERANDSLVKHFYEQQSDIEQREGFESKLTFGTAGIRGKFGLGEGRLNKFTIEKLALGLARYLNAQTNSPTIVIHYDIRHLSTEFAQIIANVLANHQITVYLPDTYKTTPELSFAVRNLNTTAGIMITASHNPKDYNGIKVYGSDGAQLSTDASELASRYIEEVGDPLQIDIPISKQNTSYIKPFPKSVTDDYMKHIQNMIGYIPKSDLQVVFTSLHGTSVPIVPELLQSLNFNQFNLVEAQCKPDPNFSSVQSANPEDHRAFDQAVELANKSHADLLISTDPDADRLGIAERDAHGHITYFNGNQIGALLLNYRIQQTSQLRHRLMIQSIVSSELTKSLARYNNVEYKEVLTGFKFIAQEIRQLDDHQNMIFAFEESYGFLSEPFVRDKDAVQIVPLIIKYASELKLYGKTLKDELEQIYQTVGRHEDTLFSHTLEGFEGKKKINAIMTKFRSNPPQEIQGLKVKAIEDYLTSEVYHLDKDTTSQINSPKSNVIRVLFDEGFIALRPSGTEPKIKLYVSLKCPNFDDVAQKINAMIFS

SEQ ID NO: 3533 - DNA, 264 bp, Staphylococcus aureus
atgaaaggctctaaacaaatacttttgattatgggcattatatctcttattgttttatttatttttacactattcatcatggcgcaatatgcaaaacattatgaacaaaaatccgacagttccaacgcacatactttaaattcatcatcagccataattgagcaacatactatgtcgaatttagcgtctctagatttatacgctcctgttcgtaacattacttctagtcgtgatattcatcccatttatttcatgacaaaagat

SEQ ID NO: 3534 - protein, 88 aa, Staphylococcus aureus
  MISC_FEATURE (1)..(88): hypothetical protein
MKGSKQILLIMGIISLIVLFIFTLFIMAQYAKHYEQKSDSSNAHTLNSSSAIIEQHTMSNLASLDLYAPVRNITSSRDIHPIYFMTKD

SEQ ID NO: 3535 - DNA, 306 bp, Staphylococcus aureus
atgaccgtcaacatcgtatttagtatcgtattctgcataagtatggttatattaggcatttatgtcgcaataactaaagatttcacactaatctcttttataaatcaaacggccattgcagataaacacaagaaccaaattgcatatatatttacgctatgtataagtttgagtgcagtatttttaatgtcttcaattctaagctttgaatatgattttattgcattagcattcttatttttaacgatagcattattacttatcgcattattctacgtttgcttttataaaattacaaaataccca

SEQ ID NO: 3536 - protein, 102 aa, Staphylococcus aureus
  MISC_FEATURE (1)..(102): hypothetical protein
MTVNIVFSIVFCISMVILGIYVAITKDFTLISFINQTAIADKHKNQIAYIFTLCISLSAVFLMSSILSFEYDFIALAFLFLTIALLLIALFYVCFYKITKYP

SEQ ID NO: 3537 - DNA, 150 bp, Staphylococcus aureus
ttggcttataatttagcaattataatagggtcgctaattatattatgtatactaatatctagaggttatgatatttatgtaatcttgattccaattttgactattttagctagtttaatcaatttgttttgtgatattaaaaagcataaa

SEQ ID NO: 3538 - protein, 50 aa, Staphylococcus aureus
  MISC_FEATURE (1)..(50): hypothetical protein
LAYNLAIIIGSLIILCILISRGYDIYVILIPILTILASLINLFCDIKKHK

SEQ ID NO: 3539 - DNA, 1200 bp, Staphylococcus aureus
gtgataaatatgttgtatttagaagttttgaaaaatagaaactttacatatttattgattggtaatttcttacgtcggagttgttttgtgctgttttcgttacaaataatttggtttactgttgaattgacaaaccaatcatctttaaaattatcaatgatggttatgagtcaaacacttccatttattatatttggtattttcggtggcgcatattctgataaacataataaaaagaaaatactttatctatctgatcttatactaagtttgattataataattattcctttacttgcaataacatcaaatttaaattatctgacgcttctaaccatatctacagctatcaccattattaactgctatacggatcctgcgtttagggcaattcttcctgaaattattgatgaggagcatttagcaacaagtaatgcgttaatcgatagtttgcaaagaggctcaaatattattttacctgctttaattggtgtcattgtaatactagttggtaatgttggcgtcttttttatttgtagtatattgctatttttaggatttatttttaatgcacttttaaaatatacaaataacaacatgattgatagacactcaaaagaagatttttctgaaacttgggaattcttgaaacaatctaaagaaattccatttattataatcatccaatttgcctgcatattgattaatactggcctttggcgtgttgtattaccattgtttatttccaatatattaaaagagggcgttggtgtatatggactagctacatcatgtttaggtatagcatctttattaatgtcattgattatgggtttgctgtcagaaaagcgattaatctttaaatttagtattggtgttttagtttggggaattggcttatcgattattaatgtgtttccaagtgtggcgatattatatataggtgcaacattattgggacttggacaatctatagagggactaacaagatcagttgccattcaaataaaaacgccaaatcatttgatggggaaagtatttagtatctcatctacatcgaattatgcagcggatacattgtctttaggactgataagtataattatacctttactaagcttaagtaatatatttatattaggaggtgtaattatttcaatacttagcttagctgggttaaagtttgttaagaagtctatg

SEQ ID NO: 3540 - protein, 400 aa, Staphylococcus aureus
  MISC_FEATURE (1)..(400): conserved hypothetical
VINMLYLEVLKNRNFTYLLIGNFLRRSCFVLFSLQIIWFTVELTNQSSLKLSMMVMSQTLPFIIFGIFGGAYSDKHNKKKILYLSDLILSLIIIIIPLLAITSNLNYLTLLTISTAITIINCYTDPAFRAILPEIIDEEHLATSNALIDSLQRGSNIILPALIGVIVILVGNVGVFFICSILLFLGFIFNALLKYTNNNMIDRHSKEDFSETWEFLKQSKEIPFIIIIQFACILINTGLWRVVLPLFISNILKEGVGVYGLATSCLGIASLLMSLIMGLLSEKRLIFKFSIGVLVWGIGLSIINVFPSVAILYIGATLLGLGQSIEGLTRSVAIQIKTPNHLMGKVFSISSTSNYAADTLSLGLISIIIPLLSLSNIFILGGVIISILSLAGLKFVKKSM

SEQ ID NO: 3541 - DNA, 4887 bp, Staphylococcus aureus
atgcaaatgagagataagaaaggaccggtaaataaaagagtagattttctatcaaataaattgaataaatattcaataagaaaatttacagttggaacagcatctattttaattggctcactaatgtatttgggaactcaacaagaggcagaagcagctgaaaacaatattgagaatccaactacattaaaagataatgtccaatcaaaagaagtgaagattgaagaagtaacaaacaaagacactgcaccacagggtgtagaagctaaatctgaagtaacttcaaacaaagacacaatcgaacatgaaccatcagtaaaagctgaagatatatcaaaaaaggaggatacaccaaaagaagtagctgatgttgctgaagttcagccgaaatcgtcagtcactcataacgcagagacacctaaggttagaaaagctcgttctgttgatgaaggctcttttgatattacaagagattctaaaaatgtagttgaatctaccccaattacaattcaaggtaaagaacattttgaaggttacggaagtgttgatatacaaaaaaaaccaacagatttaggggtatcagaggtaaccaggtttaatgttggtaatgaaagtaatggtttgataggagctttacaattaaaaaataaaatagattttagtaaggatttcaattttaaagttagagtggcaaataaccatcaatcaaataccacaggtgctgatggttgggggttcttatttagtaaaggaaatgcagaagaatatttaactaatggtggaatccttggggataaaggtctggtaaattcaggcggatttaaaattgatactggatacatttatacaagttccatggacaaaactgaaaagcaagctggacaaggttatagaggatacggagcttttgtgaaaaatgacagttctggtaattcacaaatggttggagaaaatattgataaatcaaaaactaattttttaaactatgcggacaattcaactaatacatcagatggaaagtttcatgggcaacgtttaaatgatgtcatcttaacttatgttgcttcaactggtaaaatgagagcagaatatgctggtaaaacttgggagacttcaataacagatttaggtttatctaaaaatcaggcatataatttcttaattacatctagtcaaagatggggccttaatcaagggataaatgcaaatggctggatgagaactgacttgaaaggttcagagtttacttttacaccagaagcgccaaaaacaataacagaattagaaaaaaaagttgaagagattccattcaagaaagaacgtaaatttaatccggatttagcaccagggacagaaaaagtaacaagagaaggacaaaaaggtgagaagacaataacgacaccaacactaaaaaatccattaactggagtaattattagtaaaggtgaaccaaaagaagagattacaaaagatccgattaatgaattaacagaatacggacctgaaacaatagcgccaggtcatcgagacgaatttgatccgaagttaccaacaggagagaaagaggaagttccaggtaaaccaggaattaagaatccagaaacaggagacgtagttagaccgccggtcgatagcgtaacaaaatatggacctgtaaaaggagactcgattgtagaaaaagaagagattccattcgagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagatgtagttagaccaccggtcgatagcgtaacaaaatatggacctgtaaaaggagactcgattgtagaaaaagaagagattccattcgagaaagaacgtaaatttaatcctgatttagcaccagggacagaaaaagtaacaagagaaggacaaaaaggtgagaagacaataacgacaccaacactaaaaaatccattaactggagtaattattagtaaaggtgaaccaaaagaagaaatcacaaaagatccgattaatgaattaacagaatacggaccagaaacgataacaccaggtcatcgagacgaatttgatccgaagttaccaacaggagagaaagaagaagttccaggtaaaccaggaattaagaatccagaaacaggagacgtagttagaccaccggtcgatagcgtaacaaaatatggacctgtaaaaggagactcgattgtagaaaaagaagagattccattcaagaaagaacgtaaatttaatccggatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagatgtagttagaccaccggtcgatagcgtaacaaaatatggacctgtaaaaggagactcgattgtagaaaaagaagagattccattcgagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagacgtagttagaccaccggtcgatagcgtaacaaaatatggacctgtaaaaggagactcgattgtagaaaaagaagaaattccattcaagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagatgtagttagaccaccggtcgatagcgtaacaaaatatggacctgtaaaaggagactcgattgtagaaaaagaagaaattccattcgagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagatgtagttagaccaccggtcgatagcgtaacaaaatatggacctgtaaaaggagactcgattgtagaaaaagaagaaattccattcgagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccagttaatgaattaacagaattcggtggcgagaaaataccgcaaggtcataaagatatctttgatccaaacttaccaacagatcaaacggaaaaagtaccaggtaaaccaggaatcaagaatccagacacaggaaaagtgatcgaagagccagtggatgatgtgattaaacacggaccaaaaacgggtacaccagaaacaaaaacagtagagataccgtttgaaacaaaacgtgagtttaatccaaaattacaacctggtgaagagcgagtgaaacaagaaggacaaccaggaagtaagacaatcacaacaccaatcacagtgaacccattaacaggtgaaaaagttggcgagggtcaaccaacagaagagatcacaaaacaaccagtagataagattgtagagttcggtggagagaaaccaaaagatccaaaaggacctgaaaacccagagaagccgagcagaccaactcatccaagtggcccagtaaatcctaacaatccaggattatcgaaagacagagcaaaaccaaatggcccagttcattcaatggataaaaatgataaagttaaaaaatctaaaattgctaaagaatcagtagctaatcaagagaaaaaacgagcagaattaccaaaaacaggtttagaaagcacgcaaaaaggtttgatctttagtagtataattggaattgctggattaatgttattggctcgtagaagaaagaat

SEQ ID NO: 3542 - protein, 1629 aa, Staphylococcus aureus
  MISC_FEATURE (1)..(1629): hypothetical protein
MQMRDKKGPVNKRVDFLSNKLNKYSIRKFTVGTASILIGSLMYLGTQQEAEAAENNIENPTTLKDNVQSKEVKIEEVTNKDTAPQGVEAKSEVTSNKDTIEHEPSVKAEDISKKEDTPKEVADVAEVQPKSSVTHNAETPKVRKARSVDEGSFDITRDSKNVVESTPITIQGKEHFEGYGSVDIQKKPTDLGVSEVTRFNVGNESNGLIGALQLKNKIDFSKDFNFKVRVANNHQSNTTGADGWGFLFSKGNAEEYLTNGGILGDKGLVNSGGFKIDTGYIYTSSMDKTEKQAGQGYRGYGAFVKNDSSGNSQMVGENIDKSKTNFLNYADNSTNTSDGKFHGQRLNDVILTYVASTGKMRAEYAGKTWETSITDLGLSKNQAYNFLITSSQRWGLNQGINANGWMRTDLKGSEFTFTPEAPKTITELEKKVEEIPFKKERKFNPDLAPGTEKVTREGQKGEKTITTPTLKNPLTGVIISKGEPKEEITKDPINELTEYGPETIAPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGVIISKGEPKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFKKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPINELTEYGPETITPGHRDEFDPKLPTGEKEEVPGKPGIKNPETGDVVRPPVDSVTKYGPVKGDSIVEKEEIPFEKERKFNPDLAPGTEKVTREGQKGEKTITTPTLKNPLTGEIISKGESKEEITKDPVNELTEFGGEKIPQGHKDIFDPNLPTDQTEKVPGKPGIKNPDTGKVIEEPVDDVIKHGPKTGTPETKTVEIPFETKREFNPKLQPGEERVKQEGQPGSKTITTPITVNPLTGEKVGEGQPTEEITKQPVDKIVEFGGEKPKDPKGPENPEKPSRPTHPSGPVNPNNPGLSKDRAKPNGPVHSMDKNDKVKKSKIAKESVANQEKKRAELPKTGLESTQKGLIFSSIIGIAGLMLLARRRKN

SEQ ID NO: 3543 - DNA, 357 bp, Staphylococcus aureus
ttgatgaatgatttgaaaagcaagagcaatattaaattaatgaaaagagtattaactacatatgagctgcgtaaatatttaaaaaaatatttttgtcttacattagataattatttagtattagcatatttagatgtatttaaaaatgatgaaggtaaatattttatgagagacattataagttatatcggtatagaccaatctagaattgttaaaagcgtaaaagatttatcaaaaaagggttacttgaataaatgtagagacccacatgatagtagaaatgtaatcattgttgtttctgtaaaacaacacaattatattaaaaatcttttgagtgaaataaatattaatgaaaca

SEQ ID NO: 3544 - protein, 119 aa, Staphylococcus aureus
  MISC_FEATURE (1)..(119): staphylococcal accessory
LMNDLKSKSNIKLMKRVLTTYELRKYLKKYFCLTLDNYLVLAYLDVFKNDEGKYFMRDIISYIGIDQSRIVKSVKDLSKKGYLNKCRDPHDSRNVIIVVSVKQHNYIKNLLSEININET

SEQ ID NO: 3545 - DNA, 774 bp, Staphylococcus aureus
ttgggacatcagaaaatagtaggagaatgtaaggtggactatcaaactttcgaaaaggtcaataaattcataaatgtagaagcgtacatattttttctcactcaagagttaaagcaacaatataaattatcattaaaagaattgttgatattagcatatttttattacaaaaatgaacacagtatttcactaaaagaaatcattggtgacatactttacaaacaatctgatgttgtaaagaacattaagtcactatctaaaaaaggatttataaataagtctagaaacgaagcagatgaacgccgtatttttgtttcagttactccaatacaacgtaaaaagattgcttgtgttattaatgagttagataaaataattaaaggatttaataaggaaagagactacataaaatatcaatgggctccaaaatatagcaaagaattttttatactttttatgaacattatgtactcaaaagattttttaaaatatcgatttaatttaacatttcttgatttatctatcttatatgtaatatcatctcgaaaaaatgagatactaaatttaaaagatttgtttgaaagtattagatttatgtatcctcaaattgttaggtcagttaatagattaaataataaaggtatgctaatcaaagaacgatcccttgcagatgaaaggattgtgttaatcaaaataaataaaatacaatataacactattaaaagcatattcacagatacttccaagattctcaaaccaagaaaatttttcttt

SEQ ID NO: 3546 - protein, 258 aa, Staphylococcus aureus
  MISC_FEATURE (1)..(258): staphylococcal accessory
LGHQKIVGECKVDYQTFEKVNKFINVEAYIFFLTQELKQQYKLSLKELLILAYFYYKNEHSISLKEIIGDILYKQSDVVKNIKSLSKKGFINKSRNEADERRIFVSVTPIQRKKIACVINELDKIIKGFNKERDYIKYQWAPKYSKEFFILFMNIMYSKDFLKYRFNLTFLDLSILYVISSRKNEILNLKDLFESIRFMYPQIVRSVNRLNNKGMLIKERSLADERIVLIKINKIQYNTIKSIFTDTSKILKPRKFFF

SEQ ID NO: 3547 - DNA, 864 bp, Staphylococcus aureus
ttgaaaaaaataaaaaaggcaatcattcccgctgctggtttagggactagatttttaccagcaactaaagcgatgccaaaggaaatgcttcctatcttagataaacccacaatacaatatatcgttgaagaagctgcaagagctggaattgaagatattattatagtgacaggtcgccacaaacgcgcgattgaagatcattttgatagtcaaaaagaattagaaatggtgttaaaagaaaaaggtaaatctgaattactagagaaagttcagtattcaacggaacttgcgaatattttttatgtaaggcagaaagaacaaaaaggtttagggcatgcgattagttctgcgcgtcaatttatcggcaatgaaccatttgcggtattattaggtgacgatattgttgaatctgaagtgccagcagtgaaacagttgattgacgtttatgaagaaacagggcactcagttataggtgtccaagaagttccggaagcagatactcatcgttatggaattattgacccattaactaaaaacggacgtcagtatgaagtgaaaaagtttgttgaaaagccagcacaaggtacggcaccatcaaacctagctattatgggacgttatgtattaacgcctgaaattttcgattatttaaaaacgcaaaaagaaggcgcaggtaacgaaattcagttaacagatgcgattgaacgtatgaataatgataaccaagtgtatgcatatgacttcgaaggcgaacgttatgacgttggagaaaaattaggcttcgttaaaactaccatagaatatgcattgaaagatgacagtatgcgagaagaattaacacgatttattaaagcattaggttta

SEQ ID NO: 3548 - protein, 288 aa, Staphylococcus aureus
  MISC_FEATURE (1)..(288): UTP-glucose-1-phosphate
LKKIKKAIIPAAGLGTRFLPATKAMPKEMLPILDKPTIQYIVEEAARAGIEDIIIVTGRHKRAIEDHFDSQKELEMVLKEKGKSELLEKVQYSTELANIFYVRQKEQKGLGHAISSARQFIGNEPFAVLLGDDIVESEVPAVKQLIDVYEETGHSVIGVQEVPEADTHRYGIIDPLTKNGRQYEVKKFVEKPAQGTAPSNLAIMGRYVLTPEIFDYLKTQKEGAGNEIQLTDAIERMNNDNQVYAYDFEGERYDVGEKLGFVKTTIEYALKDDSMREELTRFIKALGL

SEQ ID NO: 3549 - DNA, 1389 bp, Staphylococcus aureus
ttgaagggtgttttgtttatggcaattgctgtgttattaaatcgaatgtttcgaatggaacacaatccattatttgaatatatttatcaacaaaaagaagacattgatgcatgttattttatcattccggaagaggacatgtcttcagcttctgatttgaaagcacagttttatcgcggtactttgcagcgcttttaccaatcgttgcacgcagaaaagcttacaccttatgttatgtcttatgacgatatcatttcattttgtaaagaaaacaatatctctgaagtagtgactgcgggtgatattatgagttatcatcttgaagaatatgatattttacatcaacgttctttattcaatgaagcacgcattgccgttactttgatacgtgggaatcattactttaaagcgagtaaaacaatgaatcaacaaggggagccatacaatgtttttactagtttctataaaaaatggcgaccttacttgaggcatagagacgtatatcactatgatttaaaatcattcgaaaactttgtcattgcatcacctgatgatttagtgtttgatgacatagcatttggatcctcacaaataattgaacagaataaatggcaacattttttagatcaagatatacagaattacgaaagcggaagagactatttacctgaagtattaacaagtcagctaagtgttgctttagcatatggattattagatattattgaaatttttaatgatttattggcgcgttatgatgaagatgaggcaaactatgaagcatttatacgtgaactcatttttagagaattttattatgtgttaatgacacagtatcctgaaacctcataccaagctttcaaacctaaatatcgacagataaaatggtcgcaaaatgaagcggattttaatgcatggtgcgaagggcaaacaggatttccaatcattgatgcagcaataatggaattgacacaaactggttttatgcataatcgaatgagaatggttgtgtcgcaatttttaaccaaagatttatttatagattggacatggggagaaaaattctttagaaagcaccttattgactatgatgcagcatcaaatattcatggatggcaatggtctgcttctacaggtacggatgcagtgccgtattttagaatgtttaatccaataagacagagtgaacgctttgatgctaaagctttgtatatcaaaacatatcttccgatttttaatcaaattgatgcaaaatatttgcatgatacacaacgcaatgagtccaacctttttgaacaggggattgaattaggtagtcattatccaagacaaatggtagatcatcaagaaaaacgtacacaagttttagctacatttaaagcgctagac

SEQ ID NO: 3550 - protein, 463 aa, Staphylococcus aureus
  MISC_FEATURE (1)..(463): hypothetical protein
LKGVLFMAIAVLLNRMFRMEHNPLFEYIYQQKEDIDACYFIIPEEDMSSASDLKAQFYRGTLQRFYQSLHAEKLTPYVMSYDDIISFCKENNISEVVTAGDIMSYHLEEYDILHQRSLFNEARIAVTLIRGNHYFKASKTMNQQGEPYNVFTSFYKKWRPYLRHRDVYHYDLKSFENFVIASPDDLVFDDIAFGSSQIIEQNKWQHFLDQDIQNYESGRDYLPEVLTSQLSVALAYGLLDIIEIFNDLLARYDEDEANYEAFIRELIFREFYYVLMTQYPETSYQAFKPKYRQIKWSQNEADFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDAKALYIKTYLPIFNQIDAKYLHDTQRNESNLFEQGIELGSHYPRQMVDHQEKRTQVLATFKALD

SEQ ID NO: 3551 - DNA, 2844 bp, Staphylococcus aureus
ttgcatttaagggagaatattatagtgaaaagcaatcttagatacggcataagaaaacacaaattgggagcggcctcagtattcttaggaacaatgatcgttgttggaatgggacaagaaaaagaagctgcagcatcggaacaaaacaatactacagtagaggaaagtgggagttcagctactgaaagtaaagcaagcgaaacacaaacaactacaaataacgttaatacaatagatgaaacacaatcatacagcgcgacatcaactgagcaaccatcacaatcaacacaagtaacaacagaagaagcaccgaaaactgtgcaagcaccaaaagtagaaacttcgcgagttgatttgccatcggaaaaagttgctgataaggaaactacaggaactcaagttgacatagctcaaccaagtaacgtctcagaaattaaaccaagaatgaaaagatcaactgacgttacagcagttgcagagaaagaagtagtggaagaaactaaagcgacaggtacagatgtaacaaataaagtggaagtagaagaaggtagtgaaattgtaggacataaacaagatacgaatgttgtaaatcctcataacgcagaaagagtaaccttgaaatataaatggaaatttggagaaggaattaaggcgggagattattttgatttcacattaagcgataatgttgaaactcatggtatctcaacactgcgtaaagttccggagataaaaagtacagatggtcaagttatggcgacaggagaaataattggagaaagaaaagttagatatacgtttaaagaatatgtacaagaaaagaaagatttaactgctgaattatctttaaatctatttattgatcctacaacagtgacgcaaaaaggtaaccaaaatgttgaagttaaattgggtgagactacggttagcaaaatatttaatattcaatatttaggtggagttagagataattggggagtaacagctaatggtcgaattgatactttaaataaagtagatgggaaatttagtcattttgcgtacatgaaacctaacaaccagtcgttaagctctgtgacagtaactggtcaagtaactaaaggaaataaaccaggggttaataatccaacagttaaggtatataaacacattggttcagacgatttagctgaaagcgtatatgcaaagcttgatgatgtcagcaaatttgaagatgtgactgataatatgagtttagattttgatactaatggtggttattctttaaactttaataatttagaccaaagtaaaaattatgtaataaaatatgaagggtattatgattcaaatgctagcaacttagaatttcaaacacacctttttggatattataactattattatacaagtaatttaacttggaaaaatggcgttgcattttactctaataacgctcaaggcgacggcaaagataaactaaaggaacctattatagaacatagtactcctatcgaacttgaatttaaatcagagccgccagtggagaagcatgaattgactggtacaatcgaagaaagtaatgattctaagccaattgattttgaatatcatacagctgttgaaggtgcagaaggtcatgcagaaggtaccattgaaactgaagaagattctattcatgtagactttgaagaatcgacacatgaaaattcaaaacatcatgctgatgttgttgaatatgaagaagatacaaacccaggtggtggtcaggttactactgagtctaacctagttgaatttgacgaagattctacaaaaggtattgtaactggtgctgttagcgatcatacaacaattgaagatacgaaagaatatacgactgaaagtaatctgattgaactagtagatgaactacctgaagaacatggtcaagcgcaaggaccaatcgaggaaattactgaaaacaatcatcatatttctcattctggtttaggaactgaaaatggtcacggtaattatggcgtgattgaagaaatcgaagaaaatagccacgtggatattaagagtgaattaggttacgaaggtggccaaaatagcggtaatcagtcatttgaggaagacacagaagaagataaaccgaaatatgaacaaggtggcaatatcgtagatatcgatttcgatagtgtacctcaaattcatggtcaaaataatggtaaccaatcattcgaagaagatacagagaaagacaaacctaagtatgaacaaggtggtaatatcattgatatcgacttcgacagtgtgccacatattcacggattcaataagcacactgaaattattgaagaagatacaaataaagataaaccaaattatcaattcggtggacacaatagtgttgactttgaagaagatacacttccacaagtaagtggtcataatgaaggtcaacaaacgattgaagaagatacaacacctccaatcgtgccaccaacgccaccgacaccagaagtaccaagcgagccggaaacaccaacaccaccgacaccagaagtaccaagcgagccggaaacaccaacaccgccaacgccagaggtaccaactgaacctggtaaaccaataccacctgctaaagaagaacctaaaaaaccttctaaaccagtggaacaaggtaaagtagtaacacctgttattgaaatcaatgaaaaggttaaagcagtggtaccaactaaaaaagcacaatctaagaaatctgaactacctgaaacaggtggagaagaatcaacaaacaacggcatgttgttcggcggattatttagcattttaggtttagcgttattacgcagaaataaaaagaatcacaaagca

SEQ ID NO: 3552 - protein, 948 aa, Staphylococcus aureus
  MISC_FEATURE (1)..(948): fibronectin-binding protein
LHLRENIIVKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSTDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESVYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 3553 - DNA, 3054 bp, Staphylococcus aureus
gtgaaaaacaatcttaggtacggcattagaaaacataaattgggagcagcatcagtattcttaggaacaatgatcgttgttgggatgggacaagacaaagaagctgcagcatcagaacaaaagacaactacagtagaagaaaatgggaattcagctactgataataaaacaagtgaaacacaaacaactgcaactaacgttaatcatatagaagaaactcaatcatataacgcaacagtaacagaacaaccgtcaaacgcaacacaagtaacaactgaagaagcaccaaaagcagtacaagcaccacaaactgcacaaccagcaaatatagaaacagttaaagaagaggtagttaaggaagaagcgaaacctcaagttaaggaaacaacacaatctcaagacaatagcggagatcaaagacaagtagatttaacacctaaaaaggctacacaaaatcaagtcgcagaaacacaagttgaagtggcacagccaagaacggcatcagaaagtaagccacgtgtgacaagatcagcagatgtagcggaagctaaggaagctagtaacgcgaaagtggaaacgggtacagatgtaacaagtaaagttacagtagaaattggttctattgaggggcataacaatacaaataaagtagaacctcatgcaggacaacgagcggtactaaaatataagttgaaatttgagaatggtttacatcaaggtgactactttgactttactttatcaaataatgtaaatacgcatggcgtatcaactgctagaaaagtaccagaaattaaaaatggttcagtcgtaatggcgacaggtgaagttttagaaggtggaaagattagatatacatttacaaatgatattgaagataaggttgatgtaacggctgaactagaaattaatttatttattgatcctaaaactgtacaaactaatggaaatcaaactataacttcaacactaaatgaagaacaaacttcaaaggaattagatgttaaatataaagatggtattgggaattattatgccaatttaaatggatcgattgagacatttaataaagcgaataatagattttcgcatgttgcatttattaaacctaataatggtaaaacgacaagtgtgactgttactggaactttaatgaaaggtagtaatcagaatggaaatcaaccaaaagttaggatatttgaatacttgggtaataatgaagacatagcgaagagtgtatatgcaaatacgacagatacttctaaatttaaagaagtcacaagtaatatgagtgggaatttgaatttacaaaataatggaagctattcattgaatatagaaaatctagataaaacttatgttgttcactatgatggagagtatttaaatggtactgatgaagttgattttagaacacaaatggtaggacatccagagcaactttataagtattattatgatagaggatataccttaacttgggataatggtttagttttatacagtaataaagcgaacggaaatgagaaaaatggtccgattattcaaaataataaatttgaatataaagaagatacaattaaagaaactcttacaggtcaatatgataagaatttagtaactactgttgaagaggaatatgattcatcaactcttgacattgattaccacacagctatagatggtggaggtggatatgttgatggatacattgaaacaatagaagaaacggattcatcagctattgatatcgattaccatactgctgtggatagcgaagcaggtcacgttggaggatacactgagtcctctgaggaatcaaatccaattgactttgaagaatctacacatgaaaattcaaaacatcacgctgatgttgttgaatatgaagaagatacaaacccaggtggtggtcaggttactactgagtctaacttagttgaatttgacgaagagtctacaaaaggtattgtaactggcgcagtgagcgatcatacaacagttgaagatacgaaagaatatacaactgaaagtaatctgattgaattagtggatgaattacctgaagagcatggtcaagcacaaggaccagtcgaggaaattactaaaaacaatcatcatatttctcattctggtttaggaactgaaaatggtcacgggaattatgacgtgattgaagaaatcgaagaaaatagccacgttgatattaagagtgaattaggttatgaaggtggccaaaatagcggtaaccagtcattcgaggaagacacagaagaagacaaacctaaatatgaacaaggtggcaatatcgtagatatcgattttgatagtgtacctcaaattcatggtcaaaataaaggtaatcagtcattcgaggaagatacagaaaaagacaaacctaagtatgaacatggcggtaacatcattgatatcgacttcgacagtgtgccacatattcacggattcaataagcacactgaaattattgaagaagatacaaataaagataaaccaagttatcaattcggtggacacaatagtgttgactttgaagaagatacacttccaaaagtaagcggccaaaatgaaggtcaacaaacgattgaagaagatacaacacctccaatcgtgccaccaacgccaccgacaccagaagtaccaagtgagccggaaacaccaacgccaccaacaccagaagtaccaagtgagccggaaacaccaacaccaccgacaccagaagtgccgagtgagccagaaactccaacaccgccaacaccagaggtaccagctgaacctggtaaaccagtaccacctgccaaagaagaacctaaaaagccttctaaaccagtggaacaaggtaaagtagtaacacctgttattgaaatcaatgaaaaggttaaagcagtggcaccaactaaaaaaccacaatctaagaaatctgaactacctgaaacaggtggagaagaatcaacaaacaaaggtatgttgttcggcggattattcagcattctaggtttagcattattacgcagaaataaaaagaatcacaaagca

SEQ ID NO: 3554 - protein, 1018 aa, Staphylococcus aureus
  MISC_FEATURE (1)..(1018): fibronectin-binding protein
VKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNEKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITKNNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 3555 - DNA, 99 bp, Staphylococcus aureus
ttgcttttaaaaaccgaacaatatagacttgcatttattaagtttaaaaaattaatgaattttgcatttaaagggagatattatagtgaaaaacaatct

SEQ ID NO: 3556 - protein, 33 aa, Staphylococcus aureus
LLLKTEQYRLAFIKFKKLMNFAFKGRYYSEKQS

SEQ ID NO: 3557 - DNA, 300 bp, Staphylococcus aureus
ttgcaatatattgccttgaaacacgtttatttttatgcagaaaatcgtctgaaatactcagaatccgaacgatataaaaagtatattgggtattttagagtaatgaaaggcgtttcaagacatgtttttgtgcgtattgtacaggcgataattatgaaacgtttagtatattgttttaaattagataatgatgaatttaatttaaaaaataagtataaaaaatacaagccttgtgtgacaagggtttctgatgacttgaatacaatttataggtatatttcaaataataaaattatcaat

SEQ ID NO: 3558 - protein, 100 aa, Staphylococcus aureus
  MISC_FEATURE (1)..(100): hypothetical protein
LQYIALKHVYFYAENRLKYSESERYKKYIGYFRVMKGVSRHVFVRIVQAIIMKRLVYCFKLDNDEFNLKNKYKKYKPCVTRVSDDLNTIYRYISNNKIIN

SEQ ID NO: 3559 - DNA, 1356 bp, Staphylococcus aureus
atgtttaacgaaatatggccgttaatcagtgttgttttaggtatcgttattttattagtattaattattgggtttaaattaaatacatttatttcattaattatcacatcgatgattacagcgttaatgctaggtataccattgactaaaattatggagacgattgagaaaggaatgggcagtacgctcggccacattgcactgatattcggtttaggtgccatacttgggaaattgcttgctgatggtggtggtgcaactcgaatcgcagacacgttgattcaaaaatttggtcaaaaacatgtacaatgggcaatgcttgttgcagcatttatcgtcggtattgcattgttctttgaagtaggtttagtcttactgattccattagtatttacagtagcaaaacgcgcaaatgtttcagtgttaaaactaggactacctatggtaacagctttatcagtgacacatggctttttaccaccacatccaggaccggtagtcatcgcaaaagaattaaaggcaaatgttggagatgtattactgtatggtatgattattgccattccagttacactcattgcagggcctatatttaacaaagttgcacaaaaaatgattccgtctgcgtatacacgagaaggcgatatttcagcgttaggtgcacaaaaagaatttacggatcaagagatgccaggatttggtatgagtttattaacagcaacattaccagtcatattaatgttagtgtctacgataacgcaacttgtaactgggcatgacaaacctacaaatctatttgaatctatcatttatatgataggaacagcagggacagccatgctaatagcagtattatttgcaatcgttacgatgggattaatgagaaagcgtaagatgaatcatattatggaatcagtgacgaatgcgatttatccaatcggaatgatgttattgattattggcggtggcggtacatttaaacaagtattaattgacggcggtgtcggaaatacaattgctaaaatgtttgaaggtacagagatgtctccgattttactagcatggattgttgcagctgtgctacgtatcgcattaggttcggctacagtagctgcgatttcaactacaggtattgtcttaccattattacaatcatcagatgtaaatgttgcattagttgtacttgcgataggtgcaggtagtgtgattttgtctcatgtaaatgacgcaggattttggatgtttaaagaatattttggtttaactgtaaaagaaacattcttaacatggtcattattagaaacgattatttccgtttcaggtatcatcttcattttattcattagcttatttgtt

SEQ ID NO: 3560 - protein, 452 aa, Staphylococcus aureus
  MISC_FEATURE (1)..(452): gluconate permease
MFNEIWPLISVVLGIVILLVLIIGFKLNTFISLIITSMITALMLGIPLTKIMETIEKGMGSTLGHIALIFGLGAILGKLLADGGGATRIADTLIQKFGQKHVQWAMLVAAFIVGIALFFEVGLVLLIPLVFTVAKRANVSVLKLGLPMVTALSVTHGFLPPHPGPVVIAKELKANVGDVLLYGMIIAIPVTLIAGPIFNKVAQKMIPSAYTREGDISALGAQKEFTDQEMPGFGMSLLTATLPVILMLVSTITQLVTGHDKPTNLFESIIYMIGTAGTAMLIAVLFAIVTMGLMRKRKMNHIMESVTNAIYPIGMMLLIIGGGGTFKQVLIDGGVGNTIAKMFEGTEMSPILLAWIVAAVLRIALGSATVAAISTTGIVLPLLQSSDVNVALVVLAIGAGSVILSHVNDAGFWMFKEYFGLTVKETFLTWSLLETIISVSGIIFILFISLFV

SEQ ID NO: 3561 - DNA, 1551 bp, Staphylococcus aureus
atgaaatatatgattggtgtcgacattggaacgacgagtaccaagtcagtcttatatgatgaaaatggaacttttatcatgaaacatcaaataggctatgatttacacacaccaaacgttgatgtctcagaagaaaacccagatgaattatttgatgcagtactaatgactattaaatatgttatgagagaatccaaagttaataaagacgacattaagtttgtgtcatttagtgcgcaaatgcatagcttgattgcgatggatcagcaacatcaaagattaacaaataatattacttgggcagataaccgcgctgcaaaatatgcaacagtaataaatgaagtgcatgatggcaatgcgatttaccagcgaacaggcacaccgattcatcctatgtcgccattagcgaagattttttggatgaaacatgaatggcaagatgtatttcaacgtactgctaagtttgcagatattaaaacatacattttctatcatttatttgatacatatatcattgattattcaatggcttccgcaacagggatgtttaatttagaaacattagattgggatgttgaggcattagaactgctgggtatttccaaggaaatgttgccggaattagttccaacaacgtatgtgatgaaaggtatgaaagaacgttatgcaacattaatggggcttaataaagatacaccgtttgttattggtgcgagtgatggggtcctttctaatttaggtgtcaatagtgttggtaaaggagaagttgctgtcacaatcggtacatctggggcgattcgtactgtgatagataaaccgcgtactgattacaaaggtagaatattttgttatgtcttaacagaggaccactacgtcatcggaggtcctgtaaataatggtggtgtcgtattgagatggttgcgcgacgagttgctagcgagtgaagtcgaaactgcgaaacgtctcggtgttgatccttatgatgtcttaactcaaattgcaaagcgtgttaaaccaggtgcagatggtttaatattccatccctatttagcaggagaacgtgcgccgctttggaacgcaaatgcaagaggttcattcttcggtttaactttatctcataaaaaagaacatatgattcgcgctgcattagaaggtgttctttacaatttgtataccgtctatcttgcgcttattgaagtaatgaatgaaacacctaagatgataaaagcaacaggtggttttgcgaaaagtgaagtatggcgtcaaatgatgtcagatatatttgacacagagttagtggttcctgaaagttatgaaagttcatgcttaggtgcctgcgtgctcggacttaaagctgtaggtgacattgaagatttttcaatcgtttcatcgatggtcggtgccacaaacaatcatacgccgattgaagaaaatgtcactgtttaccaagagatcgtatccatttttatcaatttaagtcgttctttaacagagaattatgaacaaattgcagattttcaacgccaacatatcgctgaaaataaaacacaa

SEQ ID NO: 3562 - protein, 517 aa, Staphylococcus aureus
  MISC_FEATURE (1)..(517): gluconokinase
MKYMIGVDIGTTSTKSVLYDENGTFIMKHQIGYDLHTPNVDVSEENPDELFDAVLMTIKYVMRESKVNKDDIKFVSFSAQMHSLIAMDQQHQRLTNNITWADNRAAKYATVINEVHDGNAIYQRTGTPIHPMSPLAKIFWMKHEWQDVFQRTAKFADIKTYIFYHLFDTYIIDYSMASATGMFNLETLDWDVEALELLGISKEMLPELVPTTYVMKGMKERYATLMGLNKDTPFVIGASDGVLSNLGVNSVGKGEVAVTIGTSGAIRTVIDKPRTDYKGRIFCYVLTEDHYVIGGPVNNGGVVLRWLRDELLASEVETAKRLGVDPYDVLTQIAKRVKPGADGLIFHPYLAGERAPLWNANARGSFFGLTLSHKKEHMIRAALEGVLYNLYTVYLALIEVMNETPKMIKATGGFAKSEVWRQMMSDIFDTELVVPESYESSCLGACVLGLKAVGDIEDFSIVSSMVGATNNHTPIEENVTVYQEIVSIFINLSRSLTENYEQIADFQRQHIAENKTQ

SEQ ID NO: 3563 - DNA, 822 bp, Staphylococcus aureus
gtgatagtgaccatttcctttaaatttaaatcgaaaaggggtggtcactattttagtgctcgtaaagaaagcgcttgcaaactcataataactatattaacatacttgtatacaagtatgtcgtgtaatgaaggagtgactttgatgatgtatggatatccagagaaatggttggaaggtatgacaactggagaaggtatcgcggcagaattacgcttaggcattgtgaatggtcacatagctgaaggtacgttactcactgaaaatcaaatggcaaagcaatttaatgtgagtcgttcgccaattcgagatgcatttaaattattgcaacaaaatcaactcatccaattagaaagaatgggtgcacatgtgttgccgtttggggaacaagaaaagaaagaaatgtatgatttgcgactgatgttagagtcatttgcattttcaagagttaaaaatcaagagcgactacctatcgtaaaagaaatgaagaaacaacttgaaatgatgaaagtggcagtaaaatttgaggatgcagaatcatttacgaagcatgactttgaatttcatgaaacattaatcaaagcatctaatcatcaatatttaaactcattttggagtcatttaaaaccagtaatgatggcactcgttttaacatccatgcgacaacgtatgcaacagaacccgcaagattttgaacgcatacatcataatcatcaagtgtttattgatgcagtggaacaatacgacagtcaaattttgaaagaagcgtttcatttaaatttcgacgatgttggtaaagatattgaaggattttggttgaat

SEQ ID NO: 3564 - protein, 274 aa, Staphylococcus aureus
  MISC_FEATURE (1)..(274): gluconate operon
VIVTISFKFKSKRGGHYFSARKESACKLIITILTYLYTSMSCNEGVTLMMYGYPEKWLEGMTTGEGIAAELRLGIVNGHIAEGTLLTENQMAKQFNVSRSPIRDAFKLLQQNQLIQLERMGAHVLPFGEQEKKEMYDLRLMLESFAFSRVKNQERLPIVKEMKKQLEMMKVAVKFEDAESFTKHDFEFHETLIKASNHQYLNSFWSHLKPVMMALVLTSMRQRMQQNPQDFERIHHNHQVFIDAVEQYDSQILKEAFHLNFDDVGKDIEGFWLN

SEQ ID NO: 3565 - DNA, 771 bp, Staphylococcus aureus
gtggaatctatgtctaactattcgactggagaactcgcaaaattatgcaatgtgacaacacgaacgattcaatattatgatcgcaaaggtattttgaaaccacaaggatttacagaaggaaagcgtcgtgtgtatacagaacaacagcgacaaacattagagttaatcttattgcttaaagatttaggttgtgcgttaagcgatatagatatgttgctaaaaggtgaaggtactttgaagacgctcaatactttactaactatgaaacaacaagaaattaaccaacaagttaaacagcaacaagcggtattaaacaaaattaaaaatgttcaatattacgtaaatgaagcgtcgacgtctccaatcacacacttaaaagacatagagcatgtcatgagtaaatcagctgaaatgaaaagtattcgtcgtaacatttggattagtgctggtattataggaataattcaatattctagcattataagtgcaattttgatgaaaaataaatggccgtttttaattgctttaccatttatgattggttatggcattggtgttactttttattaccaacaaaaggttgcctatttatgtcctaactgccagcatatattctcaccatctttgtgggcagttatcaaagcgaaacatacagcgacaacacgtcgattcgaatgtccaaactgtcatgaaacgcattattgcattgaagtacctaaagcgcatatgagtacagaacaattagaaatatcccacatacaacataacaat

SEQ ID NO: 3566 - protein, 257 aa, Staphylococcus aureus
  MISC_FEATURE (1)..(257): hypothetical protein
VESMSNYSTGELAKLCNVTTRTIQYYDRKGILKPQGFTEGKRRVYTEQQRQTLELILLLKDLGCALSDIDMLLKGEGTLKTLNTLLTMKQQEINQQVKQQQAVLNKIKNVQYYVNEASTSPITHLKDIEHVMSKSAEMKSIRRNIWISAGIIGIIQYSSIISAILMKNKWPFLIALPFMIGYGIGVTFYYQQKVAYLCPNCQHIFSPSLWAVIKAKHTATTRRFECPNCHETHYCIEVPKAHMSTEQLEISHIQHNN

SEQ ID NO: 3567 - DNA, 690 bp, Staphylococcus aureus
atgtatgtagatcgaaaaccatcactatatttagaggatttgcgacatgattttaaaaatagtttaagtaaatttgaaaatggtgatgaagcatttgatacgttattaggtttcgtagagttagatcatatttattcgtcagcactaaaggaaataagcactaaactgagtattttagatgacaatttcaatcacatttataaacacaatcctatacatcatatggagcgacgtgtgaaagaaatgcgtagtttaatagaaaagcttaatcgtaaaggattacagattagcgcagaaactgccaaagaacatatactggatattgccggaattcgcgtagtatgtaattacttagatgatatttatttgattgaagagatgttgcttaaacaagaagacgtacaattgataaaacgtaaagattatattcagcaccctaaagaaaatggttaccgcagtttacatatcgttgtatctattccagtctttttagcagaacgcgttgaggtattgcctgttgaaattcaaattagaacgataggtatggatatgtgggcaagtttagaacataaaatacgttataaaaacaatgcagagacggaaaagtatcgagatttactgaaagaatgtgcgacagagattactgaagttgaagataaattacaacaaattcattctgaaataacagag

SEQ ID NO: 3568 - protein, 230 aa, Staphylococcus aureus
  MISC_FEATURE (1)..(230): hypothetical protein
MYVDRKPSLYLEDLRHDFKNSLSKFENGDEAFDTLLGFVELDHIYSSALKEISTKLSILDDNFNHIYKHNPIHHMERRVKEMRSLIEKLNRKGLQISAETAKEHILDIAGIRVVCNYLDDIYLIEEMLLKQEDVQLIKRKDYIQHPKENGYRSLHIVVSIPVFLAERVEVLPVEIQIRTIGMDMWASLEHKIRYKNNAETEKYRDLLKECATEITEVEDKLQQIHSEITE

SEQ ID NO: 3569 - DNA, 1560 bp, Staphylococcus aureus
gtgactgttatgtcagaagaaaaacatgtagttgaacatgaacaacaaaagaaagaaaagacaaaaaagcaatacaagccattttggattgtcatgagttttataatacttatagttgtactattactcccggcaccttcaagtctgccgataatggctaaggcagtactagctattttagcttttgcagttattatgtgggtaacggaagctgtatcatatccggtgtcagcaactttaattattggcttaatgatattacttttaggatttagccctgttcaaaatttaggggagaagctaggtaatccgaaaagtggcagtgctattttagctggaagtgaccttctaggaactaatcatgcattatcattagcgtttagtggatttgcaacttcagctgtagctctcgttgcagctgcattatttttggctgctgctatgcaagaaacgaatttgcataaaagactagctcttttagtgttatcaattgttggtaataaaactagaaatatagttattggagcaattatcgtttcaattgtacttgcatttttcgttccttctgcaacagctagagcaggggcagttgtaccaatcttgctgggtatgattgcggcatttaaagtttccaaagatagcaagttagcgtctttattaataattacttcagtacaagctgtgtcaatttggaatattggtatcaaaacggcggcagcacaaaatatcgtagcgattaattttataaaccatcaattaggatttgatgtttcatggggcgagtggttcttatatgcagcgccttggtccatagttatgtccgtagctttatatttcatcatgattaaagtgatgcctccagaaattaatacaatagaaggtggtaaagatttaataaaagaagaattgcataaacttggccccgttagcccacgtgaatggcgtttaattgttatatcgatgttattattactgttttggtcaactgaaaaagtattacatccgattgactctgcatccattactattattgctttaggtgttatgttaatgccgaaaattggtgtcatgacatggaaacatgttgaaaataaaataccatggggaacaattatcgtgtttggtgtaggtatttcactaggtaacgttcttttgaaaacaggtgcagctcaatggttaagtgatcaaacttttggtgttttaggtttaaaacatttacctattatcgcgacaattgcacttatcacgctttttaatatattgattcatttgggctttgcgagtgcaacaagtttatcatcagcgttaatacctgtttttatttcgctaacctctacgttacacttaggagaccagtctataggatttgttttaattcaacaatttgttattagttttggtttcttattacctgttagtgcacctcaaaatatgttggcttatggcactggtacttttacggttaaagatttcttgaaggcaggtataccattgacaattgtagggtatattctagtgatagtttttagcatgacttattggaaatggttaggtttgctt

SEQ ID NO: 3570 - protein, 520 aa, Staphylococcus aureus
  MISC_FEATURE (1)..(520): conserved hypothetical
VTVMSEEKHVVEHEQQKKEKTKKQYKPFWIVMSFIILIVVLLLPAPSSLPIMAKAVLAILAFAVIMWVTEAVSYPVSATLIIGLMILLLGFSPVQNLGEKLGNPKSGSAILAGSDLLGTNHALSLAFSGFATSAVALVAAALFLAAAMQETNLHKRLALLVLSIVGNKTRNIVIGAIIVSIVLAFFVPSATARAGAVVPILLGMIAAFKVSKDSKLASLLIITSVQAVSIWNIGIKTAAAQNIVAINFINHQLGFDVSWGEWFLYAAPWSIVMSVALYFIMIKVMPPEINTIEGGKDLIKEELHKLGPVSPREWRLIVISMLLLLFWSTEKVLHPIDSASITIIALGVMLMPKIGVMTWKHVENKIPWGTIIVFGVGISLGNVLLKTGAAQWLSDQTFGVLGLKHLPIIATIALITLFNILIHLGFASATSLSSALIPVFISLTSTLHLGDQSIGFVLIQQFVISFGFLLPVSAPQNMLAYGTGTFTVKDFLKAGIPLTIVGYILVIVFSMTYWKWLGLL

SEQ ID NO: 3571 - DNA, 414 bp, Staphylococcus aureus
atgccctttacaatgaaaggttaccccgaaaaatggaaagaatttgaagtaattaaacggcaaaaagcgatagaaattgcgaatgcaatgttaaaagaaggatatcttgaaaaagatgttgttcctattgcggcgaaaaaagcgaaagattggtatcgagcgttatcgaaagaagaaatcaaagcattagaagaagagaacttcgtacaattccatacagcaacaatggaaaaaacagaggtggatagtgaatatgcaacaactgataatgaagaacatattcaagaacaatcaaatcaagataaatcgtactttgatagcgaatcaattggcaaccaaagtggtggcgttcgacaaagagaaccgcttatggatggtccacatccaaaagttgtggaatcatttaaagacgta

SEQ ID NO: 3572 - protein, 138 aa, Staphylococcus aureus
  MISC_FEATURE (1)..(138): conserved hypothetical
MPFTMKGYPEKWKEFEVIKRQKAIEIANAMLKEGYLEKDVVPIAAKKAKDWYRALSKEEIKALEEENFVQFHTATMEKTEVDSEYATTDNEEHIQEQSNQDKSYFDSESIGNQSGGVRQREPLMDGPHPKVVESFKDV

SEQ ID NO: 3573 - DNA, 2022 bp, Staphylococcus aureus
ttgagcataaggtgttataatgacatatgttgcgtaattaaaatttatagcaacaaattcattttaactatgctaataaaaagattatggaaatattttgacaaggaaaggagaagtcgaaatgacatctttttgacatcactcataaaaatcaatcgacttaacttagacttttataaaggtgtaagacagggactgttaatgattattcctgcaataatcggttacttatgtggtaatttccaatttggattattagttgcaaccggaacactagcccatatttatgtttttaaaggtccgtcgcgatctaagctgcgaactgtaataatttgtaatttagcgtttgcaatatgtatgatgcttggtacgctaacagccaaaacgccactcgtttttggaatgacattattaattgttacggttataccattttatatatttactgccttaaaaatagctggaccgtcatcgacattcttcattgtgacattcagtctacccattaacttacctatagctcccgaagaagcattatatagaggctttgcgattttagtaggcggtatacttgccactatgatggtgttaatcacgatcgtattttctaaaaacaaagctgaagaacaagcaattcaaaatgattttaaactcatatctaagttgttacacacttataatgataaatctgcttttttacaagtagcaaaaacagcggtggatagttttaaagcatctgataaattattaatcacttctacttcaagtaacgataaattaagtagacgtttccaaaaattattattattacacacatctgcccaagggatttattctgaactgttagagttgaacgctaaacaaattcgaccattgccagatgagttaattgaaatgatggatcatatcattgcacaactagataatagtgaggaaaatgtaagatattggcgaaaagaagtgacagtaacagaggaatttcaaaatttattcaaccatatattgaaaattgatgaaatggtgcatgcaaatgaagcgcgtattgcgtatgaagcagacatgcgaaaacctttatatagtaaacgcatttatcaaaatttaacattagactctattgtttttagaaatacattgagatatacagcgattatgatgatagcgatatttattgcgttaatgtttgattttgaaaaagcatactggataccgttatctgcacatacaatattactaggaacatcaactatacatgcaatcgagagaggtatggcacgaggtttaggtactattttaggtgtgttagtactttcagtcatattgttgttttcaataccaacacctgttgcagtaattttaatgggcattgcagcattgtttactgaagcattggtgggagcaaattatgcgattgcagtagtttttattacaatacaagttattttaatgaacggattagcatcacagaatttaacaattaacattgcgtttccaagagttattgacgttgcaatgggtattgtgattgcaatcataggtttatttgtccttggacaacgtaccgcatccgcattgcttcctaatgtaatggctgaagttgttcgtaaagaagcaacgctctttcattatttattttctgaaaatcaatataaagatgatgtgtatcagaaaaacacggctatgaacctatctgtgaaattaaataacatgacgcaagtttataatgcagctaatggtgaattatttagtgataagacattgattcaaaattattatcctagcttattcgcattagaagaaattagctttatgttaaatagagccatggctaatgaagatagacttacaataaatgaacaattaatgggcgagtatttagcaatatttgaaaacatcgctaagcatttcgaattaaatacagaattagaaataaagatattaccagatttaccacagtataattatattcaatcagcaatgatgaatattcaacacaatggttttcgtgagagagacaagaacgtt

SEQ ID NO: 3574 - protein, 674 aa, Staphylococcus aureus
  MISC_FEATURE (1)..(674): conserved hypothetical
LSIRCYNDICCVIKIYSNKFILTMLIKRLWKYFDKERRSRNDIFLTSLIKINRLNLDFYKGVRQGLLMIIPAIIGYLCGNFQFGLLVATGTLAHIYVFKGPSRSKLRTVIICNLAFAICMMLGTLTAKTPLVFGMTLLIVTVIPFYIFTALKIAGPSSTFFIVTFSLPINLPIAPEEALYRGFAILVGGILATMMVLITIVFSKNKAEEQAIQNDFKLISKLLHTYNDKSAFLQVAKTAVDSFKASDKLLITSTSSNDKLSRRFQKLLLLHTSAQGIYSELLELNAKQIRPLPDELIEMMDHIIAQLDNSEENVRYWRKEVTVTEEFQNLFNHILKIDEMVHANEARIAYEADMRKPLYSKRIYQNLTLDSIVFRNTLRYTAIMMIAIFIALMFDFEKAYWIPLSAHTILLGTSTIHAIERGMARGLGTILGVLVLSVILLFSIPTPVAVILMGIAALFTEALVGANYAIAVVFITIQVILMNGLASQNLTINIAFPRVIDVAMGIVIAIIGLFVLGQRTASALLPNVMAEVVRKEATLFHYLFSENQYKDDVYQKNTAMNLSVKLNNMTQVYNAANGELFSDKTLIQNYYPSLFALEEISFMLNRAMANEDRLTINEQLMGEYLAIFENIAKHFELNTELEIKILPDLPQYNYIQSAMMNIQHNGFRERDKNV

SEQ ID NO: 3575 - DNA, 1275 bp, Staphylococcus aureus
atgaaggaaaaacgaactaacgtaaggtggatgttcgcgcttgcgttcttctttattggggttattgcgtatatggatagagcaaacatttcatatatcgctaagcaaatgatggatgatttagggatgacaaaaccacaatttggtttattggcatcattcttctctctaggttatgcattaatgcaagtaccatcggggatgttggctgaaaaattcggtccacgtaagatgattacaattgcattagtttggtggagtgcatttacaatcttaacgggtatgattaagaaccacggtttaatttatttagtgagattcttatttggtgtaggtgaggcgccaatgtacccttctaatgctgtgtttaattcattttggttctctaaaaatgaaaaaggtagagcatcaagtgcattattagcaggatcatatttcggacctgtattagcaccaatagttacaattgctattgttaacgcatttaactggcaagcagtattttacatttttggtgcagtaggtattttaatggctgtattatgggcgattattgccaaagacttacctgagcaacatagaatggttaatgaagcggagaaacgtttcattatggaaaatcgtgatatcgtagctactgaaaagtcatcaccaccatggaatgatttctttaaacgttttagcttctatgcaattgcaattcaatactttgttgtacaatttatcattacattattcttaatttggttaccgacgtatttaacagaagtattccacgttaactttaaagaaatgagcattagttcattaccttggttattaatgttcttcttaatcttatcagcaggtgcaatttctgaccgtgtattaggattaggtcgttcaaaattcgtagctagaggtgtaattgcaattgcaggatttattgtgtttgcagtttcaattatctttgctgtacgcacaggaaatttatatgtaagtattttctggttatcactaggtcttggtggtatcggtatttcaatgggtatgagttgggctgcagcaactgacttaggacgtaacttctctggtacagtatcagggtggatgaacttatggggtaatataggtgcattaatcagtccgctattagcaggtctattcgtagaacatttgggttggacaatgacattccaattgttaatcgttccagcagtaatcgctgtgattatgtggttctatgtgaaaccagatcaacctttaattgttagtgatgataaagcaatagaaaaa

SEQ ID NO: 3576 - protein, 425 aa, Staphylococcus aureus
  MISC_FEATURE (1)..(425): hypothetical protein
MKEKRTNVRWMFALAFFFIGVIAYMDRANISYIAKQMMDDLGMTKPQFGLLASFFSLGYALMQVPSGMLAEKFGPRKMITIALVWWSAFTILTGMIKNHGLIYLVRFLFGVGEAPMYPSNAVFNSFWFSKNEKGRASSALLAGSYFGPVLAPIVTIAIVNAFNWQAVFYIFGAVGILMAVLWAIIAKDLPEQHRMVNEAEKRFIMENRDIVATEKSSPPWNDFFKRFSFYAIAIQYFVVQFIITLFLIWLPTYLTEVFHVNFKEMSISSLPWLLMFFLILSAGAISDRVLGLGRSKFVARGVIAIAGFIVFAVSIIFAVRTGNLYVSIFWLSLGLGGIGISMGMSWAAATDLGRNFSGTVSGWMNLWGNIGALISPLLAGLFVEHLGWTMTFQLLIVPAVIAVIMWFYVKPDQPLIVSDDKAIEK

SEQ ID NO: 3577 - DNA, 609 bp, Staphylococcus aureus
atggaacaaattatcactgaatttattagccgttttgggtatgcagccatttttatattaattttattagaaaatgtactacctatcgtaccatcggaaattattctgacatttgctggtcttatgtctgttaaatcacatttatcaattttaactttatttattattgcaactatcgcatcgtttatagggctgttaattttatattatatctgccgtttgatttcagaagaacgtctatatcgttttattgatcgacacggtaagtggattaaattgaaaagtaaggatttaaagcgagcaaatgattggtttaaaaagtatggcgtatgggctgtatttatctgtcgtttcatacctgtattacgtgtattgattaccattccagctggtgtaaaccgcatgaatgttgtgacatttaccgttatttcattaataggtactacaatctggaatttcggtttaattttactaggacgcactttgagcgatagctttggtatgttgatgactggtcttcatacatattcacgtattatgtatgttgtcatcattatcgcagtcatttactttgctatacgttacattggcaaacgtaagagagtaaaa

SEQ ID NO: 3578 - protein, 203 aa, Staphylococcus aureus
  MISC_FEATURE (1)..(203): hypothetical protein
MEQIITEFISRFGYAAIFILILLENVLPIVPSEIILTFAGLMSVKSHLSILTLFIIATIASFIGLLILYYICRLISEERLYRFIDRHGKWIKLKSKDLKRANDWFKKYGVWAVFICRFIPVLRVLITIPAGVNRMNVVTFTVISLIGTTIWNFGLILLGRTLSDSFGMLMTGLHTYSRIMYVVIIIAVIYFAIRYIGKRKRVK

SEQ ID NO: 3579 - DNA, 1161 bp, Staphylococcus aureus
atgattaatagtaatatcagattatatattctaggatttttagcatttttcgcatcattgattcaaaacatatacacgcctattattccgagactatatgacgattttcaagtaccactattttggataaatgcgacagttggcggttttatatttatcgttgcagttatgcaaattgtacttggtagaagtatagattctcgtgattcgaaaaaagtacttttaacgggattgggaatagtaatcatatctagctttatttgtgcagtgacacataactttatattatttgctatatcaaggttatttcaagcaattggttgcggaattattcctctcgtgactttaactttattagccaaactaagtacagataatggtagagctcaagctatggcgaactatcaaatatttttatcatgtgcaccagctttggcaccaatcttagggagtactttaggtgcaagatgggattatattggtatttttagttttttgctcgttatatctatcgtattatttttgattatcttttttattgatattccaaatgttgaaaaagggattgtaaaattaactgaaaaaattgaagaaaaatatttgaccgataaagtgtttattactttagtgacattgggatttttaatattttttacgtacttttcaatattagtttatttaccaacattattaaataatacctatgatataggcgttggaatatcaggagttttgtttttacctattactgttagtgttatattaggaagtttattttataagcgattttcaaaaaaatataatgaaataatgatacttcgtgttactataactggatttgctatatttacgttattgtttggatggttaaacgaatcaaatgtaattatattatcagtaattatatttatattaggtacttgtgttggtattgtgccagctttgctgtctactataatttctaaaaggtttgaacatataaaagggaaagtgctaggtgtatttaattttgtgagatatattggaatgactgtcggtgcattattaattggtatcatttctcagccgttggtagccttttacttcacaactataactatcatgttaatagtaatatttctttatataaagatagttgactttcagctaaagtatgccaaa

SEQ ID NO: 3580 - protein, 387 aa, Staphylococcus aureus
  MISC_FEATURE (1)..(387): TcaB protein
MINSNIRLYILGFLAFFASLIQNIYTPIIPRLYDDFQVPLFWINATVGGFIFIVAVMQIVLGRSIDSRDSKKVLLTGLGIVIISSFICAVTHNFILFAISRLFQAIGCGIIPLVTLTLLAKLSTDNGRAQAMANYQIFLSCAPALAPILGSTLGARWDYIGIFSFLLVISIVLFLIIFFIDIPNVEKGIVKLTEKIEEKYLTDKVFITLVTLGFLIFFTYFSILVYLPTLLNNTYDIGVGISGVLFLPITVSVILGSLFYKRFSKKYNEIMILRVTITGFAIFTLLFGWLNESNVIILSVIIFILGTCVGIVPALLSTIISKRFEHIKGKVLGVFNFVRYIGMTVGALLIGIISQPLVAFYFTTITIMLIVIFLYIKIVDFQLKYAK

SEQ ID NO: 3581 - DNA, 462 bp, Staphylococcus aureus
gtggatatgaagagagaagttattttaaaattacaacaatttattatagaaagagaaaatgccgataaaagaagacagtataaaaaggaaaatgaggaactagatttatctctaacacaatttcatatcatagagttgattgataataatgataaagtgaataataaatttttgtctgaaatgttaaatgtatcaaaaccagcaattactaaatcgataaaaaaacttttagcgaaagacttagtagttgaatcgcacaatgaatttaacaaaagagaagttaattattcattaacacaaaaaggaaaaaaattatcttatatacatgatgaattacatgaaaaatcggtaaaaaaatatgaagaggtacttaaagtctttgatgatgatgaaatggcagttattatagagtttttaaaccgtagtatagaagaattaaaaaaagaagatggtttaaatgat

SEQ ID NO: 3582 - protein, 154 aa, Staphylococcus aureus
VDMKREVILKLQQFIIERENADKRRQYKKENEELDLSLTQFHIIELIDNNDKVNNKFLSEMLNVSKPAITKSIKKLLAKDLVVESHNEFNKREVNYSLTQKGKKLSYIHDELHEKSVKKYEEVLKVFDDDEMAVIIEFLNRSIEELKKEDGLND

SEQ ID NO: 3583 - DNA, 693 bp, Staphylococcus aureus
atggatgttttaacaatagaacatttaacaaagaagataggcaacaaaacgattctcgaagatgtatcatttaagctgaaacgcggacaaatagttggtctcgttggagcgaatggtgcaggtaaaacaactttaatgaaagttatattaggttactctagtttccaaagcgggaattttaatgttattaacagcaaggacagcaaaagcaatatcggcgcattgattgaaaatccaggaatatatccttttatgtctggatatgaaaacttgaagttattgaatgaatcaaaaaacactcaagatatcgataaaattgtctcacaacttcatatggatgaatacattcataaaaaagctaaaacgtattctcttggtatgaaacaaaaattaggaattgctatagcatttttaaataaacctcaattcattatcttagatgaaccaatgaatggcttagatccaaaagctgtgcgagatgtacgtgaattgattgtccaaaaagcgcaagaaggtgttactttcttaatttcgagtcatattttaagtgaattagttaaaatcacaaactctatccttattattaacaaaggtaaaattgttacagaaacatcggaagaagaacttaaacaatttaaagataatgatttagaaaatgtattactagaaatcatagaaagggaggaccaagca

SEQ ID NO: 3584 - protein, 231 aa, Staphylococcus aureus
  MISC_FEATURE (1)..(231): hypothetical protein
MDVLTIEHLTKKIGNKTILEDVSFKLKRGQIVGLVGANGAGKTTLMKVILGYSSFQSGNFNVINSKDSKSNIGALIENPGIYPFMSGYENLKLLNESKNTQDIDKIVSQLHMDEYIHKKAKTYSLGMKQKLGIAIAFLNKPQFIILDEPMNGLDPKAVRDVRELIVQKAQEGVTFLISSHILSELVKITNSILIINKGKIVTETSEEELKQFKDNDLENVLLEIIEREDQA

SEQ ID NO: 3585 - DNA, 768 bp, Staphylococcus aureus
atgggaactttaattaaacaagaatgtttcaaattatttaaaaagaaatcaacttttatcgcacctattgtctttattctactaatggttgctcaaggttatattgctacaaaatacaatgaaatttttacgccacaggaatctttcacatctgcttataatggtttttcatggtttgcatttttattaattattcaagcaagtacaatcatttcaatggaatttcattacggtacgattaaaaatttactctatcgtgaatattcaagaacaactatgattgttagcaaaatcatcacattatttattatttctttaatttattttgttattacaattattgcttcaattgttattgggtctttattctttaatgatttaaatatatttgaaagtagcggtaatcaattatctttattgaatcaattattattagttagtttaggcacatttgttggcgtttggttagttttaagcttaacgttgctattatcatctgcaacaaattcaacgggagtagccattgctgtaggtattgttttttattttgcaagttctattttagcagttattcaaacggcacttttagaaaaaatagactggctaaagtggaatcctattaatatgatgaatattatgcttcaaacagttgaaaaaggctttagtaagtcgacaaaattagaacttcatgaattgtttattggtaatattgcttatatttctattttcttaatacttgtagtatttattttcaagaagaaaaatatt

SEQ ID NO: 3586 - protein, 256 aa, Staphylococcus aureus
  MISC_FEATURE (1)..(256): hypothetical protein
MGTLIKQECFKLFKKKSTFIAPIVFILLMVAQGYIATKYNEIFTPQESFTSAYNGFSWFAFLLIIQASTIISMEFHYGTIKNLLYREYSRTTMIVSKIITLFIISLIYFVITIIASIVIGSLFFNDLNIFESSGNQLSLLNQLLLVSLGTFVGVWLVLSLTLLLSSATNSTGVAIAVGIVFYFASSILAVIQTALLEKIDWLKWNPINMMNIMLQTVEKGFSKSTKLELHELFIGNIAYISIFLILVVFIFKKKNI

SEQ ID NO: 3587 - DNA, 1962 bp, Staphylococcus aureus
atgactcaaattactgaaaaagaattaaaaaagaagtatttagatttactatcccaaaattttgatactccagaaaaacttgcaactgaaattatcaatttagaatcaattttagaattacctaaaggtacggaacatttcgtcagcgatttacatggtgaatatgaagctttccaacacgtattacgcaacggttctgggaacgtgcgagcgaaaatcaatgatattttcaaagagagactttcaactaaggagcttaatgacttaactgctcttgtctactatccagaagacaaattaaaattgattaaaagtgatttccaaaattgcggtcaacttaatgtctggtatatcacaacaatcgaacatttaattgagttaattaaatattgttcttcaaaatatacgcgttcaaaactgcgtaaagcattgccaaaacaatacgtttatattattgaggaactactgtataaaagtaatgaatatcaaaataaaaaatcatattacgaaacacttgttaaccaagtaattgaacttaaacaggcagatgatttaattattggactcgcttattccgtacaacgcttagtcgtcgatcatttacacgttgtcggtgatatttatgatcgtggaccacaaccagataaaattatggatacactgattaattatcattccctagatattcaatggggtaatcatgatgtgctttgggttggagcctatgctgggtcaaaagtatgcttagcaaacttacttcgaatttgtgcacgttatgataatttagatattatcgaagacgcttatggcattaatttaagaccactgcttactttagctgaaaaatactatgacgcagataatcctgcttttaagcctaaaaaaagacctgacaaacacgaacgtttaactcaacgtgaagaaagtcaaattactaaaattcatcaagctattgcgatgattcaattcaagttagaaataccaattattaaacgtcgtccaaatttcgaaatggaagaacgtcttgtgcttgaaaaggttaattatgatacaaatgaaattacagtttatggtaatacatacccattgaaagacacatgtttccaaactgtcaatcgtgataatccagcagaattactacctgaagaagaagaagtcatgaataaactattattgtcattccaacaatctgaaaaattacgtcgtcatatgtctttcttgatgcgtaaaggctctctttacttaccatataatggcaatttactcattcatggttgtattccagttgatgaaaatggtgagatggaatcatttgaaattgatggtcatacttacagcggccaagaattattagatgtgtttgagtatcatgtccgtaaatcatttgatgaaaaagaaaatactgatgacttatcgacggatttagtttggtatttatggactgggaaatattcgtcactatttggtaaacgtgccatgactacgtttgagcgatactttattgcagataaagcttctcataaagaagaaaagaatccgtactatcatcttcgtgaagatgtgaatatggttcgtaaaatgctcagtgatttcggattaaatccagatgaaggacgcattattaatggtcacacaccagtgaaagaaatcaatggcgaagatcctatcaaggctgatggaaagatgcttgtcattgatggtggcttttcaaaagcttatcagtcaacaactggcattgcaggctatacactattgtataattcattcggtatgcaactcgttgcacaccaacaatttaacgctaaagaaaaaatactttccgaaggtatcgatgaactttctataaagcgcgtcgtagataaagaattacaacgtaagaagattcgtgataccaatattggtaaagatcttcaagctcaaatagatattttgaaaatgttaatgcatgatcgttacttagac

SEQ ID NO: 3588 - protein, 654 aa, Staphylococcus aureus
  MISC_FEATURE (1)..(654): fructose-bisphosphatase
MTQITEKELKKKYLDLLSQNFDTPEKLATEIINLESILELPKGTEHFVSDLHGEYEAFQHVLRNGSGNVRAKINDIFKERLSTKELNDLTALVYYPEDKLKLIKSDFQNCGQLNVWYITTIEHLIELIKYCSSKYTRSKLRKALPKQYVYIIEELLYKSNEYQNKKSYYETLVNQVIELKQADDLIIGLAYSVQRLVVDHLHVVGDIYDRGPQPDKIMDTLINYHSLDIQWGNHDVLWVGAYAGSKVCLANLLRICARYDNLDIIEDAYGINLRPLLTLAEKYYDADNPAFKPKKRPDKHERLTQREESQITKIHQAIAMIQFKLEIPIIKRRPNFEMEERLVLEKVNYDTNEITVYGNTYPLKDTCFQTVNRDNPAELLPEEEEVMNKLLLSFQQSEKLRRHMSFLMRKGSLYLPYNGNLLIHGCIPVDENGEMESFEIDGHTYSGQELLDVFEYHVRKSFDEKENTDDLSTDLVWYLWTGKYSSLFGKRAMTTFERYFIADKASHKEEKNPYYHLREDVNMVRKMLSDFGLNPDEGRIINGHTPVKEINGEDPIKADGKMLVIDGGFSKAYQSTTGIAGYTLLYNSFGMQLVAHQQFNAKEKILSEGIDELSIKRVVDKELQRKKIRDTNIGKDLQAQIDILKMLMHDRYLD

SEQ ID NO: 3589 - DNA, 1077 bp, Staphylococcus aureus
atgcgtatcttaaaagagtccattattgtggcatttgcctttgttggtgttgtcgttggtgccggctttgctactggtcaagaaattttccagtttttcacaagtcatggcgcatatagcatttcaggcattattgtaacaggactattgattactttaggtggaatggttgtcatgcatacaggtcatcatctaaagtccagaaatcattctgattcaattaactatttcttatacccctctattgcaagaggttttgatattattttaacaatgtttatgttgtctttagctattattatgactgcaggtggtgcgtcaaccattcatcaaagtttcaacttaccgtattggctgagcgcactcatattagtcgcctttattttagcaacactgtttctaaaattcgatcgtttaattgctgtgcttggcggtgttaccccatttttaattgcgattgtcattatgattgcggtctactatttcacaacaagtcatcttgattttactgccgctaataatgatgctcagattcataagcagaaatcattatcacctggatggtggtttgatgcgattaactatgcaagcttgcaaattgctgctgccttcagcttcttatcagtgatgggtagtaaagttaaatatcgtgactcaacgttatacgggggcttgattggcggtttaatcattacatttttactcatgatgattaatctaggtttaatttctcaattcgataaaattaaacacgtagatctacctacattaaaattagcgacacaaatgtctccgtcaattggtattattatgtctgtcattatgatacttgtcatctacaatactgttgttggattaatgtatgcatttgcgtcacgtttcagcgttccattcagcagacgttacttcatcattattattacaatggctgtcatcacttatattagtacatttatcggtttcatttcattaattggaaaagtattccctattatgggattgttcggtttcatcttactcatacctgtactctataaaggtttaattaagcgtattaccggcaaatctcatatcgat

SEQ ID NO: 3590 - protein, 359 aa, Staphylococcus aureus
  MISC_FEATURE (1)..(359): conserved hypothetical
MRILKESIIVAFAFVGVVVGAGFATGQEIFQFFTSHGAYSISGIIVTGLLITLGGMVVMHTGHHLKSRNHSDSINYFLYPSIARGFDIILTMFMLSLAIIMTAGGASTIHQSFNLPYWLSALILVAFILATLFLKFDRLIAVLGGVTPFLIAIVIMIAVYYFTTSHLDFTAANNDAQIHKQKSLSPGWWFDAINYASLQIAAAFSFLSVMGSKVKYRDSTLYGGLIGGLIITFLLMMINLGLISQFDKIKHVDLPTLKLATQMSPSIGIIMSVIMILVIYNTVVGLMYAFASRFSVPFSRRYFIIIITMAVITYISTFIGFISLIGKVFPIMGLFGFILLIPVLYKGLIKRITGKSHID

SEQ ID NO: 3591 - DNA, 285 bp, Staphylococcus aureus
atgacaaacgaagataaacgtttcgaacaattaagatttgaacgcaaatttatagttattccgtatttaatttatgcagtcattgtattactattaaatattttctattctgatttgaaaataacaatgacattattcggacttttctttgcgtataatgtagtcattttgttcatagcatttgttaaacattataaacgcacattgttactaagtcttatattaacagtgcttagtggcgcggcattctttggaattatttatgtttatggcattaatcatttt

SEQ ID NO: 3592 - protein, 95 aa, Staphylococcus aureus
  MISC_FEATURE (1)..(95): hypothetical protein
MTNEDKRFEQLRFERKFIVIPYLIYAVIVLLLNIFYSDLKITMTLFGLFFAYNVVILFIAFVKHYKRTLLLSLILTVLSGAAFFGIIYVYGINHF

SEQ ID NO: 3593 - DNA, 594 bp, Staphylococcus aureus
gtgatggaacatatttttagagaaggacaaaatggtgcgccaacactaatattattgcatggtacaggtggtgatgagttcgatttattaccgttaggcgaagcattgaatgaaaattatcacttgttaagtattagaggacaagtttcagaaaatgggatgaaccgttatttcaaacgtcttggtgaaggtgtttatgatgaagaagatttggcatttcgtggacaagaattgttgacgttcattaaagaagctgctgaacgttatgattttgatattgaaaaagcagtacttgttggattttcaaatggatcaaatatagcgattaacttaatgttgcgttcagaagcaccatttaaaaaagcattgttatatgcaccgttatacccagttgaagtaacgtcaacaaaggatttatcagatgtcagtgtgttgctttctatggggaaacatgatccaattgtgccattagctgcaagtgaacaagtcattaacttgtttaatacacgtggggcacaagtcgaagaagtttgggtgaagggccatgaaattacagaaactggattaacggctggtcaacaaatacttgggaaa

SEQ ID NO: 3594 - protein, 198 aa, Staphylococcus aureus
  MISC_FEATURE (1)..(198): conserved hypothetical
VMEHIFREGQNGAPTLILLHGTGGDEFDLLPLGEALNENYHLLSIRGQVSENGMNRYFKRLGEGVYDEEDLAFRGQELLTFIKEAAERYDFDIEKAVLVGFSNGSNIAINLMLRSEAPFKKALLYAPLYPVEVTSTKDLSDVSVLLSMGKHDPIVPLAASEQVINLFNTRGAQVEEVWVKGHEITETGLTAGQQILGK

SEQ ID NO: 3595 - DNA, 966 bp, Staphylococcus aureus
atgataaataatcatgaattactaggtattcaccatgttactgcaatgacagatgatgcagaacgtaattataaattttttacagaagtactaggcatgcgtttagttaaaaagacagtcaatcaagatgatatttatacgtatcatactttttttgcagatgatgtaggttcggcaggtacagacatgacgttctttgattttccaaatattacaaaagggcaggcaggaacaaattccattacaagaccgtcttttagagtgcctaacgatgacgcattaacatattatgaacagcgctttgatgagtttggtgttaaacacgaaggtattcaagaattatttggtaaaaaagtgttgccatttgaagaagtcgatggccaagtgtatcaattaatttcagatgagttaaatgaaggggtagcacctggtgtaccttggaagaatggaccggttccagtagataaagcgatttatggattaggccccattgaaattaaagtaagttattttgacgactttaaaaatattttagagactgtttacggtatgacaactattgcgcatgaagataatgtcgcattacttgaagttggcgaaggaggcaatggtggccaggtaatcttaataaaagatgataaagggccagcagcacgtcaaggttatggtgaggtacatcatgtgtcatttcgtgtgaaagatcatgatgcaatagaagcgtgggcaacgaaatataaagaggtaggtattaataactcaggcatcgttaatcgtttctattttgaagcattatatgcacgtgtggggcatattttaatagaaatttcaacagatggaccaggatttatggaagatgaaccttatgaaacattaggcgaagggttatccttaccaccatttttagaaaataaaagagaatatattgaatcggaagttagaccttttaatacgaagcgtcaacatggt

SEQ ID NO: 3596 - protein, 322 aa, Staphylococcus aureus
  MISC_FEATURE (1)..(322): hypothetical protein
MINNHELLGIHHVTAMTDDAERNYKFFTEVLGMRLVKKTVNQDDIYTYHTFFADDVGSAGTDMTFFDFPNITKGQAGTNSITRPSFRVPNDDALTYYEQRFDEFGVKHEGIQELFGKKVLPFEEVDGQVYQLISDELNEGVAPGVPWKNGPVPVDKAIYGLGPIEIKVSYFDDFKNILETVYGMTTIAHEDNVALLEVGEGGNGGQVILIKDDKGPAARQGYGEVHHVSFRVKDHDAIEAWATKYKEVGINNSGIVNRFYFEALYARVGHILIEISTDGPGFMEDEPYETLGEGLSLPPFLENKREYIESEVRPFNTKRQHG

SEQ ID NO: 3597 - DNA, 432 bp, Staphylococcus aureus
atggatcgaacgaaacaatctctcaatgtttttgtcggaatgaatagggcgttagacacattagagcaaattacaaaagaagacgtaaagcgatatggcttaaatattactgaatttgcagtgctcgagttgctttataataaaggtccgcaaccaattcaacgtattagagaccgcgtattaattgcaagtagcagcatttcatatgttgtaagtcaattagaggacaaaggttggattacacgtgaaaaggataaagatgataaacgtgtatatatggcttgtttaactgaaaaaggtcaaagtcaaatggcagatattttccctaagcatgctgagacattaacaaaagcgtttgatgtgttaacaaaggatgaattaacaatcttacaacaagcgtttaagaaactaagtgcacaatctacagaagtg

SEQ ID NO: 3598 - protein, 144 aa, Staphylococcus aureus
  MISC_FEATURE (1)..(144): hypothetical protein
MDRTKQSLNVFVGMNRALDTLEQITKEDVKRYGLNITEFAVLELLYNKGPQPIQRIRDRVLIASSSISYVVSQLEDKGWITREKDKDDKRVYMACLTEKGQSQMADIFPKHAETLTKAFDVLTKDELTILQQAFKKLSAQSTEV

SEQ ID NO: 3599 - DNA, 291 bp, Staphylococcus aureus
ttgatatgtatgagtaaccttgaaatcaaacaaggcgagaacaaattctatattggtgatgatgaaaataatgctttagctgaaatcacataccgttttgtggataataatgaaattaacattgatcatacaggcgtatctgatgaacttggtggtcaaggtgttggcaaaaaactacttaaagcagttgttgaacacgctcgagaaaataatttgaaaattattgcctcatgttcatttgccaaacatatgttagaaaaagaagattcatatcaagatgtatatcttggt

SEQ ID NO: 3600 - protein, 97 aa, Staphylococcus aureus
  MISC_FEATURE (1)..(97): conserved hypothetical
LICMSNLEIKQGENKFYIGDDENNALAEITYRFVDNNEINIDHTGVSDELGGQGVGKKLLKAVVEHARENNLKIIASCSFAKHMLEKEDSYQDVYLG

SEQ ID NO: 3601 - DNA, 804 bp, Staphylococcus aureus
atggcatttcacgataaaacagcaacacaagtgacaaacattgtactgaacgtaagagacttagacttaatgacaacattttacaaaaacattttaggactatccgttaaaagttctgacgataatacaaccgtattatctgttgggactggtggccatactctaacgttacatttattagaagacggccgtcagacttccccacgtgaagcagggctttttcatatagcatttttattaccaactactgaggatctagctaacttcttatatttcgtggcacaaaaaaatatgggcatcggcgctggtgatcatttagtaagtgaagctttatatttcaacgaccccgaaggtaatggtattgaagtctatcgcgatagaccttcatcttcatgggaatggcaaaatggcaaagttaaaatggatactttagaagttgatagccaaaccttattaacacatcgtactgatgaaggttggcaaggaatgccagcaaaaggcatgattggacacttacatttaaaaacacatgatttagacgcagcatatcaatgttacattgaacaattaggattccaacatgtgtctgattttccacgtgcgctatttatgtcaacgaatcattatcaccatcatattgctgctaatacttggcaatccaatcaagcaagacaaaacaattcacaaagttatggattaacacatgttgatatttatcaacccgacgcctcaacacatacatttacggcaccagaagggtttgacatcacagttcattcaaatactgaccttgttccagaaaaa

SEQ ID NO: 3602 - protein, 268 aa, Staphylococcus aureus
  MISC_FEATURE (1)..(268): conserved hypothetical
MAFHDKTATQVTNIVLNVRDLDLMTTFYKNILGLSVKSSDDNTTVLSVGTGGHTLTLHLLEDGRQTSPREAGLFHIAFLLPTTEDLANFLYFVAQKNMGIGAGDHLVSEALYFNDPEGNGIEVYRDRPSSSWEWQNGKVKMDTLEVDSQTLLTHRTDEGWQGMPAKGMIGHLHLKTHDLDAAYQCYIEQLGFQHVSDFPRALFMSTNHYHHHIAANTWQSNQARQNNSQSYGLTHVDIYQPDASTHTFTAPEGFDITVHSNTDLVPEK

SEQ ID NO: 3603 - DNA, 720 bp, Staphylococcus aureus
atgaagtataatttgtatagcaataaatataaaaatgggaggctatgttcaatgagcaatatgaatcaaacaattatggatgcatttcatttcagacatgcgactaagcaattcgatccacaaaagaaagtttcgaaagaagattttgaaacaatattagagtcaggtagattgtctccaagttctcttgggttagaaccttggaagtttgtcgtgattcaagatcaagcgttacgtgatgaattaaaagcgcacagttggggcgcagcaaaacaattagatacagcgagccattttgtgctaatttttgcgcgtaaaaatgtaacgtcaagatcaccgtatgtacaacatatgttaagagatattaaaaaatatgaggcacaaacgattccagctgttgaacaaaaattcgatgcattccaagcagatttccatatttctgataatgatcaagccttgtatgactggtcaagtaaacaaacgtatattgcattaggcaatatgatgacgacagccgcattgttaggtattgattcatgtccgatggaaggttttagtctggatacagtgacagacattttagcaaataaagggatcttagatactgagcaatttggtttatcagtgatggtcgcatttggctacagacaacaagagccaccgaaaaataaaacacgccaagcttatgaagatgttattgaatgggttggaccaaaagaa

SEQ ID NO: 3604 - protein, 240 aa, Staphylococcus aureus
  MISC_FEATURE (1)..(240): hypothetical protein
MKYNLYSNKYKNGRLCSMSNMNQTIMDAFHFRHATKQFDPQKKVSKEDFETILESGRLSPSSLGLEPWKFVVIQDQALRDELKAHSWGAAKQLDTASHFVLIFARKNVTSRSPYVQHMLRDIKKYEAQTIPAVEQKFDAFQADFHISDNDQALYDWSSKQTYIALGNMMTTAALLGIDSCPMEGFSLDTVTDILANKGILDTEQFGLSVMVAFGYRQQEPPKNKTRQAYEDVIEWVGPKE

SEQ ID NO: 3605 - DNA, 1062 bp, Staphylococcus aureus
gtgattttaatgtgcataatctttaatttcactcatttacttttcaatcttttaaaagcgaggtttttaataatgacaaaaattatgttctttggtacgcgtgattatgagaaagagatggcattaaattgggggaaaaagaataatgtcgaagtaactacttctaaagagctattatcaagtgctacagtcgatcaattaaaagattacgatggcgtaactacaatgcaatttggtaagttagaaaatgacgtttatcctaaattagaatcttacggtattaaacaaattgcacaacgtactgctggatttgatatgtatgatttagatttagctaaaaaacacaatattgtgatatctaacgttcctagttattcacctgaaacaattgcagagtattctgtttctatcgccctacaattagtgcgtcgcttcccagatattgaacgccgtgtacaagcacatgattttacttggcaagcagaaatcatgtctaaaccagttaaaaatatgactgttgcaattattggtacgggtcgtatcggtgctgctacagctaaaatatatgcaggatttggtgctacaattacagcttatgacgcctatcctaataaagatttagactttttaacttataaagatagtgttaaagaagctattaaagatgccgatattatttctttacatgttccagcgaacaaagaaagctatcatttattcgataaagcaatgtttgatcatgtgaaaaaaggtgcaatcttagttaacgcagcacgtggtgcagtcatcaatacacctgatttaatcgctgcagtgaacgatggtactttgttaggtgctgcgattgatacttatgaaaatgaagcagcatacttcacaaatgactggactaataaagacattgacgataaaacattattagagttaatcgaacatgaaagaattttagtaacaccacatattgctttcttctctgatgaagcagtacaaaaccttgttgaaggtggtttaaacgcagcattatctgtcattaacactggtacatgtgaaacacgtttaaat

SEQ ID NO: 3606 - protein, 354 aa, Staphylococcus aureus
  MISC_FEATURE (1)..(354): D-specific D-2-hydroxyacid
VILMCIIFNFTHLLFNLLKARFLIMTKIMFFGTRDYEKEMALNWGKKNNVEVTTSKELLSSATVDQLKDYDGVTTMQFGKLENDVYPKLESYGIKQIAQRTAGFDMYDLDLAKKHNIVISNVPSYSPETIAEYSVSIALQLVRRFPDIERRVQAHDFTWQAEIMSKPVKNMTVAIIGTGRIGAATAKIYAGFGATITAYDAYPNKDLDFLTYKDSVKEAIKDADIISLHVPANKESYHLFDKAMFDHVKKGAILVNAARGAVINTPDLIAAVNDGTLLGAAIDTYENEAAYFTNDWTNKDIDDKTLLELIEHERILVTPHIAFFSDEAVQNLVEGGLNAALSVINTGTCETRLN

SEQ ID NO: 3607 - DNA, 870 bp, Staphylococcus aureus
atgacaaacttcattgcttgtcatgagatggatataatgaagacgactaaaagagcaatgaggaggataatcatggttaaggctattgcggtagatatggacgggacgtttttagattcaaaaaagacatatgataaacttagatttgaagcgatttttactgaacttagaaatagagatattacatttattgctgcgagtggcaatcaatatgcgaagttgaagtctattttcggggatagagatatgtattttatttctgaaaatggtgcagttatttataatggcaatgagttatataattataaaagctttaatcgtcaggtgtttcaacaggttgtcgattacttaaatatgaagcaaagtattgatcaactcgtcatctgtggtttgaaaagcgcgtatattttaaaacatacttctgaagcgtttaaagaagatacgagattttattatcatcagttaaaagaaattgacagtctacagcaattacctgaggatgattatgtcaaaatagcatttaatattaatcgtgagacgcatccgaatgttgacgaagaagtagcaacgcaattcagcaatgatattaaacttgtctcaagtgggcacgatagcattgatattattatgccaaacatgactaaagggcaggcattaaaacgattgttagataaatgggaaatgtctccttcagagctcatggccttcggagatgcgaataatgataaagatatgttagcgttcgctaagcatagttatgtgatggaaaatagtcatgatgaagaattgttcaatattgcctctgctgtcgctccaagtaatgataagcagggtgtattaacgattatcgaacaagaagtgttgaaaaag

SEQ ID NO: 3608 - protein, 290 aa, Staphylococcus aureus
  MISC_FEATURE (1)..(290): conserved hypothetical
MTNFIACHEMDIMKTTKRAMRRIIMVKAIAVDMDGTFLDSKKTYDKLRFEAIFTELRNRDITFIAASGNQYAKLKSIFGDRDMYFISENGAVIYNGNELYNYKSFNRQVFQQVVDYLNMKQSIDQLVICGLKSAYILKHTSEAFKEDTRFYYHQLKEIDSLQQLPEDDYVKIAFNINRETHPNVDEEVATQFSNDIKLVSSGHDSIDIIMPNMTKGQALKRLLDKWEMSPSELMAFGDANNDKDMLAFAKHSYVMENSHDEELFNIASAVAPSNDKQGVLTIIEQEVLKK

SEQ ID NO: 3609 - DNA, 633 bp, Staphylococcus aureus
atgaaactaaataactattctttaaaagttaaaaacaaacaactagttgacaattgtgatttaaatttctatcttggtcagatcaatcacattgttggtaaaaatggtgtaggaaaatctttattagctaaagatttcttactaaataatagtggaaatatccctaagtccatttctcaaaatgtaaccttaatatcaagttcatcaaatattcctaatgatataacaaaagattttttattatcattgttaaaatcaaaatttgaaaacaatcgacaaacattcgataagatttataacatactaaacatcgaagcaataccgtctaacgtactactaaaaaacttgagtgatggtcaaaaacaaaagcttaaattattaagtttcttattggaagatcatgatttaatcatattagatgaagttacaaacgctttagacaagaaaacagttaatgaaatttatgaatttttaaatgattttattcaaagccatcaaactaaaactattatcaatattacacataatttatccgatttaagtgctttgccgggtaaatactttatttttaaagaccttcaaatagaagagtaccaatcaaaagaagaagtcataaatgattacattaattta

SEQ ID NO: 3610 - protein, 211 aa, Staphylococcus aureus
  MISC_FEATURE (1)..(211): hypothetical protein
MKLNNYSLKVKNKQLVDNCDLNFYLGQINHIVGKNGVGKSLLAKDFLLNNSGNIPKSISQNVTLISSSSNIPNDITKDFLLSLLKSKFENNRQTFDKIYNILNIEAIPSNVLLKNLSDGQKQKLKLLSFLLEDHDLIILDEVTNALDKKTVNEIYEFLNDFIQSHQTKTIINITHNLSDLSALPGKYFIFKDLQIEEYQSKEEVINDYINL

SEQ ID NO: 3611 - DNA, 729 bp, Staphylococcus aureus
gtgtccactttgaaattagaatttaaaaaaagtatttccaataaaattatttacacgcttgttgtgctattcacattccttttcttacttgggtattttttaccaataggtatagacaaagttaaaagtttaagctatagccagtttttcttcagttcatatactgttgcaacgcaattagggttcttactattttcatttgttattgcatattttattaataaagagtattcgaataaaaatatcctgttttataaattgattggcgataatatctttaccttcttctataaaaaggtagcagtgttattttttgaatgtttagtgttcataattctaagtatcactattatttcaattatatattcggatttctcacattacttactattaataatcttattttcactcgttatcttacaatatatcttagttgttggaacgattagtatggtttcacctaacattttaatcagcttaggtatcagcattgtatattggattggttcagtcatcttagttgccattaataaaaatatatttggtatcgttgctccatttgaggcgagcaatacgatgtatcgtgccgtagaaaaaatattgaataacgagtcaacatttatgtgtcctactgaaattataaatatagtatcattcttcgttcttctatttatagttaatactattgtcttattactaagtagaaagagatggttgaaaatcggtatg

SEQ ID NO: 3612 - protein, 243 aa, Staphylococcus aureus
  MISC_FEATURE (1)..(243): conserved hypothetical
VSTLKLEFKKSISNKIIYTLVVLFTFLFLLGYFLPIGIDKVKSLSYSQFFFSSYTVATQLGFLLFSFVIAYFINKEYSNKNILFYKLIGDNIFTFFYKKVAVLFFECLVFIILSITIISIIYSDFSHYLLLIILFSLVILQYILVVGTISMVSPNILISLGISIVYWIGSVILVAINKNIFGIVAPFEASNTMYRAVEKILNNESTFMCPTEIINIVSFFVLLFIVNTIVLLLSRKRWLKIGM

SEQ ID NO: 3613 - DNA, 906 bp, Staphylococcus aureus
atggaacaaataatgattaatcactatgttcatttttctaggcttgtacaaggtttttggcgtgcaaatgaatggaagatgactgcgaaagagttaaattattttataaatgaattagttgaacgtggaattacaacgatggatcatgctgatatttatggagattatcaatgtgaatcactgtttggtaatgctttggatttatcacccgaattaagaaataaaattcaaattgttacgaaatgtggtatcattttgccttctaagcaatttgattttacaaatggacatcgttatgatttgagtagtaagcacatcgtgaaatctgttgaacagtcattaatcaatttgaatgtagattatttagatagtctactcattcatcgtccttcaccattgatggatccagaacaagttgctgatgcattaactaaacttgttaaacaaggtaagttgaagtcattcggggtgtcgaattttaatcattcacaataccaattgttaaatcaatatattatgaaagaaagactacatattagcatcaatcaattagaattatcgccatatcacgttgatagtttacaagatggaacaatggattcaatgtatcaaaaccatgttcaaatcatggcttggagtccttttgcaggcggtaaaattttcgacaaggaagatattaaagcgcaacgtattatgaaagttgttcaatcaatagctgacaaatatggtgtgagtgacacagctgtgatgatagcgtggttagtaaaaataccgcatcgtatcatgccgatacttggaacaagtcagttaaagcgtattgatcaagcaatcgaagggctacaacttaatttagatgatcagtcgtggtttgacatttacaccgctattatcggacaagatattccg

SEQ ID NO: 3614 - protein, 302 aa, Staphylococcus aureus
  MISC_FEATURE (1)..(302): hypothetical protein
MEQIMINHYVHFSRLVQGFWRANEWKMTAKELNYFINELVERGITTMDHADIYGDYQCESLFGNALDLSPELRNKIQIVTKCGIILPSKQFDFTNGHRYDLSSKHIVKSVEQSLINLNVDYLDSLLIHRPSPLMDPEQVADALTKLVKQGKLKSFGVSNFNHSQYQLLNQYIMKERLHISINQLELSPYHVDSLQDGTMDSMYQNHVQIMAWSPFAGGKIFDKEDIKAQRIMKVVQSIADKYGVSDTAVMIAWLVKIPHRIMPILGTSQLKRIDQAIEGLQLNLDDQSWFDIYTAIIGQDIP

SEQ ID NO: 3615 - DNA, 615 bp, Staphylococcus aureus
gtgaatatggagttcttattattaattgtcgtagccggactgtattatattatatatttaactgctgtgatgtattctgaaaaaatagtagtattgcctataatcatctatgccattgtgtttgtaataattggtatcacttatatctttataggcgacagctatgatcaattaacaaatttcaatgtgattttgtatatggggagtttgttttatgcatggatggctattagaaatctttggaacagaccactattactaaaatataagaacattacagatagttcaagtggaatagttaataaatctgaatacaattcagttgaaagcttacgtataaatattgaaatagctaagtataaagggattatttctttgatagtagctatagtactaacggtattaatgacattaaagtcaacacctcaaatcactgcagaaacacgtgacttaagtatctcatttttcatactcagcttatttatcattattatatttgcagtttgggatttgtttattagagttagaaaaggagcgtttgcttttgttgtaataaggccaatattatttagttgttggttatttattttgaatatgattttatcaagattatta

SEQ ID NO: 3616 - protein, 205 aa, Staphylococcus aureus
  MISC_FEATURE (1)..(205): hypothetical protein
VNMEFLLLIVVAGLYYIIYLTAVMYSEKIVVLPIIIYAIVFVIIGITYIFIGDSYDQLTNFNVILYMGSLFYAWMAIRNLWNRPLLLKYKNITDSSSGIVNKSEYNSVESLRINIEIAKYKGIISLIVAIVLTVLMTLKSTPQITAETRDLSISFFILSLFIIIIFAVWDLFIRVRKGAFAFVVIRPILFSCWLFILNMILSRLL

SEQ ID NO: 3617 - DNA, 564 bp, Staphylococcus aureus
gtggcagcatatttgtttgctaaaccacatatcgataattatcttcacgataaagataaagatgaaaagattgaacaatatgataaaaatgtaaaagaacaggcgagtaaagataaaaagcagcaagctaaacctcaaattccgaaagataaatcgaaagtggcaggctatattgaaattccagatgctgatattaaagaaccagtatatccaggaccagcaacacctgaacaattaaatagaggtgtaagctttgcagaagaaaatgaatcactagatgatcaaaatatttcaattgcaggacacactttcattgaccgtccgaactatcaatttacaaatcttaaagcagccaaaaaaggtagtatggtgtactttaaagttggtaatgaaacacgtaagtataaaatgacaagtataagagatgttaagcctacagatgtaggagttctagatgaacaaaaaggtaaagataaacaattaacattaattacttgtgatgattacaatgaaaagacaggcgtttgggaaaaacgtaaaatctttgtagctacagaagtcaaa

SEQ ID NO: 3618 - protein, 188 aa, Staphylococcus aureus
  MISC_FEATURE (1)..(188): sortase [Staphylococcus
VAAYLFAKPHIDNYLHDKDKDEKIEQYDKNVKEQASKDKKQQAKPQIPKDKSKVAGYIEIPDADIKEPVYPGPATPEQLNRGVSFAEENESLDDQNISIAGHTFIDRPNYQFTNLKAAKKGSMVYFKVGNETRKYKMTSIRDVKPTDVGVLDEQKGKDKQLTLITCDDYNEKTGVWEKRKIFVATEVK

SEQ ID NO: 3619 - DNA, 153 bp, Staphylococcus aureus
atgagtcattttgaaattaatggtatactatatgaaatgttaacaggcattgtgaaatgtataaaaggagccttaacgtatgaaaaaatggacaaatcgattaatgacaatcgctggtgtggtacttatcctagtggcagcatatttgtttgc

SEQ ID NO: 3620 - protein, 51 aa, Staphylococcus aureus
MSHFEINGILYEMLTGIVKCIKGALTYEKMDKSINDNRWCGTYPSGSIFVC

SEQ ID NO: 3621 - DNA, 489 bp, Staphylococcus aureus
atgattagatacgctaaaaaagaggatttaaacgctatattagcgatatacaatgatgccattatcaatactacagctgtttatacttatgaaccacaaaccatagacgaacgtgtcgcatggtttgaaacgaaacaacgtaagcatgagcctatctttgtatttgaggaaaatggaagtgtcttagggtttgcgacgttcggttcatttagaccttggccagcatacctatatacaatcgaacattctatttatgtcgatgcttcagctagaggaaaaggtattgctagtcaattactacaccatttaattgtggaagcaaaagctaaaggttatcgtgcgctagttgcaggcattgatgcttccaacaaagcgagtattcagttgcatcaaaagtttgcttttaagcatgccggcacactgaccaatgtaggttttaaatttaatagatggttagatttagcattttacgaattagatttacaagac

SEQ ID NO: 3622 - protein, 163 aa, Staphylococcus aureus
  MISC_FEATURE (1)..(163): hypothetical protein
MIRYAKKEDLNAILAIYNDAIINTTAVYTYEPQTIDERVAWFETKQRKHEPIFVFEENGSVLGFATFGSFRPWPAYLYTIEHSIYVDASARGKGIASQLLHHLIVEAKAKGYRALVAGIDASNKASIQLHQKFAFKHAGTLTNVGFKFNRWLDLAFYELDLQD

SEQ ID NO: 3623 - DNA, 96 bp, Staphylococcus aureus
ttgataaaaaagaagcatctgtctggatcattagtaccagatagatgcttcttaattatctctgaagaagttgaaagatttatggaaaatgcatac

SEQ ID NO: 3624 - protein, 32 aa, Staphylococcus aureus
LIKKKHLSGSLVPDRCFLIISEEVERFMENAY

SEQ ID NO: 3625 - DNA, 897 bp, Staphylococcus aureus
atgtttgattcaattagagagactatagattatgccgtagaaaataatatgtcatttgcggatatcatggttaaagaagaaatggaattaagcggtaaatcacgtgatgaagtgcgagcgcaaatgaaacaaaatttagatgtcatgcgagacgcagtaatcaaagggacgacaggtgatggggttgaaagtgtaacgggctacactggtcatgatgctgctaaactacgtgattataatgaaacacatcatgctttgtctggatatgaaatgattgacgcagtcaaaggtgccattgcaacaaatgaagtcaatgctgcgatgggtattatttgtgcaacgccaacagctggttcctcgggtaccattcccggtgcactttttaaattagaaaaaacacatgatttaacagaagagcaaatgattgatttcttattcacttcagcattgtttgggcgtgtcgtagcaaacaatgcaagtgtagctggtgcaacaggtggctgccaagctgaagttggttcagcatctgcaatggccgcagctgcagcagtagctatattcggaggatcaccagaagcatccgggcacgctatggcattagcgataagtaatttattaggtttagtttgtgatccagtagccggacttgttgaaattccttgtgttatgagaaatgcaattggttcgggtaacgctttaatttcagcagatttagcattagcaggtattgaaagtagaatccctgttgatgaagttattgaagcaatggataaggttggtcgtaaccttcctgcatcattacgtgaaactggattgggtggactagcaggcacaccaactggcgaagcaattaaacgtaaaatctttggcacagctgaagatatggttaaaaataat

SEQ ID NO: 3626 - protein, 299 aa, Staphylococcus aureus
  MISC_FEATURE (1)..(299): hypothetical protein
MFDSIRETIDYAVENNMSFADIMVKEEMELSGKSRDEVRAQMKQNLDVMRDAVIKGTTGDGVESVTGYTGHDAAKLRDYNETHHALSGYEMIDAVKGAIATNEVNAAMGIICATPTAGSSGTIPGALFKLEKTHDLTEEQMIDFLFTSALFGRVVANNASVAGATGGCQAEVGSASAMAAAAAVAIFGGSPEASGHAMALAISNLLGLVCDPVAGLVEIPCVMRNAIGSGNALISADLALAGIESRIPVDEVIEAMDKVGRNLPASLRETGLGGLAGTPTGEAIKRKIFGTAEDMVKNN

SEQ ID NO: 3627 - DNA, 678 bp, Staphylococcus aureus
atggcaaagagctatgattatcaaagtgctttcgatattatcggaccagttatgatgggcccttcaagttctcatacggctggtgcagtaaagattgggaattcagcacgcgcaatattgggagatattcctaaaaatattgaaatacattattatgaatcatttgctcaaacacaccaaggacatggtacagatgtcgctattgtgggtggagcaatgggatattcaacatttgataaccgaattaaatcttcattagaaattgcagctgatgatggtattaaaatagatatcatcgaagaagaaggcgatagtattggtcaacatccaaactgtgcttatatcaaatcatctcgtaatgatggtcgctacattgaaattatcggtatttcaatcggtggtggtacaattaaaattaaaggtattcatataaatggactagaagtagatttaaatcatggattaccaattttagttgttgacggaaatatgactaaagcacaagtaaatcatttcatcaatgatatcaacgatatgaaattagactgtaaagatgaatttattaagatagatgaagataaatgcttggttgtaataccattaaataaagcaatctcagaatcaacattaaatacaattaaagagaaatacagtgacgtaaacgtttcctatataaat

SEQ ID NO: 3628 - protein, 226 aa, Staphylococcus aureus
  MISC_FEATURE (1)..(226): hypothetical protein
MAKSYDYQSAFDIIGPVMMGPSSSHTAGAVKIGNSARAILGDIPKNIEIHYYESFAQTHQGHGTDVAIVGGAMGYSTFDNRIKSSLEIAADDGIKIDIIEEEGDSIGQHPNCAYIKSSRNDGRYIEIIGISIGGGTIKIKGIHINGLEVDLNHGLPILVVDGNMTKAQVNHFINDINDMKLDCKDEFIKIDEDKCLVVIPLNKAISESTLNTIKEKYSDVNVSYIN

SEQ ID NO: 3629 - DNA, 1041 bp, Staphylococcus aureus
atggatattctgttaggtgtaggcacattagtcttggttttagtgatcatgacgctatttttaaagtatgcaccgtacggtaaacaaggactacaagcattatccggtgcagcttgtgcgacatttctaccacaagcattcttaagttatgctattggtggcgtatttgatattaaatttctacaagatattggggatttagcaggaagtttaagcggtatcgcagtaggtattctaacgtgcttaaacttaggcgttgcaccagtatttgcggtcattgttggtttagtattacatgactttaaattattaccagcattcatcgcagcttatggcgtagcttttttaattaaatggattgaaaagaaagttccagaaggcttggacttaattgtggtgatcttatttgcaccagcaattgctttcggacttgcatcaatcattacacctggtgtgctagcaacattaaaacaaataggtagtgctgtcactgcggtaggtgataacaatccatatgcattagcggtcattttaggactagtgattcctgttacaggtatgacaccgctaagttcaatggtattaacaagtttattaggactgacaggtgttcctatggctattggagcactaacatgtacaggtagctcatttgttaaccttattttattccgaaaattaaacattggtggaccgtcaaaagcatttgcagtttgtattgagccattgacgcaaattgatttaatagcgcaatatccagtacaactatatggtacaaatgcactgattggggtcgtcaacgcatgtatcgtgacatttagcggactagtaataggtgtcaaaggtatggcaacaccaattgcaggcgccatcgtattgtttggctttaataatgcagtgacatcaattgtaacaatcgcaacagtgattattgtcagcattgtcttagcctatattattggaacactaattaataagtttaatttaatgaatatcaactttaaaatgccgagcaaaaagaatcatattaaggagagtgtt

SEQ ID NO: 3630 - protein, 347 aa, Staphylococcus aureus
  MISC_FEATURE (1)..(347): hypothetical protein
MDILLGVGTLVLVLVIMTLFLKYAPYGKQGLQALSGAACATFLPQAFLSYAIGGVFDIKFLQDIGDLAGSLSGIAVGILTCLNLGVAPVFAVIVGLVLHDFKLLPAFIAAYGVAFLIKWIEKKVPEGLDLIVVILFAPAIAFGLASIITPGVLATLKQIGSAVTAVGDNNPYALAVILGLVIPVTGMTPLSSMVLTSLLGLTGVPMAIGALTCTGSSFVNLILFRKLNIGGPSKAFAVCIEPLTQIDLIAQYPVQLYGTNALIGVVNACIVTFSGLVIGVKGMATPIAGAIVLFGFNNAVTSIVTIATVIIVSIVLAYIIGTLINKFNLMNINFKMPSKKNHIKESV

SEQ ID NO: 3631 - DNA, 960 bp, Staphylococcus aureus
atgttgttggtgttaagttttaaaggggtgagatacttggcgaataatcattcagctttgcgtttaaaaggaattatacttgccattgtcggtgcttgtttatggggattaggtggtactgtttctgatttcttgttcaaatataagaatattaatgtcgattggtacgtcactgctcgacttgtagtcagtggtgttttcttacttattatgtacaaaatgatgcaacccaaacgttcaatatttagcgtattccaagatcgacgtatgttaggcaaattacttatcttcagtatactgggcatgttagtagtacaatatgcttatatggcatctattaatacaggtaatgctgcgattgcaacattactacaatacattgcgccagtttatattattatttggtttgtcataagaggcgttgcaaaactaacattatttgatgtgcttgctattatcatgacactattaggaacatttttattattaacaaatggttcattttctaatttagtcgtcaatcctgcaagtttattctggggtattttagctggtgtagcactcgctttttacacaatttatccttcagacctacttaaccgcttcggttcgattctaattgtcgggtgggcaatgcttatttctggtgttgcgatgaatttacgccatccaatttggcacattgatatcactaaatgggacatatcaattatattatttttaatctttggtattatcggtggtaccgcactcgcattttatttctttatcgacagtttacaatacatatcagcgaaagaaacaacattattcggaactgttgaacctgtcgtagccgttatcgcaagcagtctatggttacatgtggcattcaaaccatttcaaatcgtaggcatcattcttattatgattttaattttattactatcacttaaaagacaacctgaaacattagatgaa

SEQ ID NO: 3632 - protein, 320 aa, Staphylococcus aureus
  MISC_FEATURE (1)..(320): conserved hypothetical
MLLVLSFKGVRYLANNHSALRLKGIILAIVGACLWGLGGTVSDFLFKYKNINVDWYVTARLVVSGVFLLIMYKMMQPKRSIFSVFQDRRMLGKLLIFSILGMLVVQYAYMASINTGNAAIATLLQYIAPVYIIIWFVIRGVAKLTLFDVLAIIMTLLGTFLLLTNGSFSNLVVNPASLFWGILAGVALAFYTIYPSDLLNRFGSILIVGWAMLISGVAMNLRHPIWHIDITKWDISIILFLIFGIIGGTALAFYFFIDSLQYISAKETTLFGTVEPVVAVIASSLWLHVAFKPFQIVGIILIMILILLLSLKRQPETLDE

SEQ ID NO: 3633 - DNA, 966 bp, Staphylococcus aureus
atgcgtaaaaaatggtctacacttgcgtttggatttttagttgcagcatacgcacatattagaattaaagaaaaacgcagtgtgaaaagttatatgttagaacaaggtatacgattatctagagctaagcgtcgttttatgtataaagaagaagcgatgaaagcattagaaaaaatggcgccacagacagcaggcgaatatgagggaaccaattatcagtttaagatgccagtaaaagtggataagcacttcggttcaaccgtttataccgttaacgataaacaagataagcatcaacgcgttgtattatatgcacatggaggcgcatggttccaagacccactcaaaattcatttcgaatttattgatgaacttgcagaaacactcaatgctaaagtcatcatgccagtatatccgaagattccgcatcaagattatcaagcgacgtatgtgctttttgaaaagttgtaccatgatttattgaatcaagtagcagattctaaacaaatcgttgtaatgggtgactctgcgggcggtcaaattgctttatcatttgctcaattgttaaaagaaaaacatattgtgcaaccaggacatattgtattaatttcaccagttttagatgcaacgatgcagcatcctgaaattcctgactacttaaagaaagacccaatggtaggtgtggatggcagtgtgttcttagctgaacaatgggcaggggacacacctttagataactacaaagtatcaccaattaatggtgacttagatggtttaggtcgtattacattaactgttggtacaaaagaagtactgtacccagatgctttgaacttatcgcaattgttgagtgcgaaaggtatcgaacatgactttatacctggatattaccaattccatatttatccagtatttccgataccagagcgacgacgctttttataccaagtgaaaaatattattaac

SEQ ID NO: 3634 - protein, 322 aa, Staphylococcus aureus
  MISC_FEATURE (1)..(322): conserved hypothetical
MRKKWSTLAFGFLVAAYAHIRIKEKRSVKSYMLEQGIRLSRAKRRFMYKEEAMKALEKMAPQTAGEYEGTNYQFKMPVKVDKHFGSTVYTVNDKQDKHQRVVLYAHGGAWFQDPLKIHFEFIDELAETLNAKVIMPVYPKIPHQDYQATYVLFEKLYHDLLNQVADSKQIVVMGDSAGGQIALSFAQLLKEKHIVQPGHIVLISPVLDATMQHPEIPDYLKKDPMVGVDGSVFLAEQWAGDTPLDNYKVSPINGDLDGLGRITLTVGTKEVLYPDALNLSQLLSAKGIEHDFIPGYYQFHIYPVFPIPERRRFLYQVKNIIN

SEQ ID NO: 3635 - DNA, 924 bp, Staphylococcus aureus
atgaaaaataataaagatgaaaaaataagaatatccataattaacggatttttgggtagtggtaaaaccacgttactgacacattatattagtgaattattaaaaaatgatgagaaaattaaaatcatcatgaatgaattcggtacttttgatattgatagcaatagtatttcaaatgaaattgaagtccattcattgattaatggttgtgtttgttgcgatcttaaacaagaacttgtctatgaactaaaagccattgctttaaaaggggacgttaatcatgtcatcatagaagcgacaggcattgcgcatcctttggaattactagttgcatgtcaagatccgcaaatcgttaatttctttgaaaagccgattatttatggtgtattagatgcgactcgatttttagaacgtcatcaatataccgaaaatacagtttcgctgatggaagatcagttgaaactaagtgacatgattattattaataaaattgatcttataactgatgacagtcttgagaaaattgataagcaattaggtatgatttgtgcaagtattccaacttataaaacaacctatggaaaagtttcgttggaagaattggacttaactgttaaagacagagagatatcgtctcatcatcaccatcatcatgggattaaaagtatgacttacacgtttacaggtccgattgatcgtcatttgttttatcaatttataatgaaattaccggaatctgttctacgtttgaaaggttatgtgtcatttagagatcaaccaaatgcaatttatgaatttcaatatgcatatggtttaccagactatggaataattggcatgcaattaccattaacgattgttattattggtgaaactttagatacaaatcacatacgtaatcaattggatatgctacaatttacg

SEQ ID NO: 3636 - protein, 308 aa, Staphylococcus aureus
  MISC_FEATURE (1)..(308): hypothetical protein
MKNNKDEKIRISIINGFLGSGKTTLLTHYISELLKNDEKIKIIMNEFGTFDIDSNSISNEIEVHSLINGCVCCDLKQELVYELKAIALKGDVNHVIIEATGIAHPLELLVACQDPQIVNFFEKPIIYGVLDATRFLERHQYTENTVSLMEDQLKLSDMIIINKIDLITDDSLEKIDKQLGMICASIPTYKTTYGKVSLEELDLTVKDREISSHHHHHHGIKSMTYTFTGPIDRHLFYQFIMKLPESVLRLKGYVSFRDQPNAIYEFQYAYGLPDYGIIGMQLPLTIVIIGETLDTNHIRNQLDMLQFT

SEQ ID NO: 3637 - DNA, 441 bp, Staphylococcus aureus
atgtctgatcaacataatttaaaagaacagctatgctttagtttgtacaatgctcaaagacaagttaatcgctactactctaacaaagtttttaagaagtacaatctaacatacccacaatttcttgtcttaacaattttatgggatgaatctcctgtaaacgtcaagaaagtcgtaactgaattagcactcgatactggtacagtatcaccattattaaaacgaatggaacaagtagacttaattaagcgtgaacgttccgaagtcgatcaacgtgaagtatttattcacttgactgacaaaagtgaaactattagaccagaattaagtaatgcatctgacaaagtcgcttcagcttcttctttatcgcaagatgaagttaaagaacttaatcgcttattaggtaaagtcattcatgcatttgatgaaacaaaggaaaaa

SEQ ID NO: 3638 - protein, 147 aa, Staphylococcus aureus
  MISC_FEATURE (1)..(147): hypothetical protein
MSDQHNLKEQLCFSLYNAQRQVNRYYSNKVFKKYNLTYPQFLVLTILWDESPVNVKKVVTELALDTGTVSPLLKRMEQVDLIKRERSEVDQREVFIHLTDKSETIRPELSNASDKVASASSLSQDEVKELNRLLGKVIHAFDETKEK

SEQ ID NO: 3639 - DNA, 351 bp, Staphylococcus aureus
gtgttcgaaatggttaagcaattaaatagtgtcgaagcattccgtgaatttattcatcaatatccgttagcagttgtacatgtcatgcgcgatcagtgtagcgtgtgtcatgccgttttaccacaaattgaagacttgatgcaatcatatcccaatgtgccattagctgtgattaatcaaagtcaggtggaagctattgctggagaattaaatattttcactgtacctgtggatttaatttttatgaatggaaaagaaatgcatcgtcaagggcgttttatcgatatgcaacgttttgaacatcatcttaagcaaatgaatgatagtgtaaataacgatgtcgatgagcat

SEQ ID NO: 3640 - protein, 117 aa, Staphylococcus aureus
  MISC_FEATURE (1)..(117): hypothetical protein
VFEMVKQLNSVEAFREFIHQYPLAVVHVMRDQCSVCHAVLPQIEDLMQSYPNVPLAVINQSQVEAIAGELNIFTVPVDLIFMNGKEMHRQGRFIDMQRFEHHLKQMNDSVNNDVDEH

SEQ ID NO: 3641 - DNA, 408 bp, Staphylococcus aureus
atgacaacagaaggtctattagttgcagagaaagaaatcgaagtgaatggttacgacattgatgcgatgggtgtcgttagtaatatcgtttatattagatggttcgaagatttgagaacagcgtttattaatcagcacatgaattactcaacaatgatcaatcaaggcatttcacctatacttatgaaaacggaagcagagtataaagtacctgtcacaatacatgacaaaccagtaggtcgtatttacttagttaaagcaagcaagatgaaatgggtgtttcagtttgaaattgtgtccgcacatggcgtgcattgtattggtacacagacaggcggtttttacagattgagtgataagaagataacctctgtgccacaagtgtttcaagacattttagcaacaaaa

SEQ ID NO: 3642 - protein, 136 aa, Staphylococcus aureus
  MISC_FEATURE (1)..(136): conserved hypothetical
MTTEGLLVAEKEIEVNGYDIDAMGVVSNIVYIRWFEDLRTAFINQHMNYSTMINQGISPILMKTEAEYKVPVTIHDKPVGRIYLVKASKMKWVFQFEIVSAHGVHCIGTQTGGFYRLSDKKITSVPQVFQDILATK

SEQ ID NO: 3643 - DNA, 99 bp, Staphylococcus aureus
atgataaaaatacaagcaattgaactttattacggaaaatcaaacttttcaatgagactattaatttggctagtcgcgaagatgcatttttctaaaatg

SEQ ID NO: 3644 - protein, 33 aa, Staphylococcus aureus
MIKIQAIELYYGKSNFSMRLLIWLVAKMHFSKM

SEQ ID NO: 3645 - DNA, 2181 bp, Staphylococcus aureus
ttgcgtgttactggtaatgcaggcatgagcaaacaaccgcactatgagaatagtcttgtttgttcatgcctgctttttttgtacatggaagcggaaattgagataggggatgtttatatgtttaagaaattgtttggacaattgcaacgtatcggtaaagcattaatgttacctgttgcgattttaccagcagctggtattttattagcgtttggtaacgcaatgcacaacgaacaattagtagaaattgcaccatggttaaaaaacgatatcattgtaatgatttcgtcggtcatggaagcagcaggacaagttgtatttgataacttgccattattatttgcagttggtacagcacttggattagcaggaggagacggtgttgcagcattagcagcgctagtaggttacttaattatgaatgcaacaatggggaaagtgttgcacattacaattgatgacattttctcatatgccaaaggggcaaaagaattaagtcaagcagcgaaagaaccagcacatgctttagtattaggtattccaacgttacaaacgggtgtgtttggtggtattatcatgggtgctttagccgcatggtgttacaacaaattttataatattacactaccaccatttttaggattctttgcaggtaaacgatttgtaccgattgtgacatcggtcgtagcaatcgcaacaggtgtgcttttaagctttgcgtggccaccaattcaagatggattaaatagtttatcgaatttcttattaaataaaaatttaacattaacaacgtttatattcggtattattgaacgctcattaattccatttggtttacatcatattttctattcaccgttctggtttgaattcggaagttatacaaatcacgcaggtgaattggttcgtggtgaccaacgtatttggatggcacaattgaaagatggcgtaccatttactgctggtgcatttactactggtaaatatccatttatgatgtttggtttaccagcggcggcatttgctatttataaaaatgcacgaccagaacgtaaaaaagtcgtgggtggtttaatgttatcagcaggattaactgcatttttaactggtatcactgagccattagaattttcattcttatttgtagcaccagtactttatggaattcacgtattattagctggtacatcattcttagtaatgcatttattaggcgttaaaattggtatgacattctcaggtggtttcatagattatattttatatggtttattaaactgggatcgttcacacgcattattagttattccagtcggtattgtatatgctatcgtgtattacttcttattcgactttgcaattcgtaagtttaaattgaaaacaccaggtcgtgaagatgaagaaactgaaattcgtaactctagtgtcgcaaaattaccatttgatgtcttagatgcaatgggtggaaaagaaaacattaaacatttagatgcatgtattacacgtctacgcgtagaagtggttgataaatcaaaagtagatgtagcaggtattaaagctttaggcgcatcaggtgtattagaagttggaaacaatatgcaagctatctttggtccaaaatcagatcaaattaaacatgatatggccaagattatgagtggtgaaattacgaaaccaagtgaaacgacagtgactgaagaaatgtcagatgaaccagttcacgtagaagcacttggaacaacagacatctatgcaccaggtatcggtcaaatcattccattatcagaagtacctgatcaagtattcgctggtaaaatgatgggtgatggtgttggctttatccctgaaaaaggtgaaattgtagcaccgtttgatggtacagtgaaaacaatcttccctacgaaacatgcgataggattagaatctgaaagtggcgtcgaagtacttattcatattggtatcgatacagtgaaactgaatggtgaaggattcgaaagtctgattaacgttgatgaaaaagtaacacaaggtcaaccattaatgaaagtgaatttagcatacttgaaagcacacgcaccaagcatcgttacaccaatgattattacaaatcttgaaaataaagaacttgtcattgaagatgtacaagatgctgatccaggtaagctaattatgacagtcaaa

SEQ ID NO: 3646 - protein, 727 aa, Staphylococcus aureus
  MISC_FEATURE (1)..(727): PTS system,
LRVTGNAGMSKQPHYENSLVCSCLLFLYMEAEIEIGDVYMFKKLFGQLQRIGKALMLPVAILPAAGILLAFGNAMHNEQLVEIAPWLKNDIIVMISSVMEAAGQVVFDNLPLLFAVGTALGLAGGDGVAALAALVGYLIMNATMGKVLHITIDDIFSYAKGAKELSQAAKEPAHALVLGIPTLQTGVFGGIIMGALAAWCYNKFYNITLPPFLGFFAGKRFVPIVTSVVAIATGVLLSFAWPPIQDGLNSLSNFLLNKNLTLTTFIFGIIERSLIPFGLHHIFYSPFWFEFGSYTNHAGELVRGDQRIWMAQLKDGVPFTAGAFTTGKYPFMMFGLPAAAFAIYKNARPERKKVVGGLMLSAGLTAFLTGITEPLEFSFLFVAPVLYGIHVLLAGTSFLVMHLLGVKIGMTFSGGFIDYILYGLLNWDRSHALLVIPVGIVYAIVYYFLFDFAIRKFKLKTPGREDEETEIRNSSVAKLPFDVLDAMGGKENIKHLDACITRLRVEVVDKSKVDVAGIKALGASGVLEVGNNMQAIFGPKSDQIKHDMAKIMSGEITKPSETTVTEEMSDEPVHVEALGTTDIYAPGIGQIIPLSEVPDQVFAGKMMGDGVGFIPEKGEIVAPFDGTVKTIFPTKHAIGLESESGVEVLIHIGIDTVKLNGEGFESLINVDEKVTQGQPLMKVNLAYLKAHAPSIVTPMIITNLENKELVIEDVQDADPGKLIMTVK

SEQ ID NO: 3647 - DNA, 1737 bp, Staphylococcus aureus
atggcaaaaataaaagcaaatgaagcattagttaaagcattacaagcatgggatatagatcacttgtatggtattccaggagactcaatcgacgcagtagtcgatagtttacgtacagtgagagatcaatttaaattttatcatgtacgtcatgaagaagtagcaagcttagcggctgctggttacacaaaattaactggtaaaatcggtgtggcattaagtatcggtggccctggtttaattcatttattaaatggtatgtatgatgccaaaatggataatgtaccgcaattaatattatctggacaaacgaatagtacagcacttggaacgaaagcattccaagaaacaaatttacaaaaattatgtgaagatgtagccgtttataatcaccaaattgaaaaaggtgacaatgtgtttgaaatcgttaacgaagcaattcgtacggcatatgaacaaaaaggtgtagctgttgttatttgtcctaacgacttattaactgaaaaaattaaagatacaacgaataaaccagtagatacatcaagaccaacagtagtatcaccaaaatataaagacatcaaaaaagcggttaaactaattaataaaagtaaaaagcctgtcatgttaattggtgtaggtgcgaaacatgcgaaagatgagctacgtgaatttattgaaatggctaaaattcctgtcattcattcattaccagctaaaacaatcttgccggatgatcatccatatagtatcggtaacttaggtaaaatcggtaccaaaacatcttatcaaacaatgcaggaagcggatttattaattatggttggtacaaactatccatatgtggattacttacctaagaaaaatattaaagccattcaaattgacacaaatcctaaaaatatcggacatcgtttcaatattaatgtaggaattgttggagatagtaaaattgcgttgcatcagttaactgaaaatattaaacatgttgctgaaagaccattcttaaacaaaacgttagaacgtaaagcggtttgggataaatggatggaacaagataaaaataataatagtaaaccattacgtccagaacgattaatggcatcaatcaataaatttattaaagatgatgcagtgatttcagcagatgtaggtacagcaacagtttggtcaactcgatacttaaaccttggtgtaaataacaagttcatcatttcaagttggttaggtacaatgggttgcggtcttccaggtgcaattgcatcaaaaattgcatatccaaatagacaagccatcgcaattgctggtgacggtgcattccaaatggtaatgcaagacttcgctacagcagtacaatatgatttacctttaactgtatttgtacttaataacaaacagttagcatttattaaatatgaacaacaagcagctggtgaattagaatatgcagttgatttttctgatatggatcatgcaaaatttgctgaggcagcaggtggtaaaggttatacaattaagagtgctagcgaagtagatgctatagtcgaagaggcattagcacaagatgtaccaacgattgtagatgtatatgttgatcctaatgctgcgccattaccaggtaaaattgtaaatgaagaagcgcttggttatggtaagtgggcatttagatcaattactgaagataaacatttagatttagatcaaattccaccaatttcagtggcagcaaaacgtttctta

SEQ ID NO: 3648 - protein, 579 aa, Staphylococcus aureus
  MISC_FEATURE (1)..(579): hypothetical protein
MAKIKANEALVKALQAWDIDHLYGIPGDSIDAVVDSLRTVRDQFKFYHVRHEEVASLAAAGYTKLTGKIGVALSIGGPGLIHLLNGMYDAKMDNVPQLILSGQTNSTALGTKAFQETNLQKLCEDVAVYNHQIEKGDNVFEIVNEAIRTAYEQKGVAVVICPNDLLTEKIKDTTNKPVDTSRPTVVSPKYKDIKKAVKLINKSKKPVMLIGVGAKHAKDELREFIEMAKIPVIHSLPAKTILPDDHPYSIGNLGKIGTKTSYQTMQEADLLIMVGTNYPYVDYLPKKNIKAIQIDTNPKNIGHRFNINVGIVGDSKIALHQLTENIKHVAERPFLNKTLERKAVWDKWMEQDKNNNSKPLRPERLMASINKFIKDDAVISADVGTATVWSTRYLNLGVNNKFIISSWLGTMGCGLPGAIASKIAYPNRQAIAIAGDGAFQMVMQDFATAVQYDLPLTVFVLNNKQLAFIKYEQQAAGELEYAVDFSDMDHAKFAEAAGGKGYTIKSASEVDAIVEEALAQDVPTIVDVYVDPNAAPLPGKIVNEEALGYGKWAFRSITEDKHLDLDQIPPISVAAKRFL

SEQ ID NO: 3649 - DNA, 687 bp, Staphylococcus aureus
atgaatgattacgtgcaagccttattaatgattttgttgactgtcgttttatattatttcgctaaaaggttacaacaaaaatatccgaacccatttttgaatccagcattaattgcatctttaggaattatttttgtcttacttatctttggaattagttataacgggtatatgaaaggtggcagttggatcaaccatattttaaacgcaacggtcgtatgtttagcgtacccactttataaaaatagagagaaaattaaagacaatgtctctatcatttttgcaagtgtattaactggcgtcatgctgaatttcatgttagtgttcttaacacttaaagcatttggctattctaaagacgtcattgtaacgttattgccccgatctataacagccgcagtaggtatcgaagtgtcacatgaactaggtggtacagatacgatgaccgtactttttattatcacaacgggtttaatcggtagtattttaggttcgatgttattaagatttggaagatttgaatcttctatcgccaaaggattaacgtatgggaatgcgtcacatgcatttggcacagctaaagcactagaaatggatattgaatccggtgcatttagttcaattgggatgattttaactgcagttattagttcagtgttaatacctgttctaattttattattctat

SEQ ID NO: 3650 - protein, 229 aa, Staphylococcus aureus
  MISC_FEATURE (1)..(229): conserved hypothetical
MNDYVQALLMILLTVVLYYFAKRLQQKYPNPFLNPALIASLGIIFVLLIFGISYNGYMKGGSWINHILNATVVCLAYPLYKNREKIKDNVSIIFASVLTGVMLNFMLVFLTLKAFGYSKDVIVTLLPRSITAAVGIEVSHELGGTDTMTVLFIITTGLIGSILGSMLLRFGRFESSIAKGLTYGNASHAFGTAKALEMDIESGAFSSIGMILTAVISSVLIPVLILLFY

SEQ ID NO: 3651 - DNA, 393 bp, Staphylococcus aureus
atgcacaaagtccaattaataatcaaactactactacaactaggaatcatcattgtgattacttatattggcacagaaattcaaaagatttttcatcttcccttagccggcagtattgttggtctatttttattttatttactattacaatttaagattgtaccgctaacttgggtagaagacggtgcaaactttttattaaagacgatggtctttttcttcataccgtcagttgtaggtattatggatgttgcttccgaaattacgctaaattatatactctttttcgcagtcattatcataggaacatgtatcgttgcattatcttcaggttatattgctgaaaaaatgtctgttaaacataaacatcgtaaaggtgtagacgcttatgaa

SEQ ID NO: 3652 - protein, 131 aa, Staphylococcus aureus
  MISC_FEATURE (1)..(131): conserved hypothetical
MHKVQLIIKLLLQLGIIIVITYIGTEIQKIFHLPLAGSIVGLFLFYLLLQFKIVPLTWVEDGANFLLKTMVFFFIPSVVGIMDVASEITLNYILFFAVIIIGTCIVALSSGYIAEKMSVKHKHRKGVDAYE

SEQ ID NO: 3653 - DNA, 885 bp, Staphylococcus aureus
atgatgttagtggatatcaaacatatgaaatattttattgaagtcgttaagcaaggaggcatgactaatgcttccaaatcattatatattgcacaacctacaattagtaaagcaattaaagatattgaaaatgaaatgggcacgcccttatttgatagaagtaaaagacatttaattcttaccgatgcaggtcaaattttttatgagaaaagtaaagaaattgttgcactgtatgattatttaccatctgaaatggaacgcttgaatggactggaaacaggacatataaacatgggcatgtcggcagtcatgaatatgaagattcttatcaatattcttggtgcattccatcaacaatatccaaatgttacatataatttgatagaaaatggcggtaaaacaattgaacagcaaattatcaatgatgaagtagatataggcgtgaccactttgccagtcgatcatcatattttcgattatactaccctagataaggaagatttgcgacttatcgtgagcagagagcatcgactcgcaaaatatgaaactgttaaactcgaagatttagcaggtgaagacttcattttatttaataaagacttttacttgaatgataaaattattgaaaatgctaaaaacgttggctttgttccgaatactgtagcgcaaatttcacaatggcatgttatagaagatttagttacgaatgaattaggtattagtattttaccaacatcaatttcagagcaactaaatggagatgtgaagctgctacgcattgaagatgctcatgtacattgggaattaggtgttgtttggaagaaggataaacaattaagtcatgccacaacgaaatggatagaatttttgaaagaccgtttaggc

SEQ ID NO: 3654 - protein, 295 aa, Staphylococcus aureus
  MISC_FEATURE (1)..(295): hypothetical protein
MMLVDIKHMKYFIEVVKQGGMTNASKSLYIAQPTISKAIKDIENEMGTPLFDRSKRHLILTDAGQIFYEKSKEIVALYDYLPSEMERLNGLETGHINMGMSAVMNMKILINILGAFHQQYPNVTYNLIENGGKTIEQQIINDEVDIGVTTLPVDHHIFDYTTLDKEDLRLIVSREHRLAKYETVKLEDLAGEDFILFNKDFYLNDKIIENAKNVGFVPNTVAQISQWHVIEDLVTNELGISILPTSISEQLNGDVKLLRIEDAHVHWELGVVWKKDKQLSHATTKWIEFLKDRLG

SEQ ID NO: 3655 - DNA, 216 bp, Staphylococcus aureus
ttgagcttttacgaatttatgcaaagttttcttggtgatgacacaccattaggtgaattggttgattggattaatcaagatagcaatttccctagagaagtgaagagccatagtgaaatattgtcatattttcgaacaaatccatgtcctgaaagcatctcagtacctgtaattaaacgggcactatcagttttcaaccaattcacaaatgtacaa

SEQ ID NO: 3656 - protein, 72 aa, Staphylococcus aureus
  MISC_FEATURE (1)..(72): hypothetical protein
LSFYEFMQSFLGDDTPLGELVDWINQDSNFPREVKSHSEILSYFRTNPCPESISVPVIKRALSVFNQFTNVQ

SEQ ID NO: 3657 - DNA, 147 bp, Staphylococcus aureus
atgtatcattgtacatttgtgaattggttgaaaactgatagtgcccgtttaattacaggtactgagatgctttcaggacatggatttgttcgaaaatatgacaatatttcactatggctcttcacttctctagggaaattgctatct

SEQ ID NO: 3658 - protein, 49 aa, Staphylococcus aureus
MYHCTFVNWLKTDSARLITGTEMLSGHGFVRKYDNISLWLFTSLGKLLS

SEQ ID NO: 3659 - DNA, 429 bp, Staphylococcus aureus
atggaatataaaaagatactaattcgtttattaattgcttttgcagtacttttctcagcagatttcacttatcaatccgtcgaacaaacgcatcaatcgcatgccgcagttaattattatagtaaaaaccaatgtacatggtgggcatttaaacgtcgcgcacaagtcggtaaacctgtttctaatagatggggcaatgctaaaaattggtattacaatgcacgtaaatcaaaatatgcgactggtcgtacaccaagaaaatttgctgtcatgcaatcaactgcaggatattatggacatgtcgcagttgttgaacaagtatataaaaacggtagtattaaagtttcagaatacaacttttatcgcccattaaaatacaatacacgtgtactaagcaaaaaggcagcacgtaactttaactatatttac

SEQ ID NO: 3660 - protein, 143 aa, Staphylococcus aureus
  MISC_FEATURE (1)..(143): hypothetical protein
MEYKKILIRLLIAFAVLFSADFTYQSVEQTHQSHAAVNYYSKNQCTWWAFKRRAQVGKPVSNRWGNAKNWYYNARKSKYATGRTPRKFAVMQSTAGYYGHVAVVEQVYKNGSIKVSEYNFYRPLKYNTRVLSKKAARNFNYIY

SEQ ID NO: 3661 - DNA, 102 bp, Staphylococcus aureus
gtgttaaatattaaagcaattaaaccgagtgaaaaggggataaaggttttgagtcatcaatttaaacaggtctcaaaaactcagttaaattatttttttaac

SEQ ID NO: 3662 - protein, 34 aa, Staphylococcus aureus
VLNIKAIKPSEKGIKVLSHQFKQVSKTQLNYFFN

SEQ ID NO: 3663 - DNA, 132 bp, Staphylococcus aureus
ttgactgataaaaatggtcatggaatcgctataactgggattatactttttgttataaatgctcttcaaataaataatgatttaccaataagtatatcaagtaaactaaagaaatatattcataaacctgac

SEQ ID NO: 3664 - protein, 44 aa, Staphylococcus aureus
LTDKNGHGIAITGIILFVINALQINNDLPISISSKLKKYIHKPD

SEQ ID NO: 3665 - DNA, 294 bp, Staphylococcus aureus
ttgagtataatgttttttgagagaggagatatgacatttatggagattataatagagatttatatgtatttaagagatggaattaaagagcattttattttgaaaaaggttagaaaaaaatttaaaaaattaaatgagattaacagcgatatacaaaatatgtatgcagaaaatcaggggctcttagaaacagataaaacaataattgacaaggtcttaagcactgacgttacaaatagccatgatattaatgaattatatttatttcttaaaaactatttggataagacgcaa

SEQ ID NO: 3666 - protein, 98 aa, Staphylococcus aureus
LSIMFFERGDMTFMEIIIEIYMYLRDGIKEHFILKKVRKKFKKLNEINSDIQNMYAENQGLLETDKTIIDKVLSTDVTNSHDINELYLFLKNYLDKTQ

SEQ ID NO: 3667 - DNA, 1275 bp, Staphylococcus aureus
atgcaaaatttagataagaattttcgacatttatctcgtaaagaaaagttacaacaattggttgataagcaatggttatcagaagaacaattcgacattttactgaatcatccattaatcgatgaagaagtagccaatagtttaattgaaaatgtcatcgcgcaaggtgcattacccgttggattattaccgaatatcattgtggacgataaggcatatgttgtacctatgatggtggaagagccttcagttgtcgctgcagctagttatggtgcaaagctagtgaatcagactggcggatttaaaacggtatcttctgaacgtattatgataggtcaaatcgtctttgatggcgttgacgatactgaaaaattatcagcagacattaaagctttagaaaagcaaattcataaaattgcggatgaggcatatccttctattaaagcgcgtggtggtggttaccaacgtatagcgattgatacatttcctgagcaacagttactatctttaaaagtatttgttgatacgaaagatgctatgggcgctaatatgcttaatacgattttagaggccataactgcatttttaaaaaatgaatttccgcaaagcgacattttaatgagtattttatccaatcatgcaacagcgtccgttgttaaagttcaaggcgaaattgatgttaaagatttagcaaggggcgagagaactggagaagaggttgccaaacgaatggaacgtgcttctgtattggcccaagtagatattcatcgtgcagcaacacataataaaggtgttatgaatggcatacatgctgttgttttagcaacaggaaatgatacgcgtggtgcagaagcaagtgcgcatgcatacgcgagtcgtgacggacagtatcgtggtattgctacatggcgttacgatcaagatcgtcaacgattgattggtacaattgaagtgcctatgacattggcaatcgttggcggtggtacaaaagtattaccaattgctaaagcttcattagagctactaaatgtagagtcagcacaagaattaggtcatgtagttgctgccgttggtttagcgcaaaactttgcagcatgtcgcgcgcttgtgtcagaaggtattcaacaaggtcatatgagtttacaatataaatcattagctatcgttgtaggggcaaaaggtgatgaaattgctaaagtagctgaagctttgaaaaaagaaccccgtgcaaatacacaagcagcggaacatattttacaagaaattagacaacaa

SEQ ID NO: 3668 - protein, 425 aa, Staphylococcus aureus
  MISC_FEATURE (1)..(425): hydroxymethylglutaryl-CoA
MQNLDKNFRHLSRKEKLQQLVDKQWLSEEQFDILLNHPLIDEEVANSLIENVIAQGALPVGLLPNIIVDDKAYVVPMMVEEPSVVAAASYGAKLVNQTGGFKTVSSERIMIGQIVFDGVDDTEKLSADIKALEKQIHKIADEAYPSIKARGGGYQRIAIDTFPEQQLLSLKVFVDTKDAMGANMLNTILEAITAFLKNEFPQSDILMSILSNHATASVVKVQGEIDVKDLARGERTGEEVAKRMERASVLAQVDIHRAATHNKGVMNGIHAVVLATGNDTRGAEASAHAYASRDGQYRGIATWRYDQDRQRLIGTIEVPMTLAIVGGGTKVLPIAKASLELLNVESAQELGHVVAAVGLAQNFAACRALVSEGIQQGHMSLQYKSLAIVVGAKGDEIAKVAEALKKEPRANTQAAEHILQEIRQQ

SEQ ID NO: 3669 - DNA, 1164 bp, Staphylococcus aureus
atgacaataggtatcgataaaataaacttttacgttccaaagtactatgtagacatggctaaattagcagaagcacgccaagtagacccaaacaaatttttaattggaattggtcaaactgaaatggctgttagtcctgtaaaccaagacatcgtttcaatgggcgctaacgctgctaaggacattataacagacgaagacaaaaagaaaattggtatggtaattgtggcaactgaatcagcagttgatgctgctaaagcagccgctgttcaaattcacaacttattaggtattcaaccttttgcacgctgctttgaaatgaaagaagcttgttatgctgcaacaccagcaattcaattagctaaagattatttagcaactagaccgaatgaaaaagtattagttattgctacagatacagcacgttatggattgaattcaggcggcgagccaacacaaggtgctggcgcagttgcgatggttattgcacataatccaagcattttggcattaaatgaagatgctgttgcttacactgaagacgtttatgatttctggcgtccaactggacataaatatccattagttgatggtgcattatctaaagatgcttatatccgctcattccaacaaagctggaatgaatacgcaaaacgtcaaggtaagtcgctagctgacttcgcatctctatgcttccatgttccatttacaaaaatgggtaaaaaggcattagagtcaatcattgataacgctgatgaaacaactcaagagcgtttacgttcaggatatgaagatgctgtagattataaccgttatgtcggtaatatttatactggatcattatatttaagcctaatatcattacttgaaaatcgagatttacaagctggtgaaacaatcggtttattcagttatggctcaggttcagttggtgaattttatagtgcgacattagttgaaggctacaaagatcatttagatcaagctgcacataaagcattattaaataaccgtactgaagtatctgttgatgcatatgaaacattcttcaaacgttttgatgacgttgaatttgacgaagaacaagatgctgttcatgaagatcgtcatattttctacttatcaaatattgaaaataacgttcgtgaatatcacagaccagag

SEQ ID NO: 3670 - protein, 388 aa, Staphylococcus aureus
  MISC_FEATURE (1)..(388): 3-hydroxy-3-methylglutaryl
MTIGIDKINFYVPKYYVDMAKLAEARQVDPNKFLIGIGQTEMAVSPVNQDIVSMGANAAKDIITDEDKKKIGMVIVATESAVDAAKAAAVQIHNLLGIQPFARCFEMKEACYAATPAIQLAKDYLATRPNEKVLVIATDTARYGLNSGGEPTQGAGAVAMVIAHNPSILALNEDAVAYTEDVYDFWRPTGHKYPLVDGALSKDAYIRSFQQSWNEYAKRQGKSLADFASLCFHVPFTKMGKKALESIIDNADETTQERLRSGYEDAVDYNRYVGNIYTGSLYLSLISLLENRDLQAGETIGLFSYGSGSVGEFYSATLVEGYKDHLDQAAHKALLNNRTEVSVDAYETFFKRFDDVEFDEEQDAVHEDRHIFYLSNIENNVREYHRPE

SEQ ID NO: 3671 - DNA, 519 bp, Staphylococcus aureus
atggagtataagagttactatgattcgcctgtaggacgattggaacttttgagtgatggggtaagtctgaccgctgttttgtttgaaaatcaacaaggtgatggtactagggaagaaaatacgtctttagcgatatttagagaggcgacacagtggttagacgcgtattttaaaggtgacaatcctgaaatcacaatacctttaaagccaacaggtagtcattttcaacagtgtgtttggaatgaattaagacaggttccttatgggactctaacaacgtatggtgctattgccaaaaaagtaggcaagctgcttaacaagccaaaaatgtcagcccaagcggttggaggtgcagtcggaagtaatccattatctattatcgtgccatgtcatcgtgttgtcggtaaaacgggtagcttaacagggttcggtggaacgattaataataaaattaagctgttagagttggagaatatcgatatgtcaaagctttatgtaccaaaacatagcacgaagccg

SEQ ID NO: 3672 - protein, 173 aa, Staphylococcus aureus
  MISC_FEATURE (1)..(173): probable methylated
MEYKSYYDSPVGRLELLSDGVSLTAVLFENQQGDGTREENTSLAIFREATQWLDAYFKGDNPEITIPLKPTGSHFQQCVWNELRQVPYGTLTTYGAIAKKVGKLLNKPKMSAQAVGGAVGSNPLSIIVPCHRVVGKTGSLTGFGGTINNKIKLLELENIDMSKLYVPKHSTKP

SEQ ID NO: 3673 - DNA, 2103 bp, Staphylococcus aureus
atgaataacggttttttcaatagcgactttgattcaatttttcgaagaatgatgaaagatatgcaaggttcaaatcaagtcggaaacaaaaagtactatattaatggtaaagaagtttcacctgaagaactagcgcaactcacacaacaaggtggcaatcactctgctgaacaaagtgcgcaagcttttcaacaagcagcacaaagacaacaagggcaacaaggtggcaacggcaattatttagaacaaattggtcgtaaccttacgcaagaagcacgtgacggtttattagatccagtcattggtcgtgataaagaaattcaagaaactgctgaagttttaagtagacgaactaaaaacaatcctatattagttggagaagctggtgttggtaaaactgcgattgttgaaggtttagcacaggcaatcgttgaaggaaatgtaccagcagcaatcaaagacaaagaaattatttctgtagacatttcatcattagaagctggaacgcaatatcgtggtgcttttgaagaaaatattcaaaaattaatcgaaggtgttaaatcttcacaaaatgccgtactattctttgatgaaatccatcaaattatcggttcaggtgccacaggaagtgattcaggtagcaaagggttatctgatattttgaaacctgcattaagtcgtggtgagatttctattattggtgcaacaacacaagatgaatatcgaaacaatattcttaaagatgctgcattaacgcgcagatttaatgaagtgcttgttaatgaaccaagcgctaaagatactgttgaaattttaaaaggtattcgcgaaaaattcgaagaacaccatcaagtaaaattaccagatgacgtattaaaagcatgtgttgacttatcaattcaatatattccacaacgattattaccagataaagcaatcgatgtgttagatattacagcagcacatttatctgcgcaaagtccagctgtcgataaagttgaaactgaaaaacgaatttctgaattagaaaatgataaacgtaaagcagtaagtgctgaagaatataaaaaagctgacgacattcaaaatgaaatcaaatcattacaagataaattagaaaatagtaatggtgaacatactgctgttgctacagttcatgatatttcagatactattcaacgattaactggtattccagtttctcaaatggatgataacgatattgaacgtttaaaaaatatttctaatcgtttaagaagtaaaatcataggtcaagatcaagctgtagaaatggtttcacgtgcaattcgccgtaatcgtgctgggtttgatgacggcaaccgtccaattggcagtttcctatttgttggccctactggtgttggtaaaacagagcttgctaaacaattagcaattgatttatttggtaataaagatgcactgattcgacttgatatgagtgaatatagtgacacaacagctgtttcaaaaatgattggtacaactgctggttatgttggttatgatgacaattcaaatacgttaactgaaaaagtacgccgtaatccatactcagtcattctatttgatgaaatcgaaaaagcaaatccacaaattttaacattgttattacaagtaatggatgatggtaatttgactgatggtcaaggtaatgtcatcaactttaaaaatacaattattatttgtacatcaaatgctggctttggcaatggcaatgacgctgaagaaaaagatattatgcacgaaatgaaaaaattcttccgccctgaattccttaaccgcttcaacggcatcgttgaattcttacatttagataaagatgcattgcaagatatcgtcaacttattattagacgatgtacaagttacattagacaaaaaaggtattacgatggacgtttctcaagatgcgaaagattggttaattgaagaaggctatgatgaagaattaggtgcacgtccattaagacgtattgttgaacagcaagtacgtgacaaaattacagattactatttagatcatacagacgttaaacatgtggatatagatgttgaggataacgaattagtcgtaaaaggtaaa

SEQ ID NO: 3674 - protein, 701 aa, Staphylococcus aureus
  MISC_FEATURE (1)..(701): ATP-dependent Clp
MNNGFFNSDFDSIFRRMMKDMQGSNQVGNKKYYINGKEVSPEELAQLTQQGGNHSAEQSAQAFQQAAQRQQGQQGGNGNYLEQIGRNLTQEARDGLLDPVIGRDKEIQETAEVLSRRTKNNPILVGEAGVGKTAIVEGLAQAIVEGNVPAAIKDKEIISVDISSLEAGTQYRGAFEENIQKLIEGVKSSQNAVLFFDEIHQIIGSGATGSDSGSKGLSDILKPALSRGEISIIGATTQDEYRNNILKDAALTRRFNEVLVNEPSAKDTVEILKGIREKFEEHHQVKLPDDVLKACVDLSIQYIPQRLLPDKAIDVLDITAAHLSAQSPAVDKVETEKRISELENDKRKAVSAEEYKKADDIQNEIKSLQDKLENSNGEHTAVATVHDISDTIQRLTGIPVSQMDDNDIERLKNISNRLRSKIIGQDQAVEMVSRAIRRNRAGFDDGNRPIGSFLFVGPTGVGKTELAKQLAIDLFGNKDALIRLDMSEYSDTTAVSKMIGTTAGYVGYDDNSNTLTEKVRRNPYSVILFDEIEKANPQILTLLLQVMDDGNLTDGQGNVINFKNTIIICTSNAGFGNGNDAEEKDIMHEMKKFFRPEFLNRFNGIVEFLHLDKDALQDIVNLLLDDVQVTLDKKGITMDVSQDAKDWLIEEGYDEELGARPLRRIVEQQVRDKITDYYLDHTDVKHVDIDVEDNELVVKGK

SEQ ID NO: 3675 - DNA, 2028 bp, Staphylococcus aureus
ttgttctattgcattagaagaataggagccggacgaatggaaaattattgtattttaggaaatcctaatgttggtaaaacatctttgtttaacgctttaactggttcgtatgaatatataggcaactggagtggcgtaacggtagagaaaaaagtagggaaacttaaagaaaatgtaggacaattaattgatttaccaggtacatatgatttatcgccgatttctaaagatgaaactgtagtgacagactatttattaaacgattcattttcaggaatcattaacattgttgatgcgagtcaactaaaaagaaatatgcaattaacagtacaattgttagaacttaatcaaccaatatacatcggattaaatatgattgatgtagctacaaagcgcgggataaaaatcgattatcataaattgatgaaaaagttaaaaacacctatttttccagttgtggcacgtacaggcaaaggaacaaaatatttacttggcgaaataaagcatctaggggaagggtatcaaccgcattttaaaatcaattatggtgagaagattgaagagacaattaaaaatatgtgtcaaataataatgacagagacatctcatgataagtatcaagctaggtttattgcgattcaattcttattaaataacatgcaaattgcaaacgaacttaattcagaggttgtaaataaattgtcgagtttacgtgatcaagttgctgaacaagtaggggctgtatctgttcgtcgagagatggagcgtatacgcaatcattatattgagacgttattgcaagacgtggtaacgtatccagatgaagataagcaatatttcagctctagaatagacaagatattaacacataaatatatagggatgcctatctttctagcaattatgtggttgatctttcaaactacatttacatggattggcacacctttgtcggatcaactcgatgcatttataggtggtacatttacagatagtgtgaagacgattatgaattatcttggtgttataccatttttacaagatttaattacagatggcattattgctggtgtaggatcagtattagtctttgtaccacaaattgttgtgctctttttctttatatctttattagaagattcgggttatatggcacgtattgcggttttaatggatcgtattatggaatcgttcggtttaagcgggaagtcttttataccaatgattatcggatttggttgtaatgtaccgagtattatggctgcgcgcagtattgaaaatgaaaaagagcgtttaacaacgatattaattgcaccattcatgtcatgctctgctagactgccagtgtatgcgttgttcgtaggtatctttttcaaagagaatcaatctttagtagtattaagcctgtatgttttaggtattattatggcatttttagtcagtacagtacttactaagacgattttaaaaaatgataatgcaatctttattgtggaattgccaacataccgtgtgccttccattaaaacgttgtggcgtagtacttgggaaaaggctaagggctttgttcgtaaagcaggtacatttatttttggcggctcagtagtcatttggctattaagttatgtaggaccacatggtatcaatgtgaatatcaatcaaagttttttacatatggttggtagtttctttggtatgttagtgcaaccgctcggatttggaacatggcaagcaggtgctacgttagtgccaggatttttagcaaaagaagttatcgtaagttcgatggcgattatctattcatcaggtgatgcaggccttgttaatgtgattcaaaatcaattcacaccgctatctgcgtatgcatttatgatatttatactattgtatattccttgtgtttctacagtagcagcaatccgtaaagagacttattcatggaaatggacggcacttgcagttgcctatcctctagtcactgcatatgtcttaacattcattttttatcaagtcggacatttatttgtt

SEQ ID NO: 3676 - protein, 676 aa, Staphylococcus aureus
  MISC_FEATURE (1)..(676): ferrous iron transport
LFYCIRRIGAGRMENYCILGNPNVGKTSLFNALTGSYEYIGNWSGVTVEKKVGKLKENVGQLIDLPGTYDLSPISKDETVVTDYLLNDSFSGIINIVDASQLKRNMQLTVQLLELNQPIYIGLNMIDVATKRGIKIDYHKLMKKLKTPIFPVVARTGKGTKYLLGEIKHLGEGYQPHFKINYGEKIEETIKNMCQIIMTETSHDKYQARFIAIQFLLNNMQIANELNSEVVNKLSSLRDQVAEQVGAVSVRREMERIRNHYIETLLQDVVTYPDEDKQYFSSRIDKILTHKYIGMPIFLAIMWLIFQTTFTWIGTPLSDQLDAFIGGTFTDSVKTIMNYLGVIPFLQDLITDGIIAGVGSVLVFVPQIVVLFFFISLLEDSGYMARIAVLMDRIMESFGLSGKSFIPMIIGFGCNVPSIMAARSIENEKERLTTILIAPFMSCSARLPVYALFVGIFFKENQSLVVLSLYVLGIIMAFLVSTVLTKTILKNDNAIFIVELPTYRVPSIKTLWRSTWEKAKGFVRKAGTFIFGGSVVIWLLSYVGPHGINVNINQSFLHMVGSFFGMLVQPLGFGTWQAGATLVPGFLAKEVIVSSMAIIYSSGDAGLVNVIQNQFTPLSAYAFMIFILLYIPCVSTVAAIRKETYSWKWTALAVAYPLVTAYVLTFIFYQVGHLFV

SEQ ID NO: 3677 - DNA, 225 bp, Staphylococcus aureus
atgttaaacattaaaaatggtgaaatgaataaggcttataaaataaagcgaatggatattgctaatgagaatatgttgtatcgtctaagtgcctttgggttaacagatgacgctatcataacgattaaacaaaaatgtttatttaaagggccatgtattattgaagtaaacggacaacagttaagtattagacattgcgatgcttgttctattgcattagaagaa

SEQ ID NO: 3678 - protein, 75 aa, Staphylococcus aureus
  MISC_FEATURE (1)..(75): hypothetical protein
MLNIKNGEMNKAYKIKRMDIANENMLYRLSAFGLTDDAIITIKQKCLFKGPCIIEVNGQQLSIRHCDACSIALEE

SEQ ID NO: 3679 - DNA, 1671 bp, Staphylococcus aureus
atgaaaacacgactaaaatttcaagtagataaggatttattgttagctatagttgttggtgtttgtggaagtttagttgcgctcgccatgtttttcttaagtggttatatggtgacacaaagtgcacttggtgcgccactatacgctctgatgattttagtcgttacagtaaaattgtttgggtttttaagagctattactcgatacgtagagcgccttatttctcataaagctacatttacaatgctacgtgatattcgggtacagtttttcggtaaattagtaaatgtcattcctaatgtttaccgtaaactgagttctagtgatttaatttcacgtatgattagtcgtgttgaggcattacaaaatatatatttacgtgtttattatccaccagtcgtcatcggtttgacagcgctagttacagtcatagttttggcgttcatttcaatcggccatgcgctattgattatggttagcatgttgttcactttactcattgttccttggttaagctcaaaaaaagcacgtactttaaagaaacatgcagctaatgaacaggcccgatttttaaatcatttttatgattataaagctggtatggatgaactacgtcgatttaatcaaattaatcattatcgagataatttgatggctaaattaaatcattttgataaattacaacttaaagagcaacgctttttaacgatttatgattttatattaaatattattgctatgctttcgatttttggtagtttagttctaggattaattcaaattaatgcaggccaactaaatattatttatatgacgagtatagttttaatggtcttaactttatttgaacaagctgtaccaatgacaaatgtcgcgtattataaagcggatactgaccaagcattgcacgatattaatgaagtgatatctgtaccttctactaatggaaaaaaacgtcttaatgataagtatgatgcaacgaacatttatgaagttaaggatgctagttttaagtattggaatcagcaaacgtatgtgttgtcggatattaattttaatgttaatagaggcgaaaagattgcgattgtgggtccttctggttcaggaaaaagtacattactacaaattatggcagggttatatcaattagatagtggctctgttcgtttcgaaaatatggatatgtttgaaatagatgacaaagataagtttgaatcgttaaatgtcttgctacaatctcaacaattatttgatggtacaatacgtcaaaatttatttaccgatgaaaaagatgaagcggtgcaagcaatatttaagcaattagatttagaacatttggcactagaacgtcaaattgacttagatggtcatacattatctggcggagaaattcagcgtttagcgattacgaggatgttattaaaagatactgcatcaacatggattttagatgaaccaacaactgcattagataaacaaaatagtttaaaagttatggatttaattgaagcacatgcagaaacattaattgttgctacacacgatttaactttattgtcacgttttgagaccatcattgtgatgataaatggtaaaatagttgaaaagggaaactatcaacaattactagctaatcaaggtgctttatggaatatgattcaatataatgca

SEQ ID NO: 3680 - protein, 557 aa, Staphylococcus aureus
  MISC_FEATURE (1)..(557): hypothetical protein
MKTRLKFQVDKDLLLAIVVGVCGSLVALAMFFLSGYMVTQSALGAPLYALMILVVTVKLFGFLRAITRYVERLISHKATFTMLRDIRVQFFGKLVNVIPNVYRKLSSSDLISRMISRVEALQNIYLRVYYPPVVIGLTALVTVIVLAFISIGHALLIMVSMLFTLLIVPWLSSKKARTLKKHAANEQARFLNHFYDYKAGMDELRRFNQINHYRDNLMAKLNHFDKLQLKEQRFLTIYDFILNIIAMLSIFGSLVLGLIQINAGQLNIIYMTSIVLMVLTLFEQAVPMTNVAYYKADTDQALHDINEVISVPSTNGKKRLNDKYDATNIYEVKDASFKYWNQQTYVLSDINFNVNRGEKIAIVGPSGSGKSTLLQIMAGLYQLDSGSVRFENMDMFEIDDKDKFESLNVLLQSQQLFDGTIRQNLFTDEKDEAVQAIFKQLDLEHLALERQIDLDGHTLSGGEIQRLAITRMLLKDTASTWILDEPTTALDKQNSLKVMDLIEAHAETLIVATHDLTLLSRFETIIVMINGKIVEKGNYQQLLANQGALWNMIQYNA

SEQ ID NO: 3681 - DNA, 2487 bp, Staphylococcus aureus
ttggcaaaatttttatataagatggggacattcatcgcaaaacataaatggtccgcggtcattgcatggatagtgattgtagctgcaatattgataccacttgctacaaatgcaccgaaatttgacaatgatattaaaatgacaggattagagtcgttagatacgaataaaaagattgaaaaacattttaatcaagatagtgaaaaggcacaaatacgtgttgtctttaagacgactaaagatgatggtattgtgcaaccgaacattactaaagatattaagaaaacgttagatgatattaaaaaagatgacaagcacattgataaaatatcagatccttatgaaaataagcaaattagtaaagataaaacaactgcatttgcagatatcacatatgacgttagtcaaacatctttaaaagatggctctagagataatgttaaaagtcatttgaaagacttacgtgacaatcataatgtacaaacagagttaactggtacaggaatgacatctacagaagtaggcggtaattctgaactagttggtattattgttgcatttgttgtactgttaatcacattcggttcagtcattgctgcaggattaccaattataagtgcattgattggtctagcctctggtgtaggtattatcagtttgttaacttatgcattcgatataccaaatgtcacactgacattagccgtaatgattggactagcagttggtatcgattatgcattatttattttattcagatatcgacaagttatgaaaactgaaacagattacattaaaggcattggtcttgcaataggaacagcaggtagtgcagttgtttttgctggtgtaacagttgtaattgcagtatgtggtttatcattagtaggcattgacttcttagcggtaatgggatttgcttcggcaattagtgttgtttttgcagtacttagcgctttaactttattacctgcattaataagcattttccataaacgcattaaagtgaataaattacagtctaaattcaaaaaagatattgatacgccatggtctaaatttattacaggaaatgcacttgcggcagtattactaggtttaatcatattagtagcagctgcaataccagttagtcatatgcgacttggtattccagatgacggtgttaaaccagcagattctacacagaaaaaagcttacgatattatctcggataaatttggtgaaggatttaatggccaaataccgatgttgataaatgtgaaagataaaaaggatgatccacaaggattacaacaagatttacagtctgtatataaagatattaaagataagaaaaatgtagatatcgttacgccaccacaaatgagtaaagataatgattacgctttgatggtcgtgatacctaagcaagggcctaatgcagagagtacaaatgatttagtgcatgatttacgagattatcataaagatgcacaagataaatatgggttcaaaacggagatttcgggacaaagtgtcattaatattgatatgtctaaaaagttaaatgaggcgatacctttatttgcctcagtcattgttgtattagcatttttcttattaatgattgtcttccgttcaattctaataccattaaaagcagttttaggattcgtcttgtcattaatggcaacattaggatttacaacattagtaatgcaagatggttttatgaaaggtctgtttggtattgaaacgacaggaccaatgctagcatttttaccggttattactataggtatcttatttggattagcgatggattatgaagtcttccttatgtcgcgaattcatgaagaatatagtaaaacaggggataatgattattctatcaaagtaggattgaaagaaagcggtcctgttattgtagcagctgcattaattatgtttagtgtcttctttgcgtttgtattccaagaagatgtcatgattaaatcaatgggtatggcattagcgtttggtgtactctttgatgccttcgtagtcagaatgatgttaattcctgcattaacgaaattgtttggaaaaggttcgtggtatttaccagcatggttgaatcgcattattccacgagttgatattgaaggacatgcacttgaaaaatataaaacggttgaatcacaggaatctgaagctaaagatagtaaggaaacatacgacacaacctttaaagtatatccacaaggtgcaacaaatgtatcgaaacatcaagatgcacatgggcaagatgatgcacattcaatagtactagatgataaaacgatggcattgtaccaagaagtgaaacagcaatcagcaagttcattgttcttatatgatgctttaatagattatcaaaacaagcatcaactaaattcaaaacaacaagcaacgaatatagaacagttgaataaaaatattgaaaagctcaatcaattgttagaaaaaaatctacgaaataaatca

SEQ ID NO: 3682 - protein, 829 aa, Staphylococcus aureus
  MISC_FEATURE (1)..(829): hypothetical protein
LAKFLYKMGTFIAKHKWSAVIAWIVIVAAILIPLATNAPKFDNDIKMTGLESLDTNKKIEKHFNQDSEKAQIRVVFKTTKDDGIVQPNITKDIKKTLDDIKKDDKHIDKISDPYENKQISKDKTTAFADITYDVSQTSLKDGSRDNVKSHLKDLRDNHNVQTELTGTGMTSTEVGGNSELVGIIVAFVVLLITFGSVIAAGLPIISALIGLASGVGIISLLTYAFDIPNVTLTLAVMIGLAVGIDYALFILFRYRQVMKTETDYIKGIGLAIGTAGSAVVFAGVTVVIAVCGLSLVGIDFLAVMGFASAISVVFAVLSALTLLPALISIFHKRIKVNKLQSKFKKDIDTPWSKFITGNALAAVLLGLIILVAAAIPVSHMRLGIPDDGVKPADSTQKKAYDIISDKFGEGFNGQIPMLINVKDKKDDPQGLQQDLQSVYKDIKDKKNVDIVTPPQMSKDNDYALMVVIPKQGPNAESTNDLVHDLRDYHKDAQDKYGFKTEISGQSVINIDMSKKLNEAIPLFASVIVVLAFFLLMIVFRSILIPLKAVLGFVLSLMATLGFTTLVMQDGFMKGLFGIETTGPMLAFLPVITIGILFGLAMDYEVFLMSRIHEEYSKTGDNDYSIKVGLKESGPVIVAAALIMFSVFFAFVFQEDVMIKSMGMALAFGVLFDAFVVRMMLIPALTKLFGKGSWYLPAWLNRIIPRVDIEGHALEKYKTVESQESEAKDSKETYDTTFKVYPQGATNVSKHQDAHGQDDAHSIVLDDKTMALYQEVKQQSASSLFLYDALIDYQNKHQLNSKQQATNIEQLNKNIEKLNQLLEKNLRNKS

SEQ ID NO: 3683 - DNA, 546 bp, Staphylococcus aureus
atgaaagagactgatttacgagttataaagacaaaaaaagcattgtcgagtagcttgctacaattgttagaacagcaattattccaaacgattactgtcaatcaaatttgcgacaacgcactcgtacaccgtacaacattttataaacatttttatgataaatatgatcttctagagtacttgttcaatcaattgactaaagactactttgctagagatatcagtgaccgtcttaatcatccattccaaacgatgagtgatacgattaataataaagaggatttgagagaaatcgcagaattccaagaagaagacgctgaatttaataaagtattaaaaaatgtctgcattaaaattatgcataacgatatcaaaaataatagagaccgtatcgatattgacagcgacatcccagataatctcatattttatatttatgactcgttgattgaaggttttatacattggataaaagatgaaaaaattgattggcctggcgaagatattgataacattttccatagattaatcaatattaagattaaa

SEQ ID NO: 3684 - protein, 182 aa, Staphylococcus aureus
  MISC_FEATURE (1)..(182): hypothetical protein
MKETDLRVIKTKKALSSSLLQLLEQQLFQTITVNQICDNALVHRTTFYKHFYDKYDLLEYLFNQLTKDYFARDISDRLNHPFQTMSDTINNKEDLREIAEFQEEDAEFNKVLKNVCIKIMHNDIKNNRDRIDIDSDIPDNLIFYIYDSLIEGFIHWIKDEKIDWPGEDIDNIFHRLINIKIK

SEQ ID NO: 3685 - DNA, 165 bp, Staphylococcus aureus
gtgagatacgttatttcaataataatgggaattgtattagcaatttggtcatttaaacaactgagtcaaagtcatttagatagcggatttatttttttcttcatagtttatgtgttgtgtatcagttgttttaatagcgataagcacgataaaaataaaaaacga

SEQ ID NO: 3686 - protein, 55 aa, Staphylococcus aureus
VRYVISIIMGIVLAIWSFKQLSQSHLDSGFIFFFIVYVLCISCFNSDKHDKNKKR

SEQ ID NO: 3687 - DNA, 1548 bp, Staphylococcus aureus
gtgtacatggtagtagaatttaaaaatgaacctggttacgatttttcagtccaagaaaatgtggatatgtttaagaaagcattgaaagacgtggaaaaagaattaggtcaagacataccattagtgattaatggagagaagattttcaaagatgacaaaattaaatcaatcaatcctgcagacacatcacaagtgattgcaaatgcatcaaaggcaacaaaacaagatgttgaagatgcgtttaaagcagcaaacgaagcttataaatcttggaaaacatggtcagcaaatgatcgtgcagagcttatgttacgtgtttcggcaattattcgtcgtcgaaaagcggaaattgcagcaattatggtttatgaagcaggtaagccatgggatgaagcagttggtgatgcagctgaaggtattgattttattgaatactatgcacgttcaatgatggacttggctcaaggtaagccagtacttgatcgtgaaggtgaacacaataaatatttctataaatcaattggtacaggtgttacaattccgccgtggaacttcccgtttgcgattatggctggtacaactttagcaccagttgtggcaggtaatacagtgttattgaaacctgctgaggatacaccttatatcgcttataaattaatggaaattttagaagaagcaggattaccaaaaggcgtagttaactttgttcctggtgatccgaaagaaattggtgattacttagttgatcataaagatacgcatttcgttacatttacaggatcacgtgcgacaggtactagaatttatgaacgtagtgccgttgttcaagaaggtcaaaacttcttgaaacgtgttatcgctgaaatgggtggtaaagatgccattgtagttgatgaaaatattgatacagatatggcagcagaagctattgtaacgtcagcatttggtttttctggtcaaaaatgttcagcatgttcacgtgcaattgtgcataaagacgtttatgacgaagtattagagaaatcaatcaaattaacaaaagaattaacgttgggcaatactgtagacaatacgtatatgggcccagttattaataaaaaacaatttgataagattaaaaattatattgagattggtaaagaagaaggtaaattagaacaaggtggcggcactgatgattcaaaaggttactttgtagaaccaacaatcatttcaggacttaaatctaaagatagaatcatgcaagaagaaatttttggtccagttgttggctttgtgaaagttaacgattttgatgaagcaattgaggttgcaaatgatacagattacggtttaactggtgcagtgattacaaataatcgcgagcattggattaaagcggtaaacgaatttgatgtaggcaatttataccttaacagaggctgtacttcagcagttgttggataccatccatttggtggtttcaaaatgtcaggtacggacgctaaaacaggtagtccagactacttattacacttcttagaacaaaaggttgtttcagaaatgttc

SEQ ID NO: 3688 - protein, 516 aa, Staphylococcus aureus
  MISC_FEATURE (1)..(516): 1-pyrroline-5-carboxylate
VYMVVEFKNEPGYDFSVQENVDMFKKALKDVEKELGQDIPLVINGEKIFKDDKIKSINPADTSQVIANASKATKQDVEDAFKAANEAYKSWKTWSANDRAELMLRVSAIIRRRKAEIAAIMVYEAGKPWDEAVGDAAEGIDFIEYYARSMMDLAQGKPVLDREGEHNKYFYKSIGTGVTIPPWNFPFAIMAGTTLAPVVAGNTVLLKPAEDTPYIAYKLMEILEEAGLPKGVVNFVPGDPKEIGDYLVDHKDTHFVTFTGSRATGTRIYERSAVVQEGQNFLKRVIAEMGGKDAIVVDENIDTDMAAEAIVTSAFGFSGQKCSACSRAIVHKDVYDEVLEKSIKLTKELTLGNTVDNTYMGPVINKKQFDKIKNYIEIGKEEGKLEQGGGTDDSKGYFVEPTIISGLKSKDRIMQEEIFGPVVGFVKVNDFDEAIEVANDTDYGLTGAVITNNREHWIKAVNEFDVGNLYLNRGCTSAVVGYHPFGGFKMSGTDAKTGSPDYLLHFLEQKVVSEMF

SEQ ID NO: 3689 - DNA, 609 bp, Staphylococcus aureus
ttgaaaggtgtaatgactgaaaaagaaaaaatgttagcagaaaaatggtacgatgcaaactttgatcaatacttaatcaatgaacgtgcacgagcgaaagatatttgctttgaattaaatcatacaagaccgagtgctacaaataaaagaaaggaattaattgatcaattatttcaaacaacaacagacaatgtaagtatttcgattccttttgatacagattatggttggaacgttaaactaggaaaaaatgtctatgtaaacaccaattgttactttatggatggtggacagattacaattggcgataatgtttttataggacctaattgtggattctacacagcgacacatccacttaatttccatcatagaaatgaaggttttgaaaaagccggacccattcatattggcagtaatacttggtttggcggtcatgtagccgtgttaccaggggtgacgattggagaaggcagtgtgattggtgctggtagtgttgtcactaaagatattccgccacacagcttagcggttggaaacccttgtaaagtcgttcgtaaaattgataatgacctaccatccgaaacattaaatgacgaaacgataaag

SEQ ID NO: 3690 - protein, 203 aa, Staphylococcus aureus
  MISC_FEATURE (1)..(203): hypothetical protein
LKGVMTEKEKMLAEKWYDANFDQYLINERARAKDICFELNHTRPSATNKRKELIDQLFQTTTDNVSISIPFDTDYGWNVKLGKNVYVNTNCYFMDGGQITIGDNVFIGPNCGFYTATHPLNFHHRNEGFEKAGPIHIGSNTWFGGHVAVLPGVTIGEGSVIGAGSVVTKDIPPHSLAVGNPCKVVRKIDNDLPSETLNDETIK

SEQ ID NO: 3691 - DNA, 198 bp, Staphylococcus aureus
atgatagcgatgagaatattaattacaggcacagttgctatcttaatcattctaggtttggtcaaaacgatacaagattacgaaatgacaaacgacacgagtcgtcagttgtcagacaacaaagatgatgataaagtcatccatcttaataattttaaaaatttacatgcgaaagaatttaacccatctgatttcttt

SEQ ID NO: 3692 - protein, 66 aa, Staphylococcus aureus
  MISC_FEATURE (1)..(66): hypothetical protein
MIAMRILITGTVAILIILGLVKTIQDYEMTNDTSRQLSDNKDDDKVIHLNNFKNLHAKEFNPSDFF

SEQ ID NO: 3693 - DNA, 2406 bp, Staphylococcus aureus
gtggctaatacgaaaaaaacaacattagatatcactggtatgacttgtgccgcatgttcaaatcgtatcgaaaagaaactgaataaacttgatgacgttaatgcccaagtgaatttaactacagagaaagcaactgttgagtataaccctgatcaacatgatgtccaagaatttattaatacgattcaacatttaggttacggtgtcgctgtagaaactgtcgaattagacattacaggtatgacttgtgctgcatgctcaagccgtattgaaaaagtgttaaataaaatggacggcgttcaaaatgcaacggtcaatttaacaacagagcaagctaaagttgactattatcctgaagaaacagatgctgataaacttgtcactcgcattcaaaaattaggttatgacgcgtctattaaagataacaataaagatcaaacgtcacgcaaagctgaagcgctacaacataaattgattaagcttatcatatcagcagtattatctttaccactattaatgttaatgtttgtacatcttttcaatatgcatataccagcactatttacgaatccatggttccaatttattttagctacacctgtacaatttattattggatggcaattttatgtaggtgcttataaaaacttaagaaatggtggcgccaatatggatgtacttgttgctgttggtacaagtgcagcatatttttacagtatttatgaaatggttcgttggctaaatggctcaacaacgcaaccgcatttatactttgaaacaagcgccgtactaattaccttaatcttattcggtaagtatttagaagctagagcgaagtctcaaacaaccaatgcgcttggcgaattattaagtttacaagctaaagaagcacgcattttaaaagatggtaatgaagtgatgattcctctaaatgaagtacatgttggagatacacttatcgttaaaccaggtgaaaagatacctgttgatggcaaaattattaaaggtatgactgccatcgacgaatctatgttaacaggtgaatctatccctgttgagaagaatgttgatgatactgtaattggttcaacgatgaacaaaaacggtactattactatgacagcaacaaaagttggcggggacactgcgttggcaaatattattaaagttgtcgaagaagctcaaagttctaaagcgccgattcaacgattggcagatattatttctggttatttcgttcctatcgttgttggtatcgcactattaacatttatcgtgtggattactttagttacaccaggtacatttgaacctgcacttgttgcgagtatttccgttctcgtcattgcttgtccatgcgcattgggacttgctacaccaacttctattatggtaggtactggtcgcgctgctgaaaatggtattttatttaaaggtggcgagtttgttgaacgcacacatcaaattgataccatcgttttagataagacgggtaccattacaaatggtcgtccagtcgtgacagattatcatggtgacaatcaaacgctacaactacttgctactgctgaaaaagattctgaacacccattggcagaagccattgtcaattatgcaaaagaaaagcaattaatattaactgagacaacaacatttaaagcagtacctggccatggtattgaagcaacgattgatcatcaccatatattggttggtaaccgtaaattaatggctgacaatgatattagcttgcctaagcatatttctgatgatttaacacattatgaacgagatggtaaaactgctatgctcattgctgttaattattcattaactggtatcatcgcagtggcagatactgtcaaagatcatgccaaagatgctataaaacaattgcatgatatgggcattgaagttgccatgttaactggcgataataaaaacactgctcaagccattgcaaaacaagtaggcatagatactgttattgcagatattttaccagaagaaaaagctgcacaaattgcgaaactacagcaacaaggtaagaaggttgcgatggttggtgacggtgtaaatgatgcacctgcattagttaaagctgatatcggtatcgccattggtacaggtacagaagttgccattgaagcagctgatattactattcttggtggcgacttgatgcttattcctaaagccatttatgcaagtaaagcaaccattcgtaatattcgtcaaaatctattttgggcattcggctataatattgccggtatccctatagctgcattgggcttacttgcgccatgggttgctggtgctgcaatggcactaagttcagtaagtgttgtcacaaacgcacttagattgaaaaagatgcgattagaaccacgccgtaaagatgcc

SEQ ID NO: 3694 - protein, 802 aa, Staphylococcus aureus
  MISC_FEATURE (1)..(802): copper-transporting ATPase
VANTKKTTLDITGMTCAACSNRIEKKLNKLDDVNAQVNLTTEKATVEYNPDQHDVQEFINTIQHLGYGVAVETVELDITGMTCAACSSRIEKVLNKMDGVQNATVNLTTEQAKVDYYPEETDADKLVTRIQKLGYDASIKDNNKDQTSRKAEALQHKLIKLIISAVLSLPLLMLMFVHLFNMHIPALFTNPWFQFILATPVQFIIGWQFYVGAYKNLRNGGANMDVLVAVGTSAAYFYSIYEMVRWLNGSTTQPHLYFETSAVLITLILFGKYLEARAKSQTTNALGELLSLQAKEARILKDGNEVMIPLNEVHVGDTLIVKPGEKIPVDGKIIKGMTAIDESMLTGESIPVEKNVDDTVIGSTMNKNGTITMTATKVGGDTALANIIKVVEEAQSSKAPIQRLADIISGYFVPIVVGIALLTFIVWITLVTPGTFEPALVASISVLVIACPCALGLATPTSIMVGTGRAAENGILFKGGEFVERTHQIDTIVLDKTGTITNGRPVVTDYHGDNQTLQLLATAEKDSEHPLAEAIVNYAKEKQLILTETTTFKAVPGHGIEATIDHHHILVGNRKLMADNDISLPKHISDDLTHYERDGKTAMLIAVNYSLTGIIAVADTVKDHAKDAIKQLHDMGIEVAMLTGDNKNTAQAIAKQVGIDTVIADILPEEKAAQIAKLQQQGKKVAMVGDGVNDAPALVKADIGIAIGTGTEVAIEAADITILGGDLMLIPKAIYASKATIRNIRQNLFWAFGYNIAGIPIAALGLLAPWVAGAAMALSSVSVVTNALRLKKMRLEPRRKDA

SEQ ID NO: 3695 - DNA, 213 bp, Staphylococcus aureus
gtgaatgctatgtcacaagaaattttaaatgttgaaggtatgagctgtggtcactgcaaaagtgctgttgaatctgcattaaataatattgacggtgtcacttcagctgacgttaaccttgaaaatggtcaagtaagtgttcaatatgatgacagtaaagttgctgtatctcaaatgaaagacgcaattgaagatcaaggttacgatgtcgtt

SEQ ID NO: 3696 - protein, 71 aa, Staphylococcus aureus
  MISC_FEATURE (1)..(71): hypothetical protein
VNAMSQEILNVEGMSCGHCKSAVESALNNIDGVTSADVNLENGQVSVQYDDSKVAVSQMKDAIEDQGYDVV

SEQ ID NO: 3697 - DNA, 978 bp, Staphylococcus aureus
atgagtgtacgtgatgaagatatgccttatatcaaggcgtgggcagagaaacatcatgttgaggtagatattactaaagaagcattaactgatgacaatgttgaaggtgtcgctggttatgatggcttatcgctatcacaacaaataccattatcagagcatgtttataaacgattaaatgaactaggtattaaacaaatcgcacaacgtagtgctggatttgatacatatgatttggagttagcaaacaagtataactttattgtgtcaaatgtgccgtcatactctccgaattcaattgcggagtttgctgtgaaccaggctattaatgtggttcgtcattttaatcaaattcaaacgaaagtgcgggagcatgattttagatgggaacctactattttatcgaaatccattaaagatttaaaagtagctgttattggtacaggtcgaattggccgtgtagtagccgatatatttgccaatggttatcaaagtgatgtggtcgcatacgacccgtttcctaatgctaaaattgcaacgtatgtcgattacaaagatacgattgaggaagcggttgaaggtgctgatatcgtgacattacatgtacctgcaacgaaatataatcattatctatttaatgctgaattatttaaacattttaaaaagggcgcagtatttgtcaattgtgcgagaggttctttagtagatactaaggcgttattagacgcattagacaatggtgtgattaaaggtgcagcacttgatacgtatgaatttgaacgcaaacttttcccaagtgatcaaaggggcaaaacactgaacgatccattgttagaatcgttgattgacagggaagatgtcatattaacaccacatattgcgttttatactgaagctgcagttaaaaatctaattgtcgatgcattagatgcaacattagatgtattgcagactggagatactaggttacgagtaaat

SEQ ID NO: 3698 - protein, 326 aa, Staphylococcus aureus
  MISC_FEATURE (1)..(326): hypothetical protein
MSVRDEDMPYIKAWAEKHHVEVDITKEALTDDNVEGVAGYDGLSLSQQIPLSEHVYKRLNELGIKQIAQRSAGFDTYDLELANKYNFIVSNVPSYSPNSIAEFAVNQAINVVRHFNQIQTKVREHDFRWEPTILSKSIKDLKVAVIGTGRIGRVVADIFANGYQSDVVAYDPFPNAKIATYVDYKDTIEEAVEGADIVTLHVPATKYNHYLFNAELFKHFKKGAVFVNCARGSLVDTKALLDALDNGVIKGAALDTYEFERKLFPSDQRGKTLNDPLLESLIDREDVILTPHIAFYTEAAVKNLIVDALDATLDVLQTGDTRLRVN

SEQ ID NO: 3699 - DNA, 1629 bp, Staphylococcus aureus
gtgaaaaaattaacaacaatactgtttcaatataaaatttttccggtactcatgttcttggtcagtactggtctcggcataatcgttataacgcaaaatattttaatagcagattttttagctaaaattataagacatcaatttcaaggtttatggattgtattatttattttattaggtgttttacttttaagagcaactgtgcaatttctaaatcaatggttaggtgatacattagcatttaaagttaagcatatgcttagacagcgggttatttataaaaataatggtcatccaatcggtgaacaaatgactatactcacagaaaacattgatggtctagcacctttttataagagttatttgcctcaagtgttcaaatcaatgatggttccgctcatcataatcattgcaatgtttttcatccatttcaataccgcattaattatgttaataactgcaccatttattcctttgttttatattattttcggtttgaaaacgcgagatgagtcaaaagatcaaatgacttatttgaatcaatttagtcaacggtttttaaatattgctaaaggtttagtgacgttaaagctatttaatcgtacagagcaaacagagaagcatatttacgacgatagtactcagtttagaactttaacaatgcgcattttacgcagtgcttttttatcgggattaatgctcgaatttataagtatgttaggtattggattggttgcattggaagcaacgctaagcttagtagtatttcataatattgattttaaaactgcggcaattgcgattattttagcgcctgaattttataatgcaattaaggacttagggcaagcgttccatactggaaaacaaagtgaaggtgccagtgacgttgtgtttgagtttttagaacaaccgaactataataatgaatttctattaaagtatgaggaaaaccaaaagccatttattcagttaacagacatatcatttcgatatgatgattctgatagattggtattaaatgatttaaatttggaaatatttaaaggtgatcaaattgcacttgtaggtccaagcggggcaggtaaatccactttgacacatcttattgcaggtgtttatcagccaacaataggtactataagtacaaaccagcgtgatttaaatataggaatacttagtcaacagccatatattttcagtgcttctataaaagagaatattacgatgtttaaagatatagaaaataatactattgaagaagtgctagacgaagtaggtttattagacaaagtgcaatctttcacaaaaggcattaacacaataataggtgaaggaggcgaaatgttatctggtggacagatgagacgcatagaactttgccgtcttttagttatgaagccagatctcgttatatttgatgagcctgcaactggtttagatattcaaacagaacacatgattcagaacgttctgtttcaacattttaaagatacaacgatgattgtcattgcacatagagataatacaattcgccatttacaacgacgcttgtatatagaaaatggaagactgattgctgatgatcgcaatatttcagtaaatataacagaaaatggtgatgactta

SEQ ID NO: 3700 - protein, 543 aa, Staphylococcus aureus
  MISC_FEATURE (1)..(543): hypothetical protein
VKKLTTILFQYKIFPVLMFLVSTGLGIIVITQNILIADFLAKIIRHQFQGLWIVLFILLGVLLLRATVQFLNQWLGDTLAFKVKHMLRQRVIYKNNGHPIGEQMTILTENIDGLAPFYKSYLPQVFKSMMVPLIIIIAMFFIHFNTALIMLITAPFIPLFYIIFGLKTRDESKDQMTYLNQFSQRFLNIAKGLVTLKLFNRTEQTEKHIYDDSTQFRTLTMRILRSAFLSGLMLEFISMLGIGLVALEATLSLVVFHNIDFKTAAIAIILAPEFYNAIKDLGQAFHTGKQSEGASDVVFEFLEQPNYNNEFLLKYEENQKPFIQLTDISFRYDDSDRLVLNDLNLEIFKGDQIALVGPSGAGKSTLTHLIAGVYQPTIGTISTNQRDLNIGILSQQPYIFSASIKENITMFKDIENNTIEEVLDEVGLLDKVQSFTKGINTIIGEGGEMLSGGQMRRIELCRLLVMKPDLVIFDEPATGLDIQTEHMIQNVLFQHFKDTTMIVIAHRDNTIRHLQRRLYIENGRLIADDRNISVNITENGDDL

SEQ ID NO: 3701 - DNA, 897 bp, Staphylococcus aureus
ttgagtaatgaaagtgggtacattatgtttatcattgaattaataaaaggtattatcttaggggtcgtcgaaggattaacagaatttgcacctgtttcctctactggacatatgatcctagttgatgatatgtggttaaaatcatctgaatttttaggttctcagtcagcatttacatttaaaatcgtcatccaattaggatccgtctttgcagcagcatgggtgttccgcgaacgcttcttagagattttacatattggtaaacacaaacatgttgaaggagataacgatcaacaaagacgttcaaagccaagacgtttaaatttattacatgtattagtgggtatggtgccagcaggtattttaggcttactatttgatgatttcatcgaagaacatttatttagtgtgccaactgttatgattggcttattcgtaggtgctatctatatgattattgctgataaatactcagctaaagttaaaaacccacaaacagtagatcaaatcagttatttccaagcatttgtaattggtatttctcaagcagtagctatgtggcctggtttcagccgttcaggctcaacaatttcaactggggtattaatgaaattaaatcataaagcagcatcggactttacatttattatggctgttccaattatgttagcagctagtggtttatctttattaaaacattatcaagatattcagattgctgatatacctttttatattttaggctttttagctgcatttactgttggactaattgcaatcaaaacattcttgcatctaattaacaaaatcaaactaattccatttgccatttacagaattgtattagtaatctttattgctatactttacttcggatttggcattggtaaaggtatt

SEQ ID NO: 3702 - protein, 299 aa, Staphylococcus aureus
  MISC_FEATURE (1)..(299): bacitracin resistance
LSNESGYIMFIIELIKGIILGVVEGLTEFAPVSSTGHMILVDDMWLKSSEFLGSQSAFTFKIVIQLGSVFAAAWVFRERFLEILHIGKHKHVEGDNDQQRRSKPRRLNLLHVLVGMVPAGILGLLFDDFIEEHLFSVPTVMIGLFVGAIYMIIADKYSAKVKNPQTVDQISYFQAFVIGISQAVAMWPGFSRSGSTISTGVLMKLNHKAASDFTFIMAVPIMLAASGLSLLKHYQDIQIADIPFYILGFLAAFTVGLIAIKTFLHLINKIKLIPFAIYRIVLVIFIAILYFGFGIGKGI

SEQ ID NO: 3703 - DNA, 1155 bp, Staphylococcus aureus
ttgatgatctctaacaaattagcaaatatccctgatagttatttcgggaaaacgatgggacgtaaaatcgaacatggaccattgccattaattaatatggcagttggaatccctgatgggcccacgccacaaggtattattgatcattttcaaaaagcactaactattcctgaaaatcaaaaatatggtgcttttcatggtaaagaagcgttcaagcaagctattgtagatttttatcaaagacaatataatgtgacgttagataaagaagatgaagtatgcattttatatggtacaaaaaatggattagtggcagtaccaacatgtgttatcaatccaggagactatgtattactacctgatccaggctacacggattatttagcaggtgtacttttagctgatggcaagccagtcccgcttaatttagaaccgccacattatttgccagattggtccaaagttgattcacaaataatagataaaacaaaactcatttatttaacgtatccaaataatccaactggatcgacagctacgaaagaagtttttgatgaagcgatagctaaatttaaaggtacagacactaaaatcgtgcatgattttgcttatggtgctttcggtttcgacgctaaaaatcctagtatacttgcttcggaaaatgggaaagatgttgcgattgaaatttattccttgtctaaaggttataacatgtcaggttttagagtcggttttgcagttggtaataaagatatgattcaagctttgaaaaagtaccaaacgcacacaaatgctgggatgtttggtgcattacaagatgccgcaatatatgctttgaatcattatgatgattttttagaagaacaaagcaatgtatttaaaacacgtcgtgaccgattcgaagccatgcttgcaaaagctgatttgccatttgttcatgctaaaggtggcatatatgtatggttggaaacaccgcctggttatgacagcgagcaatttgagcaatttttagtgcaagagaagtcaatacttgttgctccagggaaaccatttggagagaatggtaatcgttatgtgagaatttcattggcgttagatgaccagaaattagacgaagctgcaataagattaacagaactagcatatttatatgaa

SEQ ID NO: 3704 - protein, 385 aa, Staphylococcus aureus
  MISC_FEATURE (1)..(385): hypothetical protein
LMISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSKVDSQIIDKTKLIYLTYPNNPTGSTATKEVFDEAIAKFKGTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 3705 - DNA, 1506 bp, Staphylococcus aureus
atgaagattgcagtaattggtgcaggtgtcacaggattagcagcggcagcccgtattgcttctcaaggtcatgaagtgacgatatttgaaaaaaataataatgtaggcgggcgtatgaatcaattaaagaaagacggctttacatttgatatgggtcccacaattgtcatgatgccagatgtttataaagatgtttttacagcgtgtggtaaaaattatgaagattatattgaattgagacaattacgttatatttacgatgtgtattttgaccacgatgatcgtataacggtgcctacagatttagctgaattacagcaaatgctagaaagtatagaacctggttcaacgcatggttttatgtcctttttaacggatgtttataaaaaatatgaaattgcacgtcgctatttcttagaaagaacgtatcgcaaaccgagtgacttttataatatgacgtcacttgtgcaaggtgctaagttaaaaacgttaaatcatgcagatcagctaattgaacattatattgataacgaaaagatacaaaagcttttagcgtttcaaacgttatacataggaattgatccaaaacgaggcccgtcactatattcaattattcctatgattgaaatgatgtttggtgtgcattttattaaaggcggtatgtatggcatggctcaagggctagcgcaattaaataaagacttaggcgttaatattgaactaaatgctgaaattgagcaaattattattgatcctaaattcaaacgggccgatgcgataaaagtgaatggtgacataagaaaatttgataaaattttatgtacggctgatttccctagtgttgcggaatcattaatgccagattttgcacctattaaaaagtatccaccacataaaattgcagacttagattactcttgttcagcatttttaatgtatatcggtatagatattgatgtgacagatcaagtgagacttcataatgttattttttcagatgactttagaggcaatattgaagaaatatttgagggacgtttatcatatgatccttctatttatgtgtatgtaccagcggtcgctgataaatcacttgcgccagaaggcaaaactggtatttatgtgctaatgccgacgccggaacttaaaacaggtagcggaatcgattggtcagatgaagctttgacgcaacaaataaaggaaattatttatcgtaaattagcaacgattgaagtatttgaagatataaaatcgcatattgtttcagaaacaatctttacgccaaatgattttgagcaaacgtatcatgcgaaatttggttcggcattcggtttaatgccaactttagcgcaaagtaattattatcgtccacaaaatgtatcgcgagattataaagatttatattttgcaggtgcaagtacgcatccaggtgcaggcgttcctattgtcttaacgagtgcgaaaataactgtagatgaaatgattaaagatattgagcggggcgta

SEQ ID NO: 3706 - protein, 502 aa, Staphylococcus aureus
  MISC_FEATURE (1)..(502): squalene synthase
MKIAVIGAGVTGLAAAARIASQGHEVTIFEKNNNVGGRMNQLKKDGFTFDMGPTIVMMPDVYKDVFTACGKNYEDYIELRQLRYIYDVYFDHDDRITVPTDLAELQQMLESIEPGSTHGFMSFLTDVYKKYEIARRYFLERTYRKPSDFYNMTSLVQGAKLKTLNHADQLIEHYIDNEKIQKLLAFQTLYIGIDPKRGPSLYSIIPMIEMMFGVHFIKGGMYGMAQGLAQLNKDLGVNIELNAEIEQIIIDPKFKRADAIKVNGDIRKFDKILCTADFPSVAESLMPDFAPIKKYPPHKIADLDYSCSAFLMYIGIDIDVTDQVRLHNVIFSDDFRGNIEEIFEGRLSYDPSIYVYVPAVADKSLAPEGKTGIYVLMPTPELKTGSGIDWSDEALTQQIKEIIYRKLATIEVFEDIKSHIVSETIFTPNDFEQTYHAKFGSAFGLMPTLAQSNYYRPQNVSRDYKDLYFAGASTHPGAGVPIVLTSAKITVDEMIKDIERGV

SEQ ID NO: 3707 - DNA, 888 bp, Staphylococcus aureus
atggcatttcaatataggaggactagtatgacaatgatggatatgaattttaaatattgtcataaaatcatgaagaaacattcaaaaagcttttcttacgcttttgacttgttaccagaagatcaaagaaaagcggtttgggcaatttatgctgtgtgtcgtaaaattgatgacagtatagatgtttatggcgatattcaatttttaaatcaaataaaagaagatatacaatctattgaaaaatacccatatgaacatcatcactttcaaagtgatcgtagaatcatgatggcgcttcagcatgttgcacaacataaaaatatcgcctttcaatctttttataatctcattgatactgtatataaagatcaacattttacaatgtttgaaacggacgctgaattattcggatattgttatggtgttgctggtacagtaggtgaagtattgacgccgattttaagtgatcatgaaacacatcagacatacgatgtcgcaagaagacttggtgaatcgttgcaattgattaatatattaagagatgtcggtgaagattttgacaatgaacggatatattttagtaagcaacgattaaagcaatatgaagttgatattgctgaagtgtaccaaaatggtgttaataatcattatattgacttatgggaatattatgcagctatcgcagaaaaagattttcaagatgttatggatcaaatcaaagtatttagtattgaagcacaaccaatcatagaattagcagcacgtatatatattgaaatactggacgaagtgagacaggctaactatacattacatgaacgtgtttttgtggataagaggaaaaaggcaaagttgtttcatgaaataaatagtaaatatcatagaata

SEQ ID NO: 3708 - protein, 296 aa, Staphylococcus aureus
  MISC_FEATURE (1)..(296): squalene desaturase
MAFQYRRTSMTMMDMNFKYCHKIMKKHSKSFSYAFDLLPEDQRKAVWAIYAVCRKIDDSIDVYGDIQFLNQIKEDIQSIEKYPYEHHHFQSDRRIMMALQHVAQHKNIAFQSFYNLIDTVYKDQHFTMFETDAELFGYCYGVAGTVGEVLTPILSDHETHQTYDVARRLGESLQLINILRDVGEDFDNERIYFSKQRLKQYEVDIAEVYQNGVNNHYIDLWEYYAAIAEKDFQDVMDQIKVFSIEAQPIIELAARIYIEILDEVRQANYTLHERVFVDKRKKAKLFHEINSKYHRI

SEQ ID NO: 3709 - DNA, 1134 bp, Staphylococcus aureus
gtgatatctatgaaatggttatcacgaatattaacagtaatagtgaccatgtctatggcgtgtggtgcattgatatttaatcgtagacatcagctaaaggcgaaaacgctgaacttcaatcataaagcattaacaattattattccggctagaaacgaagaaaaaagaataggtcatttactacattcgataatacaacagcaagttccagtagatgtcattgttatgaatgacggatcgacagatgaaacagcacgtgtagcacgttcatatggtgcgactgtagtagatgttgttgatgatactgacggcaaatggtatgggaaatcacatgcttgttatcaaggtgtgacgcatgcatgtacgaatcgcattgcctttgtagatgctgatgtaactttcttaaggaaagatgctgttgaaacgttgattaatcagtatcaattacaaggtgaaaaaggattgttaagcgtacagccttatcatataacaaagcgtttctacgaagggttttcagcgatatttaatttaatgacagtcgttggtatgaatgtattttctaccttagacgacggtcggactaaccagcatgcatttggaccggtgacattaacaaataaagaagattattatgcaactggaggtcataaaagtgcaaaccgtcatattattgaaggatttgctttaggaagtgcatatacttcacaatcattgcccgtaacagtttatgaagggtttccatttgttgcatttcgcatgtatcaagaaggatttcagtcattacaagaaggatggacaaagcatttgtcaactggggcaggtggcacaaagcctaagatcatgacagcaattgtgttgtggttgtttggttctatagcgagtattttagggctatgtcttagtttaaaatatcgccaaatgtctgtaagaaaaatggtagcactttacttgagctatactacacaatttatttatctgcatcgaagggtcggccaattttctaatttattaatggtatgtcatccattgttatttatgttttttactaaaattttcatccaatcttggaaacaaacgcatcgttatggtgtagttgaatggaaaggtcgtcaatattctatatctaaagaacaa

SEQ ID NO: 3710 - protein, 378 aa, Staphylococcus aureus
  MISC_FEATURE (1)..(378): conserved hypothetical
VISMKWLSRILTVIVTMSMACGALIFNRRHQLKAKTLNFNHKALTIIIPARNEEKRIGHLLHSIIQQQVPVDVIVMNDGSTDETARVARSYGATVVDVVDDTDGKWYGKSHACYQGVTHACTNRIAFVDADVTFLRKDAVETLINQYQLQGEKGLLSVQPYHITKRFYEGFSAIFNLMTVVGMNVFSTLDDGRTNQHAFGPVTLTNKEDYYATGGHKSANRHIIEGFALGSAYTSQSLPVTVYEGFPFVAFRMYQEGFQSLQEGWTKHLSTGAGGTKPKIMTAIVLWLFGSIASILGLCLSLKYRQMSVRKMVALYLSYTTQFIYLHRRVGQFSNLLMVCHPLLFMFFTKIFIQSWKQTHRYGVVEWKGRQYSISKEQ

SEQ ID NO: 3711 - DNA, 1500 bp, Staphylococcus aureus
gtgaacgtcatgactaaacatatcatcgttattggtggtggcttaggtgggatttctgcagcaattcgaatggcacaaagtggctattcggtctcattatatgaacaaaataatcatataggaggcaaagtgaatcgtcatgaatcagatggctttggctttgatttaggtccatctattttaacgatgccttatatttttgaaaaattattcgaatatagcaagaagcaaatgtcagactacgttacaatcaagcgattgccacatcaatggcgtagcttttttccagatggaacgactatcgatttgtatgaaggtattaaagaaacaggtcagcataatgcgatattgtcgaaacaggatatagaggaactgcaaaattatttgaattatacaagacgaatcgatcgtattactgaaaaagggtatttcaactatggtttagatacactatctcaaattattaaatttcatgggccattaaatgctcttattaattatgattatgtacatactatgcaacaggccatagacaagcgtatctcgaatccatacttgcgacaaatgttaggctattttatcaaatatgtaggttcttcatcatacgatgcgccagctgtattatctatgttattccatatgcaacaagagcaaggcctttggtatgtagaaggtggaatccatcatttagccaatgccttggaaaagctagcgcgtgaagaaggtgtcacaattcatacaggtgcacgtgtggacaatattaaaacatatcaaagacgtgtgacgggtgtcagattagatacaggtgagtttgtaaaggcagattatattatttcaaatatggaagtcatacctacttataaatatttaattcaccttgatactcaacgattaaacaaattagagagggaatttgagccggcaagctcaggatatgtgatgcatttaggtgttgcttgccaatacccgcaattagcacatcataatttcttttttacggaaaatgcttatctcaattatcaacaagtttttcatgaaaaggtattgccagatgatccgaccatttatctagtaaatacgaataaaactgatcacacacaagcgccagtaggttatgaaaatatcaaagtcttaccacatattccatatattcaagatcagccttttaccactgaagattatgcgaagtttagggataaaattttggataaattagaaaaaatgggacttactgatttaagaaaacacattatttatgaagatgtttggacaccggaggatattgaaaaaaattatcgttctaatcgtggtgcaatatatggtgttgtagcagataaaaagaaaaacaaaggatttaaatttcctaaagaaagtcagtattttgaaaacttgtactttgtaggtggatcagtaaatcctggtggtggcatgccaatggttacattaagtgggcaacaagtcgcagacaaaataaacgcgcgagaagcgaagaataggaag

SEQ ID NO: 3712 - protein, 500 aa, Staphylococcus aureus
  MISC_FEATURE (1)..(500): hypothetical protein
VNVMTKHIIVIGGGLGGISAAIRMAQSGYSVSLYEQNNHIGGKVNRHESDGFGFDLGPSILTMPYIFEKLFEYSKKQMSDYVTIKRLPHQWRSFFPDGTTIDLYEGIKETGQHNAILSKQDIEELQNYLNYTRRIDRITEKGYFNYGLDTLSQIIKFHGPLNALINYDYVHTMQQAIDKRISNPYLRQMLGYFIKYVGSSSYDAPAVLSMLFHMQQEQGLWYVEGGIHHLANALEKLAREEGVTIHTGARVDNIKTYQRRVTGVRLDTGEFVKADYIISNMEVIPTYKYLIHLDTQRLNKLEREFEPASSGYVMHLGVACQYPQLAHHNFFFTENAYLNYQQVFHEKVLPDDPTIYLVNTNKTDHTQAPVGYENIKVLPHIPYIQDQPFTTEDYAKFRDKILDKLEKMGLTDLRKHIIYEDVWTPEDIEKNYRSNRGAIYGVVADKKKNKGFKFPKESQYFENLYFVGGSVNPGGGMPMVTLSGQQVADKINAREAKNRK

SEQ ID NO: 3713 - DNA, 495 bp, Staphylococcus aureus
atgaaaaccatgaaaaaatatattaaaacagcatttttttgtagtatgtattggttaattgttcaactaaatatagcaaatttaggtacaagaattcctgataagtattttcgtcagaagtacataatatttaaatcatttaactttgagaagcatggaaaattttggaacaaatggttttacgtaagaaaatggaaacataagattttagatggtcatcagcttaatcaaaatatatatgatcagcgtcatttaatgacaatcaatactgatgaaattgaaaaaatgattatagagacaaagagggcagagttgattcattggatatcgatacttccagtcatcatattcaataaaggccctcgtttagtaaagtatataaatattttctatgcaatgatagctaatgttccaatcattattgtgcaacgctataatcgaccgagattaacgcagttactacgcatattaaaacgaagaggtgaacgtcatgac

SEQ ID NO: 3714 - protein, 165 aa, Staphylococcus aureus
  MISC_FEATURE (1)..(165): hypothetical protein
MKTMKKYIKTAFFCSMYWLIVQLNIANLGTRIPDKYFRQKYIIFKSFNFEKHGKFWNKWFYVRKWKHKILDGHQLNQNIYDQRHLMTINTDEIEKMIIETKRAELIHWISILPVIIFNKGPRLVKYINIFYAMIANVPIIIVQRYNRPRLTQLLRILKRRGERHD

SEQ ID NO: 3715 - DNA, 783 bp, Staphylococcus aureus
ttgggaggatatttaattatgaaaaaaatcgttacagctacaatcgctacagcaggacttgccactatcgcatttgcaggacatgatgcacaagccgcagaacaaaataacaatggatataattctaatgacgctcaatcatacagctatacgtatacaattgatgcacaaggtaattatcattacacttggacaggaaattggaatccaagtcaattaacgcaaaacaacacatactactacaacaactacaatacttatagttataacaatgcatcttacaataactactataatcattcatatcaatacaataactatacaaacaatagtcaaacagcaacaaataactattatactggtggttcaggtgcaagttatagcacaacaagtaataatgttcatgtgactacaactgcagcgccatcttcaaatggtcgttcaatttctaatggttatgcatcaggaagtaacttatatacttcaggacaatgtacttattatgtatttgatcgtgttggtgggaaaattggttcaacatggggtaacgcaagtaattgggctaacgcagctgcatcatctggctatacagtgaacaatacaccaaaagttggtgctatcatgcaaacaacacaaggctattacggtcatgttgcttacgttgaaggcgttaacagcaacggttctgttcgtgtttcagaaatgaactatggacatggtgctggtgtggttacgtctcgtacaatttcagcaaaccaagcaggttcatataatttcattcat

SEQ ID NO: 3716 - protein, 261 aa, Staphylococcus aureus
  MISC_FEATURE (1)..(261): hypothetical protein
LGGYLIMKKIVTATIATAGLATIAFAGHDAQAAEQNNNGYNSNDAQSYSYTYTIDAQGNYHYTWTGNWNPSQLTQNNTYYYNNYNTYSYNNASYNNYYNHSYQYNNYTNNSQTATNNYYTGGSGASYSTTSNNVHVTTTAAPSSNGRSISNGYASGSNLYTSGQCTYYVFDRVGGKIGSTWGNASNWANAAASSGYTVNNTPKVGAIMQTTQGYYGHVAYVEGVNSNGSVRVSEMNYGHGAGVVTSRTISANQAGSYNFIH

SEQ ID NO: 3717 - DNA, 1809 bp, Staphylococcus aureus
atggatacaaaagactttaaacgtttagaaaaaatgtattccccgcgatacttacctggattagatggattgagggcattcgcagttataggaatcattatttatcacttgaatgcacaatggttaagtgggggctttttaggagtagatacattcttcgttatttcaggttatttaataacaagtttgttgataagtgagtattatcggacgcaaaaaatcgatttgctagagttttggaagcgacgattgaaacgactcattccggcagtgttatttttaatctgtgtcgtgcttacgttcacactgatatttaaaccggaattgattatacaaatgaaacgagatgctattgcagctatattctatgtttcaaactggtggtacatttcacagaatgtagattattttaaccaatttgctattgaaccactcaaacatttatggtctttagccattgaagaacaattttacttgcttttcccattggttatcacgttcttattacatagatttaaaccgagaaatattattcaaacgctatttattgtatcgttgatttctttaggacttatgatagtgattcatttcatcactggagataattcacgtgtgtattttgggacagatacacgactgcaaactttattgcttggttgtatattagcatttatttggcctccgtttgctttgaaaaaagatatttctaaaaagattgtcgtatcattagatattatagggatatctggttttgcggttctaatgactttgttctttatagttggagaccaagatcaatggatctataatggaggattttacattatatcatttgcaactttattcattattgcaattgcggtacatccttctagtttatttgctaaatttttaagtatgaaacctttactaattataggtaaacgatcatatagcttatacttatggcattatcctatcattgtttttgtgaacagttattacgtacaaggacaaataccggtatacgtttatattatagaaattttgttaacagcgttaatggctgaaatttcgtatcgctttattgaaacacctatacgtaaaaaaggatttaaagcttttgcatttttacctaaaaagaaggggcaatttgctagaacagtgttagttatcctattattggttccgtctatcgttgtgctcagtggacagtttgatgcacttggcaaacaacatgaagccgagaagaaagagaagaagacggaatttaaaacaacgaagaaaaaagtcgttaaaaaagataagcaagaggataagcagacagcgaatagcaaagaggatattaaaaagtcatcaccactattaattggtgactcggtcatggtggatattggtaatgtctttactaagaaaataccaaatgcacaaattgatggtaaagttggacggcaactcgttgatgctacaccaattgtgaaatcgcaatataaagactatgctaaaaaaggtcaaaaagttgtagtagagcttggtacaaatggggcatttacgaaagatcaattaaatgaactattggatagttttggaaaagcagacatatatttagtttctattagagtacctagagattatgaaggtagaataaataaattaatttatgaggcagctgaaaagcgctctaatgtacatctagtcgattggtataaagcttctgcaggtcatccggaatactttgcatatgacggtattcacttagaatatgcaggtagtaaagcgctgactgatttgattgtaaaaacgatggaaacacatgctacaaataagaaa

SEQ ID NO: 3718 - protein, 603 aa, Staphylococcus aureus
  MISC_FEATURE (1)..(603): hypothetical protein
MDTKDFKRLEKMYSPRYLPGLDGLRAFAVIGIIIYHLNAQWLSGGFLGVDTFFVISGYLITSLLISEYYRTQKIDLLEFWKRRLKRLIPAVLFLICVVLTFTLIFKPELIIQMKRDAIAAIFYVSNWWYISQNVDYFNQFAIEPLKHLWSLAIEEQFYLLFPLVITFLLHRFKPRNIIQTLFIVSLISLGLMIVIHFITGDNSRVYFGTDTRLQTLLLGCILAFIWPPFALKKDISKKIVVSLDIIGISGFAVLMTLFFIVGDQDQWIYNGGFYIISFATLFIIAIAVHPSSLFAKFLSMKPLLIIGKRSYSLYLWHYPIIVFVNSYYVQGQIPVYVYIIEILLTALMAEISYRFIETPIRKKGFKAFAFLPKKKGQFARTVLVILLLVPSIVVLSGQFDALGKQHEAEKKEKKTEFKTTKKKVVKKDKQEDKQTANSKEDIKKSSPLLIGDSVMVDIGNVFTKKIPNAQIDGKVGRQLVDATPIVKSQYKDYAKKGQKVVVELGTNGAFTKDQLNELLDSFGKADIYLVSIRVPRDYEGRINKLIYEAAEKRSNVHLVDWYKASAGHPEYFAYDGIHLEYAGSKALTDLIVKTMETHATNKK

SEQ ID NO: 3719 - DNA, 681 bp, Staphylococcus aureus
atggataagaaaaaagtcatcaaatttatgattaatgtattaccaattgtattggtaccgttaattgttgaacgtaaacgtatcaaacaacatccggacgtacaaaaagttacagatgctacaagtaaagttgcttcaaaaacatctgcagcaatcagtaacacagcgagtgatgttaaagaatatgtcggcgataaaaaacaagattttgaaaataaacgtgaacttaaaaagtttgctagagaacatgatcctgcctatattgagaaaaaaggcgaaaaattagctaaacaaaatcgtaaagacgctgataaaatgaataaaatacttcaaaaaaatatcgaaaagcgtcataaagaagagcaaaaagcccgcgaaaagaatgaaatacaacgtattaaagatatgaaaaaatcacaaaaatacgaagaaaaagcaggcttaacacctaataaattagatgagaaaactgagaaaaaaggcgataaactagctgaaaaaaatcgcaaagaaatcgctaaaatgaataaaaagttacaaaaaaatattgaaaaacgacacaaagaagaacaaaaacgccaacaagaagctgataaagcacgcatcaagtcatttaaaaaatataaagattatgttgccaaaagcgcctctcaacaaaataaagaaaacaatacagaggca

SEQ ID NO: 3720 - protein, 227 aa, Staphylococcus aureus
  MISC_FEATURE (1)..(227): conserved hypothetical
MDKKKVIKFMINVLPIVLVPLIVERKRIKQHPDVQKVTDATSKVASKTSAAISNTASDVKEYVGDKKQDFENKRELKKFAREHDPAYIEKKGEKLAKQNRKDADKMNKILQKNIEKRHKEEQKAREKNEIQRIKDMKKSQKYEEKAGLTPNKLDEKTEKKGDKLAEKNRKEIAKMNKKLQKNIEKRHKEEQKRQQEADKARIKSFKKYKDYVAKSASQQNKENNTEA

SEQ ID NO: 3721 - DNA, 504 bp, Staphylococcus aureus
atgaaaaaggagataaaaatggctataaacataattgaatataataggtcttataaggaagagctaatcgagtttattttatcgattcaaaaaaatgaatttaatataaaaattgatagagatgatcaacctgatttggagaacatcgaacataactatttgaataatggagggcaattttggcttgcaataaacaatcatcaaaatattgttggtactataggtttgattagactagataataatatgtctgcacttaaaaaaatgtttgttgataaaggttataggaatttaaaaataggtaaaaaacttttagataaagttataatgacatgtaaagaacaaaatatcgatggtatttatttaggaacaattgataaatttattagtgcacagtatttttattctaataatgacttccgtgaaattaagcgaggagatttaccaagtagttttcctaaattagatgtagataataggttttattacagaaatttaaaagat

SEQ ID NO: 3722 - protein, 168 aa, Staphylococcus aureus
  MISC_FEATURE (1)..(168): conserved hypothetical
MKKEIKMAINIIEYNRSYKEELIEFILSIQKNEFNIKIDRDDQPDLENIEHNYLNNGGQFWLAINNHQNIVGTIGLIRLDNNMSALKKMFVDKGYRNLKIGKKLLDKVIMTCKEQNIDGIYLGTIDKFISAQYFYSNNDFREIKRGDLPSSFPKLDVDNRFYYRNLKD

SEQ ID NO: 3723 - DNA, 699 bp, Staphylococcus aureus
atgaaaaagacaattatggcatcatcattagcagtggcattaggtgtaacaggttacgcagcaggtacaggacatcaagcacacgctgctgaagtaaacgttgatcaagcacacttagttgacttagcgcataatcaccaagatcaattaaatgcagctccaatcaaagatggtgcatatgacatccactttgtaaaagatggtttccaatataacttcacttcaaatggtactacatggtcatggagctatgaagcagctaatggtcaaactgctggtttctcaaacgttgcaggtgcagactacactacttcatacaaccaaggttcaaatgtacaatcagtaagctacaatgcacaatcaagtaactcaaacgttgaagctgtttcagctccaacttaccataactacagcacttcaactacttcaagttcagtgagattaagcaatggtaatactgcaggtgctactggttcatcagcagctcaaatcatggctcaacgtactggtgtttcagcttctacatgggctgcaatcatcgctcgtgaatcaaatggtcaagtaaatgcttacaacccatcaggtgcttcaggtttattccaaactatgccaggttggggtccaacaaacactgttgaccaacaaatcaacgcagctgttaaagcatacaaagcacaaggtttaggtgcttggggattc

SEQ ID NO: 3724 - protein, 233 aa, Staphylococcus aureus
  MISC_FEATURE (1)..(233): immunodominant antigen A
MKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 3725 - DNA, 1149 bp, Staphylococcus aureus
atgcacatcttagaatttaagctagtggcagcttataacttaaggctctttattatttgcatacagatgtatatacataaatggaaggatgatattatgacatcaattaaaacaattacacccaaagattttatatttagagttttatcaggtgtcgccataggtattgttgcgggtttagttcctaatgcgatacttggagaaatttttaaatactttatggattatcatccgatttttaaaacgttattaggcgttgtcgttgcaattcaatttacagtacctgctttgattggtgcattggttgccatgaaatttgacctatcgccattagcaattgctgttgtggcaagtgcagcatatgtaggaagcggtgcagcgcagtttaaaaatggtgcttggatgattacgggtattggtgatttaattaatacaatgattacagcagcgattgcagtgttattcattttacttattcaacatcgcgtaggtagtatggcattgattgtattcccaacagttgttggcggtatttcaggtgcaattggtgttttaatattgccgtatacgaaaatgattacaacagccatcggtaatatggttaatggttttacagaattacaaccgattgtcatgagtattttgatttcaatggtatttagtcttattattatttcgccactatcaactgtggccattgcctttgcgataggtattacaggtttagcagctggatcagcgtcaattggtatctccgcgactgaagcagtattgataattggtacaagtaaagtgaatcgtttaggggtgccgttatccgtcttctttggaggcgttaaaatgatgatacctaatatggtgaaatatccaattcttatgttaccaatattaacgacagccattgtatcaggtttggtatcagcattagtaggtattcatggaacgaaagagtcagctggatttggttttataggaatggtaggaccgattaatgcatttaaatttatggaggttgattctgcttggttgagtgtcttactaattgtagtagcgttctttgttgtaccatttgtaacagcttggcttgcagatatcatttatcgtaaagtgtttcgtttatatactaatgatatttttaaattcatggga

SEQ ID NO: 3726 - protein, 383 aa, Staphylococcus aureus
  MISC_FEATURE (1)..(383): hypothetical protein
MHILEFKLVAAYNLRLFIICIQMYIHKWKDDIMTSIKTITPKDFIFRVLSGVAIGIVAGLVPNAILGEIFKYFMDYHPIFKTLLGVVVAIQFTVPALIGALVAMKFDLSPLAIAVVASAAYVGSGAAQFKNGAWMITGIGDLINTMITAAIAVLFILLIQHRVGSMALIVFPTVVGGISGAIGVLILPYTKMITTAIGNMVNGFTELQPIVMSILISMVFSLIIISPLSTVAIAFAIGITGLAAGSASIGISATEAVLIIGTSKVNRLGVPLSVFFGGVKMMIPNMVKYPILMLPILTTAIVSGLVSALVGIHGTKESAGFGFIGMVGPINAFKFMEVDSAWLSVLLIVVAFFVVPFVTAWLADIIYRKVFRLYTNDIFKFMG

SEQ ID NO: 3727 - DNA, 126 bp, Staphylococcus aureus
atggattttaaaaatgaagataaaataaaagtgtattgtaacaatatgtttgaaaaattgccaatttatttatctaaaaattcagaattttgtgatatactatttttcatagtcttgagttataga

SEQ ID NO: 3728 - protein, 42 aa, Staphylococcus aureus
MDFKNEDKIKVYCNNMFEKLPIYLSKNSEFCDILFFIVLSYR

SEQ ID NO: 3729 - DNA, 135 bp, Staphylococcus aureus
ttgttacaatacacttttattttatcttcatttttaaaatccattaatacaatagaagaaagacattcaaatgcttaccaaaaaggtacattatttgttaggagcgtatcagcacttacatatcatcaacacaat

SEQ ID NO: 3730 - protein, 45 aa, Staphylococcus aureus
LLQYTFILSSFLKSINTIEERHSNAYQKGTLFVRSVSALTYHQHN

SEQ ID NO: 3731 - DNA, 600 bp, Staphylococcus aureus
gtgttaaaacaacagatgttaggtagtgaacaaatgatggaaagtaaatccatagatccaagaatcgttagaaccaaacaattgcttgtcgatgcttttcttaaaatttctagagaaaagaaattatctcaaattacagttaaagatatcactgatattgctacgctaaatcgtgcaacattttacgctcatttcgctgataaagaagacctcctagactacacattatctgtaaccattttaaaagacttgaatgataatttgagcatttctaatgtcattaatgaaaaggttctgcgtaatattttcatttcaattgcgagttatatcaaagatgctgcaaagtcttgcgaattaaatagtgaagcattttgcaacaaagcacatcaacgtattaataatgaattagaagatatttttgcgattatgttagaaaacagctatccggagcatcaacgagatatcattgtaaatagtgcgagttttttagcagctggtatctcaggcttagcattacattggtttaacacgagtcaagagacagccgatgtgtttatcgatcgcaaccttccatttttaattcatcatatagcacatttt

SEQ ID NO: 3732 - protein, 200 aa, Staphylococcus aureus
  MISC_FEATURE (1)..(200): hypothetical protein
VLKQQMLGSEQMMESKSIDPRIVRTKQLLVDAFLKISREKKLSQITVKDITDIATLNRATFYAHFADKEDLLDYTLSVTILKDLNDNLSISNVINEKVLRNIFISIASYIKDAAKSCELNSEAFCNKAHQRINNELEDIFAIMLENSYPEHQRDIIVNSASFLAAGISGLALHWFNTSQETADVFIDRNLPFLIHHIAHF

SEQ ID NO: 3733 - DNA, 498 bp, Staphylococcus aureus
gtgacaagcatttttgtttttgcgtacttaaacaacacttcaggcaatatgttgtttaggcaacaaatgatatgtgcgtgtttattggcaaacgtacgacatagtagtatagtatgtctaaacaacatatgttgcatagttgatatgcgttgtttaaatactaagataggagggattgacgtgagcgagacagatgaacctcaggggtttgaacgcacgcataatatattaaatattaatcagagtagtctgggtgtagtgacatacattacaaataaattaaagtcgacgttgaagcaacacataataattgctcgtggtaaaaagcgaatcgactatcgactgtcgtataacttttacactacgtattatgataatgtagaaatcaagaaaatcgactgtgaatatacctatgctatgcccattgcaattttaataagacacacgatgtcattcgacaatgctcatttctttgctcagttacgtcatcctgtctta

SEQ ID NO: 3734 - protein, 166 aa, Staphylococcus aureus
  MISC_FEATURE (1)..(166): hypothetical protein
VTSIFVFAYLNNTSGNMLFRQQMICACLLANVRHSSIVCLNNICCIVDMRCLNTKIGGIDVSETDEPQGFERTHNILNINQSSLGVVTYITNKLKSTLKQHIIIARGKKRIDYRLSYNFYTTYYDNVEIKKIDCEYTYAMPIAILIRHTMSFDNAHFFAQLRHPVL

SEQ ID NO: 3735 - DNA, 228 bp, Staphylococcus aureus
atgaaaattttagatagaattaatgaacttgcaaataaagaaaaagtacaaccacttactgtagctgaaaaacaagaacaacatgcattgcgtcaagactacttaagcatgatccgaggacaagtattaacaacattttccacaataaaagtggttgatccaatcggtcaggatgtcacaccagataaagtttatgatcttcgccaacaatacggttatattcaaaat

SEQ ID NO: 3736 - protein, 76 aa, Staphylococcus aureus
  MISC_FEATURE (1)..(76): conserved hypothetical
MKILDRINELANKEKVQPLTVAEKQEQHALRQDYLSMIRGQVLTTFSTIKVVDPIGQDVTPDKVYDLRQQYGYIQN

SEQ ID NO: 3737 - DNA, 426 bp, Staphylococcus aureus
gtgattggcttaaagtccaaaactataataagtaatgaatggggtgcaatcatgattcaatcaatgtggtttaatttgcatgtgcaagatttagaaaagagcgcacagttttataaagcgttaggatttaaaataaatagaaacccacaaatgttagataaaatggtcggcattcaaataggtcaaacaaccgtaattttaatagaaaacaagcattttcaaaatgtaagtcagcaaagccttaatactgaaccaaatgaagtgatgatttctctaggtgtgaacacaaatgaagaagttgaccagttggtgaataaagtgaaagaagcgggtggcacagtcgttcaagaaccaacagtaagccaagggttttatggagcaatgttcaaagatcttgatggacaccattttaattttttggtctgc

SEQ ID NO: 3738 - protein, 142 aa, Staphylococcus aureus
  MISC_FEATURE (1)..(142): conserved hypothetical
VIGLKSKTIISNEWGAIMIQSMWFNLHVQDLEKSAQFYKALGFKINRNPQMLDKMVGIQIGQTTVILIENKHFQNVSQQSLNTEPNEVMISLGVNTNEEVDQLVNKVKEAGGTVVQEPTVSQGFYGAMFKDLDGHHFNFLVC

SEQ ID NO: 3739 - DNA, 819 bp, Staphylococcus aureus
atgaaagatattttagtaataggcgcaacagggaagcaaggtaatgcagttgtaaaacagttgttagaggatggatggtatgtaagtgcattaactagaaataagaataatcgtaaactttcagacataggacatccgcatttatcaatcgttgaaggtgatctgagtgataatgttagtttgcaatcagcgatgaaaggtaagtatggcttatacagtattcagccaatcgttaaagatgatgttagcgaagaattaagacaaggtatgaagataattgaaatagctgagcaagaaaatattcaacatattgtgtatagtactgcgggaggggttaatcgaaatcgaactggcccacactttgaagtactagcaaaaatagaaaatagattaatggaatctaatataaatgcaacagttatcaaaccatcattctttatggataattttttacgcattgctaaagtcgaagatgaacgtattacattaccagaatttattaatccgaatataaaattcacaatgatttcttctattgatatagctaaaattgcatcgtatatttttgcacatccacaaagctttacgcatcaatcaatagagattggttccgatgaagttacattaagtgaagcagcaacaatttttagtgaagtgacaggtaaatctactgttatagaaggagaatttgttagtggtgttgcagaaaagcaatggttggaagaaaaaggttatgaagtagactttgaattaatggctgaaataaatccaacaagattatcattaagtgattggcttaaagtccaaaactataataag

SEQ ID NO: 3740 - protein, 273 aa, Staphylococcus aureus
  MISC_FEATURE (1)..(273): conserved hypothetical
MKDILVIGATGKQGNAVVKQLLEDGWYVSALTRNKNNRKLSDIGHPHLSIVEGDLSDNVSLQSAMKGKYGLYSIQPIVKDDVSEELRQGMKIIEIAEQENIQHIVYSTAGGVNRNRTGPHFEVLAKIENRLMESNINATVIKPSFFMDNFLRIAKVEDERITLPEFINPNIKFTMISSIDIAKIASYIFAHPQSFTHQSIEIGSDEVTLSEAATIFSEVTGKSTVIEGEFVSGVAEKQWLEEKGYEVDFELMAEINPTRLSLSDWLKVQNYNK

SEQ ID NO: 3741 - DNA, 456 bp, Staphylococcus aureus
gtgacacatattattattgatggagatgcttgtcctgttgttgattctattatagatttaacaactgagacaggcatttttgtgacaattattcggagcttcagccatttttcgaaccaattatatcctccacatgtatcaacattatatgttgatgatggaccagatgcagttgattacaaaattgttcaattatcaacgaaggatgatatcgtagtcactcaagattatggactcgcaagtttattagtcgacaaagtcttaattgtcatgcatcataatgggaagatatacaattccaaaaatattcaacaactattagataaacgatatatgaatgcacaaattagaaaacaaggtggtcgccacaaaggtcccccaccttttacaaagcaagatcaaaaagtgtttgaacaatcactattaaaagtcattcatcgaattaaggagctggat

SEQ ID NO: 3742 - protein, 152 aa, Staphylococcus aureus
  MISC_FEATURE (1)..(152): conserved hypothetical
VTHIIIDGDACPVVDSIIDLTTETGIFVTIIRSFSHFSNQLYPPHVSTLYVDDGPDAVDYKIVQLSTKDDIVVTQDYGLASLLVDKVLIVMHHNGKIYNSKNIQQLLDKRYMNAQIRKQGGRHKGPPPFTKQDQKVFEQSLLKVIHRIKELD

SEQ ID NO: 3743 - DNA, 306 bp, Staphylococcus aureus
gtgttgataatgtctttaaataaagagcaaagacgcatcacagctgaagagttgcaagcacatttcgaagcatctaccttatcggttcaaatgattgctgaaaaactgaatgtcactacagaagatgtggaaaaagtattagctatgacagcgccactaggcatttttagtcatcaattacaacgatttattcatttagtatgggatgtcagagatgtaataaacgacaatattaaaggaaatggacaaacaccagaaccatatacgtatttaaaaggtgaaaaagaggactattggtttttaaga

SEQ ID NO: 3744 - protein, 102 aa, Staphylococcus aureus
  MISC_FEATURE (1)..(102): hypothetical protein
VLIMSLNKEQRRITAEELQAHFEASTLSVQMIAEKLNVTTEDVEKVLAMTAPLGIFSHQLQRFIHLVWDVRDVINDNIKGNGQTPEPYTYLKGEKEDYWFLR

SEQ ID NO: 3745 - DNA, 555 bp, Staphylococcus aureus
atgcgaaaagatgcaaaagagaataggcaacgaattgaagaaatagcgcacaaactttttgatgaagaaggcgttgaaaacattagtatgaatcgtattgctaaagaactaggtatcggtatggggacattgtatcgacatttcaaagataaaagcgatttatgctactacgtcatacaaagagaccttgatatttttatcactcattttaagcaaattaaagatgactatcattctaattatgaggttatgcaagtgtcgttagattatcttttacaatttaaaatcgataataaggcactactgcaatgtattgaagcaggcaacaataaattacgtttttaccaaagcgcattttatcaagaattatttgatttttattatgacttatttaaaagcgatgacgacacttacacgaagttcaaaacagatatgctgttgcaatcattatcaactagtgtatttgccttccaaatagagcatcgccatatttcaattgaagcgtacagaaattatttattaaacatttatttagatgaggtgggacgtaatgac

SEQ ID NO: 3746 - protein, 185 aa, Staphylococcus aureus
  MISC_FEATURE (1)..(185): hypothetical protein
MRKDAKENRQRIEEIAHKLFDEEGVENISMNRIAKELGIGMGTLYRHFKDKSDLCYYVIQRDLDIFITHFKQIKDDYHSNYEVMQVSLDYLLQFKIDNKALLQCIEAGNNKLRFYQSAFYQELFDFYYDLFKSDDDTYTKFKTDMLLQSLSTSVFAFQIEHRHISIEAYRNYLLNIYLDEVGRND

SEQ ID NO: 3747 - DNA, 717 bp, Staphylococcus aureus
atgaggtgggacgtaatgactaaaattgtgttaatcacaggaggcaataaagggttaggctatgcaagtgcagaggcacttaaagcattgggttacaaagtttatataggttctcggaatgatgtaagaggacaacaagcatcacaaaaattaggtgttcattatgtacaattagatgttacaagtgactactcagtcaaaaatgcttataacatgattgctgaaaaagaaggccgtcttgatatcctcattaacaatgcaggtatatctggtcaattttcagcaccttccaaattgacacctcgtgacgttgaagaagtatatcaaacgaatgtattcggtatcgtacgaatgatgaatacattcgtccctctcttagaaaaatctgaacaacctgttgtcgtcaacgtatcaagtggtttaggttcatttggaatggttacaaaccccgaaacagctgaatctaaagtgaattcattagcttattgttcgtctaaatcggcagtaacaatgctaacgctacaatacgctaaaggattacctaacatgcaaatcaatgctgctgatccaggcgctacaaatactgatttagttggtgattttagtaataattccaaacacgtttctgaaggaatcaagccaatcattcaattagcaacgattggtgcagatggcccaacaggtacatttattaatggcgatggagagatgccttgg

SEQ ID NO: 3748 - protein, 239 aa, Staphylococcus aureus
  MISC_FEATURE (1)..(239): hypothetical protein
MRWDVMTKIVLITGGNKGLGYASAEALKALGYKVYIGSRNDVRGQQASQKLGVHYVQLDVTSDYSVKNAYNMIAEKEGRLDILINNAGISGQFSAPSKLTPRDVEEVYQTNVFGIVRMMNTFVPLLEKSEQPVVVNVSSGLGSFGMVTNPETAESKVNSLAYCSSKSAVTMLTLQYAKGLPNMQINAADPGATNTDLVGDFSNNSKHVSEGIKPIIQLATIGADGPTGTFINGDGEMPW

SEQ ID NO: 3749 - DNA, 1008 bp, Staphylococcus aureus
atgaaaagtattacgtttgaagaacattatgtcattgaagatattcaaaaagaaacgatgaatgcgatatcagcagatcctaaaggtgtaccgatgaaagtaatgttagaaggccttgaaaaaaagacaggttttacaaatgccgacgaattatcacatcatgatgaacgtatccaatttatgaataatcaagacgttcaaattcaagtcttatcttatggaaatggttctccttcaaatttggttggtcagaaagccattgaattatgtcaaaaagcaaatgatcaattggcaaactatattgcacaatatcccaatcgctttgtaggctttgcaactttacctatcaatgagcctgaagccgcagcgcgagaattcgaacgttgcatcaatgatttaggattcaaaggtgcgctcattatgggacgtgcacaagatggttttcttgatcaagacaaatatgacattattttcaaaacagctgaaaatttagacgtaccgatttatctacatcccgcgccagttaacagtgacatttatcaatcatactataaaggaaattatcctgaagtaactgcggcaacatttgcttgttttggttatggttggcacattgatgtcggcattcatacaatacatctagtattatctggtatttttgatcgttatccaaagttaaatatgattattggacattggggtgagtttatcccattcttcttagaacgtatggatgaagctttattcgctgaacatttgaaccaccctgtaagctattactttaaaaataatttttatatcacaccgagtggcatgttaacgaagccacagtttgatttagtcaagaaagaagtaggtattgatagaattctttatgctgctgattatccatatattgagcctgaaaaattaggtgtatttttagatgaactgggtttaacagatgaagaaaaagagaaaataagttatacaaatggtgctaaattattaggtttatcacctaacaat

SEQ ID NO: 3750 - protein, 336 aa, Staphylococcus aureus
  MISC_FEATURE (1)..(336): conserved hypothetical
MKSITFEEHYVIEDIQKETMNAISADPKGVPMKVMLEGLEKKTGFTNADELSHHDERIQFMNNQDVQIQVLSYGNGSPSNLVGQKAIELCQKANDQLANYIAQYPNRFVGFATLPINEPEAAAREFERCINDLGFKGALIMGRAQDGFLDQDKYDIIFKTAENLDVPIYLHPAPVNSDIYQSYYKGNYPEVTAATFACFGYGWHIDVGIHTIHLVLSGIFDRYPKLNMIIGHWGEFIPFFLERMDEALFAEHLNHPVSYYFKNNFYITPSGMLTKPQFDLVKKEVGIDRILYAADYPYIEPEKLGVFLDELGLTDEEKEKISYTNGAKLLGLSPNN

SEQ ID NO: 3751 - DNA, 834 bp, Staphylococcus aureus
ttgaatatggaaactttagaattacaaggcgctaaattacgataccaccaagtcggacaaggacccgtgctcatctttattcctggtgcaaacggtaccggagacatttttctgcctcttgcagaacagttaaaagaccattttactgttgtagccgttgatcgtcgtgattatggagaaagcgagttaactgaaccactccctgattccgcttcaaaccctgacagtgattatcgtgtcaaacgcgacgcacaggacattgccgaacttgcaaagtcattaagtgatgaacctgtctatatattaggttcaagttcaggttcaatcgttgcgatgcatgtgttaaaagattaccctgaagtcgttaaaaagattgcatttcacgaaccaccaattaatacatttttaccagacagtacttattggaaagataaaaatgatgacattgtgcatcaaattttaacagaaggcttagaaaaaggcatgaaaacatttggcgaaacattaaatatcgcaccaattgatgcaaaaatgatgtctcaacctgctgatactgaagaaggacgtatagaacagtacaaacgtacgatgttctggtcagaatttgaaattagacaatatacgcattcagatattactttggatgatttcacaaaatacagcgataaaatcaccctactaaatgggacagattctagaggctccttcccacaagatgttaacttttatataaataaagaaactggcatacctattgtagatattccaggcggtcacttaggttatattcaaaaacctgaaggctttgctgatgtattattaaatatgtggggt

SEQ ID NO: 3752 - protein, 278 aa, Staphylococcus aureus
  MISC_FEATURE (1)..(278): conserevd hypothetical
LNMETLELQGAKLRYHQVGQGPVLIFIPGANGTGDIFLPLAEQLKDHFTVVAVDRRDYGESELTEPLPDSASNPDSDYRVKRDAQDIAELAKSLSDEPVYILGSSSGSIVAMHVLKDYPEVVKKIAFHEPPINTFLPDSTYWKDKNDDIVHQILTEGLEKGMKTFGETLNIAPIDAKMMSQPADTEEGRIEQYKRTMFWSEFEIRQYTHSDITLDDFTKYSDKITLLNGTDSRGSFPQDVNFYINKETGIPIVDIPGGHLGYIQKPEGFADVLLNMWG

SEQ ID NO: 3753 - DNA, 888 bp, Staphylococcus aureus
atgaaaatagttattataggtgggtttttaggtggcggtaaaacgactgtcttaaatcatttgctcgctgaatcattaaaggaatcgctgaaaccagcagtcatcatgaatgaatttgggaaaatgagtgttgatggtgccttagtatctgaagacatacctttaagtgaactgacagaggggtgtatctgttgtgcaatgaaagcagatgtatcagaacagttacatcaattatatttaaaagagcaaccagacattgtatttattgaatgtagtgggattgcagaaccggtctctgtcttagatgcttgtttaacgcctattttagctccgtttacaacaattacacatatgattggtgtaatagacgcaagcatgtataaacacattaaatcattccctaaagacatccaaggcttattttatgagcaattagcatattgttctgtcttatttgttaataaaatagattcagcagatgttgaaacaacgagcaaactattgaaagatttagaagttattaacccagaggccgatatacaagtcggtatgcatggcagcgtcactttgccaatatcagttagacaaatgacagcaacttctgacaataaacataagtctttacatcaaatgattaatcatcaatttgtgcaatcaccagtcaaatgtactaaagcagagtttataaaacgtttagcatgccttccgtctcatatttataggttgaaagggtttatgacatttgaagacaccgcacatacgtatctcattcaatttacacaaggacaatatgaattaacacctgtagcattttcaaaaaaagtgccagaatatttggtgcttatcggaaagggtatttcaaaagaagactatcaatgtttggaacag

SEQ ID NO: 3754 - protein, 296 aa, Staphylococcus aureus
  MISC_FEATURE (1)..(296): hypothetical protein
MKIVIIGGFLGGGKTTVLNHLLAESLKESLKPAVIMNEFGKMSVDGALVSEDIPLSELTEGCICCAMKADVSEQLHQLYLKEQPDIVFIECSGIAEPVSVLDACLTPILAPFTTITHMIGVIDASMYKHIKSFPKDIQGLFYEQLAYCSVLFVNKIDSADVETTSKLLKDLEVINPEADIQVGMHGSVTLPISVRQMTATSDNKHKSLHQMINHQFVQSPVKCTKAEFIKRLACLPSHIYRLKGFMTFEDTAHTYLIQFTQGQYELTPVAFSKKVPEYLVLIGKGISKEDYQCLEQ

SEQ ID NO: 3755 - DNA, 516 bp, Staphylococcus aureus
ttgaaaaagaatgatcaacaacttagcgttccgctaccttatgataggcaattacatatgccaaatatacgtcaaatgttgctacaaatgtggcaaaatatacaaatgtttatcgttcaagcgctacctatttttatcacaatctgtcttattgttagtattttatcactaacgccaattttgaatgttttatcacaaatatttacacctatattatcgttattaggcatctcgtcagaattgtcaccagggattttattttcaatgattcgaaaagacggcatgctcttgtttaatttgcatcagggcgccttattacaaggaatgacagcaacacagttactactacttgtgttttttagttcaacatttacagcgtgctcggtcacaatgacgatgcttttgaaacatttaggtggtcagtcagcactaaaattaattggaaagcaaatggtgacatcattgtctttagttattggtgtaggcatcattgttaaaatagtaatgctgattatt

SEQ ID NO: 3756 - protein, 172 aa, Staphylococcus aureus
  MISC_FEATURE (1)..(172): hypothetical protein
LKKNDQQLSVPLPYDRQLHMPNIRQMLLQMWQNIQMFIVQALPIFITICLIVSILSLTPILNVLSQIFTPILSLLGISSELSPGILFSMIRKDGMLLFNLHQGALLQGMTATQLLLLVFFSSTFTACSVTMTMLLKHLGGQSALKLIGKQMVTSLSLVIGVGIIVKIVMLII

SEQ ID NO: 3757 - DNA, 828 bp, Staphylococcus aureus
atgcacatgttagaagtgaaatatgatatgagaactgggcattatacgcccatacctaatgaacctcattatttggttattagtcatgcggataaacttaccgcaacagaaaaagcgaaattaagattattaatcataaaacagaaattagatatttcattggcagaaagtgtagtttcttcgcctatagcgagtgaacatgtgatagaacaattgacactatttcaacatgagcgacgacatttaagacctaaaataagtgcgacatttttagcctggttgttgatatttttaatgtttgcattgccaatcggtatcgcttatcaattttcagattggtttcaaaatcagtatgtgtcagcatggatagaatatttaactcaaacaacattgctcaatcacgatatattacagcatatattatttggtgattatggtgtgctatcacttggaacatattcgctcgtatgggcattgccggttgtaatattgattagtttatcaactgctataattgatcaaacaggactcaaatcatggatgatatgggcaattgaaccgtcaatgttatggataggattacaaggtaatgatatcgtgccactattagaagggtttggatgtaatgcagcagctatttcacaagcagcacaccaatgccatacctgcacgaagacacagtgtatgagtttaataagctttggtagttcttgtagttatcaaataggtgcgacattatctatttttagtgtagctggaaagtcatggctatttatgccgtacttaatattagtacttttaggtggcatcttacataaaggatatggt

SEQ ID NO: 3758 - protein, 276 aa, Staphylococcus aureus
  MISC_FEATURE (1)..(276): hypothetical protein
MHMLEVKYDMRTGHYTPIPNEPHYLVISHADKLTATEKAKLRLLIIKQKLDISLAESVVSSPIASEHVIEQLTLFQHERRHLRPKISATFLAWLLIFLMFALPIGIAYQFSDWFQNQYVSAWIEYLTQTTLLNHDILQHILFGDYGVLSLGTYSLVWALPVVILISLSTAIIDQTGLKSWMIWAIEPSMLWIGLQGNDIVPLLEGFGCNAAAISQAAHQCHTCTKTQCMSLISFGSSCSYQIGATLSIFSVAGKSWLFMPYLILVLLGGILHKGYG

SEQ ID NO: 3759 - DNA, 1104 bp, Staphylococcus aureus
atgcaacatcataaagtggctattatcggtgccggtgctgcaggtataggtatggccattaccttaaaagatttcggtataacagatgtcattattttagaaaaaggaacagtaggacattcatttaaacattggccgaaatcgacccgtacgatcacgccatcatttacgtctaatggatttggcatgcctgatatgaatgcaatttccatggatacttcaccagcatttacatttaatgaagaacatatttccggagaaacatatgctgaatatttacaagtggttgccaaccattacgagctgaatatctttgaaaatacagttgtcacaaatatatctgtagatgatgcatattatacgattgcaacgacaacagagatatatcacgcggattatatctttgtcgcaacaggtgattataatttccctaaaaagccatttaaatatggtattcattatagtgaaattgaagactttgataactttaataaggggcaatatgtggttatcggaggtaatgaaagtggctttgatgctgcatatcaacttgcaaaaaatggctctgacatcgcactttatactagcacaaccggtttaaatgatccggatgctgatcctagtgttagattgtcaccttatacacgtcagcgactaggtaatgtcattaagcaaggtgctcgcatcgaaatgaatgtacattatacagttaaagatattgattttaacaatggacagtatcatatcagttttgatagcggacaaagtgtgcttacacctcatgaaccaatactagcaactggctttgatgcaacaaaaaatccaatcgttcaacaattatttgtgacaacaaatcaagatattaaattaacaacacatgatgaatcgacacgttatccgaatatttttatgattggtgcaacagttgaaaatgataatgccaaattatgctatatctataaatttagagcgcgatttgcagtacttgcacatcttttaacacagcgggaaggcttaccagctaaacaagatgtcattgaaaattatcaaaaaaatcaaatgtatttagatgattattcatgttgtgaagtgtcatgcacatgt

SEQ ID NO: 3760 - protein, 368 aa, Staphylococcus aureus
  MISC_FEATURE (1)..(368): conserved hypothetical
MQHHKVAIIGAGAAGIGMAITLKDFGITDVIILEKGTVGHSFKHWPKSTRTITPSFTSNGFGMPDMNAISMDTSPAFTFNEEHISGETYAEYLQVVANHYELNIFENTVVTNISVDDAYYTIATTTEIYHADYIFVATGDYNFPKKPFKYGIHYSEIEDFDNFNKGQYVVIGGNESGFDAAYQLAKNGSDIALYTSTTGLNDPDADPSVRLSPYTRQRLGNVIKQGARIEMNVHYTVKDIDFNNGQYHISFDSGQSVLTPHEPILATGFDATKNPIVQQLFVTTNQDIKLTTHDESTRYPNIFMIGATVENDNAKLCYIYKFRARFAVLAHLLTQREGLPAKQDVIENYQKNQMYLDDYSCCEVSCTC

SEQ ID NO: 3761 - DNA, 294 bp, Staphylococcus aureus
atggaaacaataggaagcattatttatttaaaagaaggttcgcaaaagttaatgattattaatagaggaccaattgtagaaattgaaaatcaaaagtatatgtttgactattctgcatgtaaatatccgattggtgttgtagaagatgaaatttattattttaacgaggaaaatatagattcagttatttttaaaggttattctgatcaagatgaggttagatttcaagagttgtttgaaaatatgaaacaaaatttggatagtgaaatacaacgtggagaagttacacaacaa

SEQ ID NO: 3762 - protein, 98 aa, Staphylococcus aureus
  MISC_FEATURE (1)..(98): conserved hypothetical
METIGSIIYLKEGSQKLMIINRGPIVEIENQKYMFDYSACKYPIGVVEDEIYYFNEENIDSVIFKGYSDQDEVRFQELFENMKQNLDSEIQRGEVTQQ

SEQ ID NO: 3763 - DNA, 564 bp, Staphylococcus aureus
atgaaacgaatcgcagtttattgtggtgcaagcaaaggtcatgacccttcatatgtacaaaaagcatacgatttaggtaaatattttgctgaacaaggttatgaattagtatttggtgcagggtcaattggcattatgggtgccattcaagatggtgtattagatcatggcggcaaagctattggcgtcatgcctaaaatgttagatgaacatgaaatcacaagccaacgtttaactgaattaattttagttgattctatgcatgaacgtaaaaataaaatggcagaacttgcagatgcatttgtcatggctcctggtggcgcaggttcactagaagaatttttcgaaatgtatagttgggctcaaataggtatccatgaaaagcctattgccatttataatattaatggctttttcaatccactacaaacaatgattgaccatatgattgaggaaggttttattgatcctaagtatcgtgctcttgcaccgttatgcgacactaaggaatcattaattgaatcaatattaaatttcaaacctctgggtactcgttcatacgat

SEQ ID NO: 3764 - protein, 188 aa, Staphylococcus aureus
  MISC_FEATURE (1)..(188): conserved hypothetical
MKRIAVYCGASKGHDPSYVQKAYDLGKYFAEQGYELVFGAGSIGIMGAIQDGVLDHGGKAIGVMPKMLDEHEITSQRLTELILVDSMHERKNKMAELADAFVMAPGGAGSLEEFFEMYSWAQIGIHEKPIAIYNINGFFNPLQTMIDHMIEEGFIDPKYRALAPLCDTKESLIESILNFKPLGTRSYD

SEQ ID NO: 3765 - DNA, 369 bp, Staphylococcus aureus
atgatgtcgaataaactggatgaaatcaataaaataatcacagcgaaacatgagcaaatggatgacttatatgatgaaaagcgagaggttaaagcattgatagatgaaagtgatgcgcttaatcattcgatagatcaattatatcaacatttaggtgagcgttattatagtagcaatatggctagtcgtatggaacagttccgcgatgaatttcattttgcgaaacgacgttcaacggaagcgttatacgagcagcaacagcaaattcaacatggcattcgtaaagtggaagaagagatgattgacttggaaatgcgaaggaatgttgaaattgagacggtgacaaaggaggaaaataaatggaaacaa

SEQ ID NO: 3766 - protein, 123 aa, Staphylococcus aureus
  MISC_FEATURE (1)..(123): hypothetical protein
MMSNKLDEINKIITAKHEQMDDLYDEKREVKALIDESDALNHSIDQLYQHLGERYYSSNMASRMEQFRDEFHFAKRRSTEALYEQQQQIQHGIRKVEEEMIDLEMRRNVEIETVTKEENKWKQ

SEQ ID NO: 3767 - DNA, 276 bp, Staphylococcus aureus
atgatgagtacagttcaaagtgatatttttaagaccaatagtgcatcatcatctattaaaagcgctgttgaaacatgtaataatgtgtcgaaaccggataaagatgaaagtacaacagtaagtggaaataataatgctcatagtgtgatagatgatttgatgagtaagaatcaatctgttgctgaagcaatacgaactgcgagcgataatatacaaaaagttggtgaggcttttgaccaaactgacgtaatgattggtaatgaaattggtaaaaat

SEQ ID NO: 3768 - protein, 92 aa, Staphylococcus aureus
  MISC_FEATURE (1)..(92): hypothetical protein
MMSTVQSDIFKTNSASSSIKSAVETCNNVSKPDKDESTTVSGNNNAHSVIDDLMSKNQSVAEAIRTASDNIQKVGEAFDQTDVMIGNEIGKN

SEQ ID NO: 3769 - DNA, 879 bp, Staphylococcus aureus
ttggaaggtgtttgtatgaatgaacaatggttagagcatttacctttaaaagatattaaagagatttcaccagtgagtggtggtgatgtaaacgaagcatatcgagtcgaaacagatacggatacatttttcttacttgtccaacgtggacgtaaagaatcattttatgctgcagaaattgcaggtttaaatgaatttgaacgtgcaggtatcacggcacctagagtaattgcaagtggcgaggttaacggtgatgcgtatttagtgatgacgtatttagaagaaggggcttcagggagtcaacgccaattagggcaactcgtagctcaattacacagtcagcaacaagaagaaggcaaatttggcttctcattaccttatgaaggtggcgatatttcttttgataatcattggcaagacgattggtgtaccatttttgtcgacaaacgcttggaccatttgaaagatgagttgctaaatagagggctatgggatgccaacgatatcaaagtatatgacaaagtgcgacgtcaaattgtggcggaattagaaaagcatcaaagtaaaccgtctttattacatggtgacctatggggtggtaattatatgttcttacaagatggtcgtccggcgttatttgatccagcgccattatatggtgacagagaattcgatatcggtattacaacggtatttggtggttttacgagcgaattttatgatgcgtataataaacattatccactcgcaaaaggtgcatcctatagacttgaattttatcgtttatatttattgatggtccatttattgaaatttggtgagatgtaccgtgatagtgttgcgcattctatggataagattttacaagatacaacaagt

SEQ ID NO: 3770 - protein, 293 aa, Staphylococcus aureus
  MISC_FEATURE (1)..(293): conserved hypothetical
LEGVCMNEQWLEHLPLKDIKEISPVSGGDVNEAYRVETDTDTFFLLVQRGRKESFYAAEIAGLNEFERAGITAPRVIASGEVNGDAYLVMTYLEEGASGSQRQLGQLVAQLHSQQQEEGKFGFSLPYEGGDISFDNHWQDDWCTIFVDKRLDHLKDELLNRGLWDANDIKVYDKVRRQIVAELEKHQSKPSLLHGDLWGGNYMFLQDGRPALFDPAPLYGDREFDIGITTVFGGFTSEFYDAYNKHYPLAKGASYRLEFYRLYLLMVHLLKFGEMYRDSVAHSMDKILQDTTS

SEQ ID NO: 3771 - DNA, 1062 bp, Staphylococcus aureus
atgtacaaattaattaaacctttcttattcaaaatcgaacccgaaaaagcacacggactaactatcgatgcattaaaaacgttacaaaagtttccggttttattcccagtcgtcgataaactatttacttataagaatccaacgttatcacaaacgatacaaggtaatacgtacgacaatccaattggcttagcagctggtttcgacaaatcttgcgaagtaccaaaagcattggaacaccttggattcggtgctttagaattaggtggtatcacacctaaacctcaaccgggtaaccctcaaccacgcatgtttagattattagaagatgacgccttgataaatcgaatgggcttcaataatattggtatgaacaaagcactaagtcatttgcgtaaaaatgcttatcaagtacctgttggtatcaatgttggtgtgaataaaatgacaccttatgaagcgcgttatcaagattatataaaggttattgatacgtttaaacacgacgtttcatttttcacagtcaacatcagttctccaaatactgaaaatcttcaaaacttccatgataaagatgaattttcaatgttatgccaagctttaacagcatttaaaaaacaacatgatgtaacagtgccaatttatttaaaactaacgtctgatatggatttcgatggcttaaaagcactattaccagcgattactgagacatttgacggtatcatcttagcaaacacaacgcgacaacgagatggtttaacttctgctaataaagtcgaagaaggcggtttgagtggtcgtccattatttgaacgtaatttaaaattgattaagtatgcttatcagcaaacaaatggtgaatttttaattataggtacaggcggcgtattcagtactgaagatgcaatcaaaatgatgcgtcacggtgcgtcacttattcaaatttattcatcacttgttattgaaggcccaggtttaactaagaaaatgaacaaaggcatcgcacgttacttaaaagatcatcattttgacaatgtcagtgatattataggactagatgcc

SEQ ID NO: 3772 - protein, 354 aa, Staphylococcus aureus
  MISC_FEATURE (1)..(354): hypothetical protein
MYKLIKPFLFKIEPEKAHGLTIDALKTLQKFPVLFPVVDKLFTYKNPTLSQTIQGNTYDNPIGLAAGFDKSCEVPKALEHLGFGALELGGITPKPQPGNPQPRMFRLLEDDALINRMGFNNIGMNKALSHLRKNAYQVPVGINVGVNKMTPYEARYQDYIKVIDTFKHDVSFFTVNISSPNTENLQNFHDKDEFSMLCQALTAFKKQHDVTVPIYLKLTSDMDFDGLKALLPAITETFDGIILANTTRQRDGLTSANKVEEGGLSGRPLFERNLKLIKYAYQQTNGEFLIIGTGGVFSTEDAIKMMRHGASLIQIYSSLVIEGPGLTKKMNKGIARYLKDHHFDNVSDIIGLDA

SEQ ID NO: 3773 - DNA, 273 bp, Staphylococcus aureus
atgactaaagaaacagataataaaaaaacagtagcgacttctgacaacaaagacacacagcaacaaaatcaacctgaagaagatgaacgtcaaggtttgaatggttatcgtaaaacagatcttgatttagaaatcgagcaagagctacgtgaaatgatgaaaacaggagaaaatgaaacgaaaaatgactataaaaagtttaaagtgttttcacttatttcaacacttgtcattgtcattttagcaattataagatttgttcataaaatgatg

SEQ ID NO: 3774 - protein, 91 aa, Staphylococcus aureus
  MISC_FEATURE (1)..(91): hypothetical protein
MTKETDNKKTVATSDNKDTQQQNQPEEDERQGLNGYRKTDLDLEIEQELREMMKTGENETKNDYKKFKVFSLISTLVIVILAIIRFVHKMM

SEQ ID NO: 3775 - DNA, 720 bp, Staphylococcus aureus
atgattaatgctgaacctattatcagtaaaatgaaaaatcaaaaaattaattatgacaaggtgttgaagaaattaatcgggcagtgggaaagagaagcaatcagacctaaaatcttattgcatagttgttgtgcaccttgtagtacatatacattagagtttttaacacaatatgcagacattgcaatttatttcgcgaattcaaatattcatccgaaaaatgagtacttacgacgtgctaaagtgcaagaacaatttgtggaagattttaatcgcaagactggtgcgaatgtgaagtatattgaagcaccttatgaaccacataagtttgtgaaaatggtgaaggataaagaattagctgatgaaaaagaaggcggcttacgttgtaccgcttgttttgaaatgcgtttggatattgtagcgaaagcagctgtagaacatggctatgattattttggcagtgcaatcacattatcacctaaaaagaacgcacaattaatcaatgaacttggtatggatgtccaaaaaatatacgatgtgaactatttgccaagtgattttaagaaaagtaaaggttatgagcgttccatagaaatgtgtaatgactataatatctttaggcagtgttattgtggatgtgtctttgcagcgatgcaacaaggtattgattttaaaacagttaataaagaagcgaaagcatttttagaacaatatccagat

SEQ ID NO: 3776 - protein, 240 aa, Staphylococcus aureus
  MISC_FEATURE (1)..(240): conserved hypothetical
MINAEPIISKMKNQKINYDKVLKKLIGQWEREAIRPKILLHSCCAPCSTYTLEFLTQYADIAIYFANSNIHPKNEYLRRAKVQEQFVEDFNRKTGANVKYIEAPYEPHKFVKMVKDKELADEKEGGLRCTACFEMRLDIVAKAAVEHGYDYFGSAITLSPKKNAQLINELGMDVQKIYDVNYLPSDFKKSKGYERSIEMCNDYNIFRQCYCGCVFAAMQQGIDFKTVNKEAKAFLEQYPD

SEQ ID NO: 3777 - DNA, 456 bp, Staphylococcus aureus
gtgttttacatgacagcattattcccttatatcgcttttgaaaattcaaaagaagcccttgcatattacgaagaagtatttggtgcaactgacgttaaacgtttagaagttggcgaagaacaagcgtcacattttggtatgactaaggaagaagcgcaagaagcaactatgcatgctgaatttgaagtgcttggcgtaaaagtgttatgttctgattcttttggtcgcgctgacaaaattaataatggcatatcattattaattgattatgatgttaacaataaggaagatgctgataaagttgaagcattctatgagcaaattaaagatcattcttcaattgaaatagaattaccgtttgctgaccaattctggggtggcaaaatgggcgtctttaccgataaatacggtgttcgttggatgttacatggtcaagactatactgcaatccaacaa

SEQ ID NO: 3778 - protein, 152 aa, Staphylococcus aureus
  MISC_FEATURE (1)..(152): conserved hypothetical
VFYMTALFPYIAFENSKEALAYYEEVFGATDVKRLEVGEEQASHFGMTKEEAQEATMHAEFEVLGVKVLCSDSFGRADKINNGISLLIDYDVNNKEDADKVEAFYEQIKDHSSIEIELPFADQFWGGKMGVFTDKYGVRWMLHGQDYTAIQQ

SEQ ID NO: 3779 - DNA, 546 bp, Staphylococcus aureus
atgagaaatgcatttattgaacttttacatcaacaccaattagaagagattactgtgcaacaaattgcagatttagctgatgttaaccgtagtacattttatacgcattattatgataagtatgatttgcttgaaaaattagaggaccagcagttggaggaaataagagacttcattcatgatgagaagttaaatggagcagttaagttatccacggataacatacatcaaattatgaccgttttaatagaaatgatagaaaaagacatcgcattttatcaattgatgtttcgtatgggtaaagattcaaatatccacgaaaaactttatgatttaattatgtgtcatttacaacgttataaaaatgaaaatgatcaaattaatggtataccattttcttatttcatgagttatgtttcaggtgcgggattgtcttttataagacattgggtagaagatccaaaccgtatagacaaagttgacttaataaggcattttaatacgattgtcaatcaagggccagcaacgataattaaaaatatacaa

SEQ ID NO: 3780 - protein, 182 aa, Staphylococcus aureus
  MISC_FEATURE (1)..(182): hypothetical protein
MRNAFIELLHQHQLEEITVQQIADLADVNRSTFYTHYYDKYDLLEKLEDQQLEEIRDFIHDEKLNGAVKLSTDNIHQIMTVLIEMIEKDIAFYQLMFRMGKDSNIHEKLYDLIMCHLQRYKNENDQINGIPFSYFMSYVSGAGLSFIRHWVEDPNRIDKVDLIRHFNTIVNQGPATIIKNIQ

SEQ ID NO: 3781 - DNA, 96 bp, Staphylococcus aureus
gtgccaatcatcaatgttggagatttgtgggataatgaacataacgtttataatcattggggaggacttgatataaatgactatagatcgacgtat

SEQ ID NO: 3782 - protein, 32 aa, Staphylococcus aureus
VPIINVGDLWDNEHNVYNHWGGLDINDYRSTY

SEQ ID NO: 3783 - DNA, 1743 bp, Staphylococcus aureus
ttggcacacaatgtttacctgtttaatataggtgatacaaacaaacagaaaaaggtgataacaatgaaccaacatttactaggaaatccaaaattaactgtaactcatgtcaatgaagttaaagccggtattaaccacatcgttgtcgacagtgttcaatatggaaatcaagaaatgattatggaaaaagatgtcactgtggaaatgcgcgatggcgaaaaattatatattaatattttcagaccaaataaagatggcaaattccctgtagttatgtctgcagatacttacggtaaagataataagcctaaaatcacaaatatgggtgccctttggccaacattaggtaccattccgacatctagttttacacctgaagaatcaccagacccaggattttgggtgccaaatgattatgttgtagttaaagttgcattacgcggtagtgacaaatccaaaggcgtcttatctccatggtcaaaaagagaagcggaagattattacgaagtgattgaatgggcagcaaatcagtcatggagtaatggaaatatcgggacaaatggtgtttcttatcttgcggtgactcaatggtgggtcgcatcattaaatccaccacatttaaaagcaatgattccttgggaaggcttaaatgatatgtatagagaagtagcctttcacggaggtataccagatactggcttttatcgtttctggactcaaggtatttttgcgagatggacagataatccaaatatcgaagatttgattcaagcacaacaagaacatcctctgttcgatgatttttggaaacagcgtcaagtgccattatcacaaattaaaacacctctactaacatgtgctagttggtctacacaaggtttgcacaaccgtggctcttttgaaggatttaaacaagctgcatctgaagaaaaatggctatatgtgcatggacgtaaagagtgggaaagttactacgctagagaaaatctcgaacgccaaaaatcattctttgatttttaccttaaagaagaaaataacgattggaaagatacgcctcatgtcatttatgaagttagagatcaattttataaaggcgaattcaaatcagcgtcagcgttccctttacctaacgcagaatatacaccattgtatttgaatgctgaaaatcacacattgaatcatgcaaagattagtagcgcgcatgtcgcacaatatgactctgaagataaacaacaagatgtaagttttaaatatacgtttgacaaagatactgagttagttggaaacatgaacttaaaactatgggtaagcactaaagactcagatgatatggatttatttgcaggtattaaaaagttagatcgtcgtggtaatgaagttaacttccctgattttaatcatattgaaaatggtcaagtagctactggttggttacgcgtatcacatcgtgaattagatcaagaaaaatcctcaatcgcgcaaccttggcataaacatgaaacagaattaaagttgtcacaagatgagattgtacctgttgaaatcgaattgttaccttcaggcacgctatttaaacaaggcgaaacattggaagttgttgtaaagggtagtgaaattgtaattggtaatagtactcctggcatgaaaacacgttatgaacatgaagaaaccgtaaataaaggcatgcacatgatttatactggtggtaaatatgattcacaattaatcattcctatcgttaat

SEQ ID NO: 3784 - protein, 581 aa, Staphylococcus aureus
  MISC_FEATURE (1)..(581): conserved hypothetical
LAHNVYLFNIGDTNKQKKVITMNQHLLGNPKLTVTHVNEVKAGINHIVVDSVQYGNQEMIMEKDVTVEMRDGEKLYINIFRPNKDGKFPVVMSADTYGKDNKPKITNMGALWPTLGTIPTSSFTPEESPDPGFWVPNDYVVVKVALRGSDKSKGVLSPWSKREAEDYYEVIEWAANQSWSNGNIGTNGVSYLAVTQWWVASLNPPHLKAMIPWEGLNDMYREVAFHGGIPDTGFYRFWTQGIFARWTDNPNIEDLIQAQQEHPLFDDFWKQRQVPLSQIKTPLLTCASWSTQGLHNRGSFEGFKQAASEEKWLYVHGRKEWESYYARENLERQKSFFDFYLKEENNDWKDTPHVIYEVRDQFYKGEFKSASAFPLPNAEYTPLYLNAENHTLNHAKISSAHVAQYDSEDKQQDVSFKYTFDKDTELVGNMNLKLWVSTKDSDDMDLFAGIKKLDRRGNEVNFPDFNHIENGQVATGWLRVSHRELDQEKSSIAQPWHKHETELKLSQDEIVPVEIELLPSGTLFKQGETLEVVVKGSEIVIGNSTPGMKTRYEHEETVNKGMHMIYTGGKYDSQLIIPIVN

SEQ ID NO: 3785 - DNA, 396 bp, Staphylococcus aureus
ttggagctgaataaagtgataagaacaatgatgaatgctaaaattcatagagcaagagtgactgagtcaaatttaaattatgtaggtagcattacgattgattcagatatattggaagcggtagacatcttgccaaatgaaaaagtagccatcgtgaataataataatggtgcacgttttgaaacatacgtaatagctggtgaaagaggtagtggtaaaatttgtttaaacggtgcagcgtcaagacttgttgaagtaggcgatgtagtcataatcatgacttatgcacagttgaatgaagaagaaattaaaaaccatgcacctaaagtagcagtaatgaatgaagataatgtcattattgaaatgattcatgaaaaagaaaatacgatagtgtta

SEQ ID NO: 3786 - protein, 132 aa, Staphylococcus aureus
  MISC_FEATURE (1)..(132): aspartate 1-decarboxylase
LELNKVIRTMMNAKIHRARVTESNLNYVGSITIDSDILEAVDILPNEKVAIVNNNNGARFETYVIAGERGSGKICLNGAASRLVEVGDVVIIMTYAQLNEEEIKNHAPKVAVMNEDNVIIEMIHEKENTIVL

SEQ ID NO: 3787 - DNA, 864 bp, Staphylococcus aureus
atgaggttaataacaatgactaagctgattactacggtaaaagagatgcaacacattgttaaagcagccaaacgctcaggcacaacgattggttttatcccaacaatgggtgccttacatgatggacatttaacgatggtacgcgaatcagttagtacaaatgatattacaattgtgagtgtatttgttaatccattacaatttggtccaaacgaagatttcgatgcttatccgagacaaattgataaagatttagaattagtatcagaagtaggagcggacattgtttttcatcctgcagtagaagatatgtatccaggtgaattaggtattgatgtcaaagtaggcccattagctgatgtgttagaaggagcgaagcgtccagggcattttgatggggtggtaacagtagttaataagctatttaatattgttatgccggattatgcttattttggtaaaaaagatgcccagcaattggctattgtcgagcaaatggtaaaagacttcaatcatgccgttgaaattattggtattgatatcgttcgagaagcagatggtttggcgaaaagttcaagaaatgtttatttaacggagcaagaacgacaagaagcggtacatttaagtaaaagtttgctattagcacaagcgttgtatcaagacggtgaacgtcaaagtaaagtaattatagacagggttactgaatatcttgaatcacatataagtgaacgcattgaagaagttgctgtttatagttatcctcaattagtagaacaacacgaaataactggacgcatatttatctcgttagctgttaaattttcaaaagcgcgtttaatagataatataataattggagctgaa

SEQ ID NO: 3788 - protein, 288 aa, Staphylococcus aureus
  MISC_FEATURE (1)..(288): pantoate beta-alanine
MRLITMTKLITTVKEMQHIVKAAKRSGTTIGFIPTMGALHDGHLTMVRESVSTNDITIVSVFVNPLQFGPNEDFDAYPRQIDKDLELVSEVGADIVFHPAVEDMYPGELGIDVKVGPLADVLEGAKRPGHFDGVVTVVNKLFNIVMPDYAYFGKKDAQQLAIVEQMVKDFNHAVEIIGIDIVREADGLAKSSRNVYLTEQERQEAVHLSKSLLLAQALYQDGERQSKVIIDRVTEYLESHISERIEEVAVYSYPQLVEQHEITGRIFISLAVKFSKARLIDNIIIGAE

SEQ ID NO: 3789 - DNA, 816 bp, Staphylococcus aureus
ttgaaaacagtaagtcaattaatagatatgaaacaaaagcaaactaaaatttctatggtaacagcttatgattttccaagtgctaaacaagtggaagcagcgggtattgatatgattcttgttggggattcacttggtatgactgtattaggttatgaaagtaccgtacaagtgacgttagcagatatgattcatcacggtcgtgcagtaagaagaggcgcaccaaatacatttgtagttgttgatatgccgattggtgcagtaggcatctctatgacacaagacttaaatcatgctctaaagctttatcaggagacgaatgcaaatgcaattaaagcagaaggagcgcatattacaccatttattgaaaaagcaacggcaattggtattcctgttgttgcacatttaggattaacacctcaaagtgttggcgttatggggtataaattacaaggtgcaacgaaagaagcagcggagcaacttattttagacgcgaaaaatgtagaacaagctggtgcagttgcgttagtacttgaagcaattccaaatgatttagcagaagaaattagcaagcacttaacaattccagtcattggtattggtgcaggaaaaggtacagatggtcaagtattggtttatcacgatatgttaaattatggtgttgaacataaagcgaaatttgtgaagcaatttgctgattttagtgttggtgtggatggtttaaaacaatacgatcaagaagttaaatctggtgcatttccatcagaagaatatacgtataaaaagaaaattatgaatgaggttaataacaatgac

SEQ ID NO: 3790 - protein, 272 aa, Staphylococcus aureus
  MISC_FEATURE (1)..(272): 3-methyl-2-oxobutanoate
LKTVSQLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 3791 - DNA, 858 bp, Staphylococcus aureus
atgttatcagttgcgattatcggcccaggcgctgtcggtacaactattgcctatgaattacaacaatcattgcctcatacaacgcttatcgggagacacgccaaaacaataacatattatactgtaccacatgcacctgcacaagatattgttgtgaaaggttatgaagatgtcacaaacacatttgatgttattattattgcagtcaaaacacatcaacttgatgcagttattcctcatttaactcatcttgcacatgaggacacgctcatcattttagcccaaaatggttatggtcaactcgaacatatttcatttaaaaacgtatgccaagcagttgtctatataagtggtcaaaagaaaggcgatgttgttacgcacttcagagattatcaattacgtatacaagataatgcattaactcgacaatttagagatttggtccaagacagtcaaatcgacattgtattagaagcaaatattcaacaagctatttggtataaattgttagttaacttgggcattaattctatcacagcactcggtagacagaccgttgcaatcatgcataatcctgaaatacgtacactgtgtagacagctattactagatggttgtcgtgttgcacaggcagaggggttaaacttttcagaacaaactgtcgatactattatgactatatatcaaggttatcccgacgaaatgggaacgagcatgtattacgacattgcgcatcagcaacctcttgaagtcgaagcgattcaaggctttatttatcgacgtgcacgtgaacacattcttgacaccccatatcttgatactatttatagctttttacgcgcgtatcaacaaaatatg

SEQ ID NO: 3792 - protein, 286 aa, Staphylococcus aureus
  MISC_FEATURE (1)..(286): hypothetical protein
MLSVAIIGPGAVGTTIAYELQQSLPHTTLIGRHAKTITYYTVPHAPAQDIVVKGYEDVTNTFDVIIIAVKTHQLDAVIPHLTHLAHEDTLIILAQNGYGQLEHISFKNVCQAVVYISGQKKGDVVTHFRDYQLRIQDNALTRQFRDLVQDSQIDIVLEANIQQAIWYKLLVNLGINSITALGRQTVAIMHNPEIRTLCRQLLLDGCRVAQAEGLNFSEQTVDTIMTIYQGYPDEMGTSMYYDIAHQQPLEVEAIQGFIYRRAREHILDTPYLDTIYSFLRAYQQNM

SEQ ID NO: 3793 - DNA, 702 bp, Staphylococcus aureus
atgacgaatgtcttgtatcaacatggtacattaggtacgttaatggctggcttactagaaggcacagctacaattaatgaattgttagaacatgggaatttagggattgcaacgttaacagggtctgatggcgaagtaatatttttagacggaaaggcatatcatgctaacgagcataaagaatttatagaattaaaaggcgatgagaaagtaccgtatgcatcgattactaattttaaagcgagtaagacatttccattgcaacaattatcacaagatgatgtatttgcacaaattaaaaatgaaatgttaagtgagaatttattttcggctgttaaaatttatggcacatttaaacatatgcatgtacgaatgatgcctgctcagcaaccgccatatacacgtttgattgattcagcacgcagacaacctgaggaaaaaagacaagatattcgtggtgccattgttggattttttacaccagaattatttcatggcgtagggtctgctggttttcatatacattttgcggatgatgaaagagcttatggtggacatgttcttgactttgaagtggatgacgttgtcgttgagatacaaaactttgaaacattccaacaacatttcccggtaaataacgagacgtttgttaaagcgaaaatagactataaagatgtggcagaagaaattagagaagctgaa

SEQ ID NO: 3794 - protein, 234 aa, Staphylococcus aureus
  MISC_FEATURE (1)..(234): hypothetical protein
MTNVLYQHGTLGTLMAGLLEGTATINELLEHGNLGIATLTGSDGEVIFLDGKAYHANEHKEFIELKGDEKVPYASITNFKASKTFPLQQLSQDDVFAQIKNEMLSENLFSAVKIYGTFKHMHVRMMPAQQPPYTRLIDSARRQPEEKRQDIRGAIVGFFTPELFHGVGSAGFHIHFADDERAYGGHVLDFEVDDVVVEIQNFETFQQHFPVNNETFVKAKIDYKDVAEEIREAE

SEQ ID NO: 3795 - DNA, 957 bp, Staphylococcus aureus
atgaaaacatttggtaaaaaggttgtattaatcggagatggatctgtaggatcaagctatgcctttgcaatggttacgcaaggtgttgctgatgaatttgtaattattgacattgcaaaagacaaagtaaaagcagatgttcaagatttaaaccatggtacagtccacagtccttcaccagttgatgtgaaagcaggtgaatacgaagactgtaaagatgcagatttagttgttattacagctggtgcacctcaaaagccaggtgaaacacgtttacaattagttgaaaaaaatactaagattatgaagagcatcgttaagagtgttatggatagtggctttgatggatatttcttaatcgcggcaaaccctgtagacattttaacaagatttgtaaaagaatatactggattaccagcagagcgtgttatcggttcaggtactgtattggacagtgcacgtttacaatatttaattagccaagaacttggtgttgcaccttcaagtgttgacgctagtattattggcgagcatggtgatactgaacttgcagtttggtcacaagcaaatgtagcaggtatttcagtatatgacacattaaaagaacaaactggtagcgaagctaaagcggaagaaatttatgtgaatacacgtgacgctgcttatgaaattatccaagctaaagggtcaacatactatggtattgcattagcattgatgcgcatttcaaaagccattttaaataatgaaaataatgtcttaaatgtttctatacaattagatggtcaatatggtggtcacaaaggcgtttacctaggtgtaccaacattagttaaccaacatggcgcagttaaaatttatgaaatgccattaagtgccgaagaacaagcgttgttcgataaatctgttaaaacattagaagatacatttgattcaattaaatatttattagaagac

SEQ ID NO: 3796 - protein, 319 aa, Staphylococcus aureus
  MISC_FEATURE (1)..(319): L-lactate dehydrogenase
MKTFGKKVVLIGDGSVGSSYAFAMVTQGVADEFVIIDIAKDKVKADVQDLNHGTVHSPSPVDVKAGEYEDCKDADLVVITAGAPQKPGETRLQLVEKNTKIMKSIVKSVMDSGFDGYFLIAANPVDILTRFVKEYTGLPAERVIGSGTVLDSARLQYLISQELGVAPSSVDASIIGEHGDTELAVWSQANVAGISVYDTLKEQTGSEAKAEEIYVNTRDAAYEIIQAKGSTYYGIALALMRISKAILNNENNVLNVSIQLDGQYGGHKGVYLGVPTLVNQHGAVKIYEMPLSAEEQALFDKSVKTLEDTFDSIKYLLED

SEQ ID NO: 3797 - DNA, 1461 bp, Staphylococcus aureus
ttgggaggaaagtttatgggaagttttttcaataaaatagcacgaaaagaggatccggctatctatcaaaataaagatggtcatttaaagcgtacacttcgggtgcgtgatttcttagctttaggtgtaggaacaattgtatcgacatctatctttacgctacctggcattgttgctgcagaacatgcaggaccggccgttgcgttatcattcttactcgctgctattgttgctggtttagttgcatttacttatgcagaaatggctgccgctatgccatttgcaggttcagcctattcttgggtcaatgtattatttggtgaattttttggatgggttgccggttgggctctattagctgaatattttatcgccgtagcctttgttgcatcaggattctcagcgaatttacgcggacttgtgaaaccaattggcatcgaattacctgcagcattatcaaatccatttggtacaaatggcggttttatcgatattattgctgctatcgttattttattaactgcattattactatcacgtggtatgtcggaagcagctcgtatggaaaatattttagttattttaaaagtattagctattattttatttgtcatcgtaggtttaacagcaataaatgttagtaactatgtgccatttattccagaacacaaagtaactgctacaggtgactttggtggatggcaaggcatatatgctggtgtttcaatgattttcttagcgtatatcggtttcgattctatcgcagcaaactcagcagaagcacttgatcctcaaaagacaatgcctagaggtattcttggttctttaagcgttgctatcgtattatttattgctgtagcacttgtgttagttggtatgttccattactcacaatacgcaaacaatgctgaacctgttggttgggctttacgtcaaagtggtcatggtgttgtagcagctattgttcaagctatctctgttatcggtatgtttacagcattaattggtatgatgttagcaggctcacgtttactttattcatttggacgtgacggcttattaccttcatgggtaagccacttaaacgacaaacatttacctaatcgcgcactagttatacttactattattggtgttttaattggttctatgttcccattcgcatttttagcacaattaatttcagcaggtacacttgttgcatttatgttcgtttcattagcaatgtatcgtttgagaaagcgtgaaggtaaagatctaccaattcctgcatttaaattacctttatatcctgtgttaccagcaattacatttgttttagtattgctagtattctggggattaggattcgaagcgaaattatacactttaatttggtttattgttggtatcatcctatatttaagttatggacttagacattctaagaaaaatgacgtagctgaataccacccaccaaaa

SEQ ID NO: 3798 - protein, 487 aa, Staphylococcus aureus
  MISC_FEATURE (1)..(487): hypothetical protein
LGGKFMGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSVAIVLFIAVALVLVGMFHYSQYANNAEPVGWALRQSGHGVVAAIVQAISVIGMFTALIGMMLAGSRLLYSFGRDGLLPSWVSHLNDKHLPNRALVILTIIGVLIGSMFPFAFLAQLISAGTLVAFMFVSLAMYRLRKREGKDLPIPAFKLPLYPVLPAITFVLVLLVFWGLGFEAKLYTLIWFIVGIILYLSYGLRHSKKNDVAEYHPPK

SEQ ID NO: 3799 - DNA, 1371 bp, Staphylococcus aureus
ttgcacattaatactgtcaatgggaggggaatgtatatgagtaaagcacatcaattaattcaagaggatgaacattattttgcgaaatcaggacgtattaaatattatccgttagtgattgatcatggatatggagcaacattggttgatattgaggggaagacatatatcgatttgttatcgagtgcgagttctcaaaacgtaggtcatgcacctagagaagtaacagaagcgataaaggcacaagttgataaatttattcattatacaccagcatatatgtatcatgaaccgttggtacgtttagctaagaagctttgtgagattgcacctggagattttgaaaaaagagtgaccttcggattaaccggatcagacgcaaatgatggcatcattaaatttgccagagcatatacagggcgtccttatatcattagtttcactaatgcatatcatggttcaacttttggctcattgtctatgtcagctattagtttaaatatgcgcaaacattatggtccgttattgaatggtttttatcatattccgtttccagataaatatcgtggtatgtacgagcagccacaagctaattcagtagaagaatatttagcacccttaaaagaaatgtttgcgaagtatgtacctgctgacgaagtagcatgtattgttattgaaacgatacaaggcgatggtggacttttagaaccagttccagggtattttgaagcgttagaaaagatttgtcgtgaacatggtattttaatcgctgtcgatgatattcaacaaggttttgggagaacaggtacatggagttcagtctcgcattttaattttacgcctgatttaatcactttcggaaaatccttagcaggtggtatgcctatgtcagcaattgttggacgcaaagagattatgaattgtttagaagcaccagcacatttatttacaacaggtgctaatccagttagttgtgaagctgcattagccacaattcaaatgattgaagatcagtcgcttcttcaggctagtgcggaaaaaggggaatatgttaggaaacgaatggatcaatgggtatctaaatacaatagtgtaggcgatgttagaggtaaaggtctgagcattggtattgatattgtttccgacaaaaaactcaaaacacgtgatgccagtgcggcacttaaaatttgtaattactgctttgagcatggcgtagttattatagctgtagcaggaaatgtgttgcgattccaaccgccattggtaataacatatgagcaattagacacggcgttaaacactatagaagatgcactgactgctttggaagcaggtaacttagatcaatatgacatatctggacaaggttgg

SEQ ID NO: 3800 - protein, 457 aa, Staphylococcus aureus
  MISC_FEATURE (1)..(457): hypothetical protein
LHINTVNGRGMYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEIAPGDFEKRVTFGLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDASAALKICNYCFEHGVVIIAVAGNVLRFQPPLVITYEQLDTALNTIEDALTALEAGNLDQYDISGQGW

SEQ ID NO: 3801 - DNA, 93 bp, Staphylococcus aureus
ttggatagtattcatagaggcatgacggtatttgagcaggattttaaatcggattttataatcgatttaagagaggccactttgcttgcacat

SEQ ID NO: 3802 - protein, 31 aa, Staphylococcus aureus
LDSIHRGMTVFEQDFKSDFIIDLREATLLAH

SEQ ID NO: 3803 - DNA, 423 bp, Staphylococcus aureus
gtgatacgaatgcgtttaaaagtattgttccatttcattgctgctattttcatatcattcatgttgctatggatgaccatgttgtttgacttaataagcaatcaatcacatttaaaagctttattattgaatttagattttctaattccttctgacaatacaccatatattctagaaataatatgtcacttactaattggtagcgtcatttattttgtatttgtgttgctgtttcatacttctaaaaggctttactatctatgttatatccctttatttttcttatttatagcattgtatccctttttagtatttattgcgcaacgtccaatttttcaatttagtgtgacagaattaatcggttggattattacacatattttctttatgtcattaatggcgttagtcatacctagaataaaa

SEQ ID NO: 3804 - protein, 141 aa, Staphylococcus aureus
  MISC_FEATURE (1)..(141): hypothetical protein
VIRMRLKVLFHFIAAIFISFMLLWMTMLFDLISNQSHLKALLLNLDFLIPSDNTPYILEIICHLLIGSVIYFVFVLLFHTSKRLYYLCYIPLFFLFIALYPFLVFIAQRPIFQFSVTELIGWIITHIFFMSLMALVIPRIK

SEQ ID NO: 3805 - DNA, 540 bp, Staphylococcus aureus
atgatttattgtgaaacagagcgtttaatattaagagactggcatgaagatgatctgttaccttttcaaaaaatgaatgcgaattatgacgtacgtaaatattttccaagtttattgagttatcgtcgttcagaattagatatgagaactatggatgcggttattaaagattatggcattggattatttgctgtagaagataaagagtcccatcaatggataggctttataggtttgaattatattccagaaacaagcgattatccatttaaagaattaccgctttatgaaataggttggcgcttgttgccagaattttggggaaaaggattagcaactgaaggcgcaaaggcaacattgaagttagcagaagaacatcaaatatacgatgtctatagttttacagcagaagcaaataaagcttcacaacgtgtaatggaaaaaattggcatgacagtgtatgatcatttcgaattacccaatctaagtaagtatcatttattaaaaaggcaagtgcgctattacattaatcttcgaaag

SEQ ID NO: 3806 - protein, 180 aa, Staphylococcus aureus
  MISC_FEATURE (1)..(180): conserved hypothetical
MIYCETERLILRDWHEDDLLPFQKMNANYDVRKYFPSLLSYRRSELDMRTMDAVIKDYGIGLFAVEDKESHQWIGFIGLNYIPETSDYPFKELPLYEIGWRLLPEFWGKGLATEGAKATLKLAEEHQIYDVYSFTAEANKASQRVMEKIGMTVYDHFELPNLSKYHLLKRQVRYYINLRK

SEQ ID NO: 3807 - DNA, 897 bp, Staphylococcus aureus
gtggaaagtatgaataaagagcaattagaaaaaatgaaaaatggaaaaggctttattgccgcattagaccaaagtggtggtagtacaccaaaagcacttaaagaatatggtgtaaacgaagatcaatatagcaatgaagacgaaatgttccaacttgttcacgatatgcgtacacgtgtggtaacttcaccttcattctcaccagataaaattttgggtgctattcttttcgaacaaacaatggatcgcgaagtagaaagcaaatacactgcagattacttagctgataaaggtgttgttccgttcttaaaagtagacaaaggtcttgctgaagagcaaaatggtgttcaattaatgaaaccaatcgacaacttagacaatttattagaccgtgcaaacgaacgtcacatttttggtacaaaaatgcgttctaacattttagaattaaatgagcaaggtatcaaagacgttgttgaacaacaatttgaagttgctaaacaaattattgctaaaggtttagttccaattatcgaaccagaagttaatattaatgcaaaagacaaagctgaaattgaaaaagtattaaaagctgaacttaaaaaaggtttagatagcttaaatgctgatcaattagtaatgttgaaattaacaattcctactgaaccaaacttatacaaagagttagctgaacatcctaatgttgttcgtgtcgttgtattatcaggtggttacagcagagaaaaagcaaatgaattacttaaagataacgctgaacttatcgcaagtttctcacgtgcattagctagtgatttaagagctgatcaatctaaagaagaattcgataaagctttaggtgatgctgtagaatcaatctacgacgcatctgtaaacaaaaac

SEQ ID NO: 3808 - protein, 299 aa, Staphylococcus aureus
  MISC_FEATURE (1)..(299): fructose-bisphosphate
VESMNKEQLEKMKNGKGFIAALDQSGGSTPKALKEYGVNEDQYSNEDEMFQLVHDMRTRVVTSPSFSPDKILGAILFEQTMDREVESKYTADYLADKGVVPFLKVDKGLAEEQNGVQLMKPIDNLDNLLDRANERHIFGTKMRSNILELNEQGIKDVVEQQFEVAKQIIAKGLVPIIEPEVNINAKDKAEIEKVLKAELKKGLDSLNADQLVMLKLTIPTEPNLYKELAEHPNVVRVVVLSGGYSREKANELLKDNAELIASFSRALASDLRADQSKEEFDKALGDAVESIYDASVNKN

SEQ ID NO: 3809 - DNA, 1503 bp, Staphylococcus aureus
gtgaaaccaatggctaagtctaatagtaaagacatcgttttaattggagccggtgtacttagcacaacatttggttcaatgttaaaagaaattgagccagactggaatatccacgtttacgaacgcttggatcgtcctgcaatcgaaagttcaaacgaaagaaataatgctggtacgggtcatgcagcattatgtgagttgaactacacagttttacaacctgatggttctatcgacatcgaaaaagcgaaagtgattaacgaagagtttgagatttcaaaacaattctggggtcacttagtgaaaagcggtagcatcgagaacccaagagaatttatcaatccattaccacacatcagttatgttagaggtaaaaacaatgttaaattcttaaaagatcgttacgaagcgatgaaagctttccctatgttcgataatatcgaatatactgaagacatcgaagtaatgaaaaaatggattccattgatgatgaaaggccgtgaagataaccctggtatcatggcggcaagtaaaattgacgaaggtacagatgtaaacttcggtgaattaacacgtaaaatggctaaaagcattgaagcacatccaaatgctacagtgcaatttaaccatgaagttgttgattttgaacaattatcaaatggtcaatgggaagttactgttaaaaatcgcctaactggtgagaaattcaaacaagtaactgactacgtattcatcggtgctggcggtggagcaattccattattacaaaaaacaggtatccctgaaagtaaacatttgggtggattccctatcagtggtcaattcttagcttgtacaaacccacaagttattgaacaacacgatgccaaagtttatggtaaagagccacctggtacaccaccaatgactgtacctcatttagatacgcgttacattgatggtcaaagaacattattatttggaccatttgctaatgttggacctaaattcttgaaaaatggttctaacttagatttattcaagtctgttaaaacatacaacattacaactttattagcagcagcagttaaaaacttacctttaattaaatactcatttgaccaagtaattatgacaaaagaaggttgtatgaaccacttacgtactttctatccagaagcacgtaatgaagattggcaattatacactgctggtaaacgtgtacaagttatcaaagatacacctgaacacggtaaaggattcatccaattcggtacagaagtggttaactcacaagaccacactgtaattgcattattaggtgaatcaccaggggcttcaacttcagtttcagttgcgttagaagtattagaacgtaacttccctgaatacaaaactgaatgggcacctaaaattaagaaaatgattccatcatacggtgaatcattaattgaagacgaaaaattaatgagaaaaatccgtaaacaaacttcaaaagacttagaattaggttactacgaaaac

SEQ ID NO: 3810 - protein, 501 aa, Staphylococcus aureus
  MISC_FEATURE (1)..(501): malate/quinone
VKPMAKSNSKDIVLIGAGVLSTTFGSMLKEIEPDWNIHVYERLDRPAIESSNERNNAGTGHAALCELNYTVLQPDGSIDIEKAKVINEEFEISKQFWGHLVKSGSIENPREFINPLPHISYVRGKNNVKFLKDRYEAMKAFPMFDNIEYTEDIEVMKKWIPLMMKGREDNPGIMAASKIDEGTDVNFGELTRKMAKSIEAHPNATVQFNHEVVDFEQLSNGQWEVTVKNRLTGEKFKQVTDYVFIGAGGGAIPLLQKTGIPESKHLGGFPISGQFLACTNPQVIEQHDAKVYGKEPPGTPPMTVPHLDTRYIDGQRTLLFGPFANVGPKFLKNGSNLDLFKSVKTYNITTLLAAAVKNLPLIKYSFDQVIMTKEGCMNHLRTFYPEARNEDWQLYTAGKRVQVIKDTPEHGKGFIQFGTEVVNSQDHTVIALLGESPGASTSVSVALEVLERNFPEYKTEWAPKIKKMIPSYGESLIEDEKLMRKIRKQTSKDLELGYYEN

SEQ ID NO: 3811 - DNA, 198 bp, Staphylococcus aureus
ttgaatcttgcacttataggtattgtaattatcgttctaacacatactgagtttcaacttaatgccggtgatagtaatgtgtttttattaaactgggatattcgaggtttaacatcttatattttctcattcttaatactggttgcgcttgtttctaaactaattttaatatttataactagacgacaaagaacatca

SEQ ID NO: 3812 - protein, 66 aa, Staphylococcus aureus
  MISC_FEATURE (1)..(66): hypothetical protein
LNLALIGIVIIVLTHTEFQLNAGDSNVFLLNWDIRGLTSYIFSFLILVALVSKLILIFITRRQRTS

SEQ ID NO: 3813 - DNA, 1617 bp, Staphylococcus aureus
atgtatgaaaggaagttagttatgcaaaagtcagctctattcgcgcctgaaaaatataacattatttcggaaatcgaaaaatatagccacataccagataaaaaggcaattttatatcataatactgaaggcgaagatatatcagtcacttaccaacagctcattgaacagtctaataaagtaggtaatgttttagcatcgcacggtttatctaaaggcgataaagtactcattatgatgccacgatctattgcgacgtatgaattatatattgctgctttaaaattaggtgttgcaatcattccatgttctgaaatgctaagaactaaagatttacaataccgtatcacacatggtgaaattaatgcagttattgcactagagccattcacagttgaatttgaaaaaattaaagaatatgatgcgttaactaaatttgttattgccggtcaaaaagatggatggatttcacttgaagctgaaaaagaaaacgcaagtaacaaactagaaatggcagatacgacgcgtgatgatatggcgattctgtcatatacatctggtacaactggcaatcctaaagccgttacacattgtcatggatggggatttgcacatttacaaatggcaccaaaacattggttatgtattaatgaagatgacttagtttgggcaacagcagcaccaggttggcaaaaatgggtatggagtcctttcttatctgtattaggttcaggtgcaactgcttttgtatttaatggaaggttcagtcctgaaacatacttagaattgcttcaaaaatatcaaattaatgttttatgttgtacaccgacagaatatcgtatgatggctaaattacagaacttaaatgattatgacttaacgcatttacatagtgccgtttctgcaggtgagccactaaatcgagaagtagttgaacaattcaagaaatactttaatttaactgtaagagatggatatggccagactgaaagtaccttgcttataggctttttaaaagatacaccacagaggattggatcaatgggtaaaggcattccgggtagttcggtcactgtagtagatgatgaggggaatagcgtacctgctaatacgaaagggaatattgcagtaccacttgatttgccagcacttttcaaagggtattataaagagccagaacgtacggcgaaagcgcaaacaggtaaatactacatcactggtgacttagctcatgtagatgatgatggttatttctggtttgaaggacgtcgagatgacattattattagttcaggctatacgattgggccttttgaagttgaagatgcgttaacgaatcatccagccgttaaagaatgtgctgtagtagcaaaacctcatgatatacgaggaaatattgttaaagcattcgttattttacaggaccatactgcgggtgatgatacgttagttaaagaactacaacaatttgttaaaaatgaagttgcaccatataaatatccgagagagattgaattcgttgacgacttaccaaaaacaaactcaggtaaaattcgtcgtgttgaactacgagatgctgaaatagaaaaatggcaacaacaaaaagatagcaatcaa

SEQ ID NO: 3814 - protein, 539 aa, Staphylococcus aureus
  MISC_FEATURE (1)..(539): acetate-CoA ligase
MYERKLVMQKSALFAPEKYNIISEIEKYSHIPDKKAILYHNTEGEDISVTYQQLIEQSNKVGNVLASHGLSKGDKVLIMMPRSIATYELYIAALKLGVAIIPCSEMLRTKDLQYRITHGEINAVIALEPFTVEFEKIKEYDALTKFVIAGQKDGWISLEAEKENASNKLEMADTTRDDMAILSYTSGTTGNPKAVTHCHGWGFAHLQMAPKHWLCINEDDLVWATAAPGWQKWVWSPFLSVLGSGATAFVFNGRFSPETYLELLQKYQINVLCCTPTEYRMMAKLQNLNDYDLTHLHSAVSAGEPLNREVVEQFKKYFNLTVRDGYGQTESTLLIGFLKDTPQRIGSMGKGIPGSSVTVVDDEGNSVPANTKGNIAVPLDLPALFKGYYKEPERTAKAQTGKYYITGDLAHVDDDGYFWFEGRRDDIIISSGYTIGPFEVEDALTNHPAVKECAVVAKPHDIRGNIVKAFVILQDHTAGDDTLVKELQQFVKNEVAPYKYPREIEFVDDLPKTNSGKIRRVELRDAEIEKWQQQKDSNQ

SEQ ID NO: 3815 - DNA, 477 bp, Staphylococcus aureus
atgaccaaaaatataaatgaaatgaaggcatttattatgaaaatttatgatgaatatagaagttatgtaatagaagaactggatgattgtctcacaatacaaaaaaataatgacactgcatattacgatgtgctagaagcgataaatgatttatcaaatgattcattatgtgtgttaaatcatttatatattaacgaaggacaagaagaaacattcgagcaaaaatttttgcgacgtaataagcatttaaaaaacgttgatggatttaaagcattaaggtttttaagacctagaacagctggtagacactatatcattattacgctgtgggaaaataggcaagcattttatcattggcaaaattcagctgagtacaagcatacacacaagcatcgtggcacttcgaaaggtgcagatgtaaaaataattaatcgtgaattatcatacaatattcgtattgaattagctgatatggtc

SEQ ID NO: 3816 - protein, 159 aa, Staphylococcus aureus
  MISC_FEATURE (1)..(159): conserved hypothetical
MTKNINEMKAFIMKIYDEYRSYVIEELDDCLTIQKNNDTAYYDVLEAINDLSNDSLCVLNHLYINEGQEETFEQKFLRRNKHLKNVDGFKALRFLRPRTAGRHYIIITLWENRQAFYHWQNSAEYKHTHKHRGTSKGADVKIINRELSYNIRIELADMV

SEQ ID NO: 3817 - DNA, 210 bp, Staphylococcus aureus
atgagcttttacgaatatatacaaacatttaaagatgataaaacaccattaggcgaattagcgatttggattaaagaagatgattcattcccaaaacaagagaagctaacagaaaacattttgtcttattttcatcaaatgtccaatatagatcatgagtttttagaaattgtaaaaagatcactttctctgtatgatcaattaaaatcg

SEQ ID NO: 3818 - protein, 70 aa, Staphylococcus aureus
  MISC_FEATURE (1)..(70): hypothetical protein
MSFYEYIQTFKDDKTPLGELAIWIKEDDSFPKQEKLTENILSYFHQMSNIDHEFLEIVKRSLSLYDQLKS

SEQ ID NO: 3819 - DNA, 1815 bp, Staphylococcus aureus
gtgttttggttagctaagtttagcaattcaacgataaccaatcagccactaacaaatatttcatgcaatactcactttgaaatacaacaaactttggaggtcataacgatgagtaacaaaaacaaatcatatgattatgtcatcattggaggaggcagtgcaggttctgtactaggtaatcgtctgagtgaagataaagataaagaagtcttagtattagaagcgggtcgcagtgattatttttgggatttatttatccaaatgcctgctgcgttaatgttcccttcaggcaataaattttacgattggatttattcaacagatgaagaaccacatatgggcggtcgtaaagtagcacatgcccgaggtaaagttttaggtggatcaagttcgattaatggcatgatttatcaacgtggtaatccaatggactatgaaggctgggcagaaccagaaggtatggaaacttgggattttgcgcactgtttaccgtattttaaaaaattagaaaaaacatacggtgcagcgccttatgataaatttagaggccatgatggaccaattaagttaaaacgagggccagcaacgaatcctttattccagtcattctttgatgcaggtgttgaagcaggctatcataaaacacctgatgtgaatggatttagacaagaaggttttggaccgttcgatagtcaagtacatcgtggtcgccgaatgtcagcttcaagagcatatttacatccagcgatgaagcgtaaaaacttaaccgttgaaacacgtgcctttgtaactgaaattcattatgaaggtagaagagcaactggtgttacgtataagaaaaatggcaaactacataccatcgatgctaatgaagtcattttgtctggtggggcattcaatacgccacaattactacaattatctggtatcggtgattcagagttcctaaaatcaaaaggcattgagccacgtgttcatttacctggtgtgggtgaaaactttgaagatcacttagaggtatacattcaacataaatgtaaggaacctgtatcattacagccaagcttagatatcaagcgcatgccatttattggtttacaatggattttcacacgtacaggtgcagcagcatctaaccattttgaaggtggcggatttgtacgttcaaataacgaagttgattatcctaacttaatgttccatttcttaccaatagctgtaagatatgatggtcaaaaggcagcggtcgcacatggttatcaagttcacgtaggaccaatgtattcaaactctcgtggtagcttgaaaatcaaatctaaagatccattcgaaaaaccaagtatccgctttaattatttatcaacagaagaagataaaaaagaatgggtagaagcaattcgtgtagcaagaaatatcttatctcaaaaagcaatggatccattcaatggtggagaaatttcaccaggaccagaagtgcaaacagacgaagaaattcttgattgggttcgtagagatggtgaaacagcattacacccatcttgtagtgctaaaatgggtcctgcttcagatccaatggcagtagttgacccgttaacaatgaaagtccacggtatggaaaatttacgtgtagttgatgcatcagctatgccacgtacgacaaatggcaatatacacgcacctgttttaatgttagctgaaaaagcagcagacattatacgtggcagaaagcctttagagccacaatatattgattattataagcatggtgttcatgatgaaaatgaaggtgcaatcgaagtaaaaccatacgctaaa

SEQ ID NO: 3820 - protein, 605 aa, Staphylococcus aureus
  MISC_FEATURE (1)..(605): choline dehydrogenase
VFWLAKFSNSTITNQPLTNISCNTHFEIQQTLEVITMSNKNKSYDYVIIGGGSAGSVLGNRLSEDKDKEVLVLEAGRSDYFWDLFIQMPAALMFPSGNKFYDWIYSTDEEPHMGGRKVAHARGKVLGGSSSINGMIYQRGNPMDYEGWAEPEGMETWDFAHCLPYFKKLEKTYGAAPYDKFRGHDGPIKLKRGPATNPLFQSFFDAGVEAGYHKTPDVNGFRQEGFGPFDSQVHRGRRMSASRAYLHPAMKRKNLTVETRAFVTEIHYEGRRATGVTYKKNGKLHTIDANEVILSGGAFNTPQLLQLSGIGDSEFLKSKGIEPRVHLPGVGENFEDHLEVYIQHKCKEPVSLQPSLDIKRMPFIGLQWIFTRTGAAASNHFEGGGFVRSNNEVDYPNLMFHFLPIAVRYDGQKAAVAHGYQVHVGPMYSNSRGSLKIKSKDPFEKPSIRFNYLSTEEDKKEWVEAIRVARNILSQKAMDPFNGGEISPGPEVQTDEEILDWVRRDGETALHPSCSAKMGPASDPMAVVDPLTMKVHGMENLRVVDASAMPRTTNGNIHAPVLMLAEKAADIIRGRKPLEPQYIDYYKHGVHDENEGAIEVKPYAK

SEQ ID NO: 3821 - DNA, 1488 bp, Staphylococcus aureus
atggaacttttaaaacatttatctcagcgtcaatatattgatggtgagtgggttgaaagcgcgaataaaaatacaagagatattatcaatccttacaatcaagaagtgatatttacggtttctgaagggacaaaagaggatgcagaacgtgcaatcttagctgcaagacgtgcgtttgagtctggtgaatggtcgcaagaaactgctgaaacaagaggtaaaaaagtacgtgccatcgcggacaagattaaagaacatcgcgaagcgttagcacgattagaaacattagatactggaaaaacgttagaagaatcatatgcagatatggatgatattcataatgtgtttatgtattttgctggattagcagataaagacggtggcgaaatgattgattcaccaattccagatacagaaagcaaaattgttaaagaaccagtaggtgtagttacacaaattacaccttggaattatccgttattacaagcatcatggaaaattgcgccagcgcttgctacgggttgttcactagttatgaaaccaagtgaaattacaccattaacaacaatacgtgtttttgaattaatggaagaagttggtttccctaaaggaacaattaatcttattctaggtgcaggttctgaagttggtgacgtaatgtcaggtcataaagaggttgaccttgtatcatttacaggtggcattgagactggtaagcatattatgaaaaatgctgctaataatgttacgaatattgccttggaacttggcggtaaaaatccaaacattatctttgatgatgctgattttgaattggcagtagaccaagcgttaaatggtggatatttccatgcaggtcaagtttgttcagcaggatcaagaatattagtacaaaacagtattaaagacaaatttgagcaagcacttattgatcgcgtgaaaaaaatcaaattaggtaatggttttgatgctgatactgaaatgggaccagtgatttcaacagaacatcgtaataagatcgaatcttatatggatgtagctaaagcagaaggcgcaacaattgctgttggtggtaaacgtccagatagagatgatttaaaagatggtctattcttcgagccaacagtcattacaaattgtgatacgtcaatgcgtattgtacaagaagaggttttcggacctgtcgttactgtagaaggctttgaaactgaacaagaagcgattcaattagcgaatgattctatatatggtttagcaggtgctgtattttctaaagatattggaaaagcacaacgcgttgctaacaagttgaaacttggaacggtgtggattaatgatttccatccatattttgcacaagcgccatggggtggatacaaacaatcaggtatcggtagagaattaggcaaagaaggcttagaagagtaccttgtttcaaaacacattttaacaaatacaaatccacaattagtgaattggtttagcaaa

SEQ ID NO: 3822 - protein, 496 aa, Staphylococcus aureus
  MISC_FEATURE (1)..(496): glycine betaine aldehyde
MELLKHLSQRQYIDGEWVESANKNTRDIINPYNQEVIFTVSEGTKEDAERAILAARRAFESGEWSQETAETRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 3823 - DNA, 93 bp, Staphylococcus aureus
atgaaaaatgtgtcaatttacaaaacaactcaagaattaagttttgtaagttcgttagatttttatttaacgaaacatttaactttaatgctt

SEQ ID NO: 3824 - protein, 31 aa, Staphylococcus aureus
MKNVSIYKTTQELSFVSSLDFYLTKHLTLML

SEQ ID NO: 3825 - DNA, 591 bp, Staphylococcus aureus
gtgaccaaaatgatgtacggaggtgcaatgatgactcgttctcagaacaaacagcaacaattagaacaagcaaaagatattgtaattaattcaattggacagacaatggatttgtatggcactaatagaagtgtaggaaacttatatggcacaatggtgtttgaaggcagtatgacgcttgatgaaatgcgtcatcaattgcaaatgagcaaaccaagtatgagtgctggcgttaagaaattgcaggaatttgatattgttaaacaacaatttacgagaggaagccgcaaacaacattttatcgccgagaaagactttttcatctttttccgaaactttttcactaaaaaattccagcgtgaaattgacatcaatgtcgaagcagtaaaagatgctcaagctattatcaatccattacttgaaagcagtgatttaactgaagctgaaacacaagaggcacaaaaaattaaagctcagcttgatcatacacatgtttattacgaatggttagaacagttaaccgaagcgattgaaagcggtgaaattttcaaatatttcccaattccagaacagccttctgattctgaaaat

SEQ ID NO: 3826 - protein, 197 aa, Staphylococcus aureus
  MISC_FEATURE (1)..(197): conserved hypothetical
VTKMMYGGAMMTRSQNKQQQLEQAKDIVINSIGQTMDLYGTNRSVGNLYGTMVFEGSMTLDEMRHQLQMSKPSMSAGVKKLQEFDIVKQQFTRGSRKQHFIAEKDFFIFFRNFFTKKFQREIDINVEAVKDAQAIINPLLESSDLTEAETQEAQKIKAQLDHTHVYYEWLEQLTEAIESGEIFKYFPIPEQPSDSEN

SEQ ID NO: 3827 - DNA, 297 bp, Staphylococcus aureus
atgcatgaacaagattttagaattttagagggtcaagatattactttgccagaattaggtagagaattagaaaatattacaggacatacgattgctgattctactggcgaaattaagcgtgtaattgcacatttaccaaactttgagtccgatacagatacttttgttgctacatatcgtttaaaccatcaacaagattttatagatgcaacttttactgcgctgaaatcagatagagcacgtttaaaagaagtgccagttcatgttgaacttataagttatatttctaaatcaaaa

SEQ ID NO: 3828 - protein, 99 aa, Staphylococcus aureus
  MISC_FEATURE (1)..(99): hypothetical protein
MHEQDFRILEGQDITLPELGRELENITGHTIADSTGEIKRVIAHLPNFESDTDTFVATYRLNHQQDFIDATFTALKSDRARLKEVPVHVELISYISKSK

SEQ ID NO: 3829 - DNA, 216 bp, Staphylococcus aureus
atggaaaaccaaaaacaaggcaatggcttaaaaattgcaacatgggtatttattgtattaacagtagttacaccgctatttggtattggaagtattgtttgtagtattaattataaaaaatacgatgctgaaaaaggttcgaagttattgcaaattgcaattatcgtaacaataattgcttttgttttaaatttattagcatatttaggtttaaga

SEQ ID NO: 3830 - protein, 72 aa, Staphylococcus aureus
  MISC_FEATURE (1)..(72): hypothetical protein
MENQKQGNGLKIATWVFIVLTVVTPLFGIGSIVCSINYKKYDAEKGSKLLQIAIIVTIIAFVLNLLAYLGLR

SEQ ID NO: 3831 - DNA, 684 bp, Staphylococcus aureus
atgactaatcaatttaaaaataaacagtccaaattacatgacagtttagaatccatcacaaaaaacttatatgcgacacctacttcggaactgccttttgataatcgatttctatttaaatcttttattttaaaacgtgaaacaggtaatattgttatctatcattccggacacttaggtgactcccaacaagacattgcatcattaggtggtgtttcaaaagtattgatgaatcatgatcatgaatctataggaggttctaatcaagttgaagccccttactttatacatgaaaatgatgtggctgcactgaaacataagatttctgttcaaaaacaatttagtaatcgtgtaatgttggataaggatttagaagttattcccgcgcctggacatacaccagggacgacactatttttatgggatgatggtcatcaccgttacttatttactggagattttatatgttttgaagggaagagatggcgtacagttatattaggttcaagtgatagagaaaaatctattcaaagtttagagatggttaaagaattagattttgatgtacttgtaccttgggttactatcaaagatgaaccgttagtttattttgtagaaaatgaatatgaaaaacgtgaacaaatacaaaatattattgatagagtacgtgagggcgagaatagc

SEQ ID NO: 3832 - protein, 228 aa, Staphylococcus aureus
MTNQFKNKQSKLHDSLESITKNLYATPTSELPFDNRFLFKSFILKRETGNIVIYHSGHLGDSQQDIASLGGVSKVLMNHDHESIGGSNQVEAPYFIHENDVAALKHKISVQKQFSNRVMLDKDLEVIPAPGHTPGTTLFLWDDGHHRYLFTGDFICFEGKRWRTVILGSSDREKSIQSLEMVKELDFDVLVPWVTIKDEPLVYFVENEYEKREQIQNIIDRVREGENS

SEQ ID NO: 3833 - DNA, 1620 bp, Staphylococcus aureus
ttgaaaaaagagaaagttatggactggacgacctttatagggacagtagctgtacttctttttgcagttatacctatgatggcttttccaaaagcaagtgaagatatcatcactggtattaatagtgccatttctgattcaattggttcgatatatttatttatggggctggcgattttttgctttgtaatgtatatcgcatttggtaaatatggtaatgtcacacttggtaaagcaagtgataaaccagaatttaatacatttacatgggcggcaatgctgttttgtgcaggcataggctctgatattttatactggggcgttattgaatgggctttttactatcaagttccaccaaatggcgcgaaaagtatgagtgatgaagcactccaatatgcgacgcaatatggtatgttccactgggggccaattgcttgggctatttatgttctaccagcattaccaattggttatttagtatttgttaaaaaacaaccggtgtataaaattagtcaagcttgtcgtccgattttaaaaggtcaaacagataaatttgtaggtaaagttgtagatatcttatttatctttggattgctaggtggtgcggcaacatcactagcgttaggtgtgccattaatttctgcaggcatagaaagattaactggtttagatggtaaaaatatgattttacgttcggccattttattaacaatcacggttatatttgccattagttcatatacaggattgaaaaaaggtattcaaaagttaagtgatatcaacgtttggctatcctttgtacttttagcctttatatttattattggaccgactgtttttattatggaaacgacagtgacagggttcggaaatatgttgagagatttctttcatatggcaacatggttagaaccattcggtggtattaaaggtcgaaaagaaacgaatttcccacaagactggacaatattctactggtcatggtggttagtatatgcgccatttatcggtttatttatcgctagaatttcaaaaggtcgacgccttaaagaagtcgtgctaggaacaattatttatggaacgcttggatgcgtattattctttggtatttttggtaactatgctgtgtatttacaaatttctggacagtttaatgtaacacaatatttaaatacacatggtacagaggcaaccattattgaagtggtgcatcatttaccattcccatcattgatgattgtactattcttagtatctgctttcttattcttagcaacaacatttgattcgggttcatatattttagcggcagcatctcagaaaaaagtggtaggcgaaccattacgtgccaatcgtttattctgggcatttgcattgtgcttattgccattttcattgatgctagttggtggtgaacgtgcattagaagtattgaaaactgcttcaatactggcaagtgtgccattaattgttatttttattttcatgatgatatcatttttaatcattttagggcgcgatagaattaaacttgaaacgcgtgctgaaaaattaaaagaagttgaacgtcgttcattgcgaatcgttcaagtatcagaagaagaacaagacgataattta

SEQ ID NO: 3834 - protein, 540 aa, Staphylococcus aureus
  MISC_FEATURE (1)..(540): choline transporter
LKKEKVMDWTTFIGTVAVLLFAVIPMMAFPKASEDIITGINSAISDSIGSIYLFMGLAIFCFVMYIAFGKYGNVTLGKASDKPEFNTFTWAAMLFCAGIGSDILYWGVIEWAFYYQVPPNGAKSMSDEALQYATQYGMFHWGPIAWAIYVLPALPIGYLVFVKKQPVYKISQACRPILKGQTDKFVGKVVDILFIFGLLGGAATSLALGVPLISAGIERLTGLDGKNMILRSAILLTITVIFAISSYTGLKKGIQKLSDINVWLSFVLLAFIFIIGPTVFIMETTVTGFGNMLRDFFHMATWLEPFGGIKGRKETNFPQDWTIFYWSWWLVYAPFIGLFIARISKGRRLKEVVLGTIIYGTLGCVLFFGIFGNYAVYLQISGQFNVTQYLNTHGTEATIIEVVHHLPFPSLMIVLFLVSAFLFLATTFDSGSYILAAASQKKVVGEPLRANRLFWAFALCLLPFSLMLVGGERALEVLKTASILASVPLIVIFIFMMISFLIILGRDRIKLETRAEKLKEVERRSLRIVQVSEEEQDDNL

SEQ ID NO: 3835 - DNA, 159 bp, Staphylococcus aureus
ttggcaattattgaatatttatataatttttcccgtaataaacaaaaccttaatagcgctaaaataacagtgttaagttacgatttaacgaatttaacaaattttactagaatggcatttaagaatatttatacgttattaacgaatatttatttattg

SEQ ID NO: 3836 - protein, 53 aa, Staphylococcus aureus
LAIIEYLYNFSRNKQNLNSAKITVLSYDLTNLTNFTRMAFKNIYTLLTNIYLL

SEQ ID NO: 3837 - DNA, 108 bp, Staphylococcus aureus
ttgatagaatatgacctaacaatcattttgataccaatactaaaagttgcatatccgttttttaaaaaagttgaaagagaaaagtggtattttagtgggaaggaagtc

SEQ ID NO: 3838 - protein, 36 aa, Staphylococcus aureus
LIEYDLTIILIPILKVAYPFFKKVEREKWYFSGKEV

SEQ ID NO: 3839 - DNA, 534 bp, Staphylococcus aureus
atgatacttttagacattaaacaaggacaaggttatattgctaaaatagaatcaaatagctttgttgacggtgaaggagtaagatgcagtgtttatgtatcaggatgtccatttaattgtgttggatgttataacaaagcctcacaaaagttcagatatggcgagaaatacactgatgaaatattagcagaaatattagatgattgcgatcatgattatatatctgggctaagtctattaggtggcgaaccattttgtaatttggatattacattaaatcttgtcaaagcatttcgagcacgttttggaaatacaaagacaatttgggtatggactggatttttatatgaatatttagcaaatgattgtacagaacgtcgagagttattatcatacattgacgttttagtagatggtctatttatacaacacttattcaaacctgatttaccatataaaggttctttaaatcaacgcattatagatgtacaacaatcactctcgcatgcgcgtatgattgaatatatagttagt

SEQ ID NO: 3840 - protein, 178 aa, Staphylococcus aureus
  MISC_FEATURE (1)..(178): hypothetical protein
MILLDIKQGQGYIAKIESNSFVDGEGVRCSVYVSGCPFNCVGCYNKASQKFRYGEKYTDEILAEILDDCDHDYISGLSLLGGEPFCNLDITLNLVKAFRARFGNTKTIWVWTGFLYEYLANDCTERRELLSYIDVLVDGLFIQHLFKPDLPYKGSLNQRIIDVQQSLSHARMIEYIVS

SEQ ID NO: 3841 - DNA, 1848 bp, Staphylococcus aureus
atgaatcaaatcgaagaagcattaacgggtttgatttctaaagatcctgctattgttaacgaaaatgctaacaaagatagtgatacattttcaacaatgagagatttaacagcaggtatcgtttctaaatcttacgcattaaatcatttattaccaaagcacgttgcagatgcacatcaaagaggggacatacattttcacgacttagattatcatccattccaaccgttaactaactgttgtttaatagatgctaaaaatatgctacataatggatttgaaataggcaacgcgaatgtaacttcaccaaaatcaatacaaactgcatcagcgcagcttgtacaaattatagccaatgtttctagcagtcaatatggtggctgtacggttgaccgcgttgacgaattacttagtacatatgcacgacataatgaagaacaacataggaatatcgcaaagcaatttgtcaaagaatctgaaattgatcgttatgttgatcaacaagtcactaaagacatcaatgatgcgattgaaagtttagaatatgaaattaataccttatatacatctaatggacagacaccttttgtaacattaggattcggcttaggtacagatcatttaagtcgcaaaattcaacaagctatcttaaatactcgtatcaaaggcttaggaaaagaccgcacgacagcgattttcccgaaacttgtattttcaattaaaaaaggaaccaactttagtccgcaagatccgaactatgacattaaacaactagcattaaagtgttcaacgaaacgtatgtatccagatattttaaattatgacaaactcgtagaaatattaggtgatttcaaagcgccaatgggttgtcgttcatttttaccaagttggaaagatgcggaaggtcattttgaaaataatggtcgttgtaatcttggtgttgttacacttaatttacctagaatggcattagaatctgccggtaatatgacgaaattctgggaaatcttttatgaacgtatcgatgtgttacatgatgcattactttatcgtataaatcgtttgaaagatgctgtaccgaataacgcaccgattttatataaaagtggcgcatttaactataaattaaaagaaacagatgatgttgctgagttatttaaaaataaacgtgcaacgatttcaatgggctatatagggttgtatgaaacagctactgttttctatggtccagactgggaaacatctcaagaagcaaaagcatttacgcttgaaattcttaaagaaatgaaacgttatcaaacgaaatggacagaattatatgacatttggttcagtatttacagtacgccgagtgaatcgctaacggatcgtttttgtcgtttagaccaagagagatttggagatattaaagacattacagataaaggatattatcaaaactctttccattatgatgtacgtaaagatgttacaccttttgaaaagttagattttgaaaaagattatccttattatgcgagtggtggtttcattcactattgtgagtatccgaaattgcaacacaatttgaaagcactagaagcggtatgggactactcttatgacaaagttggttacttaggtacaaatattccgattgatcattgttatgaatgtgattacgatggagattttgaagcaactgaaaaaggatttaaatgcccgaactgtggcaatgataatcctaaaacagttgatgtcgttaaacgaacatgtggttacctaggcaatccagttcaacgtccagtaattaaaggccgtcataaagaaatttgcgcacgagtaaaacatatgaaagcgcctaaagaa

SEQ ID NO: 3842 - protein, 616 aa, Staphylococcus aureus
  MISC_FEATURE (1)..(616): anaerobic
MNQIEEALTGLISKDPAIVNENANKDSDTFSTMRDLTAGIVSKSYALNHLLPKHVADAHQRGDIHFHDLDYHPFQPLTNCCLIDAKNMLHNGFEIGNANVTSPKSIQTASAQLVQIIANVSSSQYGGCTVDRVDELLSTYARHNEEQHRNIAKQFVKESEIDRYVDQQVTKDINDAIESLEYEINTLYTSNGQTPFVTLGFGLGTDHLSRKIQQAILNTRIKGLGKDRTTAIFPKLVFSIKKGTNFSPQDPNYDIKQLALKCSTKRMYPDILNYDKLVEILGDFKAPMGCRSFLPSWKDAEGHFENNGRCNLGVVTLNLPRMALESAGNMTKFWEIFYERIDVLHDALLYRINRLKDAVPNNAPILYKSGAFNYKLKETDDVAELFKNKRATISMGYIGLYETATVFYGPDWETSQEAKAFTLEILKEMKRYQTKWTELYDIWFSIYSTPSESLTDRFCRLDQERFGDIKDITDKGYYQNSFHYDVRKDVTPFEKLDFEKDYPYYASGGFIHYCEYPKLQHNLKALEAVWDYSYDKVGYLGTNIPIDHCYECDYDGDFEATEKGFKCPNCGNDNPKTVDVVKRTCGYLGNPVQRPVIKGRHKEICARVKHMKAPKE

SEQ ID NO: 3843 - DNA, 1386 bp, Staphylococcus aureus
gtggagggagaaaataatatgaatagtgataatatgtggttaacagtaatggggctcattattattatttcaattgtaggtttactcattgccaaaaagataaatccagttgtaggtatgacaatcataccttgcttaggggcaatgattttaggatatagtgtgacagatttggttggattttttgctaaagggttagatcaagtcatcaacgttgttattatgtttatctttgccattattttctttggcatcatgaacgatagtggtttattcaagccgcttgtcaaacgcttaatattaatgacacgaggcaatgtcgtcattgtctgtgcaatgacagctttaattggcacaatagcccaattagatggggccggtgcggtaacatttttgctttctattcctgcattattacctttatataaagcgttaaatatgaataaatatttattgattttactattagcattaagcgcggcgattatgaacatggtaccttggggaggtccaatggctcgtgtagctgcagtgttaaaagccaaaagtgtcaatgaattatggtatggattaatacctattcaaataataggtttcattcttgttatgttgtttgcggtatatcttggatttaaagaacagaaacgtatcaaaaaagcaatagagagaaatgaattaccgcaaacacaagatatagatgtacataaattagttgaagtatatgaacgagatcaagatgtaaggtttcctgtaaaaggacgtgcaagaacaaaatcatggataaaatgggtgaatacagctttaactttagctgttattctatcgatgttaataaatattgcgccacctgaatttgcattcatgataggtgtttcgttggcacttgttattaattttaaatcagtggatgaacaaatggaacgattaagagcgcatgcgccgaatgcattaatgatggctgcagtgattattgcagcaggtatgtttttaggtgtactaaatgaaaccggtatgcttaaagcgattgcgaccaatttaatcaaagtgattcctgcagaagtaggaccatacttgcatattattgtaggtttacttggcgtaccattagatttactaactagcacagacgcttattattttgctgtgttaccgattgtcgaacaaacagcagggcaatttggtgtaccgtctgtatcaacagcttattcaatggtcatagggaatattataggtacatttgtcagcccattttcaccagccttatggttggcaattggtttagcagaggcaaacatgggcacgtatattaagtatgcattcttttggatttggggattcgctatcgttatgttagtaattgcaatgttgatgggcattgtgacgatt

SEQ ID NO: 3844 - protein, 462 aa, Staphylococcus aureus
  MISC_FEATURE (1)..(462): hypothetical protein
VEGENNMNSDNMWLTVMGLIIIISIVGLLIAKKINPVVGMTIIPCLGAMILGYSVTDLVGFFAKGLDQVINVVIMFIFAIIFFGIMNDSGLFKPLVKRLILMTRGNVVIVCAMTALIGTIAQLDGAGAVTFLLSIPALLPLYKALNMNKYLLILLLALSAAIMNMVPWGGPMARVAAVLKAKSVNELWYGLIPIQIIGFILVMLFAVYLGFKEQKRIKKAIERNELPQTQDIDVHKLVEVYERDQDVRFPVKGRARTKSWIKWVNTALTLAVILSMLINIAPPEFAFMIGVSLALVINFKSVDEQMERLRAHAPNALMMAAVIIAAGMFLGVLNETGMLKAIATNLIKVIPAEVGPYLHIIVGLLGVPLDLLTSTDAYYFAVLPIVEQTAGQFGVPSVSTAYSMVIGNIIGTFVSPFSPALWLAIGLAEANMGTYIKYAFFWIWGFAIVMLVIAMLMGIVTI

SEQ ID NO: 3845 - DNA, 93 bp, Staphylococcus aureus
atgggcggctttgtgaatagtctaataatgaaggatttaagcgataatgatatgcgttttaaatatgaatattacaatagagaaaaagatacg

SEQ ID NO: 3846 - protein, 31 aa, Staphylococcus aureus
MGGFVNSLIMKDLSDNDMRFKYEYYNREKDT

SEQ ID NO: 3847 - DNA, 615 bp, Staphylococcus aureus
atgttgctcaacatgaatatgccattaatgatagatttaacaaataaaaatgtcgtcatagttggtggaggcgtcgttgcaagtcgtcgggcacaaacattaaatcaatacgttgaacatatgacggtcatcagtccgacaatcactgaaaaacttcaaaatatggtagataacggtgtcgtcatatggaaagaaaaagaatttgaaccaagcgatattgtagacgcgtatctagttattgcagcaaccaatgagccacgtgtcaatgaagcggtaaaaaaagccttacctgagcatgccctttttaataatgttggagatgcatcaaatggcaatgttgtatttccaagtgcactacaccgcgacaagctaactatcagtgtatcaactgatggtgcgagtcctaagttgacaaaatcaattatggcagagcttgaggcgttatatccaccatcatacagttcgtatatcgactttttatatacttgccgacagaaaataaaagtacttgatataacatataacgaaaagcaacagttactgtcacaaattgtgtcacaagaatatttaaatcatgacaaacaagctcaatttttagcgtggttggatgtaaga

SEQ ID NO: 3848 - protein, 205 aa, Staphylococcus aureus
  MISC_FEATURE (1)..(205): hypothetical protein
MLLNMNMPLMIDLTNKNVVIVGGGVVASRRAQTLNQYVEHMTVISPTITEKLQNMVDNGVVIWKEKEFEPSDIVDAYLVIAATNEPRVNEAVKKALPEHALFNNVGDASNGNVVFPSALHRDKLTISVSTDGASPKLTKSIMAELEALYPPSYSSYIDFLYTCRQKIKVLDITYNEKQQLLSQIVSQEYLNHDKQAQFLAWLDVR

SEQ ID NO: 3849 - DNA, 393 bp, Staphylococcus aureus
atgaagaaattaatcatcagtattatggcggtcatgctatttttaacaggttgtggtaaaagtcaagagaaagccactctggaaaaggatatcgataatttacaaaaagaaaataaagaattaaaagacaaaaaagaaaagcttcaacaagaaaaagaaaaattagcagataagcaaaaagaccttgaaaaagaagtgaaagatttaaaaccttcaaaagaagataacaaggatgataaaaaagacgaagacaaaaataaagacaaagataaagataaagaggcatcacaagataagcaatcaaaagatcaaactaagtcatcggataaagataatcacaaaaagcctacatcagcagataaagatcaaaaagctaatgacaaacaccaatca

SEQ ID NO: 3850 - protein, 131 aa, Staphylococcus aureus
  MISC_FEATURE (1)..(131): conserved hypothetical
MKKLIISIMAVMLFLTGCGKSQEKATLEKDIDNLQKENKELKDKKEKLQQEKEKLADKQKDLEKEVKDLKPSKEDNKDDKKDEDKNKDKDKDKEASQDKQSKDQTKSSDKDNHKKPTSADKDQKANDKHQS

SEQ ID NO: 3851 - DNA, 1878 bp, Staphylococcus aureus
ttgaaattaaatacatctaatagtccatttacagaaaaacaagtcacagagattaacaatctgctgcaaacattaacagagagccaacaacagtggcttagtggttttttactagctaatagtaacgatacgacaagtgatagtaatcaacaacaattagagacagaagtgtggcaacaatcacaaatatcagaagaacaagcaacttcaacaacgtatatgttacaaaataaagagccacatatcgaagctaatcagcggcatgttacagtgctatatggttctgaatcaggtaatgccatgcgtttagctgaaattttttcagaacgtttaagtgatatcggacatcaagttgttttgatgtcaatggatgaatatgatacgacaaacatcgcgcagttagaagatttatttattattacgtctactcatggtgaaggagaaccgcctgataatgcatgggatttctttgaatttttagaagacgataacgcacctaatttaaatcatgtgagatattcagtactagctttaggtgatcaaacatatgaatttttctgtcaagccggtaaagatgtagatgttttactagaaaatctaggcgctgagcgtatatgtaagcgtgtagattgtgatattgattatgaagaagacgcagaaaagtggatggcagacatcattaatattattgataccacatcagaaggtattcaaagtgaatcggtgataagtgaatcaattaagtctgccaaagaaaagaaatattctaaatcaaatccataccaagcagaagtattagcgaatatcaatttaaatggtaccgattcaaataaagaaacacgacatatagaatttttacttgatgattttagtgaatcatatgaaccaggagattgtatagtagcattaccgcaaaacgaccctgaattggttgaaaaactaatatccatgttaggttgggatccgcaatctccggtgccaattaatgatcatggtgatacagttcctattgttgaagcactaacatcacattttgaatttactaaattaacattgccattattgaaaaatgcagatatctattttgacaatgaagaattatctgaacgtattcaagatgagtcatgggcgcgtgaatatgttataaatcgggactttatagatttaataacagattttccaactatagaattacaacctgagaatatgtatcaaatccttagaaaattaccaccaagagagtattcgatttctagtagttttatggcaacgccagatgaagtgcatattaccgttggtacggttcgttatcaagcacatggacgtgagagaaaaggtgtatgctcggttcattttgctgagcgaattaaaccaggcgatatagtaccaatttatttgaagaaaaatccgaacttcaaatttccgatgaagcaagatataccggttattatgattggaccaggtactggaattgctccttttagagcatatttacaagaacgtgaagaacttggtatgactggaaaaacatggttgttctttggtgatcaacaccgtagttctgactttttatatgaagaagaaatagaagaatggcttgaaaatggaaacttaacacgcgtagatttagcattttcaagagaccaagaacacaaagaatatgtacagcatcgtataatggaagaaagtaaacgtttcaatgaatggattgagcaaggcgcagcaatctatatttgtggcgatgaaaaatgtatggcgaaagatgtccatcaagccattaaagatgtattggtaaaagaacgtcatatttctcaagaagaagcagagttattattgcgacaaatgaaacaacaacaacgctatcaacgtgatgtttat

SEQ ID NO: 3852 - protein, 626 aa, Staphylococcus aureus
  MISC_FEATURE (1)..(626): sulfite reductase
LKLNTSNSPFTEKQVTEINNLLQTLTESQQQWLSGFLLANSNDTTSDSNQQQLETEVWQQSQISEEQATSTTYMLQNKEPHIEANQRHVTVLYGSESGNAMRLAEIFSERLSDIGHQVVLMSMDEYDTTNIAQLEDLFIITSTHGEGEPPDNAWDFFEFLEDDNAPNLNHVRYSVLALGDQTYEFFCQAGKDVDVLLENLGAERICKRVDCDIDYEEDAEKWMADIINIIDTTSEGIQSESVISESIKSAKEKKYSKSNPYQAEVLANINLNGTDSNKETRHIEFLLDDFSESYEPGDCIVALPQNDPELVEKLISMLGWDPQSPVPINDHGDTVPIVEALTSHFEFTKLTLPLLKNADIYFDNEELSERIQDESWAREYVINRDFIDLITDFPTIELQPENMYQILRKLPPREYSISSSFMATPDEVHITVGTVRYQAHGRERKGVCSVHFAERIKPGDIVPIYLKKNPNFKFPMKQDIPVIMIGPGTGIAPFRAYLQEREELGMTGKTWLFFGDQHRSSDFLYEEEIEEWLENGNLTRVDLAFSRDQEHKEYVQHRIMEESKRFNEWIEQGAAIYICGDEKCMAKDVHQAIKDVLVKERHISQEEAELLLRQMKQQQRYQRDVY

SEQ ID NO: 3853 - DNA, 495 bp, Staphylococcus aureus
atgaataatagaaatgtgtatgatatcgaagtaagtgattataaaggcttaacttataaattagaagcatttagaggtaaagtgattttagttgttaatactgcaacagaatgtatatatagcgaacaattgaaaaaactagagactttatttcaaaaatataaggatcgtgggtttgtagtgttgagttttccgaataataattttgacaatcgacaaccaggttctaatgaagaaatcttgaaaattagtcgtgagaaatttggtgtaacatttccagtgttagctaaaatatctgtgaacgggaacgatgaacatccgttatttacgcatttaaagaatgaacaaccaggaatctttgggtccccaataaaatggaatttcacaaaatttataatcgatcgacaaggaaatgttgtaaatcgattcttgccaatggaagatccattggatatatcgacaaatatagaaatattattgcaagaatcttcatct

SEQ ID NO: 3854 - protein, 165 aa, Staphylococcus aureus
  MISC_FEATURE (1)..(165): hypothetical protein
MNNRNVYDIEVSDYKGLTYKLEAFRGKVILVVNTATECIYSEQLKKLETLFQKYKDRGFVVLSFPNNNFDNRQPGSNEEILKISREKFGVTFPVLAKISVNGNDEHPLFTHLKNEQPGIFGSPIKWNFTKFIIDRQGNVVNRFLPMEDPLDISTNIEILLQESSS

SEQ ID NO: 3855 - DNA, 114 bp, Staphylococcus aureus
atgatgaatggcatacttataaagtgtctaaatattggcggtcaatattacttacaaacacgaatgttaagtaatgtagacaatgctgaaaaaacaataagtagaaactctata

SEQ ID NO: 3856 - protein, 38 aa, Staphylococcus aureus
MMNGILIKCLNIGGQYYLQTRMLSNVDNAEKTISRNSI

SEQ ID NO: 3857 - DNA, 111 bp, Staphylococcus aureus
atgaatagaaatatcaataagaaaaataatatgattaaaaatgatgaatggcatacttataaagtgtctaaatattggcggtcaatattacttacaaacacgaatgttaag

SEQ ID NO: 3858 - protein, 37 aa, Staphylococcus aureus
MNRNINKKNNMIKNDEWHTYKVSKYWRSILLTNTNVK

SEQ ID NO: 3859 - DNA, 1998 bp, Staphylococcus aureus
atgaagttaagattgttatggcacatagtgcgacgtcaatttattacgcagcgacttgtaatcattccattcattttagcggtaagtgtactattcatgattgaatatacgcttgtgtcaattgggttaaatagctacataaaacagaagaatgacttcctagtaccatttattatcatagctaatttttttatggcgcttttaacttttatttttattttctatgcaaatcactttatgatgtcacaaagacgaaaagagtttagcatttttatgacattgggcatgaccaagaaaagtatgcgtttaattgtagtgatggaaactatcttacaatttgtgataatttcagtcgttagtattgccggcggatacttacttggtgcgatatttttcttgtttatacagaaaataatgggcagtgaagttgcgacgttaaggtattatccatttgactctgtagcgatgtttattactttgattatcattgctgtattaatgggcatgctacttatattcaacttgtttagtattaattttcaacggccgataacttatcaacatcgttccgattctagtgtcatatcacgatggttgcgttacgttttaattgttataggaagcgcagcactatatttaggttactttattgcattacaacaagatacgacgtttggtgccttttttaaaatatggattgtcataggattagttattatcggtacttatgcattttttgtaggtataagtgaaataattattagtatattgcagcaggtatcaaaagtttactatcatccacggtatttttttgtggtagttgggatgcgtgtacgtcttaaaatgaatgcagtcagtcttgcaacaatcactttgctgtgtacatttttgattgtaacgctcacaatgacattaacaacctatcgtgatatgaatcataccattacgaaattgattacgaatgattatgatttgtcatttagcgacaattctaagtcacaaatagaacgtcaacaaacaattgagaatattaaacgtgatatacagggttcggttaatgcaaaagacttcaaagtatatgaaacgacattatttagagcttctttagaaaagaatcgtgcttattacaagttaaaacaggctagtgatgatattccaatagacttcattggtaatgaaggcgcgatattttcaagacaatcagtaatgattacagcttttactgcacaagattataatcgatatcaccaaaacaaattacacttagacaatcaaagtataggtatgattacgaatgtacctatttttaaaaagcagtctaaggtcggtcttaataatgaagtctttaaagtgaaacaacttgacgcacatgcgttaaatttgatgatgattcaagatagtatggttttaattgttaaagataacaatcaattacaaaaagtaaaaggattttatgcacatgaacaaaagaattcgacaatatcgataaactttaatgtatttggaaagacgaaattaacaacatcacaaatacaaaagctatcgaaaaaatacgatgcgtcaataaattctaaatcagaaatgctaatggtttgggatcgtttgacaggtggactaatatttgtaggtggcgtagtatcaattgtacttgtcattggaatatttctaatgatgtattataaacaagtctcagaagcctatgcaaatcagcacaattatgacattatgaaaaaacttggtttagataatggaagaatagcaaagataacacgaaatcaaatgactttcttgttcgcaataccaataacagtagcactgattcacacattaatttctagtaacattgtatatacgttactaaatatgataggtattaataaccatcatatatttttaacaagttacgtactagctgtcattataatttcgtttctatatatggcgatgtacaaaataacttcctatatttatgctaaagttattcatcaacaacgcaat

SEQ ID NO: 3860 - protein, 666 aa, Staphylococcus aureus
  MISC_FEATURE (1)..(666): hypothetical protein
MKLRLLWHIVRRQFITQRLVIIPFILAVSVLFMIEYTLVSIGLNSYIKQKNDFLVPFIIIANFFMALLTFIFIFYANHFMMSQRRKEFSIFMTLGMTKKSMRLIVVMETILQFVIISVVSIAGGYLLGAIFFLFIQKIMGSEVATLRYYPFDSVAMFITLIIIAVLMGMLLIFNLFSINFQRPITYQHRSDSSVISRWLRYVLIVIGSAALYLGYFIALQQDTTFGAFFKIWIVIGLVIIGTYAFFVGISEIIISILQQVSKVYYHPRYFFVVVGMRVRLKMNAVSLATITLLCTFLIVTLTMTLTTYRDMNHTITKLITNDYDLSFSDNSKSQIERQQTIENIKRDIQGSVNAKDFKVYETTLFRASLEKNRAYYKLKQASDDIPIDFIGNEGAIFSRQSVMITAFTAQDYNRYHQNKLHLDNQSIGMITNVPIFKKQSKVGLNNEVFKVKQLDAHALNLMMIQDSMVLIVKDNNQLQKVKGFYAHEQKNSTISINFNVFGKTKLTTSQIQKLSKKYDASINSKSEMLMVWDRLTGGLIFVGGVVSIVLVIGIFLMMYYKQVSEAYANQHNYDIMKKLGLDNGRIAKITRNQMTFLFAIPITVALIHTLISSNIVYTLLNMIGINNHHIFLTSYVLAVIIISFLYMAMYKITSYIYAKVIHQQRN

SEQ ID NO: 3861 - DNA, 762 bp, Staphylococcus aureus
gtgcatgccatgttgctagaagtgaaacatgtaaaaaaggtttatggtaaaggtttgaatgctacgacagcacttaatcaaatgaatttatcagttggagctggtgaatttgttgcaattatgggtgagtctgggtcagggaagtctacactactaaatttaattgcttcttttgatggactaactgaaggtgacattattgtggatggcgcacatttaaataatatgaaaaataaaagtaaagcattgtatcgtcaacaaatggtaggttttgtttttcaagattttaatcttttaccaacaatgacgaataaagaaaatataatgatgccattaattttagctggtgctaaacgaaaagatatagaacaaagggtacatcagttggcagtacaattacatttagagggattcttaaacaagtatccttctgaaatctctgggggtcagaagcaacgcattgccattgcacgtgcattagttactaagccgacgattttactagccgatgaacctacaggtgcacttgattcaaaaacatcaaaggcattgatgatgttatttcaagagattcatcaattggaacagacaattttaatggtaactcattcaaatatcgatgcgtcttatgcagagcgagtcatttttattaaagatgggcgtctatatcatgaaatatatcgtggtgaagaaagtcaattagcttttcaacaacgaataacagatagcttagcacttgtgaatggaggaagtgtcaatata

SEQ ID NO: 3862 - protein, 254 aa, Staphylococcus aureus
  MISC_FEATURE (1)..(254): hypothetical protein
VHAMLLEVKHVKKVYGKGLNATTALNQMNLSVGAGEFVAIMGESGSGKSTLLNLIASFDGLTEGDIIVDGAHLNNMKNKSKALYRQQMVGFVFQDFNLLPTMTNKENIMMPLILAGAKRKDIEQRVHQLAVQLHLEGFLNKYPSEISGGQKQRIAIARALVTKPTILLADEPTGALDSKTSKALMMLFQEIHQLEQTILMVTHSNIDASYAERVIFIKDGRLYHEIYRGEESQLAFQQRITDSLALVNGGSVNI

SEQ ID NO: 3863 - DNA, 948 bp, Staphylococcus aureus
ttggcgttaatgattttatcattacaaagaaaaatgtcggatataaagtatagggtgaatgcaatgacctttcttaaaagtattactcaggaaatagcaatagtcatagttatttttgctttgtttggcttaatgttttacctgtatcatttgccattagaagcatatttactagcacttggcgttattttattattattactcatattcataggtattaaatatttaagttttgtaaaaactataagccaacaacaacaaattgaaaacttagaaaatgcgttgtatcagcttaaaaatgaacaaattgaatataaaaatgatgtagagagctactttttaacatgggtacatcaaatgaaaacacccattactgcagcacaactgttacttgaaagagatgagcctaatgttgttaatcgtgttcgtcaagaggttattcaaattgataactatacaagtttagcacttagttatttaaagttattaaatgaaacttctgatatttctgtcactaaaatttcgattaataatatcattcgcccaattattatgaaatattcaatacagtttattgatcaaaaaacaaaaatccattatgaaccttgtcatcacgaagtattaactgacgttagatggacctctttaatgatagaacaattaataaataatgcacttaagtatgcgagaggtaaagatatatggattgaatttgatgagcaatccaatcaattacacgtaaaagataatggtatcggtattagtgaagcggacttgcctaaaatatttgataagggctattcaggttataatggccagcgccaaagtaactcaagtgggattggtttatttatcgtaaaacaaatttcaacacacacaaaccatcctgtttcagtcgtatctaaacaaaatgagggtacaacatttacgattcaatttccagatgaa

SEQ ID NO: 3864 - protein, 316 aa, Staphylococcus aureus
  MISC_FEATURE (1)..(316): hypothetical protein
LALMILSLQRKMSDIKYRVNAMTFLKSITQEIAIVIVIFALFGLMFYLYHLPLEAYLLALGVILLLLLIFIGIKYLSFVKTISQQQQIENLENALYQLKNEQIEYKNDVESYFLTWVHQMKTPITAAQLLLERDEPNVVNRVRQEVIQIDNYTSLALSYLKLLNETSDISVTKISINNIIRPIIMKYSIQFIDQKTKIHYEPCHHEVLTDVRWTSLMIEQLINNALKYARGKDIWIEFDEQSNQLHVKDNGIGISEADLPKIFDKGYSGYNGQRQSNSSGIGLFIVKQISTHTNHPVSVVSKQNEGTTFTIQFPDE

SEQ ID NO: 3865 - DNA, 663 bp, Staphylococcus aureus
atgaaaatattaattgttgaagatgattttgttatagcagagagtttagcatctgaacttaaaaaatggaattacggtgttattgtcgttgaacaatttgatgatatactgtctatctttaaccaaaatcaacctcagcttgtattgctagatattaatttgccaacgttaaatggttttcattggtgtcaagaaatccgaaaaacatctaatgtgccaattatatttattagttcccgtattgataatatggaccaaattatggcaatacaaatggggggagatgattttatcgaaaagccatttaacttgtcattaacgattgccaaaattcaagcattattgagacgaacttatgacttgtcagtagctaatgattcattgacggttaaaggttgtacattaatattagatgaagcaaaagtcgtgtatcaagaacaaaacatacagctatctttgactgaattacaaatattaaagttattatttcaaaatgaagataaatatgtaagtagaactgctttaattgaaaaatgttgggaatcagaaaacttcatagatgataacacattagctgttaacatgacgcgcctgcgtaaaaaattaaatactattggcgttaatgattttatcattacaaagaaaaatgtcggatataaagta

SEQ ID NO: 3866 - protein, 221 aa, Staphylococcus aureus
  MISC_FEATURE (1)..(221): hypothetical protein
MKILIVEDDFVIAESLASELKKWNYGVIVVEQFDDILSIFNQNQPQLVLLDINLPTLNGFHWCQEIRKTSNVPIIFISSRIDNMDQIMAIQMGGDDFIEKPFNLSLTIAKIQALLRRTYDLSVANDSLTVKGCTLILDEAKVVYQEQNIQLSLTELQILKLLFQNEDKYVSRTALIEKCWESENFIDDNTLAVNMTRLRKKLNTIGVNDFIITKKNVGYKV

SEQ ID NO: 3867 - DNA, 198 bp, Staphylococcus aureus
atgatactagtaatgttatctccattattaatcatattctttatagtgttgtctattttagaagagcgtaaacgtacgaagaaaaagcaactcgagaaagaaaaagcaaatacactaaatcaaaatacaaatgacacggaaagttcaaatcaagagccgtcattgcagcaggataaagaacaaaaagataacaaagga

SEQ ID NO: 3868 - protein, 66 aa, Staphylococcus aureus
  MISC_FEATURE (1)..(66): hypothetical protein
MILVMLSPLLIIFFIVLSILEERKRTKKKQLEKEKANTLNQNTNDTESSNQEPSLQQDKEQKDNKG

SEQ ID NO: 3869 - DNA, 1422 bp, Staphylococcus aureus
atgttatcagttaaaaaagccacaaaatttgcagttgctaaccttattatcgtgtcaacggtttttagttctgtcacacctgcaattgcgcaatccgataaaagttctaaagatgaaagtttcgcggttggtaatactaaaaatccaaaaaatgttatctttttagttggcgatggcatgggtccatcatttaacacagcttatcgttattataaaaatgatccgcatgctaaagaaatgacccctactgcttttgattcatatttaaaaggcacaaatcgtacatattcaaatgacccaaaacagaatattactgattctgcagctggcggaacagcctttagttctggtcataagacatataatggtgccatcggtgttgacagtaacaagcagaaagtaaagacggtgcttgaacgtgcaaaagaaaaaggtaagtcgactggtcttgtttcaacagctgaattaacagatgcaacaccagcagcatatgctgcacacgtgacttctagagatgataaaaacgaaatcgctaaacaattttataaagataaaatcaacggaaagcataaagttgatgttttattaggcggcggcgctaaatatttcggtaaaagtaatggcaatttagataaaaaattcaaaaaagatggttacgaccttgccacgaacagtaaggagttatcaaaatctgataaagataaagttcttggtttgtttgcagataaaaatatgccacttgcaatagatgcttctaaagacgaaccatcattagctgatatgcaacaaagtgcacttagtaagcttgagcgcaataaaaaaggattctttttaatggtcgaaggtgcttctatagataaatcagcgcattccaacgatattacaggcgttatgtctgaaatggaaggttttgaaaaagcattcgatgacgccattcaatatgctaagaaacataaagatacacttgtcgttgcaacagcagatcactctactggtggtctaacaattggtaaagataaaggatacgaatggaatcctcaaccgattaaatctatgaaacactctggatcatatatgacagaaaaaatggctaaaggtgaagaccctgaaaaagttattaatgaaggttatggatttgaattttcacaagatgatatgaaaaaggttaaaaaagagaataaaaagctaaaaagactacttaaaaaagaaaaagacgaaaaatccgcagaagtagaaacgcaaacaaaagccctacaacacgctattcagaagccagtaaatgataaatcttatacagggtggacttccgatggacatacaggcgaggatgttaatacctacgcttacggacctagatcagaatcatttagtggtaatatcgaaaatacagaaagcgcaaaaataatatttgatatattcaag

SEQ ID NO: 3870 - protein, 474 aa, Staphylococcus aureus
  MISC_FEATURE (1)..(474): alkaline phosphatase III
MLSVKKATKFAVANLIIVSTVFSSVTPAIAQSDKSSKDESFAVGNTKNPKNVIFLVGDGMGPSFNTAYRYYKNDPHAKEMTPTAFDSYLKGTNRTYSNDPKQNITDSAAGGTAFSSGHKTYNGAIGVDSNKQKVKTVLERAKEKGKSTGLVSTAELTDATPAAYAAHVTSRDDKNEIAKQFYKDKINGKHKVDVLLGGGAKYFGKSNGNLDKKFKKDGYDLATNSKELSKSDKDKVLGLFADKNMPLAIDASKDEPSLADMQQSALSKLERNKKGFFLMVEGASIDKSAHSNDITGVMSEMEGFEKAFDDAIQYAKKHKDTLVVATADHSTGGLTIGKDKGYEWNPQPIKSMKHSGSYMTEKMAKGEDPEKVINEGYGFEFSQDDMKKVKKENKKLKRLLKKEKDEKSAEVETQTKALQHAIQKPVNDKSYTGWTSDGHTGEDVNTYAYGPRSESFSGNIENTESAKIIFDIFK

SEQ ID NO: 3871 - DNA, 453 bp, Staphylococcus aureus
ttggagaggaaaatgaggacacttaataaagatgaacataattatatcaagcaaatagctaatatacatgagacattattgtcgcaagtagaatccaactataaatgtactaaactgagtattgctcttaggtacgagatgatatgttcaagattagaacatacaaatgataaaatttatatatatgaaaatgaaggtcaattaatagcgtttatttggggacattttagtaatgaaaaaagtatggttaacattgaactgctatatgttgaaccacaatttcgcaaactgggaatagctacgcaactgaagattgcgcttgaaaaatgggcaaaaactatgaatgcaaagcgaataagcaatacaattcataaaaataatttgccaatgatatctttgaataaagatttaggttatcaagtgagtcatgtgaaaatgtataaagatattgat

SEQ ID NO: 3872 - protein, 151 aa, Staphylococcus aureus
  MISC_FEATURE (1)..(151): hypothetical protein
LERKMRTLNKDEHNYIKQIANIHETLLSQVESNYKCTKLSIALRYEMICSRLEHTNDKIYIYENEGQLIAFIWGHFSNEKSMVNIELLYVEPQFRKLGIATQLKIALEKWAKTMNAKRISNTIHKNNLPMISLNKDLGYQVSHVKMYKDID

SEQ ID NO: 3873 - DNA, 687 bp, Staphylococcus aureus
atgaaaagtactgcgcaattaacaaaagaaaataatgttaaatcattaagattaagcaatactgatagagaaatcttcgagaattatatgacttatatgcgctctgactttcgcgtcaaccctcatgatacagagttaattattaaccgtatactcaaacaattattaagcgcagaacaacatggtttattagccttagattttttcaatcacgacccaaaagcacatgcaataaaagaactaaaagcgatgcctaatgaaacatttaaaaatatttttaaatatatctatcaacacatcgttctattaattgggattgttagttttctcaaaggatttttaggatttttcatggaaaaaaatggaagtaatttatattttgtttcattcccgttttcagtagtcgttggattctttattgtctttttatttatatggtttagttttaaaacaatacaactgcagtgttttaacaattcaaattggatatggatattcacctatttagcaatcattctactaattgtaggatttttctatgtattctttattccacaatcattacttgcctttggaccatatattcaggtaagcaattgggtatttattatattttcatttatagttatgcctattggattacgcattgaaagaaatatttcgaaaaaacattctcatacattttta

SEQ ID NO: 3874 - protein, 229 aa, Staphylococcus aureus
  MISC_FEATURE (1)..(229): conserved hypothetical
MKSTAQLTKENNVKSLRLSNTDREIFENYMTYMRSDFRVNPHDTELIINRILKQLLSAEQHGLLALDFFNHDPKAHAIKELKAMPNETFKNIFKYIYQHIVLLIGIVSFLKGFLGFFMEKNGSNLYFVSFPFSVVVGFFIVFLFIWFSFKTIQLQCFNNSNWIWIFTYLAIILLIVGFFYVFFIPQSLLAFGPYIQVSNWVFIIFSFIVMPIGLRIERNISKKHSHTFL

SEQ ID NO: 3875 - DNA, 102 bp, Staphylococcus aureus
atgatgaaaaaattagcagttattttaacattagttggcggtttatacttcgcatttaaaaaataccaagaacgtgttaaccaagcacctaacattgagtac

SEQ ID NO: 3876 - protein, 34 aa, Staphylococcus aureus
MMKKLAVILTLVGGLYFAFKKYQERVNQAPNIEY

SEQ ID NO: 3877 - DNA, 108 bp, Staphylococcus aureus
atgttaggtgcttggttaacacgttcttggtattttttaaatgcgaagtataaaccgccaactaatgttaaaataactgctaattttttcatcattcaaactcctttc

SEQ ID NO: 3878 - protein, 36 aa, Staphylococcus aureus
MLGAWLTRSWYFLNAKYKPPTNVKITANFFIIQTPF

SEQ ID NO: 3879 - DNA, 453 bp, Staphylococcus aureus
atgtcgaccaataaaaacgattatgagcatatgttgttttattttgcatataaaacctttattactaccgctgatgaaattatagagaagtatggtatgagtcgtcagcatcatcgttttttgttttttatcaataaattacctggtattactattaaatcattactagaaatattagaaatttctaaacaaggatcacatgcaacacttcaaaaattaaaagagcaaggtctcattattgaaaaagttttagagactgatcgacgtgtcaaaaaattatattcgacggataaaggcgatcaactcattgctgaattgaacaaggcgcaagatgaattattgcaaaatatatatcaacaagtcggttcggattggtatgatgtgatggaagcattggctaaagggcgacctggctttgattttattaagcatttgaaagatgaaaaagaaagc

SEQ ID NO: 3880 - protein, 151 aa, Staphylococcus aureus
  MISC_FEATURE (1)..(151): hypothetical protein
MSTNKNDYEHMLFYFAYKTFITTADEIIEKYGMSRQHHRFLFFINKLPGITIKSLLEILEISKQGSHATLQKLKEQGLIIEKVLETDRRVKKLYSTDKGDQLIAELNKAQDELLQNIYQQVGSDWYDVMEALAKGRPGFDFIKHLKDEKES

SEQ ID NO: 3881 - DNA, 759 bp, Staphylococcus aureus
atggcttatatttcattaaactatcattcaccaacaattggtatgcatcaaaatttgacagtcattttaccggaagatcaaagcttctttaatagcgatacaactgttaaaccattaaaaactttaatgttgttacatggattatcaagtgatgaaacgacatatatgagatatacaagcatagaaaggtatgcgaatgaacacaaattagctgtgattatgcccaatgtggatcatagcgcatatgctaacatggcatatggtcatagctattatgattatattttggaagtgtatgattatgttcatcaaatatttccactttccaaaaagcgtgatgacaattttatagcaggtcactctatgggaggatatggcacaattaaatttgcattaacacaaggggataaatttgccaaagctgtaccattatctgctgtgtttgaagcgcaaaatttaatggatctagagtggaatgatttttcaaaagaggccataattggcaatctttcaagtgttaaaggaactgaacatgatccgtattacttgctagacaaagctgtagctgaagataaacaaattccaaaattgctcattatgtgtggtaaacaagactttttatatcaagacaacttagattttatcgattatttatcacgcataaatgttccttatcaatttgaagatggaccaggagatcatgattatgcatattgggatcaagcgattaagcgtgctataacatggatggtgaatgat

SEQ ID NO: 3882 - protein, 253 aa, Staphylococcus aureus
  MISC_FEATURE (1)..(253): hypothetical protein
MAYISLNYHSPTIGMHQNLTVILPEDQSFFNSDTTVKPLKTLMLLHGLSSDETTYMRYTSIERYANEHKLAVIMPNVDHSAYANMAYGHSYYDYILEVYDYVHQIFPLSKKRDDNFIAGHSMGGYGTIKFALTQGDKFAKAVPLSAVFEAQNLMDLEWNDFSKEAIIGNLSSVKGTEHDPYYLLDKAVAEDKQIPKLLIMCGKQDFLYQDNLDFIDYLSRINVPYQFEDGPGDHDYAYWDQAIKRAITWMVND

SEQ ID NO: 3883 - DNA, 2631 bp, Staphylococcus aureus
ttgaaaaaaagaattgattatttgtcgaataagcagaataagtattcgattagacgttttacagtaggtaccacatcagtaatagtaggggcaactatactatttgggataggcaatcatcaagcacaagcttcagaacaatcgaacgatacaacgcaatcttcgaaaaataatgcaagtgcagattccgaaaaaaacaatatgatagaaacacctcaattaaatacaacggctaatgatacatctgatattagtgcaaacacaaacagtgcgaatgtagatagcacaacaaaaccaatgtctacacaaacgagcaataccactacaacagagccagcttcaacaaatgaaacacctcaaccgacggcaattaaaaatcaagcaactgctgcaaaaatgcaagatcaaactgttcctcaagaagcaaattctcaagtagataataaaacaacgaatgatgctaatagcatagcaacaaacagtgagcttaaaaattctcaaacattagatttaccacaatcatcaccacaaacgatttccaatgcgcaaggaactagtaaaccaagtgttagaacgagagctgtacgtagtttagctgttgctgaaccggtagtaaatgctgctgatgctaaaggtacaaatgtaaatgataaagttacggcaagtaatttcaagttagaaaagactacatttgaccctaatcaaagtggtaacacatttatggcggcaaattttacagtgacagataaagtgaaatcaggggattattttacagcgaagttaccagatagtttaactggtaatggagacgtggattattctaattcaaataatacgatgccaattgcagacattaaaagtacgaatggcgatgttgtagctaaagcaacatatgatatcttgactaagacgtatacatttgtctttacagattatgtaaataataaagaaaatattaacggacaattttcattacctttatttacagaccgagcaaaggcacctaaatcaggaacatatgatgcgaatattaatattgcggatgaaatgtttaataataaaattacttataactatagttcgccaattgcaggaattgataaaccaaatggcgcgaacatttcttctcaaattattggtgtagatacagcttcaggtcaaaacacatacaagcaaacagtatttgttaaccctaagcaacgagttttaggtaatacgtgggtgtatattaaaggctaccaagataaaatcgaagaaagtagcggtaaagtaagtgctacagatacaaaactgagaatttttgaagtgaatgatacatctaaattatcagatagctactatgcagatccaaatgactctaaccttaaagaagtaacagaccaatttaaaaatagaatctattatgagcatccaaatgtagctagtattaaatttggtgatattactaaaacatatgtagtattagtagaagggcattacgacaatacaggtaagaacttaaaaactcaggttattcaagaaaatgttgatcctgtaacaaatagagactacagtattttcggttggaataatgagaatgttgtacgttatggtggtggaagtgctgatggtgattcagcagtaaatccgaaagacccaactccagggccgccggttgacccagaaccaagtccagacccagaaccagaaccaacgccagatccagaaccaagtccagacccagaaccggaaccaagcccagacccggatccggattcggattcagacagtgactcaggctcagacagcgactcaggttcagatagcgactcagaatcagatagcgattcggattcagacagtgattcagattcagacagcgactcagaatcagatagcgactcagaatcagatagtgagtcagattcagacagtgactcggactcagacagtgattcagactcagatagcgattcagactcagatagcgattcagactcagacagcgattcagattcagacagcgactcagattcagacagcgactcagactcagatagcgactcagactcagacagcgactcagattcagatagcgattcagactcagacagcgactcagactcagacagcgactcagactcagatagcgactcagattcagatagcgattcagactcagacagcgactcagattcagatagcgattcggactcagacagcgattcagattcagacagcgactcagactcggatagcgattcagattcagatagcgattcggattcagacagtgattcagattcagacagcgactcagactcggatagcgactcagactcagacagcgattcagactcagatagcgactcagactcggatagcgactcggattcagatagcgactcagactcagatagtgactccgattcaagagttacaccaccaaataatgaacagaaagcaccatcaaatcctaaaggtgaagtaaaccattctaataaggtatcaaaacaacacaaaactgatgctttaccagaaacaggagataagagcgaaaacacaaatgcaactttatttggtgcaatgatggcattattaggatcattactattgtttagaaaacgcaagcaagatcataaagaaaaagcg

SEQ ID NO: 3884 - protein, 877 aa, Staphylococcus aureus
  MISC_FEATURE (1)..(877): Clumping factor B
LKKRIDYLSNKQNKYSIRRFTVGTTSVIVGATILFGIGNHQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNATLFGAMMALLGSLLLFRKRKQDHKEKA

SEQ ID NO: 3885 - DNA, 702 bp, Staphylococcus aureus
atgacagaaaactttattttgggtagaaataataaattagaacatgaactaaaggcattagcagattacattaatataccatatagtatattacaaccatatcaaagtgaatgttttgtcagacattatacgaaaggccaagttatttatttttcgccacaagaaagtagcaatatttactttttaattgaaggtaacattattagagaacattacaatcaaaatggagatgtatatcgttattttaataaagagcaagtattatttccaatcagtaacttatttcatccgaaagaggttaacgaattgtgtacagcattaaccgattgtacagttcttggattgcctagagaattgatggcctttttgtgcaaagctaatgatgatatatttttgacactttttgcattaataaatgataatgagcagcaacacatgaactataacatggcattaacaagtaaatttgctaaagatcgaattatcaaattgatatgccatctatgtcagacagtaggatacgatcaagatgaattttatgaaatcaaacagtttttaactattcaactcatgagtgatatggctgggatttcccgggaaacagctggtcatattattcatgaacttaaagatgaaaaacttgttgttaaagatcataaaaattggttagtaagcaaacatttattcaatgatgtatgtgtt

SEQ ID NO: 3886 - protein, 234 aa, Staphylococcus aureus
  MISC_FEATURE (1)..(234): hypothetical protein
MTENFILGRNNKLEHELKALADYINIPYSILQPYQSECFVRHYTKGQVIYFSPQESSNIYFLIEGNIIREHYNQNGDVYRYFNKEQVLFPISNLFHPKEVNELCTALTDCTVLGLPRELMAFLCKANDDIFLTLFALINDNEQQHMNYNMALTSKFAKDRIIKLICHLCQTVGYDQDEFYEIKQFLTIQLMSDMAGISRETAGHIIHELKDEKLVVKDHKNWLVSKHLFNDVCV

SEQ ID NO: 3887 - DNA, 966 bp, Staphylococcus aureus
atgttttttaaaaggagcgacaaaaatatgaaagagaaaattgtcattgcattaggcggtaatgcgatacagacaacagaagcaacagctgaagcacaacaaacagctattagatgtgcgatgcaaaaccttaaacctttatttgattcaccagcgcgtattgtcatttcacatggtaatggtccacaaattggaagtttattaatccaacaagctaaatcgaacagtgacacaacgccggcaatgccattggatacttgtggtgcaatgtcacagggtatgataggctattggttggaaactgaaatcaatcgcattttaactgaaatgaatagtgatagaactgtaggcacaatcgttacacgtgtggaagtagataaagatgatccacgatttgataacccaactaaaccaattggtcctttttatacgaaagaagaagttgaagaattacaaaaagaacagccagactcagtctttaaagaagatgcaggacgtggttatagaaaagtagttgcgtcaccactacctcaatctatactagaacaccagttaattcgaactttagcagacggtaaaaatattgtcattgcatgcggtggtggcggtattccagttataaaaaaagaaaatacctatgaaggtgttgaagcggttatagataaagattttgctagtgagaaattagcaacgctgattgaagcagataccttaatgattcttacgaatgtagaaaatgtatttattaactttaatgaacctaatcaacaacaaatcgatgatattgatgtagcaacactgaaaaaatacgcggcacaaggtaagtttgtggaaggatcgatgttgccaaaaatagaagctgcgatacgatttgttgaaagtggggaaaacaaaaaagttatcattaccaatttagagcaggcatacgaagctttgattggtaataaaggtacacacattcacatg

SEQ ID NO: 3888 - protein, 322 aa, Staphylococcus aureus
  MISC_FEATURE (1)..(322): carbamate kinase
MFFKRSDKNMKEKIVIALGGNAIQTTEATAEAQQTAIRCAMQNLKPLFDSPARIVISHGNGPQIGSLLIQQAKSNSDTTPAMPLDTCGAMSQGMIGYWLETEINRILTEMNSDRTVGTIVTRVEVDKDDPRFDNPTKPIGPFYTKEEVEELQKEQPDSVFKEDAGRGYRKVVASPLPQSILEHQLIRTLADGKNIVIACGGGGIPVIKKENTYEGVEAVIDKDFASEKLATLIEADTLMILTNVENVFINFNEPNQQQIDDIDVATLKKYAAQGKFVEGSMLPKIEAAIRFVESGENKKVIITNLEQAYEALIGNKGTHIHM

SEQ ID NO: 3889 - DNA, 1434 bp, Staphylococcus aureus
atgaatatgaacgaatcaggagataacaaactcagtaaatcttctttaattggactagttataggatccatgattggtggcggtgcgttcaatataatgtctgatatgggcggtaaagccggtggattagccattattattggttggattattacagctataggaatgatttcattagcgttcgtatttcaaaatttaaccaatgaacggccggagctagacggtggtatttatagttatgctcaagcaggatttggcgattttgtaggatttatcagtgcttggggatattggttctcagcgtttttaggcaatgttgcctatgcaacactattgatgtcagcagtaggtaactttttcccgatttttaaaggaggcaacacattaccaagtgttattgtcgcctcgttactactctggggtgtccatttcttgattttaaaaggcgttgaaacagcagcatttatcaatagtattgttactgttgcaaagttaataccgattttacttgtaatcatatgcatgataattgcattcaattttgacacttttaaaacaggctttttcagtatgacgtcagagggtgtattgccatttagttgggcgagcacaatgagccaagttaaaagtacgatgctagtgacagtttgggtgtttatcggtatcgaaggtgcagtaattttttctagtagagctaaaaataaaaaagatgtaggtagtgccacggttataggacttatatcagttttaattatctatttcttattaactgtattagctcaaggcgtgattttgcaaaatcatatttcgcaattagattcgccaagtatggcacaggtgcttgcaactattgtaggtggttggggatctacacttgtaaatattggtttaattatttcggtactaggtgcatggttaggatggacactgcttgctggtgaattacctttcattgttgcaaaagatggattatttccaaaatggtttgctaaagaaaataaaaatggagcacctgtaaatgcactgcttattaccaatatattagtacaattatttttaataagtatgctatttacacagagtgcgtatcaatttgcattttcactagcatcaagtgctattttatacccttacatgttcagtgcattttaccaagttaaatacactttagagcatcgacagcaagcaactactaaacaatggacgattggtatcatagcctcaatttatgctatatggcttatatatgcagcaggtatcaattacttattattgacgatgttactttatattccagctcttcttgtttatacaatcgttcaaaagaataatcagacacgtttgattaaatcagactatattctttttatgattattatcgtacttgcagttatcgggttaattaagttattgatgggaacgataaatgttttt

SEQ ID NO: 3890 - protein, 478 aa, Staphylococcus aureus
  MISC_FEATURE (1)..(478): arginine/oirnithine
MNMNESGDNKLSKSSLIGLVIGSMIGGGAFNIMSDMGGKAGGLAIIIGWIITAIGMISLAFVFQNLTNERPELDGGIYSYAQAGFGDFVGFISAWGYWFSAFLGNVAYATLLMSAVGNFFPIFKGGNTLPSVIVASLLLWGVHFLILKGVETAAFINSIVTVAKLIPILLVIICMIIAFNFDTFKTGFFSMTSEGVLPFSWASTMSQVKSTMLVTVWVFIGIEGAVIFSSRAKNKKDVGSATVIGLISVLIIYFLLTVLAQGVILQNHISQLDSPSMAQVLATIVGGWGSTLVNIGLIISVLGAWLGWTLLAGELPFIVAKDGLFPKWFAKENKNGAPVNALLITNILVQLFLISMLFTQSAYQFAFSLASSAILYPYMFSAFYQVKYTLEHRQQATTKQWTIGIIASIYAIWLIYAAGINYLLLTMLLYIPALLVYTIVQKNNQTRLIKSDYILFMIIIVLAVIGLIKLLMGTINVF

SEQ ID NO: 3891 - DNA, 1017 bp, Staphylococcus aureus
gtgaaaataatgacagaaattcaaaaaccgtatgatttaaaaggcagatcattattaaaagaaagtgattttaccaaagcagaattcgaaggacttattgattttgcaattacattaaaagagtataagaaaaacggtattaagcatcactacttatctggaaaaaatattgcactactattcgaaaagaattcgacgagaacgcgtgctgcgtttacagttgcgtctattgatttaggtgcgcatccagaatttttaggaaaaaatgatattcaattaggcaaaaaagaatctgtagaggatactgcgaaagtattaggtagaatgttcgatggtattgaattccgtggtttttcacaacaagctgttgaagatttagcgaagttctctggtgtaccggtgtggaatggattaacagacgattggcatcctacacaaatgttagctgattttatgacaataaaagagaattttggatatctagaaggaataaacttaacttacgttggagatggacgtaataatattgcgcattcattaatggtagcaggtgctatgttaggtgttaatgtaagaatttgtacacctaaatcattaaatccaaaagaggcatatgttgatattgcaaaagaaaaagcgagtcaatatggtggttcagtcatgattacggataatattgcagaagcagttgaaaatacagatgctatatatacagatgtttgggtatcgatgggtgaagaaagtgaatttgaacaacgtattaatttattaaaagactatcaagtgaatcaacagatgtttgatttaacaggtaaagattcaacgatattcttacattgtttaccagcattccatgatacaaatacactttatggacaagaaatttatgaaaaatatggattagctgaaatggaagttacagaccaaatctttagaagtgaacattcaaaagtgtttgatcaagctgaaaatagaatgcatacaattaaggcagtaatggcagcaacattggggagt

SEQ ID NO: 3892 - protein, 339 aa, Staphylococcus aureus
  MISC_FEATURE (1)..(339): ornithine transcarbamoylase
VKIMTEIQKPYDLKGRSLLKESDFTKAEFEGLIDFAITLKEYKKNGIKHHYLSGKNIALLFEKNSTRTRAAFTVASIDLGAHPEFLGKNDIQLGKKESVEDTAKVLGRMFDGIEFRGFSQQAVEDLAKFSGVPVWNGLTDDWHPTQMLADFMTIKENFGYLEGINLTYVGDGRNNIAHSLMVAGAMLGVNVRICTPKSLNPKEAYVDIAKEKASQYGGSVMITDNIAEAVENTDAIYTDVWVSMGEESEFEQRINLLKDYQVNQQMFDLTGKDSTIFLHCLPAFHDTNTLYGQEIYEKYGLAEMEVTDQIFRSEHSKVFDQAENRMHTIKAVMAATLGS

SEQ ID NO: 3893 - DNA, 1233 bp, Staphylococcus aureus
atgacagatggtccaattaaagtaaatagcgaaattggagctttaaaaactgtgttacttaagcgtcctggaaaagaattagaaaatttagtacctgattatttagatggattactatttgatgatattccatatttagaagtagctcaaaaagagcatgaccattttgcgcaggtgctaagagaagagggtgttgaagtactttaccttgagaagttagcagctgaaagtattgaaaatcctcaagtaagaagtgaatttattgatgatgtattagcagagtctaaaaaaacaatattaggtcatgaagaagaaattaaggcattatttgcgacactttctaatcaagaacttgtagataaaataatgtcaggggtacgtaaggaagaaattaatccgaaatgtacacatctagtagagtatatggatgataagtatccattctatttagatccaatgccaaacctttattttactagagatccacaagcctcaataggacacggtataacaatcaatcggatgttctggagagcacgacgacgagaatcaatatttattcaatatattgtaaagcatcatcctagatttaaagatgcgaatattccaatctggttagatcgagattgcccattcaatattgaaggcggcgatgaacttgttttatctaaagatgtcttggctataggcgtttcagaacgtacatctgcacaagctattgaaaagttagcgcgacgtatttttgaaaatccgcaggcgacgtttaaaaaagtagtagcaattgaaattccaactagtcgaacttttatgcacttagatacagtatttacaatgatagattatgacaaatttacaatgcattcagccattttaaaggcagaaggcaatatgaatatatttattattgaatatgatgacgtaaataaagatattgccatcaaacaatctagtcatttaaaagatactttagaagacgtactaggtatagatgatatccaattcattccaacaggaaatggtgatgtcattgatggtgctagagagcaatggaatgatggctcaaatacattatgtataagaccaggcgttgtagtgacttacgatagaaactatgtatcgaatgatttattgagacaaaaaggcattaaagtcattgaaatatctggtagcgagttggtacgtggacgtgggggccctagatgtatgagtcaaccattattcagagaggacatt

SEQ ID NO: 3894 - protein, 411 aa, Staphylococcus aureus
  MISC_FEATURE (1)..(411): arginine deiminase
MTDGPIKVNSEIGALKTVLLKRPGKELENLVPDYLDGLLFDDIPYLEVAQKEHDHFAQVLREEGVEVLYLEKLAAESIENPQVRSEFIDDVLAESKKTILGHEEEIKALFATLSNQELVDKIMSGVRKEEINPKCTHLVEYMDDKYPFYLDPMPNLYFTRDPQASIGHGITINRMFWRARRRESIFIQYIVKHHPRFKDANIPIWLDRDCPFNIEGGDELVLSKDVLAIGVSERTSAQAIEKLARRIFENPQATFKKVVAIEIPTSRTFMHLDTVFTMIDYDKFTMHSAILKAEGNMNIFIIEYDDVNKDIAIKQSSHLKDTLEDVLGIDDIQFIPTGNGDVIDGAREQWNDGSNTLCIRPGVVVTYDRNYVSNDLLRQKGIKVIEISGSELVRGRGGPRCMSQPLFREDI

SEQ ID NO: 3895 - DNA, 498 bp, Staphylococcus aureus
atgaatttattttttaatacaagaaacgtaactaccaaaggagtttacaatatgaagaaaagtaaacgattagaaattgtttctacaatagttaaaaagcataagatttataaaaaagaacaaatcatttcatatattgaagaatattttggtgtaagatatagtgcaacaacaattgctaaagacttgaaggaactaaatatatatcgtgtccctatcgattgtgagacatggatttataaagctattaataatcaaacagaacaagagatgagagaaaagtttagacactattgtgaacatgaagttctaagttcaatcatcaatggttcatacattatcgtcaaaacctcacctggtttcgcccaaggcataaactattttatcgatcagctaaatatagaagagatattaggtacggtgagtggaaatgacactacattaatcttaactgcctcaaatgatatggcagaatacgtatatgcaaaattatttaaa

SEQ ID NO: 3896 - protein, 166 aa, Staphylococcus aureus
  MISC_FEATURE (1)..(166): hypothetical protein
MNLFFNTRNVTTKGVYNMKKSKRLEIVSTIVKKHKIYKKEQIISYIEEYFGVRYSATTIAKDLKELNIYRVPIDCETWIYKAINNQTEQEMREKFRHYCEHEVLSSIINGSYIIVKTSPGFAQGINYFIDQLNIEEILGTVSGNDTTLILTASNDMAEYVYAKLFK

SEQ ID NO: 3897 - DNA, 1527 bp, Staphylococcus aureus
gtgaggaaattttcaagatatgcatttacaagtatggcagcattaaccttgttgagcactttatcaccagcagcattagcgattgattcaaaaaataaaccagctaattctgatattaaatttgaggtgactcaaaagagtgatgcggtcaaagcattaaaagaattgcctaaatccgaaaatgtaaaaaatatttatcaagattacgctgttactgatgtaaaaactgataaaaaaggatttacgcattatacattgcaaccgagtgttgatggtgttcatgcacctgacaaagaagtgaaagtacacgcagacaaatcaggaaaagtcgttttaatcaatggggatactgatgcgaagaaagtaaagccaacgaataaagtgacattaagtaaagatgacgcagccgacaaagcatttaaagcagttaagattgataagaataaagcgaaaaatcttaaagataaagtcattaaagaaaacaaagttgaaatcgatggtgacagtaataaatacgtttataatgttgagttaattacagtgacaccagaaatttcacattggaaagttaaaattgatgctcaaactggcgaaattttagaaaaaatgaacttagttaaagaagctgcagaaactggtaaaggaaaaggtgtacttggcgatacaaaagatatcaatatcaatagtattgacggtggatttagcctagaagatttaacgcatcaaggtaaattatcagcatttagctttaatgatcaaacaggtcaagcaacattgattactaatgaagatgaaaacttcgtaaaagatgagcaacgtgctggcgtagatgcaaattattacgctaaacaaacatatgattattacaaagacacatttggtcgtgaatcatatgacaaccaaggtagtccaattgtttcattaacgcatgttaataactacggtggtcaagataacagaaataatgccgcatggatcggtgacaaaatgatctatggtgatggtgatggtcgcacattcacaagtttatcgggtgcaaatgacgtagtagcacacgaattaacacacggtgtgacacaagagacagcgaacttagaatataaggaccagtcaggcgctctaaatgaaagcttttcagatgtttttggatactttgtagatgacgaggatttcttaatgggtgaagatgtctacacacctggaaaagagggagacgctttacgcagcatgtcaaacccagaacaatttggtcaaccagctcatatgaaagactatgtattcactgaaaaagataatggtggcgtacatacgaattctggaattccaaataaagcagcttataacgtgattcaagcaatagggaaatctaaatcagaacaaatttactaccgagcattaacggaatacttaacaagtaattcaaacttcaaagattgtaaagatgcattataccaagcggctaaagatttatatgacgagcaaacagctgaacaggtgtatgaagcatggaatgaagtaggcgtggag

SEQ ID NO: 3898 - protein, 509 aa, Staphylococcus aureus
  MISC_FEATURE (1)..(509): zinc metalloproteinase
VRKFSRYAFTSMAALTLLSTLSPAALAIDSKNKPANSDIKFEVTQKSDAVKALKELPKSENVKNIYQDYAVTDVKTDKKGFTHYTLQPSVDGVHAPDKEVKVHADKSGKVVLINGDTDAKKVKPTNKVTLSKDDAADKAFKAVKIDKNKAKNLKDKVIKENKVEIDGDSNKYVYNVELITVTPEISHWKVKIDAQTGEILEKMNLVKEAAETGKGKGVLGDTKDININSIDGGFSLEDLTHQGKLSAFSFNDQTGQATLITNEDENFVKDEQRAGVDANYYAKQTYDYYKDTFGRESYDNQGSPIVSLTHVNNYGGQDNRNNAAWIGDKMIYGDGDGRTFTSLSGANDVVAHELTHGVTQETANLEYKDQSGALNESFSDVFGYFVDDEDFLMGEDVYTPGKEGDALRSMSNPEQFGQPAHMKDYVFTEKDNGGVHTNSGIPNKAAYNVIQAIGKSKSEQIYYRALTEYLTSNSNFKDCKDALYQAAKDLYDEQTAEQVYEAWNEVGVE

SEQ ID NO: 3899 - DNA, 525 bp, Staphylococcus aureus
atgaataaaaccagtaaagtttgtgtagcagcaacattagcattgggcacactgattggagtaacagttgttgaaaattcggcgccaacaagtaaacaggcacaggcagcaataaccccatattatacttataatggttatattggtaataatgctaattttattctggataagaattttattaacgcgattaagtatgataatgtgaaattcaatggtattaaattagctaaaacgaatacgataaaaaaagtagagaaatatgatcaaacttttaaaggtgtttctgcaaaaggaaacgaagcaagtcaattgcaatttgtagttaaaaataatatttcattaaaagatatccaaaaagcttatggcaaggacttgaaaaaagaaaatggtaaaacaaaggaagctgatagcggtattttttactatcaaaatgctaaaaagacattaggcatctggtttgtcgttgatcataatagagttgtcgaagtaacagttggacatacaccatacaaaacaagtaaa

SEQ ID NO: 3900 - protein, 175 aa, Staphylococcus aureus
  MISC_FEATURE (1)..(175): immunodominant antigen B
MNKTSKVCVAATLALGTLIGVTVVENSAPTSKQAQAAITPYYTYNGYIGNNANFILDKNFINAIKYDNVKFNGIKLAKTNTIKKVEKYDQTFKGVSAKGNEASQLQFVVKNNISLKDIQKAYGKDLKKENGKTKEADSGIFYYQNAKKTLGIWFVVDHNRVVEVTVGHTPYKTSK

SEQ ID NO: 3901 - DNA, 471 bp, Staphylococcus aureus
atggaggcgttatatttgaaaaaacttcttattaccatcgtaattatcgtattaatcggagcacttgggttcgcaatttatgctgcaataaatcattctacatcatcaagtaataaccaagaacaagaaaataaatctacgcataaaaagacagaaaccgaagaaaatgatcaacaagatgatagtgcagacaaaacagataaaaatcaaaataatggcaataacgttactaatgacaatcaaccatcttcaccgtcaaatgttcctaacaaccattcaacagtaccatcgaatacgcaaccagctcagccaaaagactcaaattcaaataaaaataatactcacggtggtggcagtcaatcgtcaacaaacaaccaaaataatcaacaacagaacacaccacctgctaataaatcaaataataccaatacgccttctaaacaaacacctcaagcacaatcacctaaaaat

SEQ ID NO: 3902 - protein, 157 aa, Staphylococcus aureus
  MISC_FEATURE (1)..(157): conserved hypothetical
MEALYLKKLLITIVIIVLIGALGFAIYAAINHSTSSSNNQEQENKSTHKKTETEENDQQDDSADKTDKNQNNGNNVTNDNQPSSPSNVPNNHSTVPSNTQPAQPKDSNSNKNNTHGGGSQSSTNNQNNQQQNTPPANKSNNTNTPSKQTPQAQSPKN

SEQ ID NO: 3903 - DNA, 1872 bp, Staphylococcus aureus
atgcttgatagacacttaaaactactccagttttttattaaaaatccatcaaagcacattagttctaatgaaattgctaaacatgtcaatgtttcaaaccgcacagttcgcaatgatatccatgttatcaatagcaattttatggatgatatcatcgtaagtattaaatctaaaggatatcaattaaatacatctcagtataccttagaaacgataactgaacgttacacgcatattcaatcatataaagaaaaactattattatctatggcgtatcaactgctaatgcacaataaatcgcagacattgcaacaactagagcaagattatctattatctaaaactgtgctcaacgactatttcgttcgaattcaacaatggtgtcaaaaatttaatatcgctttaacaatcaagaaaaaacaaggtattgtggtcgatggaacagataatgatatcactaatgccatcatccatttaaatcaattatcatcagggcatgtacatgttgaagacctaattttaaatgaattacctgattcacaccaaaggatgatttcgcatattatacaagagacacttcaacaacatagtattgaaacaactgatattcaaatacaacagcttttaattcatctcattttaatcattaaacgtaagcaatctttaagtgagctagacacgttaaaccacgattcaaaattgatatctcaatcttgcattaagcaaatcaacgaaagattaggttatgacttgaacgaaaaagtaatcaatatgttttcattctttattgcttatcattttaataaactcgatattggcatagaacgtatatttatacaaagttatattgatcgcttaatcgaattgatgcagcaacgtattcatgtacctttcaatgaagattcgattttacaacaaaatttatataatcattttagtaaagcatatttacgtatcactcaaaacatttatttaaacaatcctttagttatagagattaaaaaactctatccctttgtgtttaacacactttttgaagcgattgataaattagcaattgatactgatatagagatgagcgaagatgaaattgcatttttaacaattcattttcaagctgccatcgagcgtcgtaccaaaacacaattaaatgtagtcattgcttgttattatggtctaggtgtgtcgaattttttagaaactaaaataaataacttatccgaagagttgtcagtgataaatacgattaaactagaaaatataacacactatcactttgacaatgtagatttattaataacgacccatgatattcctaaacaaacgctaaacatacttcctaagcacctgacgactatcaaggttgcaccattattttctgaagatgatcgtcacaaaatcagacacgttgtgaagcaaaagcaaaatccggttcaagcacatcatcatatggacactgtcaatttccttgtcgtaaatactgaacaaaaatcacggcatactgtgcaaatttttgaagaagctcaaaaaatattacaagcacatcatgcgattgtagaaggatatatcgaatcagctttagagcgtgagaaatcatcttctacatacataggtaattttatggcgattcctcatggagatcctgaaaaagttttacaatcacatgtgcttatttttcgcacaaaagatgtttttccttggcgacaacacgatgtcaaacttgtctttttcttagcgatttcgcataaagacaaagcttttacaaaacaaatgatgcaattaattgctaacttggatgatgattcagtgaaccatttatgtagtttagatgatcatagtttaaagcaacagttatttgaatacttacaagaa

SEQ ID NO: 3904 - protein, 624 aa, Staphylococcus aureus
  MISC_FEATURE (1)..(624): hypothetical protein
MLDRHLKLLQFFIKNPSKHISSNEIAKHVNVSNRTVRNDIHVINSNFMDDIIVSIKSKGYQLNTSQYTLETITERYTHIQSYKEKLLLSMAYQLLMHNKSQTLQQLEQDYLLSKTVLNDYFVRIQQWCQKFNIALTIKKKQGIVVDGTDNDITNAIIHLNQLSSGHVHVEDLILNELPDSHQRMISHIIQETLQQHSIETTDIQIQQLLIHLILIIKRKQSLSELDTLNHDSKLISQSCIKQINERLGYDLNEKVINMFSFFIAYHFNKLDIGIERIFIQSYIDRLIELMQQRIHVPFNEDSILQQNLYNHFSKAYLRITQNIYLNNPLVIEIKKLYPFVFNTLFEAIDKLAIDTDIEMSEDEIAFLTIHFQAAIERRTKTQLNVVIACYYGLGVSNFLETKINNLSEELSVINTIKLENITHYHFDNVDLLITTHDIPKQTLNILPKHLTTIKVAPLFSEDDRHKIRHVVKQKQNPVQAHHHMDTVNFLVVNTEQKSRHTVQIFEEAQKILQAHHAIVEGYIESALEREKSSSTYIGNFMAIPHGDPEKVLQSHVLIFRTKDVFPWRQHDVKLVFFLAISHKDKAFTKQMMQLIANLDDDSVNHLCSLDDHSLKQQLFEYLQE

SEQ ID NO: 3905 - DNA, 1950 bp, Staphylococcus aureus
atgaaaattgtagctattacctcatgcccaaatggcattgcacatacatatatggctcaagaaaagcttgagcaggtagcaaaagaaatgggtgtggatattaaagtagagacacagggcggtgttggtgctgaaaatgttttaactacgcaagacatcgaagaagctgacggtgtcataattgcagctgataaacaagttgatctgtcccgatttgttggtaaacggttgattaatgaaaatgttcgcgaagggattcataatccgagaggtctaattcaacgtatcattaatcaagatgcgcctatttatcaatctgaaacaaattatcattcgaaagatcgcggtaagtctaaaaatggtattcaaatggtgtatcaacatttaatgaacggtgtatcgtttatggttccttttatcgtagttggtggactccttatcgccatcgcgctgactctaggcggtgaaacgacatcaaaaggattagtcatcccagatgattcattttggaaatccattgaaaacattggtagtttagcctttaaatttatggttccaatactagctggatatatcgctgttagtatcgctgacaagcccggtcttgttcctggtatgattggcggcgctatcgctgctgacggtagtttttatggcagtgatgcaggcgcaggatttttaggtggtattgttgctggtttcttagcaggttatatcgcaaagtggattaaagatattaaagttccaaaagcaatggcaccaattatgcctatcattattattcccattatttcatcggtcgttgtaggattgatatttatatttttaatcggtgcaccaatttctaatatttttgaggcattaacaacctggttaaaaagtatgcaaggtgctaatattattatacttgcgatgattataggtgcgatgattgccttcgatatgggcggtccagtaaacaaggtagcatttttatttggctcagcacttattgctgaaggtaattacgccgttatgggtatggtcgcagttgctgtatgtacaccaccaatcggtttaggtttagcaacgtttgttcaaaagtataaattcaatcattccgaaagagaaatgggtaaggcttccttcactatgggactatttggtattactgaaggtgctattcctttcgcagcccaagatccattgcgcattatacctgcaaacatcattggtgcaatgattgcatcagtcattgcagccattggtggtgtcggcgatagagtcgcacatggaggtccaatcgtggctgtattaggtggtattgatcatgtattatggtttatctttgcagtgatagtaggtagtcttgtcacaatgactactgtactattattaaaacgcaatacaccagttatagcagtagatgcaccagcgcaacacacgcaacttcatgatacagatattacacaacatgatacagaggttgacaatgtagataacaccgcgaaacattcacatctcaataaaccttctcatgtttttgatcaacaaactatgataattactgatcacgacatgtctcgaaacgaagcaattgatatgttgattcataaacttaaaatttgccgttatgtagagcacacatcgcatttaaaaaatgcaatactagaacgtgaaatggagtctacgacagctattggcatgaacgtggccattccacatgcaaagtctgatgttgtaaaacaaccgattgtagctgttatgaaaaataatcatggtgttaaatgggacagtctagatggtagtctacctcaattgatattcttaattgccgtaccaaacaacagtcaggatacacatttaaaaatacttcagcgcttatctaaagcgttaatgaatgatgagacacgccaatcactaattaatgcaaacagtactacagaaatttataacttattaatgaaaata

SEQ ID NO: 3906 - protein, 650 aa, Staphylococcus aureus
  MISC_FEATURE (1)..(650): fructose phosphotransferase
MKIVAITSCPNGIAHTYMAQEKLEQVAKEMGVDIKVETQGGVGAENVLTTQDIEEADGVIIAADKQVDLSRFVGKRLINENVREGIHNPRGLIQRIINQDAPIYQSETNYHSKDRGKSKNGIQMVYQHLMNGVSFMVPFIVVGGLLIAIALTLGGETTSKGLVIPDDSFWKSIENIGSLAFKFMVPILAGYIAVSIADKPGLVPGMIGGAIAADGSFYGSDAGAGFLGGIVAGFLAGYIAKWIKDIKVPKAMAPIMPIIIIPIISSVVVGLIFIFLIGAPISNIFEALTTWLKSMQGANIIILAMIIGAMIAFDMGGPVNKVAFLFGSALIAEGNYAVMGMVAVAVCTPPIGLGLATFVQKYKFNHSEREMGKASFTMGLFGITEGAIPFAAQDPLRIIPANIIGAMIASVIAAIGGVGDRVAHGGPIVAVLGGIDHVLWFIFAVIVGSLVTMTTVLLLKRNTPVIAVDAPAQHTQLHDTDITQHDTEVDNVDNTAKHSHLNKPSHVFDQQTMIITDHDMSRNEAIDMLIHKLKICRYVEHTSHLKNAILEREMESTTAIGMNVAIPHAKSDVVKQPIVAVMKNNHGVKWDSLDGSLPQLIFLIAVPNNSQDTHLKILQRLSKALMNDETRQSLINANSTTEIYNLLMKI

SEQ ID NO: 3907 - DNA, 936 bp, Staphylococcus aureus
atggcattatttttacaacccgtttttaaagacagaatttggggcggtcatgcattaaaagcatttaactatgatatccctaatgaaacaactggtgaatgctgggcaatttctgcacatccaaatggtcctaatacaattatcaatggtccatacaaggatatgaccctagatcaactttggtcacaacatcgtgaattattcgataatgattcacgagatagtttccctctgctaactaaagtattagatgccaatgataaattatctgttcaagttcacccagatgatgactacgctttaaaacacgaaggcgaactaggtaaaacagaatgttggtatattttagatgcagccccaggtgctgaaattatatatggcgtacatgcacataataaacagacgttaatagacatgattgataatcatgaatttgacagtcttttcaaacgtatacctgttaagcccggtgacttttattatgttcctgctggcactgtccatgccattggttcgggtattttaattttagagacacaacaatcctccgatacgacataccgtatttatgactatgatagacgagatcaaaatggtcaattgcgtgatttgcacttagagcaaagtaaagatgtgattgaattaggcaatcatgaaccaaatactactcctataacaactcacatcgacacacacactgtaactcaatttgtagataatcaatattttgcagtatataaatgggatattcatggagatttaaaattcaataaaccacatgcttattgcttagttacaattatcgatggtactggtactttaacagtaaacgataagcactatgacatccaaaaaggttctagctttattttaactacggaagacgaggatattcactttgtcggtaatattagtgctatagtaagtcatcctgga

SEQ ID NO: 3908 - protein, 312 aa, Staphylococcus aureus
  MISC_FEATURE (1)..(312): mannose-6-phosphate
MALFLQPVFKDRIWGGHALKAFNYDIPNETTGECWAISAHPNGPNTIINGPYKDMTLDQLWSQHRELFDNDSRDSFPLLTKVLDANDKLSVQVHPDDDYALKHEGELGKTECWYILDAAPGAEIIYGVHAHNKQTLIDMIDNHEFDSLFKRIPVKPGDFYYVPAGTVHAIGSGILILETQQSSDTTYRIYDYDRRDQNGQLRDLHLEQSKDVIELGNHEPNTTPITTHIDTHTVTQFVDNQYFAVYKWDIHGDLKFNKPHAYCLVTIIDGTGTLTVNDKHYDIQKGSSFILTTEDEDIHFVGNISAIVSHPG

SEQ ID NO: 3909 - DNA, 2985 bp, Staphylococcus aureus
gtgacaatgaagaacgcatttaaattatttaaaatggatctgaagaaagtagctaagacgccagctgtgtggattatcttagcaggcttagctattttgccatcgttctacgcttggtttaacttatgggcaatgtgggatccatatggcaacacgggacacatcaaggtcgcagtcgttaatgaagataaaggcgacacaatcagagggaaaaaagttaatgtcggtaatacgatggttaatacactcaagaaaaataaaagttttgattggcagtttgtaagtagagagaaagctgatcatgagataaaaatgggtaaatattttgcaggtatttacatcccatctaagtttacacatgaaattacagggacactacgtaagcagcctcaaaaagcagatgtagaatttaaggtgaatcagaagattaacgctgttgcgtctaagctaacagatactggttcgtcagttgtcgttgaaaaagcgaatgaacaatttaataaaacagtaactcgagcattattagaagaagctaacaaagcaggtttaactattgaagaaaatgtgccgacaattaacaagataaaaaatgcggtatattcagcagataaagctttacctaagattaatgactttgcgaataaaattgtatatttgaataaccaccaagcggatttagataaatatgccaatgattttagaaaactaggaaattataaaggtgatattttagatgctcagaaaaaattaaacgaagtcaatggtgctattccgcaacttaatgaaaaggctaagttgatattagctttaaataattatatgccgaaaattgaaaaagcgttaaattttgcagctgatgacgtgccagcgcagttccctaaaattaatcaaggacttaacattgcgagtcaaggtattgatcaagctaatggacagttaaatgatgccaaaggcttcgtcacacaagttagaagtagagtcggtgattatcaagatgcaattcgacgcgcgcaagatttaaatcgaagaaaccagcaacagattcctcaaaatagcgcggcgaacaacgaaacatcaaatagtgcacctgcagctggtaatggtgtagcatcaacgccaccaagtgcaccaagtggcgatactgcaccaaataataatgttacgcaaaataccgcaccaaatagtaataatgcgcctgtatcgactacaccacaaagtacaagcgggaaaaaagatggtcaaagttttgtagatataacaacaacacaagtcagcacagctaacgagaacacacaaaacattacagataaagatgttaaatcaatggaagcggcattaacgggctctttattatcattatcaaataatttagatacccaagcgaaagccgcacaaaaagatagtcaggcattacgtaatatttcgtatgggattttagcatcggacaagccttctgattttagagagtctttagataatgttaagtccggtttagaatacacaacgcaatataatcaacaatttatcgatacattaaaagagattgagaagaatgaaaatgttgatttatcaaaagaaattgataaggtaaaagcagctaataatcgaattaatgaatcattaaggttagttaatcaattaagcaatgcattaaagaatggtagttcaggaactgctgaagctactaaattactagatcaactttcaaaactagattcatcattatcatcatttagagattatgttaaaaaagatcttaacagctctttagtatcaatatcacaacgtattatggatgaattgaacaaagggcaaactgcattatccaatgttcagtctaaattaaatacaattgatcaagtcattaacagtggacaagctattttaaaaaatggtaaaacacgtattgatcgcttacaaacagtattaccaagtattgaacaacaatacattagtgctgttaaaaatgctcaagcaaacttctcgaaagtgaaaagtgatgtagctaaagctgctaactttgtgcgcaatgacttaccacagttagaacagcgattaactaatgcgacagcaagtgtgaataaaaatttaccaacgttattaaatggttatgatcaagcggtaggattactaaataaaaatcagccacaagcgaaaaaggctttatcagatttagctgatttttctcaaaataaattgcctgatgttgaaaaagatttgaaaaaagcgaataaaattttcaagaaattagacaaagatgatgcagtcgacaaattaatcgacacacttaagaatgatttgaaaaagcaagcgggtattattgcaaatcctattaataagaagactgttgatgttttcccagttaaggattatggttcaggtatgacaccattctatactgcactgtcagtatgggtaggtgcactcttgatggtaagtttattaacggttgataataaacataagagtctagagtcagtcttaacgacaagacaagtgttcttaggtaaggcaggattctttataatgcttggtatgttgcaagcactcattgtatcggttggagatttgttaatcctaaaagcaggagttgagtcacctgtattatttgtacttataacgattttctgttcgattattttcaactcaatcgtatatacgtgcgtatcattacttggtaacccaggtaaagccattgcaatcgtattgcttgtattacaaattgcaggtggtgggggaacattcccaattcaaactacgccacaatttttccaaaacatttcgccatacttaccatttacgtatgcaattgattcattacgtgaaacagtaggcggtattgttccggaaatcctaattacaaaattaattatattaacgttatttggtataggattcttcgttgtaggtttaattttaaaacctgtaacagatccattgatgaagcgcgtatctgaaaaagttgaccaaagtaacgttacagaa

SEQ ID NO: 3910 - protein, 995 aa, Staphylococcus aureus
  MISC_FEATURE (1)..(995): hypothetical protein
VTMKNAFKLFKMDLKKVAKTPAVWIILAGLAILPSFYAWFNLWAMWDPYGNTGHIKVAVVNEDKGDTIRGKKVNVGNTMVNTLKKNKSFDWQFVSREKADHEIKMGKYFAGIYIPSKFTHEITGTLRKQPQKADVEFKVNQKINAVASKLTDTGSSVVVEKANEQFNKTVTRALLEEANKAGLTIEENVPTINKIKNAVYSADKALPKINDFANKIVYLNNHQADLDKYANDFRKLGNYKGDILDAQKKLNEVNGAIPQLNEKAKLILALNNYMPKIEKALNFAADDVPAQFPKINQGLNIASQGIDQANGQLNDAKGFVTQVRSRVGDYQDAIRRAQDLNRRNQQQIPQNSAANNETSNSAPAAGNGVASTPPSAPSGDTAPNNNVTQNTAPNSNNAPVSTTPQSTSGKKDGQSFVDITTTQVSTANENTQNITDKDVKSMEAALTGSLLSLSNNLDTQAKAAQKDSQALRNISYGILASDKPSDFRESLDNVKSGLEYTTQYNQQFIDTLKEIEKNENVDLSKEIDKVKAANNRINESLRLVNQLSNALKNGSSGTAEATKLLDQLSKLDSSLSSFRDYVKKDLNSSLVSISQRIMDELNKGQTALSNVQSKLNTIDQVINSGQAILKNGKTRIDRLQTVLPSIEQQYISAVKNAQANFSKVKSDVAKAANFVRNDLPQLEQRLTNATASVNKNLPTLLNGYDQAVGLLNKNQPQAKKALSDLADFSQNKLPDVEKDLKKANKIFKKLDKDDAVDKLIDTLKNDLKKQAGIIANPINKKTVDVFPVKDYGSGMTPFYTALSVWVGALLMVSLLTVDNKHKSLESVLTTRQVFLGKAGFFIMLGMLQALIVSVGDLLILKAGVESPVLFVLITIFCSIIFNSIVYTCVSLLGNPGKAIAIVLLVLQIAGGGGTFPIQTTPQFFQNISPYLPFTYAIDSLRETVGGIVPEILITKLIILTLFGIGFFVVGLILKPVTDPLMKRVSEKVDQSNVTE

SEQ ID NO: 3911 - DNA, 486 bp, Staphylococcus aureus
atgacaattattttatggctacttatcatcgctgccttcatgttagcatttgttgggttgattaagccgattattccttctgttttagtattatgggttggctttttaatctatcaatttggctttcataatcagcatttatcatgggtgttttatgtatctatggcattgctaacaatattaattttatgtgccgactttttagctaataaatattttgtgaatcgcttcggtggttctaagtttggagagtatgcagctttaattggtgtggttattggatgttttgttttaccgccatttggaattattattataccttttattttggtattcatagttgaattaatacaaggctattcatttgaaagagcagttaaagtaagtataggttcaatcgtagcatttttaacaagtagtatagctcaagcaatcattatgtttataatgattgtatggttctttatagatgctttattgattaat

SEQ ID NO: 3912 - protein, 162 aa, Staphylococcus aureus
  MISC_FEATURE (1)..(162): conserved hypothetical
MTIILWLLIIAAFMLAFVGLIKPIIPSVLVLWVGFLIYQFGFHNQHLSWVFYVSMALLTILILCADFLANKYFVNRFGGSKFGEYAALIGVVIGCFVLPPFGIIIIPFILVFIVELIQGYSFERAVKVSIGSIVAFLTSSIAQAIIMFIMIVWFFIDALLIN

SEQ ID NO: 3913 - DNA, 1857 bp, Staphylococcus aureus
atgcctaaaaataaaattttaatttatttgctatcaactacgctcgtattacctactttagtttcacctaccgcttatgctgatacacctcaaaaagatactacagctaagacaacatctcatgattcaaaaaaatctaatgacgatgaaacttctaaggatactacaagtaaagatattgataaagcagacaaaaataatacaagtaaccaagacaataacgacaaaaaatttaaaactatagacgacagcacttcagactctaacaatatcattgattttatttataagaatttaccacaaaccaatataaaccaattgctaaccaaaaataaatacgatgataattactcattaacaactttaatccaaaacttattcaatttaaattcggatatttctgattacgaacaacctcgtaatggcgaaaagtcaacaaatgattcgaataaaaacagtgacaatagcatcaaaaatgacactgatacgcaatcatctaaacaagataaagcagacaatcaaaaagcacctaaatcaaacaatacaaaaccaagtacatctaataagcaaccaaattcgccaaagccaacacaacctaatcaatcaaatagtcaaccagcaagtgacgataaagcaaatcaaaaatcttcatcgaaagataatcaatcaatgtcagattcggctttagactctattttggatcaatacagtgaagatgcaaagaaaacacaaaaagattatgcatctcaatctaaaaaagacaaaaatgaaaaatctaatacaaagaatccacagttaccaacacaagatgaattgaaacataaatctaaacctgctcaatcattcaataacgatgttaatcaaaaggatacacgtgcaacatcattattcgaaacagatcctagtatatctaacaatgatgatagcggacaatttaacgttgttgactcaaaagatacacgtcaatttgtcaaatcaattgctaaagatgcacatcgcattggtcaagataacgatatttatgcgtctgtcatgattgcccaagcaatcttagaatctgactcaggtcgtagtgctttagctaagtcaccaaaccataatttattcggtatcaaaggtgcttttgaagggaattctgttccttttaacacattagaagctgatggtaatcaattgtatagtattaatgctggattccgaaaatatccaagcacgaaagaatcactaaaagattactctgaccttattaaaaatggtattgatggcaatcgaacaatttataaaccaacatggaaatcggaagccgattcttataaagatgcaacatcacacttatctaaaacatatgctacagatccaaactatgctaagaaattaaacagtattattaaacactatcaattaactcagtttgacgatgaacgcatgccagatttagataaatatgaacgttctatcaaggattatgatgattcatcagatgaattcaaacctttccgtgaggtatctgatagtatgccatatccacatggccaatgtacttggtacgtatataaccgtatgaaacaatttggtacatctatctcaggtgatttaggtgatgcacataattggaataatcgagctcaataccgtgattatcaagtaagtcatacaccaaaacgtcatgctgctgttgtatttgaggctggacaatttggtgcagatcaacattacggtcatgtagcatttgttgaaaaagttaacagtgatggttctatcgttatttcagaatccaatgttaaaggattaggtatcatttctcatagaactatcaacgcagctgccgctgaagaattatcatatattacaggtaaa

SEQ ID NO: 3914 - protein, 619 aa, Staphylococcus aureus
  MISC_FEATURE (1)..(619): hypothetical protein
MPKNKILIYLLSTTLVLPTLVSPTAYADTPQKDTTAKTTSHDSKKSNDDETSKDTTSKDIDKADKNNTSNQDNNDKKFKTIDDSTSDSNNIIDFIYKNLPQTNINQLLTKNKYDDNYSLTTLIQNLFNLNSDISDYEQPRNGEKSTNDSNKNSDNSIKNDTDTQSSKQDKADNQKAPKSNNTKPSTSNKQPNSPKPTQPNQSNSQPASDDKANQKSSSKDNQSMSDSALDSILDQYSEDAKKTQKDYASQSKKDKNEKSNTKNPQLPTQDELKHKSKPAQSFNNDVNQKDTRATSLFETDPSISNNDDSGQFNVVDSKDTRQFVKSIAKDAHRIGQDNDIYASVMIAQAILESDSGRSALAKSPNHNLFGIKGAFEGNSVPFNTLEADGNQLYSINAGFRKYPSTKESLKDYSDLIKNGIDGNRTIYKPTWKSEADSYKDATSHLSKTYATDPNYAKKLNSIIKHYQLTQFDDERMPDLDKYERSIKDYDDSSDEFKPFREVSDSMPYPHGQCTWYVYNRMKQFGTSISGDLGDAHNWNNRAQYRDYQVSHTPKRHAAVVFEAGQFGADQHYGHVAFVEKVNSDGSIVISESNVKGLGIISHRTINAAAAEELSYITGK

SEQ ID NO: 3915 - DNA, 564 bp, Staphylococcus aureus
atgaagatgtctcgaaaaacggcgctattagttttggatatgcaagaaggtatagcgagtagtgtacctagaataaaaaatattattaaagcgaatcagagagcaattgaagcagcaagacaacatcgaataccagtcattttcatacgtttagtgttagataagcattttaatgatgtctcctcgagtaataaagtgttttcaacaattaaagctcaaggatatgcgattactgaagcagatgcatctacacgaatacttgaagatttagcaccactagaagatgagccgattatttctaagcgacgctttagcgcatttacaggtagttacttggaagtttatttacgtgcaaatgatattaatcatttagtattaacgggtgtctctacaagtggagctgtattgagcacggcattagaaagtgtagataaagactattatattactgttttagaagatgctgttggtgatagatcagatgataaacatgactttattattgaacaaattttatcacgctcatgtgacattgaatccgtagagtcatggaaaagtagttta

SEQ ID NO: 3916 - protein, 188 aa, Staphylococcus aureus
  MISC_FEATURE (1)..(188): hypothetical protein
MKMSRKTALLVLDMQEGIASSVPRIKNIIKANQRAIEAARQHRIPVIFIRLVLDKHFNDVSSSNKVFSTIKAQGYAITEADASTRILEDLAPLEDEPIISKRRFSAFTGSYLEVYLRANDINHLVLTGVSTSGAVLSTALESVDKDYYITVLEDAVGDRSDDKHDFIIEQILSRSCDIESVESWKSSL

SEQ ID NO: 3917 - DNA, 1911 bp, Staphylococcus aureus
atgttgatggctaaatatcgagggaaaccgtttcaattatatgtaaagttatcgtgttcgacaatgatggcgacaagtatcattttaacgaatatcttgccgtacgatgcccaagctgcatctgaaaaggatactgaaattacaaaagagatattatctaagcaagatttattagacaaagttgacaaggcaattcgtcaaattgagcaattaaaacagttatcggcttcatctaaagaacattataaagcacaactaaatgaagcgaaaacagcatcgcaaatagatgaaatcataaaacgagctaatgagttggatagcaaagacaataaaagttctcacactgaaatgaacggtcaaagtgatatagacagtaaattagatcaattgcttaaagatttaaatgaggtttcttcaaatgttgataggggtcaacaaagtggcgaggacgatcttaatgcaatgaaaaatgatatgtcacaaacggctacaacaaaacatggagaaaaagatgataaaaatgatgaagcaatggtaaataaggcgttagaagacctagaccatttgaatcagcaaatacacaaatcgaaagatgcatcgaaagatacatcggaagatccagcagtgtctacaacagataataatcatgaagtagctaaaacgccaaataatgatggttctggacatgttgtgttaaataaattcctttcaaatgaagagaatcaaagccatagtaatcgactcactgataaattacaaggaagcgataaaattaatcatgctatgattgaaaaattagctaaaagtaatgcctcaacgcaacattacacatatcataaactgaatacgttacaatctttagatcaacgtattgcaaatacgcaacttcctaaaaatcaaaaatcagacttaatgagcgaagtaaataagacgaaagagcgtataaaaagtcaacgaaatattattttggaagaacttgcacgtactgatgataaaaagtatgctacacaaagcattttagaaagtatatttaataaagacgaggcagttaaaattctaaaagatatacgtgttgatggtaaaacagatcaacaaattgcagatcaaattactcgtcatattgatcaattatctctgacaacgagtgatgatttattaacgtcattgattgatcaatcacaagataagtcgctattgatttctcaaattttacaaacgaaattaggaaaagctgaagcagataaattggctaaagattggacgaataaaggattatcaaatcgccaaatcgttgaccaattgaagaaacattttgcatcaactggcgacacgtcttcagatgatatattaaaagcaattttgaataatgccaaagataaaaaacaagcaattgaaacgattttagcaacacgtatagaaagacaaaaggcaaaattactggcagatttaattactaaaatagaaacagatcaaaataaaatttttaatttagttaaatcggcattgaatggtaaagcggatgatttattgaatttacaaaagagactcaatcaaacgaaaaaagatatagattatattttatcaccaatagtaaatcgtccaagtttactagatcgattgaataaaaatgggaaaacgacagatttaaataagttagcaaatttaatgaatcaaggatcagatttattagacagtattccagatatacccacaccaaagccagaaaagacgttaacacttggtaaaggtaatggattgttaagtggattattaaatgctgatggtaatgtatctttgcctaaagcgggggaaacgataaaagaacattggttgccgatatctgtaattgttggtgcaatgggtgtactaatgatttggttatcacgacgcaataagttgaaaaataaagca

SEQ ID NO: 3918 - protein, 637 aa, Staphylococcus aureus
  MISC_FEATURE (1)..(637): conserved hypothetical
MLMAKYRGKPFQLYVKLSCSTMMATSIILTNILPYDAQAASEKDTEITKEILSKQDLLDKVDKAIRQIEQLKQLSASSKEHYKAQLNEAKTASQIDEIIKRANELDSKDNKSSHTEMNGQSDIDSKLDQLLKDLNEVSSNVDRGQQSGEDDLNAMKNDMSQTATTKHGEKDDKNDEAMVNKALEDLDHLNQQIHKSKDASKDTSEDPAVSTTDNNHEVAKTPNNDGSGHVVLNKFLSNEENQSHSNRLTDKLQGSDKINHAMIEKLAKSNASTQHYTYHKLNTLQSLDQRIANTQLPKNQKSDLMSEVNKTKERIKSQRNIILEELARTDDKKYATQSILESIFNKDEAVKILKDIRVDGKTDQQIADQITRHIDQLSLTTSDDLLTSLIDQSQDKSLLISQILQTKLGKAEADKLAKDWTNKGLSNRQIVDQLKKHFASTGDTSSDDILKAILNNAKDKKQAIETILATRIERQKAKLLADLITKIETDQNKIFNLVKSALNGKADDLLNLQKRLNQTKKDIDYILSPIVNRPSLLDRLNKNGKTTDLNKLANLMNQGSDLLDSIPDIPTPKPEKTLTLGKGNGLLSGLLNADGNVSLPKAGETIKEHWLPISVIVGAMGVLMIWLSRRNKLKNKA

SEQ ID NO: 3919 - DNA, 1356 bp, Staphylococcus aureus
atgattaaattatttgattactttaacgatcattcacgaaagttatatgagtcttttaaagccagtaagttggaagaagatttaacaattgtactcaatgacaatggctttttaccggacgatgttatatcaccgtatcaattttttgcagataatcataatacagaaaatatgaaaccacgattttttaatcaggttactgtaccagctttttgggaaattaaaggtaacaacaattcggctacaattaatgatatgggacgtctacgaggtaaaatattttatcaaagtggagagcgccctagaattgttagtcgtgtcgaatggtttgatgaccaacaacgtgtccgatttgtcgattattattctaagaatggtattaaatttgcacaaactgtttacgatttaaatcgtaaagcgatcttgaagaaatatatgacagcagaaggtaaagaagtgatttatgaaaattttgtaacatctgatgtcatattggattggcaagggaagtcttactttttcccttcaaagctcgcattcgcattattttttatcaagcaacttgaaattacggaacatcatttcgttattaactcactagccctaccattttcagtgttatataatttgccatcaaaaggtagtgatgttttggtatggcaagaacactgtaatggtaatgtcccgggaaatatgcaattgatgtgtaaaggtgatatgaaacgacattgtaatattattattccagataaaaacgaatatgaaacgatgctcaatatagcagacgcaaaggttcaatctcgtattttacaaggcggatatctatataactatcgtagtcgtaatagatatactaaagaaattgtaatattaactaactcggatcaacttcgtaacatcaaggtattggttgaaactttaccagattttaagtttcacatcgctgctattacagagatgtctgataagctaatgcaacttgatcaatatgctaatgtgcatttatacccatctattaatattgacagggtaaatgaactataccagttatgtgatatttatcttgatatcaatgagggtaatgaaattttaaatgcggtggaacaagcgtttgactatgagttgttgattttaggttatcgtcaaaccgcacaccatgctaaagtaacattatcagagcacttatttgagcataatgatgagataacaatggaaagtaaagaccaattaatacaaatgttagaaagtttgaaagatcaacaacagtttcgagatgctttattagcacaaaaagcacatgcacacgaaatctcgcgtgaacaattcgagcaagtttttaaacaggcgctcgaaagc

SEQ ID NO: 3920 - protein, 452 aa, Staphylococcus aureus
  MISC_FEATURE (1)..(452): hypothetical protein
MIKLFDYFNDHSRKLYESFKASKLEEDLTIVLNDNGFLPDDVISPYQFFADNHNTENMKPRFFNQVTVPAFWEIKGNNNSATINDMGRLRGKIFYQSGERPRIVSRVEWFDDQQRVRFVDYYSKNGIKFAQTVYDLNRKAILKKYMTAEGKEVIYENFVTSDVILDWQGKSYFFPSKLAFALFFIKQLEITEHHFVINSLALPFSVLYNLPSKGSDVLVWQEHCNGNVPGNMQLMCKGDMKRHCNIIIPDKNEYETMLNIADAKVQSRILQGGYLYNYRSRNRYTKEIVILTNSDQLRNIKVLVETLPDFKFHIAAITEMSDKLMQLDQYANVHLYPSINIDRVNELYQLCDIYLDINEGNEILNAVEQAFDYELLILGYRQTAHHAKVTLSEHLFEHNDEITMESKDQLIQMLESLKDQQQFRDALLAQKAHAHEISREQFEQVFKQALES

SEQ ID NO: 3921 - DNA, 1506 bp, Staphylococcus aureus
atgacaatatataatataaactttggtataggctgggcgagtagcggtgttgaatatgcacaagcttaccgtgctaaattattgagacgtacaaatcaagacactaaatttgtgtttttagattttatacagtcagagaacatacagacattaacgcaaaacattgggtttaaagatcaagaagttatttggttgtatcagtattttagtgatatttctttagcaccaacaacgtacacgttagatgacattgaacgtgagcttggtcatgacattagttttagagaaagaaatggtaagatagtccgcctatattttaatgggaaatcatcatttgtaacatgttatctgcaaaatgaacaaaaagatattgtggatcgtgcagaatttgtaattaatagtatgttagtacgtaaagatttttatagttatacgcgcatattttctgagtattatgcaccagctgataataaagcgaaattatatatgcgacaattttataatcaagatggttccatcgcttataacgaatatattgatggagacagctctatatatgtgtttgaagatgcggtgttgtataacaaaacggaatttattgcatactttttacaacgattgaatttaacccgagacgatattgtcatattagaccgcgcttctgatattggtcaggctgttttgcagcataaaggtgatagtaaagttggtgttgtgattcatgctgatcattatagtaataatatgatgagtgagcagcatatactatggaacaattattatgaatatcaattttcaaaagctaaatacattgatttctttattacagcaacagatattcaaaatcatatggtttgtcgacaatttgagcaatatcaaggttatcgcccacgtgtttatactattcctgtgggaagcattgatgcattatcatatccaacattatcaagaaagccatatgcgatgattagtgcatctcgtttagcgaatgagaaacatattgattggcttgtcaaagcggttatcgtggctaaacgacaagtgccagaattaacatttgatatttatggagaaggtagcgagaagacgcgactgcgtaaaattattgatacacaccgcgcacaagattatattcgtttactagggcatgttaaacttgatgaaatttataatgattatgagttatttctttctgcatcaactagcgaaggttttgggttaacactaatggaagcggtaggctcaggactaggtatgattggattaaatgtgaattatggtaacccaacctttattcgagatggggaaaatggctacttggtaccttttgataccgacgaagatagtgtggatgatgttatcgcaaaactagctcatgccattgtaatgtattttaacaatggtccccagacaccacatgacatctcttatgaagtggcacagcaatttatgactcaagatattattttaaaatgggaaacattagttcaagaggtgctacatgat

SEQ ID NO: 3922 - protein, 502 aa, Staphylococcus aureus
  MISC_FEATURE (1)..(502): hypothetical protein
MTIYNINFGIGWASSGVEYAQAYRAKLLRRTNQDTKFVFLDFIQSENIQTLTQNIGFKDQEVIWLYQYFSDISLAPTTYTLDDIERELGHDISFRERNGKIVRLYFNGKSSFVTCYLQNEQKDIVDRAEFVINSMLVRKDFYSYTRIFSEYYAPADNKAKLYMRQFYNQDGSIAYNEYIDGDSSIYVFEDAVLYNKTEFIAYFLQRLNLTRDDIVILDRASDIGQAVLQHKGDSKVGVVIHADHYSNNMMSEQHILWNNYYEYQFSKAKYIDFFITATDIQNHMVCRQFEQYQGYRPRVYTIPVGSIDALSYPTLSRKPYAMISASRLANEKHIDWLVKAVIVAKRQVPELTFDIYGEGSEKTRLRKIIDTHRAQDYIRLLGHVKLDEIYNDYELFLSASTSEGFGLTLMEAVGSGLGMIGLNVNYGNPTFIRDGENGYLVPFDTDEDSVDDVIAKLAHAIVMYFNNGPQTPHDISYEVAQQFMTQDIILKWETLVQEVLHD

SEQ ID NO: 3923 - DNA, 2388 bp, Staphylococcus aureus
atgaaacataaactagatgttacgataaacgaattaagactaaagtcgattagaaaaatagtgaaacgcatcaatacatggagcgatgaagttaaatcatattctgatgatgcgttaaaacaaaagacaatagaatttaaagaacgtttagcatcaggagttgatacactagatacattgttacctgaagcttatgcagtggcacgtgaagcgagctggagagtattaggtatgtatcctaaagaagttcagttaatcggagcgattgtattgcatgaaggtaacattgcggagatgcaaacaggcgaaggtaaaacattaacggcaacgatgcctttatatttaaatgctctttcgggaaaaggaacatatttaattacaacgaatgattatttagcgaagcgagattttgaagagatgcaaccattatatgaatggttaggtttaactgcttcattaggttttgttgatattgtggattatgagtatcaaaaaggggaaaaacgtaatatatatgaacatgatattatatatacaactaatggacgtctcggttttgattatttaattgataatttggctgatagtgcggaagggaaatttttaccacaattaaattacggtattattgatgaagtggattcaatcattttagatgctgctcaaacaccattagttatttcgggtgcaccaagattacaatcaaatctatttcatattgtgaaagagtttgtagatacattgattgaagacgtgcattttaaaatgaagaagaccaaaaaagaaatatggctgttaaatcaaggtattgaagcggcacaatcatactttaatgttgaagatttatatagcgaacaagcgatggtcctagtgcgtaatattaatttagcactgcgcgcacaatatttgtttgaatctaatgtcgattactttgtatataatggtgatattgttttaattgaccgtattacaggtcgtatgttaccgggaactaagttgcaagctggacttcaccaagctattgaagcgaaagaaggtatggaggtttcaacagataaaagtgttatggcaacaattaccttccagaatttatttaaactttttgaatcattttcaggtatgacagctacaggaaaattaggcgaatcagagttctttgatttgtattcaaaaatagtcgtacaagtaccaactgataaagcgattcaacgtatcgatgaaccagataaagtgtttcgttcagttgatgagaaaaacatcgcgatgattcatgatatagttgaacttcatgaaacggggcgaccggttttactcataacgagaactgctgaagcggctgaatacttttcgaaagtattattccaaatggatattcctaataatttactcattgcgcaaaatgttgcaaaagaagcgcagatgatagctgaagcagggcaaattggttccatgactgttgcgactagtatggcaggtcgaggcacagatattaaacttggtgaaggtgtcgaagcattaggtggattagctgttattattcatgaacatatggaaaatagccgtgtagacaggcaattacgtggtcgttctggtagacaaggggatccgggatcatcttgtatatatatttcactagatgattatttagttaagcgatggagcgatagtaatttagcggaaaataatcaattatattcattagatgcacaacgattatcgcaaagtaatttgtttaatcgcaaagttaagcaaattgtagttaaagcgcagcgtatctcggaagaacaaggggttaaagctcgtgaaatggctaatgaatttgaaaaaagcattagtatacagcgagatcttgtatacgaggaacgcaatcgagttttagaaatagatgatgctgagaatcaagattttaaagcgttagctaaagatgtatttgaaatgtttgtaaatgaggaaaaggtgctaacaaaatcgcgtgttgtcgagtatatttatcaaaatttaagtttccaatttaataaagatgtggcttgtgttaattttaaagataagcaagcagtagtgacatttttattagagcaatttgaaaagcaattagctttgaatcgtaaaaacatgcaaagtgcatattattataatattttcgttcaaaaagtctttttgaaagcaattgattcatgttggttagaacaagtcgactatttacaacaattaaaagcaagcgttaatcaacgacaaaatgggcaacgtaacgctatttttgaataccatagagttgccttagattcatttgaagttatgacacgaaatatcaaaaaaagaatggtgaaaaatatttgtcaaagcatgattacatttgataaagagggtatgccagttatacattttcca

SEQ ID NO: 3924 - protein, 796 aa, Staphylococcus aureus
  MISC_FEATURE (1)..(796): preprotein translocase secA
MKHKLDVTINELRLKSIRKIVKRINTWSDEVKSYSDDALKQKTIEFKERLASGVDTLDTLLPEAYAVAREASWRVLGMYPKEVQLIGAIVLHEGNIAEMQTGEGKTLTATMPLYLNALSGKGTYLITTNDYLAKRDFEEMQPLYEWLGLTASLGFVDIVDYEYQKGEKRNIYEHDIIYTTNGRLGFDYLIDNLADSAEGKFLPQLNYGIIDEVDSIILDAAQTPLVISGAPRLQSNLFHIVKEFVDTLIEDVHFKMKKTKKEIWLLNQGIEAAQSYFNVEDLYSEQAMVLVRNINLALRAQYLFESNVDYFVYNGDIVLIDRITGRMLPGTKLQAGLHQAIEAKEGMEVSTDKSVMATITFQNLFKLFESFSGMTATGKLGESEFFDLYSKIVVQVPTDKAIQRIDEPDKVFRSVDEKNIAMIHDIVELHETGRPVLLITRTAEAAEYFSKVLFQMDIPNNLLIAQNVAKEAQMIAEAGQIGSMTVATSMAGRGTDIKLGEGVEALGGLAVIIHEHMENSRVDRQLRGRSGRQGDPGSSCIYISLDDYLVKRWSDSNLAENNQLYSLDAQRLSQSNLFNRKVKQIVVKAQRISEEQGVKAREMANEFEKSISIQRDLVYEERNRVLEIDDAENQDFKALAKDVFEMFVNEEKVLTKSRVVEYIYQNLSFQFNKDVACVNFKDKQAVVTFLLEQFEKQLALNRKNMQSAYYYNIFVQKVFLKAIDSCWLEQVDYLQQLKASVNQRQNGQRNAIFEYHRVALDSFEVMTRNIKKRMVKNICQSMITFDKEGMPVIHFP

SEQ ID NO: 3925 - DNA, 1038 bp, Staphylococcus aureus
atgatgattcacctaccattgcaagttggtttgttaatttttacaacattattttggaagacaagtttgggagagttcaacatgctgaaaaacaaaacatttaaagttacttggaattatatttcacaaactacatttatgtatggctctaaagtatcattttcaaatggtgaagtgacttttataaatcctttgatgccctctggattaccgattcatgagtggttgatgttaaagcaattttcaaaatataaaagtgcgccaagtttaccaattttgcgtagaggacagcattataaattgcattttgattttgatgcaacgcctgctggttcagtgtattttatcatcattttttataataaaaatggcacaaaactaagtactgagattgtaaagtcaaatagtattacgattcaatatcctgatgaagcctatgcttataaaataaaaatgatgaatgcagcatcgacgagtcttatatttagatgtttaacaatcacagagatgacgcatcaatatgatttagagtataaaagcatgcgggtgacgaagataggcgatgaccaatatggaaatgatatgatcaatgtcattattgcagaaccatctgacacctatccaactatttcgaatgattttttgaaactgtttggtcatgtttggctcgttgaacgttggatggacgacaatatcgagggaaatattaagcaactaaagaatgatttgcaaagtcaagataccctaaaggctattaatttgattagttatgggtcaaagtcaaatgtttttgcaacttatgtcgctcagcatttgggttgcaaagtgtatcgtacaagccatgaagatgatgatttaaaaggatggcttacagaacatgtcccaggaaatcatgaactaaaagatacaaatgtcgaggtttattttaaagaagagcaagacaaacatctaaattatatgtcacgtttaatgaatccagtacgatttttagattacttagatgtatcgaaactgaatggtggggaagtaaatgaaaca

SEQ ID NO: 3926 - protein, 346 aa, Staphylococcus aureus
  MISC_FEATURE (1)..(346): hypothetical protein
MMIHLPLQVGLLIFTTLFWKTSLGEFNMLKNKTFKVTWNYISQTTFMYGSKVSFSNGEVTFINPLMPSGLPIHEWLMLKQFSKYKSAPSLPILRRGQHYKLHFDFDATPAGSVYFIIIFYNKNGTKLSTEIVKSNSITIQYPDEAYAYKIKMMNAASTSLIFRCLTITEMTHQYDLEYKSMRVTKIGDDQYGNDMINVIIAEPSDTYPTISNDFLKLFGHVWLVERWMDDNIEGNIKQLKNDLQSQDTLKAINLISYGSKSNVFATYVAQHLGCKVYRTSHEDDDLKGWLTEHVPGNHELKDTNVEVYFKEEQDKHLNYMSRLMNPVRFLDYLDVSKLNGGEVNET

SEQ ID NO: 3927 - DNA, 1575 bp, Staphylococcus aureus
gtgaaaatgatgccacgtaaatttagagttttgcaaattggaggagacgatttagaacctatttttcaacacaaaaaaggtgtgagttgggattacttcgatattggattgtttgaatttgatagtggttatgtagaggctattgaagcgattgttgaagcagaagggcgctttgattttatctatattcaagcaccatactcggagacattaacgaatttattacaaatgataagcgaaccatacaatacgtatgttgatgaatcattttggtcagttgaatatgaacaagacgaaaatgtccaaaaatacgttgttcaaccattacattaccggaatattgaagaacgtaataataaattagaggcagttagcttctcaggacagtatggagataaggtttctcctaagttagcacttgtgcatccgaattttaaaggagatgtcgtttaccaaggtaattcagagctcacattgagtggagaatttgggaaagaatttaaacctatcgcatcttggcaaaataatctcgtttacgataaagataaagtcattcaaatatggccagaatttgatattgatggtgcggtcgagttgcaatatacatttagattgattcagactggcgctgatggtgcattaattgaacaaatcgtattgactgatgatatgttagacagtcctttagagatacctgcgaaaccatttgatgcttatataagtgtaactgttaaggcgcgtgggaacgggacggtacatttaggacctatacacaaacgatggtctagattagacatgggtcaatttttacttggtggtagtcgtttcgtagatagtcaacgacaggaatttatttattatttccaccctggtgatatgaaaccgccactaaacgtatattttagtggttatcgaacagcggaaggtttcgaaggatattatatgatgaaacgtatgaatgcaccgtttttacttatcggcgatcctcgtgttgaaggtggtagtttttatatcggttcatctgaatatgaacaaggtattatcaatgttattgacgagacattagaaaagctgaattttaaatcacatgaattaatattatctggtttatctatgggttcatttggtgccttgtattatggtgctcagttaaatcctcaggcaattattgttggtaaaccacttgttaatattggaacgattgctgaacatatgcgattacttagaccagaagagttcggtacagcattagacgtcctggtgtctaatgaaggtgatacatctcaagcgtcgatacaggcattaaatcaaaaattttggcaaacatttcaaaagaaatcattgtcacaaactgtttttgccatagcatatatgcaacatgatgattatgatccacatgcatttcaagagctattacctgtattgacagcacaccaagcaagagtgatgaatcgcagtattcctgggcgacataatgatgattcacctaccattgcaagttggtttgttaatttttacaacattattttggaagacaagtttgggagagttcaacatgctgaaaaacaaaacatt

SEQ ID NO: 3928 - protein, 525 aa, Staphylococcus aureus
  MISC_FEATURE (1)..(525): hypothetical protein
VKMMPRKFRVLQIGGDDLEPIFQHKKGVSWDYFDIGLFEFDSGYVEAIEAIVEAEGRFDFIYIQAPYSETLTNLLQMISEPYNTYVDESFWSVEYEQDENVQKYVVQPLHYRNIEERNNKLEAVSFSGQYGDKVSPKLALVHPNFKGDVVYQGNSELTLSGEFGKEFKPIASWQNNLVYDKDKVIQIWPEFDIDGAVELQYTFRLIQTGADGALIEQIVLTDDMLDSPLEIPAKPFDAYISVTVKARGNGTVHLGPIHKRWSRLDMGQFLLGGSRFVDSQRQEFIYYFHPGDMKPPLNVYFSGYRTAEGFEGYYMMKRMNAPFLLIGDPRVEGGSFYIGSSEYEQGIINVIDETLEKLNFKSHELILSGLSMGSFGALYYGAQLNPQAIIVGKPLVNIGTIAEHMRLLRPEEFGTALDVLVSNEGDTSQASIQALNQKFWQTFQKKSLSQTVFAIAYMQHDDYDPHAFQELLPVLTAHQARVMNRSIPGRHNDDSPTIASWFVNFYNIILEDKFGRVQHAEKQNI

SEQ ID NO: 3929 - DNA, 1551 bp, Staphylococcus aureus
atgaaatactttattccagcttggtacgatgaccaacgatggtggcaagacacgactgtgccgtattatcaactacaaaataagacggaatttgacgatatgattagtttaatgggaatgcaccttgaaaatgacttagattatcaactgattgttctcaatcatgcaccaaatttaagaacatttttacatcgatatgacttatatgagacaaagtattcgtctgtgtttgatgaaattcaaggattcagtcaccatgcgccacaagcgattaattatcatcacttaaaatggccggatgatgttgagtttgtgtacacaccgtatttattaaaatgtgtgacgagtgaacagacctatacaaatatttattttagtcaagaagggtattcaatttggtttgaagaatttgaaagagatcagttacaacggcgttatatttttgatgacagaggttatttatcagcgatacgttattttgatgatcagggagaggcttcttaccaagaatatttaacgattaatggagattgtgtacttcatgaagatttgaaaaatggcagagtcactgtttcaaaaagatatcaacatcactatcaacaaacagaatataacaatatggctcaactaattgaagaaaaatttcaagcaatgattgcacaacaaatacatgaagatgatcatgtgattgtggcttcagatgctaggcacaatcgacaaatagccaatcatattccagcgaaatcattaagttattcattttttaaaaatagaaatgaaactgtgtcagatgaggaatatcaatctatcgtaaagaatgcccatttaattgttgatagtgtgcaactagaacgtgatttaattagtcatcaagagaagtatcagcgggagaatacaatgattcgaatcacaccatttgaaacgagacaatcacctaatataagtagtcaattgatggaaacatttataggtgtatggatagatggtatgagtgacgctgatttgcaacaaatgatgcaacgacttgtggattatatcgcacaggaagattattaccgtttaattttattatcgcgccatcaaaatgacataccgatgtggcttcgtgaatgtattacgtcggtaaatgaggaataccaagctaaacagaatgcggatgttaatgtttcagcattaatgacacctgaagatcaagatgacatcattgctgttaagacgatacatgctgaacatgatgttgtagaagcattgcggacgttgcgacttgtgatagatatgtcaaaagaacctgacttgtatttacaaattagtgcaattagcgctgggattccacaaattaatggtcaacaaacagattacgtctctgattatgacaatggccgtattataaatacagttgatgaattagatgatgcgttaaattattatttattttatttgaaaaattggaattatgcgtacgcctattctttaaaattaatagatgcatatgcttctaagaatattattaatcagctcgatgagttaatagaaggtgaaaatgatgccacg

SEQ ID NO: 3930 - protein, 517 aa, Staphylococcus aureus
  MISC_FEATURE (1)..(517): hypothetical protein
MKYFIPAWYDDQRWWQDTTVPYYQLQNKTEFDDMISLMGMHLENDLDYQLIVLNHAPNLRTFLHRYDLYETKYSSVFDEIQGFSHHAPQAINYHHLKWPDDVEFVYTPYLLKCVTSEQTYTNIYFSQEGYSIWFEEFERDQLQRRYIFDDRGYLSAIRYFDDQGEASYQEYLTINGDCVLHEDLKNGRVTVSKRYQHHYQQTEYNNMAQLIEEKFQAMIAQQIHEDDHVIVASDARHNRQIANHIPAKSLSYSFFKNRNETVSDEEYQSIVKNAHLIVDSVQLERDLISHQEKYQRENTMIRITPFETRQSPNISSQLMETFIGVWIDGMSDADLQQMMQRLVDYIAQEDYYRLILLSRHQNDIPMWLRECITSVNEEYQAKQNADVNVSALMTPEDQDDIIAVKTIHAEHDVVEALRTLRLVIDMSKEPDLYLQISAISAGIPQINGQQTDYVSDYDNGRIINTVDELDDALNYYLFYLKNWNYAYAYSLKLIDAYASKNIINQLDELIEGENDAT

SEQ ID NO: 3931 - DNA, 1218 bp, Staphylococcus aureus
atggatatgtttgcagcgttattacaaataaagaattataaactctttgttgctaatatgtttctactaggtatgggtattgcggttacggtcccatatcttgttctttttgcaactaaagatttaggtatgacaacaaatcagtatggattacttctagcatctgcagcgattagccagtttacagtaaattcaattattgctagattttcggatacgcatcactttaatagaaaaattattattattctcgcattattaatgggtgcgcttggtttttcaatatacttttttgtagatacaatctggttattcatattactatatgcgattttccaaggattatttgcaccagcaatgccccaactttacgcatctgctagagaatctatcaatgtttcaagctctaaagatagagctcaatttgccaacacagtattacgttcaatgttctcattgggctttttatttggtccatttattggtgcccaattaatcggattaaaaggctatgctggattgtttggtggaacaataagtatcattttatttactttagtacttcaagtgtttttctataaggatttaaacattaaacaccctattagtacgcaacaacatgttgaaaaaattgctcctaatatgtttaaagacaaaacgcttttattaccatttattgcatttattttattacacattggacaatggatgtatacgatgaatatgcctttatttgttactgattatttaaaagaaaatgaacaacatgtcggttatttagctagtttatgtgctggtttagaagtgccatttatgatcattcttggcgttttatcatctagattacagactcgaacattgttgatttatggagcgatttttggtggtttattctacttcagcattggggtatttaaaaacttctatatgatgttagcaggacaggtgtttttagctattttcttagcggttcttttaggaattggtattagttatttccaagatatcttaccagattttccaggatacgcttcaacactattttctaatgcaatggttattggacagttaggcggtaacctattaggtggtgctatgagtcactgggtaggtttggaaaatgtattttttgtatcagcagcatcaatcatgttaggtatgatacttatattctttactaaaaatcaaaaaattacaaaagaggatgtgatatcaaca

SEQ ID NO: 3932 - protein, 406 aa, Staphylococcus aureus
  MISC_FEATURE (1)..(406): hypothetical protein
MDMFAALLQIKNYKLFVANMFLLGMGIAVTVPYLVLFATKDLGMTTNQYGLLLASAAISQFTVNSIIARFSDTHHFNRKIIIILALLMGALGFSIYFFVDTIWLFILLYAIFQGLFAPAMPQLYASARESINVSSSKDRAQFANTVLRSMFSLGFLFGPFIGAQLIGLKGYAGLFGGTISIILFTLVLQVFFYKDLNIKHPISTQQHVEKIAPNMFKDKTLLLPFIAFILLHIGQWMYTMNMPLFVTDYLKENEQHVGYLASLCAGLEVPFMIILGVLSSRLQTRTLLIYGAIFGGLFYFSIGVFKNFYMMLAGQVFLAIFLAVLLGIGISYFQDILPDFPGYASTLFSNAMVIGQLGGNLLGGAMSHWVGLENVFFVSAASIMLGMILIFFTKNQKITKEDVIST

SEQ ID NO: 3933 - DNA, 1209 bp, Staphylococcus aureus
atgttaaaacttttacaacaatacgaatataaaattatatataaacgtatgctatacacatgttttatcttgtttatttatatattaggcacaaacatttccatcgtttcctataacgatatgcaagtaaaacatgagtcattttttaaaatagctatttctaatatgggtggagacgttaatactttaaacattttcactttaggattaggtccgtggttaacatcaatgattatcttgatgctgatttcttatcggaatatggataaatacatgaaacaaacaagtcttgagaagcattataaagagcgcatcttaacattaattttaagtgttattcaaagttattttgtgattcatgaatatgtttcgaaagaacgtgttcatcaagacaatatttacttaacaatattgattttggttactggaacgatgttattagtttggttagctgacaaaaatagtcgctacggcatcgcaggaccaatgccgattgtaatggttagtattattaaatcaatgatgcatcaaaaaatggaatatatagatgcaagtcatattgtgattgcgttgttaatcatccttgtgataatcacattgtttatcttattatttattgaattagtagaagtgagaataccatatatcgatttaatgaacgtttccgcaacaaatatgaaatcttatttatcttggaaagttaaccctgcaggcagtattactttaatgatgagtatttcagcttttgttttcttaaaaagtggcattcattttattttatctatgtttaataaaagcatatcagatgacatgccaatgctgacatttgatagtccagtaggtatttcagtatatttagtgattcaaatgttattgggttattttttatcgagatttttaatcaatactaaacaaaaatccaaagatttcttaaagagtggcaattatttttcaggagttaaacctggtaaggatacagaacgttatttaaattatcaagcacgacgcgtatgttggtttggattggcattagttacagtcattattggtataccgctttatttcacattgtttgtaccgcatttatctactgaaatttatttctcagtacaactgattgtattagtttacatcagtattaatattgcagaaacaattcgtacatatttatattttgataaatataagccatttttaaaccagtattgg

SEQ ID NO: 3934 - protein, 403 aa, Staphylococcus aureus
  MISC_FEATURE (1)..(403): hypothetical protein
MLKLLQQYEYKIIYKRMLYTCFILFIYILGTNISIVSYNDMQVKHESFFKIAISNMGGDVNTLNIFTLGLGPWLTSMIILMLISYRNMDKYMKQTSLEKHYKERILTLILSVIQSYFVIHEYVSKERVHQDNIYLTILILVTGTMLLVWLADKNSRYGIAGPMPIVMVSIIKSMMHQKMEYIDASHIVIALLIILVIITLFILLFIELVEVRIPYIDLMNVSATNMKSYLSWKVNPAGSITLMMSISAFVFLKSGIHFILSMFNKSISDDMPMLTFDSPVGISVYLVIQMLLGYFLSRFLINTKQKSKDFLKSGNYFSGVKPGKDTERYLNYQARRVCWFGLALVTVIIGIPLYFTLFVPHLSTEIYFSVQLIVLVYISINIAETIRTYLYFDKYKPFLNQYW

SEQ ID NO: 3935 - DNA, 762 bp, Staphylococcus aureus
atgctttgtgaaccagacatagatgtactcagtgattcggatgtgcttgtcgaatcggatgtgctcaatgacgttgatgtgcttgttgacactgattctgagtcactaattgatgttgagtcggatttgtcttgtgacattgaaacactcgatgaattagattcactcattgatgttgagtcagatacgctcgttgaacctgaaccagacgtacttaatgattcagatatgcttgttgaagttgaaccacttgttgagtccgatgtacttgtcgatgtcgagtctgaatctgatgtactcaatgattctgagtcactgatagaagttgaatcacttgtagattctgattctactgtactttgtgaaccactgatacttattgaagtagaatcactgatactgtctgatgttgataatgatgtcgacaccgatgtgctttgtgatgacgatgtactagcactcattgacattgatgttgatatcgatgtacttaaggaaccagatgcacttgtacttgttgactggctttgtgacattgaatcacttaatgatgtagatgtgcttgttgagctcgagtcacttacacttgttgaacctgatattgagtcacttaaacttgtcgatgttgaaactgatacgcttccgctcattgagtcagatgttgaaagtgatgtactcgttgaatttgatccactgatgctagacgaatcacttgtagacattgagtcgctttctgatgcactgatgctcatagagtcaaat

SEQ ID NO: 3936 - protein, 254 aa, Staphylococcus aureus
  MISC_FEATURE (1)..(254): fibrinogen-binding protein
MLCEPDIDVLSDSDVLVESDVLNDVDVLVDTDSESLIDVESDLSCDIETLDELDSLIDVESDTLVEPEPDVLNDSDMLVEVEPLVESDVLVDVESESDVLNDSESLIEVESLVDSDSTVLCEPLILIEVESLILSDVDNDVDTDVLCDDDVLALIDIDVDIDVLKEPDALVLVDWLCDIESLNDVDVLVELESLTLVEPDIESLKLVDVETDTLPLIESDVESDVLVEFDPLMLDESLVDIESLSDALMLIESN

SEQ ID NO: 3937 - DNA, 1218 bp, Staphylococcus aureus
gtgctaagacttgtggaaccacttaaagatattgatccacttaatgagtcggagtcacttgtactagtagaatcactcattgatattgaatcacttagcgaggtagactcgcttacgctttctgaaccacttaatgatgttgaggtactcaatgaaccagatgtacttgttgaagtcgaaccacttgttgattttgaatcacttaatgaatcagattcactcacgctttctgaacttcttagtgacgtcgatacacttaatgatgacgaatcgcttgtgcttactgaatcgctcatcgattgtgagcaactcaatgaacttgactcgcttacactttctgattttcttaatgacgttgagacgctcaatgagccagaatcactgacacttgttgagccactcatcgatttagagtcactttcagaattagattcacttacactttctgaatcatttacagattctgacatactttgtgaatcagatatgcttgcgctcattacttcactagccgatgttgatgtacttgtcgaatcacttaacgatatagacacactcatcgaaccagatgtactcgcacttgttgagtctgatgttgaatcactaacactatcagataatgacgttgaatcactcatacttgttgatgtacttgtcgaaagcgacatactttgtgaatcactagtacttgtacgcatcgaagtactagttgaagctgatgtactacgagagtcacttgttgatgttgatgtacttgctgatcctgatgcacttgtacttcttgatgtgctttgtgaatcgcttaatgatgttgatgttgaatcggattcacttgtactttctgatgttgagccagactctgatgtacttaccgatgtagataaacttgcaatggtcgacatgcggtttgaagttgatgtacttagcgaatcacttaatgatgctgatgtgctttgtgaatcggattcactgctttgcattgacgcagatgttgaatcacttaaagatgttgacgacaaatcggattcacttgcgcttgctgagttactgagcgatgttgacgtacttgctgatcctgagttacttgtacttgttgagtcactgagtgatgttgacgcactttctgatgttgactcacttgcacttgttgagatactttgtgaatcagattcactctctgaaccacttaatgacgctgatgtgcttaccgaacctgat

SEQ ID NO: 3938 - protein, 406 aa, Staphylococcus aureus
  MISC_FEATURE (1)..(406): fibrinogen-binding protein
VLRLVEPLKDIDPLNESESLVLVESLIDIESLSEVDSLTLSEPLNDVEVLNEPDVLVEVEPLVDFESLNESDSLTLSELLSDVDTLNDDESLVLTESLIDCEQLNELDSLTLSDFLNDVETLNEPESLTLVEPLIDLESLSELDSLTLSESFTDSDILCESDMLALITSLADVDVLVESLNDIDTLIEPDVLALVESDVESLTLSDNDVESLILVDVLVESDILCESLVLVRIEVLVEADVLRESLVDVDVLADPDALVLLDVLCESLNDVDVESDSLVLSDVEPDSDVLTDVDKLAMVDMRFEVDVLSESLNDADVLCESDSLLCIDADVESLKDVDDKSDSLALAELLSDVDVLADPELLVLVESLSDVDALSDVDSLALVEILCESDSLSEPLNDADVLTEPD

SEQ ID NO: 3939 - DNA, 111 bp, Staphylococcus aureus
gtgcctcaaactcaacaagtacaagcacgagcgaatccgattcacaaagcacatcatcatatacaagtcagtcaacaagccaaagtgaatccacatcgacatcaacgtcac

SEQ ID NO: 3940 - protein, 37 aa, Staphylococcus aureus
VPQTQQVQARANPIHKAHHHIQVSQQAKVNPHRHQRH

SEQ ID NO: 3941 - DNA, 798 bp, Staphylococcus aureus
atgctcattgatgttgaatcggatttactttcacttgatgatgttgagtcggattcactttcacttgtagaaccacttaatgatgtggatgtactaatggaatcagatttacttgtactgattgaatcacttgtcgacattgatgtacttaatgaatcagacttactatcacttgtggaatcacttaatgatgttgacaaacttgtagagtcagacaaacttgtactcgttgacatactcagtgatgttgaaacactctcgctcttaaacgttgacgttgattcactgatacttgtcgatgttgaaatggacgtactaccacttgttgaattacttaatgatgttgatgtgctaccagattctgatgtactgtctgataatgacgtactctcacttgtcgaactactcactgactctgatgttgattcagacgtactttcacttaatgattcacttaaaaaggcagatgcactttgtgattctgaatcgctagtactatttgattcacttaatgatataaacgtgctctctgaagcagatattgcttcacttatagagtcgctcgttgacgttgattcacttattgaatcagactctgatgtacttaagcttgtggaatcactcatagatgttgatgtacgttctgaattacttgtacttaacgatgtcgaagtacttaccgaaccagatgtgctcgtagaagcactttgtgatattgattcacttgatgcagttgatgctgatttgctatcactcgttgaatcactaaacgacgttgatatgctcattgaatcggat

SEQ ID NO: 3942 - protein, 266 aa, Staphylococcus aureus
  MISC_FEATURE (1)..(266): fibrinogen-binding protein
MLIDVESDLLSLDDVESDSLSLVEPLNDVDVLMESDLLVLIESLVDIDVLNESDLLSLVESLNDVDKLVESDKLVLVDILSDVETLSLLNVDVDSLILVDVEMDVLPLVELLNDVDVLPDSDVLSDNDVLSLVELLTDSDVDSDVLSLNDSLKKADALCDSESLVLFDSLNDINVLSEADIASLIESLVDVDSLIESDSDVLKLVESLIDVDVRSELLVLNDVEVLTEPDVLVEALCDIDSLDAVDADLLSLVESLNDVDMLIESD

SEQ ID NO: 3943 - DNA, 276 bp, Staphylococcus aureus
gtgctcattgaactacttacggacattgatttactgtctgatgcagataatgacccacttgtactgatagagtcacttactatctctgaagtactcatcgagtctgatgtacttgttgagacactttgtgatgctgctatgcttagtgatccagaaacagaaccacttgtgctcgtcgaatcgctcaatgattctgatgtactcatcgattttgaatcacttgtacttaatgatattgatgtactttgtgaatctgatttgcttgttgacgcactt

SEQ ID NO: 3944 - protein, 92 aa, Staphylococcus aureus
VLIELLTDIDLLSDADNDPLVLIESLTISEVLIESDVLVETLCDAAMLSDPETEPLVLVESLNDSDVLIDFESLVLNDIDVLCESDLLVDAL

SEQ ID NO: 3945 - DNA, 528 bp, Staphylococcus aureus
ttggctatgctatttgaaatactgatagagtccgaggtgctagctgactcgctcaatgatgttgatgtactaattgcattcgatgtactgtcacttaatgatgctgatgtactagacgaccctgatatactcgttgataagctttgtgacttagacaagcttcctgatgtactcatacttaatgagtcactgagtgatgttgatgtacgcaatgaatcagatgtacttgttgatagactttcggatttttcagtactgctagagtttgaaatagaatcgcttaatgatgttgatttactagctgaatccgacatgcttgatgatacactttgtgaattcactaaacttgtgcttgttgagcttgatacactattactttcagatgtgcttaatgacttagatgcactcacagaatcagataggcttacacttgtcgatttcgaggtactagctgatgtagataccacaatcgatcctgatgtactcgttgatgcactttgtgagtcagctttacttgttgacacactt

SEQ ID NO: 3946 - protein, 176 aa, Staphylococcus aureus
LAMLFEILIESEVLADSLNDVDVLIAFDVLSLNDADVLDDPDILVDKLCDLDKLPDVLILNESLSDVDVRNESDVLVDRLSDFSVLLEFEIESLNDVDLLAESDMLDDTLCEFTKLVLVELDTLLLSDVLNDLDALTESDRLTLVDFEVLADVDTTIDPDVLVDALCESALLVDTL

SEQ ID NO: 3947 - DNA, 6813 bp, Staphylococcus aureus
atgagtaaaagacagaaagcatttcatgacagcttagcaaacgaaaaaacaagagtaagactttataaatctggaaaaaattgggtaaaatccggaattaaagaaatagaaatgttcaaaattatggggctaccatttattagtcatagtttagtgagtcaagataatcaaagcattagtaaaaaaatgacgggatacggactgaaaactacggcggttattggtggtgcattcacggtaaatatgttgcatgaccagcaagcttttgcggcttctgatgcaccattaacttctgaattaaacacacaaagtgaaacagtaggtaatcaaaactcaacgacaatcgaagcatcaacatcaacagccgattccacaagtgtaacgaaaaatagtagttcggtacaaacatcaaatagtgacacagtctcaagtgaaaagtctgaaaaggtcacttcgacaactaatagtacaagcaatcaacaagagaaattgacatctacatcagaatcaacatcctcaaagaatactacatcaagttctgatactaaatctgtagcttcaacttcaagtacagaacaaccaattaatacatcaacaaatcaaagtactgcatcaaataacacttcacaaagcacaacgccatcttcggtcaacttaaacaaaactagcacaacgtcaactagcaccgcaccagtaaaacttcgaactttcagtcgcttagctatgtcaacatttgcgtcagcagcgacgacaaccgcagtaactgctaatacaattacagttaataaagataacttaaaacaatatatgacaacgtcaggtaatgctacctatgatcaaagtaccggtattgtgacgttaacacaggatgcatacagccaaaaaggtgctattacattaggaacacgtattgactctaataagagttttcatttttctggaaaagtaaatttaggtaacaaatatgaagggcatggaaatggtggagatggtatcggttttgccttttcaccaggtgtattaggtgaaacagggttaaacggtgccgcagtaggtattggtggcttaagtaacgcatttggcttcaaattggatacgtatcacaatacatctaaaccaaattcagctgcaaaggcgaatgctgacccatctaatgtagctggtggaggtgcgtttggtgcatttgtaacaacagatagttatggtgttgcgacaacgtatacatcaagttcaacagctgataatgctgcgaagttaaatgttcaacctacaaataacacgttccaagattttgatattaactataatggtgatacaaaggttatgactgtcaaatatgcaggtcaaacatggacacgtaatatttcagattggattgcgaaaagtggtacgaccaacttttcattatcaatgacagcctcaacaggtggcgcgacaaatttacaacaagtacaatttggaacattcgaatatacagagtctgctgttacacaagtgagatacgttgatgtaacaacaggtaaagatattattccaccaaaaacatattcaggaaatgttgatcaagtcgtgacaatcgataatcagcaatctgcattgactgctaaaggatataactacacgtccgtcgatagttcatatgcgtcaacttataatgatacaaataaaactgtaaaaatgacgaatgctggacaatcagtgacatattattttactgatgtaaaagcaccaactgtaactgtaggcaatcaaaccatagaagtgggtaaaacaatgaatcctattgtattgactacaacggataatggtactgggactgtgacaaatacagttacaggattaccaagcggattaagttacgatagtgcaacgaattcaatcattgggacaccaacaaaaattggtcaatcaacagtgacagttgtgtctactgaccaagcaaataacaaatcgacgacaacttttacaataaatgttgtggatacgacagcaccaacagtgacaccaataggagatcaatcatcagaagtgtattcaccaatatccccgattaaaattgctacgcaagataacagtggaaatgcggtgacgaatacagtgactggattgccatccggactaacatttgatagtacaaataatactattagtggtacaccaacaaacattggtacaagtactatatcaatcgtttctacagatgcgagcggtaacaaaacgacgacaacttttaaatatgaagtaacaagaaatagcatgagtgattccgtatcaacatcaggaagtacacaacaatctcaaagtgtgtcaacaagtaaagctgactcacaaagtgcatcaacgagtacatcaggatcgattgtggtatctacatcagctagtacctcgaaatcgacaagtgtaagcctatctgattctgtgagtgcatctaagtcattaagcacatctgaaagtaatagtgtatcaagctcaacaagcacaagtttagtgaattcacaaagtgtatcatcaagcatgtcggattcagctagtaaatcaacatcattaagcgattctatttcaaactctagcagtactgaaaaatccgaaagtctatcaacaagtacatctgattcattgcgtacatcaacatcactcagtgactcattaagtatgagtacatcaggaagcttgtctaagtcacaaagcttatcaacgagtatatcagggtcgtctagtacatcagcatcattaagtgacagtacatcgaatgcaattagtacatcaacatcattgagcgagtcagctagcacctcggactctatcagtatttcaaatagcatagccaactctcaaagtgcgtcaacaagcaaatcagattcacaaagtacatcaatatcattaagtacaagtgattcaaaatcgatgagtacatcagaatcattgagcgattcgacgagcacaagtggttctgtttctggatcactaagcatagcagcatcacaaagtgtctcaacaagtacatcagactcgatgagtacttcagagatagtaagtgactctatcagtacaagtgggtcattatctgcatcagacagtaaatcaatgtccgtaagtagttcaatgagcacgtctcagtcaggtagtacatcagaatcattaagtgattcacaaagtacatctgattctgatagtaagtcattatcacaaagtactagtcaatcaggttcaacaagtacatcaacgtcgacaagtgcttcagtacgtacttcggaatcacaaagtacgtctggttcaatgagtgcaagtcaatccgattcaatgagcatatcaacgtcgtttagtgattcaacgagtgatagcaaatcagcatcaactgcatcaagtgaatcaatatcacaaagtgcttctacgagcacatctggttcggtaagtacttcgacatcgttaagtacaagtaattcagaacgtacatcaacatctatgagtgattccacaagcttaagtacatcagagtctgattcaataagtgaatcaacgtcaacgagcgactctataagtgaagcaatatctgcttcagagagcacgtttatatcattaagtgaatcaaatagtactagcgattcagaatcacaaagtgcatctgcctttttaagtgaatcattaagtgaaagtacgtctgaatcaacatcagagtcagtgagtagttcgacaagtgagagtacgtcattatcagacagtacatcagaatctggtagcacatcaacatcattaagtaattcaacaagtggtagtacgtccatttcaacatcgacaagtatcagtgaatcaacgtcaacgtttaagagcgagagtgtttcaacatcactgagtatgtcaacgagtacaagtttgtctgactctacaagtttgtcaacatcattaagtgattccacaagtgatagtaagtctgattcattaagtacatcaatgtcgacaagtgattcaatcagtacaagtaaatctgattccattagtacatccacatcattaagtggttctacaagtgaaagtgaatccgactcaacatcatcaagtgaaagtaaatccgattcaacatcaatgagcataagtatgtctcaatcaacatcaggaagtacaagtacgtcaacgagtacaagtttgtctgactcaacgagtacatcattgtcactaagtgcctcaatgaatcaaagcggagtagactcaaactcagcaagccaaagtgcctcaaactcaacaagtacaagcacgagcgaatccgattcacaaagcacatcatcatatacaagtcagtcaacaagccaaagtgaatccacatcgacatcaacgtcactaagcgattcaacaagtatatctaaaagtacgagtcaatcaggttcggtaagcacatcagcgtcattaagtggttcagagagtgaatctgattcacaaagtatctcaacaagtgcaagtgagtcaacatcagaaagtgcgtcaacatcactcagtgactcaacaagtacaagtaactcaggatcagcaagtacgtcaacatcgctcagtaactcagcaagcgcaagtgaatccgatttgtcgtcaacatctttaagtgattcaacatctgcgtcaatgcaaagcagtgaatccgattcacaaagcacatcagcatcattaagtgattcgctaagtacatcaacttcaaaccgcatgtcgaccattgcaagtttatctacatcggtaagtacatcagagtctggctcaacatcagaaagtacaagtgaatccgattcaacatcaacatcattaagcgattcacaaagcacatcaagaagtacaagtgcatcaggatcagcaagtacatcaacatcaacaagtgactctcgtagtacatcagcttcaactagtacttcgatgcgtacaagtactagtgattcacaaagtatgtcgctttcgacaagtacatcaacaagtatgagtgattcaacgtcattatctgatagtgttagtgattcaacatcagactcaacaagtgcgagtacatctggttcgatgagtgtgtctatatcgttaagtgattcgacaagtacatcaacatcggctagtgaagtaatgagcgcaagcatatctgattcacaaagtatgtcagaatctgtaaatgattcagaaagtgtaagtgaatctaattctgaaagtgactctaaatcgatgagtggctcaacaagtgtcagtgattctggctcattgagcgtctcaacgtcattaagaaaatcagaaagtgtaagcgagtcaagttcattgagttgctcacaatcgatgagcgattcagtaagcacaagcgattcgtcatcattaagtgtatcgacgtcactaagaagttcagaaagcgtgagtgaatctgattcattaagtgattcaaaatcaacaagtggttcgacttcaacaagtacatctggttcattgagtacctcaacatcattaagtggttcagaaagcgtaagcgagtctacctcgctaagtgattcaatatcaatgagtgattctactagtacaagtgactccgactcattaagtggatcaatatctttaagtggttccacaagtcttagcacttcggattcattaagtgattcaaaatcattgagtagctcgcaaagtatgagtggatcagaatcaacgtcaacaagtgtgagcgattcgcagtcaagctcaacaagtaatagtcaatttgactctatgagcatcagtgcatcagaaagcgactcaatgtctacaagtgattcgtctagcatcagtggatcaaattcaacgagtacatcactttcaacatctgactcaatgagcggaagcgtatcagtttcaacatcgacaagtttaagtgactcaatatcaggttcaacaagtgtaagtgactcgagctcaacaagcacatctacatcattaagtgattcaatgtcacaaagccagtcaacaagtacaagtgcatctggttccttaagtacatcgatatcaacatcaatgtcaatgagtgctagtacatcgtcatcacaaagcacatcggtgtcgacatcattatcaacatcagacagtatcagtgattctacttcaataagtatcagtggttcacaaagtacagtagaatcagaatctacaagtgattcaacttctatcagtgactcagaatcattgagtacatcagattcagactcgacatcgacaagtacatcggactcaacaagtggttcaacttcaacaagcatatctgaatcattaagtacgtctggttcaggttcaacgagcgtatctgactcaacatcaatgagtgaatctaattcatcgagtgtttcaatgtcacaagacaaatccgactcaacatcaattagtgactcagaatcagtgtcaacaagcacatcaacgtcattgagcacatccgattcgacaagcacatccgaatcactgagtacatctatgtctggttcacaaagcatttctgactcaacatcaacaagtatgtccggctcaacaagtacatctgaatctaactcaatgcatccgtcagactcaatgagtatgcatcatactcacagcacgagcacatctcgcttatcaagtgaagcaacaacgagcacgagtgaatctcagtctacattaagtgcaacatctgaagtgactaaacataatggcacaccagcacaaagtgaaaaaagattgccagatacaggtgactcaataaaacaaaatggattactaggtggcgttatgacattattagttggtttaggtttaatgaagagaaagaaaaagaaagatgaaaatgatcaagatgattctcaagca

SEQ ID NO: 3948 - protein, 2271 aa, Staphylococcus aureus
  MISC_FEATURE (1)..(2271): hypothetical protein
MSKRQKAFHDSLANEKTRVRLYKSGKNWVKSGIKEIEMFKIMGLPFISHSLVSQDNQSISKKMTGYGLKTTAVIGGAFTVNMLHDQQAFAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPVKLRTFSRLAMSTFASAATTTAVTANTITVNKDNLKQYMTTSGNATYDQSTGIVTLTQDAYSQKGAITLGTRIDSNKSFHFSGKVNLGNKYEGHGNGGDGIGFAFSPGVLGETGLNGAAVGIGGLSNAFGFKLDTYHNTSKPNSAAKANADPSNVAGGGAFGAFVTTDSYGVATTYTSSSTADNAAKLNVQPTNNTFQDFDINYNGDTKVMTVKYAGQTWTRNISDWIAKSGTTNFSLSMTASTGGATNLQQVQFGTFEYTESAVTQVRYVDVTTGKDIIPPKTYSGNVDQVVTIDNQQSALTAKGYNYTSVDSSYASTYNDTNKTVKMTNAGQSVTYYFTDVKAPTVTVGNQTIEVGKTMNPIVLTTTDNGTGTVTNTVTGLPSGLSYDSATNSIIGTPTKIGQSTVTVVSTDQANNKSTTTFTINVVDTTAPTVTPIGDQSSEVYSPISPIKIATQDNSGNAVTNTVTGLPSGLTFDSTNNTISGTPTNIGTSTISIVSTDASGNKTTTTFKYEVTRNSMSDSVSTSGSTQQSQSVSTSKADSQSASTSTSGSIVVSTSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLSIAASQSVSTSTSDSMSTSEIVSDSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASESTFISLSESNSTSDSESQSASAFLSESLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMSISMSQSTSGSTSTSTSTSLSDSTSTSLSLSASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMSTIASLSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMSVSISLSDSTSTSTSASEVMSASISDSQSMSESVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDSMSISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDSMSMHHTHSTSTSRLSSEATTSTSESQSTLSATSEVTKHNGTPAQSEKRLPDTGDSIKQNGLLGGVMTLLVGLGLMKRKKKKDENDQDDSQA

SEQ ID NO: 3949 - DNA, 690 bp, Staphylococcus aureus
atgaattattcgccaaaacaaggtgtaagaagtcatggtttaccgcacgacccatttaaaagtagtacagtaccacgtccaatagggtggatctctactgtatcgaaagatgggaaagataatttagcgccttatagtcagtatcaaaacttaacttgggatccgcctatggttatgttcgcagcaaatcaatccgttcttggtgatcacgaacgtaaagatacagtgaaaaatgctgaagagacaggttggtttgtgtggaatatggcaacgtatgatttaagagaagcagttaatttatcatcgaaagcattgccaccagaagaggatgaatttaattttgcaggtgtaacaaaggaaaaatgtatagaagctccaggatatcgtgtaaaagaatcgccagttcattttgaatgtgagtacgttcaaacgattcgtattccaactggagatccagtatctaccgtagatattgttataggaagagttgcccaagttcatattgacgataaggttattcttgataatggtaaattggacattaagtcgattaaacctattgccagattaggatattacgattacacagtagtgaatgagatatttgaaatgaaagcacctgcagcttctaaagaagagttagcaggtttagaaggaagaaatttcgataatcaatcagatgaaaagata

SEQ ID NO: 3950 - protein, 230 aa, Staphylococcus aureus
  MISC_FEATURE (1)..(230): conserved hypothetical
MNYSPKQGVRSHGLPHDPFKSSTVPRPIGWISTVSKDGKDNLAPYSQYQNLTWDPPMVMFAANQSVLGDHERKDTVKNAEETGWFVWNMATYDLREAVNLSSKALPPEEDEFNFAGVTKEKCIEAPGYRVKESPVHFECEYVQTIRIPTGDPVSTVDIVIGRVAQVHIDDKVILDNGKLDIKSIKPIARLGYYDYTVVNEIFEMKAPAASKEELAGLEGRNFDNQSDEKI

SEQ ID NO: 3951 - DNA, 426 bp, Staphylococcus aureus
atgagcgaaaaacttcaagtaaaacaagaatttaacggcgttacaaggcaatacttgaatttcagaacagatagtatcgatgatctggataagttcaaaaaagaattcaaacctgttatgcacttaaaaggtgatgcattcaatcaacagttacaatctttgattaacaaatatccacaaatacaaaaaaatatgaaatcagagttcattgcttattatgataaagaaaaaaatagagaaacagtaaaaaactatgcttggaaccttcaaaaatctataaatgacattatgcaatcatatcctagcacaaaatttgtacagttttataaagatgatgtttccccgtcaatggtagatggaaatggccgtttaaaatcggatactaatgtaatttccatcgagggaggaaagtatgatgagaacaaa

SEQ ID NO: 3952 - protein, 142 aa, Staphylococcus aureus
  MISC_FEATURE (1)..(142): hypothetical protein
MSEKLQVKQEFNGVTRQYLNFRTDSIDDLDKFKKEFKPVMHLKGDAFNQQLQSLINKYPQIQKNMKSEFIAYYDKEKNRETVKNYAWNLQKSINDIMQSYPSTKFVQFYKDDVSPSMVDGNGRLKSDTNVISIEGGKYDENK

SEQ ID NO: 3953 - DNA, 93 bp, Staphylococcus aureus
ttggttgctaatgcaccaacagcaaaagagcccctaattaataaattaaaaggggacaaaggaatacagttggttgctaatgcaccaactgca

SEQ ID NO: 3954 - protein, 31 aa, Staphylococcus aureus
LVANAPTAKEPLINKLKGDKGIQLVANAPTA

SEQ ID NO: 3955 - DNA, 303 bp, Staphylococcus aureus
atgatgagaacaaatgatcatataaccgatttagatgctattgagttaagtagcggttggaattacaattcgaaattggagactggcaaaaatgcactactatcagatagccttttaagagatattaaagtattaagttctaatgctaaaggcgacgctgacatactagaaacagaacttcgtgctgtaataaactcaatgtctcaaaacgaaggtaaatctgttgatgcacttaaaaatagtaccgcttctctaaaaaacaatctaaccaaattaaaagagcaactcgacaaaactacacat

SEQ ID NO: 3956 - protein, 101 aa, Staphylococcus aureus
  MISC_FEATURE (1)..(101): hypothetical protein
MMRTNDHITDLDAIELSSGWNYNSKLETGKNALLSDSLLRDIKVLSSNAKGDADILETELRAVINSMSQNEGKSVDALKNSTASLKNNLTKLKEQLDKTTH

SEQ ID NO: 3957 - DNA, 357 bp, Staphylococcus aureus
atgattttgcgttacgcaacgaatttaaaacttgcgaaagagctataccaagccagtaaacctaaattgcaagaagataagggtatgattgaactgtttgaacatacttttggcttgcaaaaagaacttgtaaaatacgtcggcattgcagaagcaactactgctgctttatactcagctagctttatcaataaaaacatttctcgccttgcatcactatcaacgataggcattttaagtgtagctgcttacaaacatttcgaagctggccaaggtaaaaaaggtgcacaacatgcattaaatttattaggtcttgctactttaagtttactagatacattttcttgtaataaaaaa

SEQ ID NO: 3958 - protein, 119 aa, Staphylococcus aureus
  MISC_FEATURE (1)..(119): hypothetical protein
MILRYATNLKLAKELYQASKPKLQEDKGMIELFEHTFGLQKELVKYVGIAEATTAALYSASFINKNISRLASLSTIGILSVAAYKHFEAGQGKKGAQHALNLLGLATLSLLDTFSCNKK

SEQ ID NO: 3959 - DNA, 609 bp, Staphylococcus aureus
atgtatacgtttgatgcacaatcattaactgctagagaaaactataaattattaattggttcaattattccacgacctatagcttttgttacaacattaaatcaagatgcatcagtaaatgcagcaccatttagcttttttaatattgttaataatcatccgccaatgattgctattgcagttcaacgtgcaggaggtaagagaaaagatactgcattaaatatagaacggactggagactttgttgtgcatattacagacgaagataatgttcaagatattaatgagactgcagcgccgttagcatatggtgacagtgagttgagtcgtacagaattatcacttttaacatctacaacgattaagacgccaggaattaaagatgcgaaaatgagattcgaatgtaaactatcgcaaatgatattgcttggagatgtattagatggggctgatttaataataggtgaaattgtaacttatcatattgatgacagtatttatgagggtgattttaaaatcaatccacacgcattacaggctgtttctcgtttagccggaaatgattatgctaaattagggggaatatttacgataaagagaccagaaaaa

SEQ ID NO: 3960 - protein, 203 aa, Staphylococcus aureus
  MISC_FEATURE (1)..(203): conserved hypothetical
MYTFDAQSLTARENYKLLIGSIIPRPIAFVTTLNQDASVNAAPFSFFNIVNNHPPMIAIAVQRAGGKRKDTALNIERTGDFVVHITDEDNVQDINETAAPLAYGDSELSRTELSLLTSTTIKTPGIKDAKMRFECKLSQMILLGDVLDGADLIIGEIVTYHIDDSIYEGDFKINPHALQAVSRLAGNDYAKLGGIFTIKRPEK

SEQ ID NO: 3961 - DNA, 474 bp, Staphylococcus aureus
atggcagttgtttatgtagcaggaggatgtttatggggtgttgaagcattttttgcaacaatacctggaattatacatacagaagcaggaagagcaaatggaagaagctctaaattagacggtccgtatgatggttatgctgaatgtgtcaaacttcatttcgatgatcgtatgttaacaattacagacattatgaattatttatttgaaatcattgatccttacagtgtgaatcaacaaggaaatgatattggacaaaagtatcgaacgggtttatatagttgtgtagatgaccacttaattgaagcgcgtcagttcattgaacgacgtaaagacagagatcaaattgcagtggaagtcttaccgctgtctaactacattaaaagtgctgaagaacatcagcaacatttagaaaaatatccagaagatatgcatatgtgtcatatttcaaaagatttgctaaataaatacaag

SEQ ID NO: 3962 - protein, 158 aa, Staphylococcus aureus
  MISC_FEATURE (1)..(158): hypothetical protein
MAVVYVAGGCLWGVEAFFATIPGIIHTEAGRANGRSSKLDGPYDGYAECVKLHFDDRMLTITDIMNYLFEIIDPYSVNQQGNDIGQKYRTGLYSCVDDHLIEARQFIERRKDRDQIAVEVLPLSNYIKSAEEHQQHLEKYPEDMHMCHISKDLLNKYK

SEQ ID NO: 3963 - DNA, 498 bp, Staphylococcus aureus
atggtattaagaaaagtaatcatgcaggacttagatcaaattattgcacttgaaaatattggtttttcaccggaagaagctgcaacacgagaggcattgaaattgagaattgaacaaattcaagaaacttttattgtagctgaaaagaatgatgaagtaattggatacatcaacggtccagtcataaaagagcgttacattagcgatgatttatttaaaaatgtctccacaaataatagtgaaggtggctatattagtgtgttaggtcttgttgtagcaccaaattatcaaggtcagggtattgcaggtcgcttactaaactattttgaaactcttgctaagaatcatcatcgacatggtgtaacgttaacatgtcgagaatcattaatttcattttatgaaaaatatgggtatcgtaatgaaggtgtatcagaatcatgtcatggcggtattaaatggtataaccttgttaaaaatataaaaaaggatgatgaggtg

SEQ ID NO: 3964 - protein, 166 aa, Staphylococcus aureus
  MISC_FEATURE (1)..(166): conserved hypothetical
MVLRKVIMQDLDQIIALENIGFSPEEAATREALKLRIEQIQETFIVAEKNDEVIGYINGPVIKERYISDDLFKNVSTNNSEGGYISVLGLVVAPNYQGQGIAGRLLNYFETLAKNHHRHGVTLTCRESLISFYEKYGYRNEGVSESCHGGIKWYNLVKNIKKDDEV

SEQ ID NO: 3965 - DNA, 765 bp, Staphylococcus aureus
atgattgatattcataaccatatattagttgatatagatgatggtcctaaaacaattgaaaagagtattgcactattaaagcaagctaaggatgaaggtgtaacaagtattgtagcgacacctcatcatttgcatccgagatatgataatacatttcaacaagtgcttgtgaaattggcggagttaagaacgcatccagaagttcaagcattggatattaaattatttcccgggcaagaaattagaattacagattcgattctgaaaggcttagataatggtagtattcaaggtattaatcgttcgaaatatttattaattgaatttccaacgggcgaagtaccacattatacaaaacaattgttttttgaaatacaatcgagaggttacataccaatcattgcacatcctgaaagaaatagaagtatcgccaaaaatccggaaatattatatgaattggttgcaaatggggcactgagtcaattaacatcgagttctttagttggtggatttggtaaaaacattcaaaagttatcattacaatttatagaatgtaatttggctcattttgtagcttcagatgcacattcatgtgaccaaagaccatttttgatgcaagaattatttcacaatcataaattgaagaaatattcgaatgatattgaagcattacttcgaaatgccagttcagtaatcaatgataattttgtttatttagacagaccgactaagccaggaaaagtgaagtcgtttttgaaatggttt

SEQ ID NO: 3966 - protein, 255 aa, Staphylococcus aureus
  MISC_FEATURE (1)..(255): capsular polysaccharide
MIDIHNHILVDIDDGPKTIEKSIALLKQAKDEGVTSIVATPHHLHPRYDNTFQQVLVKLAELRTHPEVQALDIKLFPGQEIRITDSILKGLDNGSIQGINRSKYLLIEFPTGEVPHYTKQLFFEIQSRGYIPIIAHPERNRSIAKNPEILYELVANGALSQLTSSSLVGGFGKNIQKLSLQFIECNLAHFVASDAHSCDQRPFLMQELFHNHKLKKYSNDIEALLRNASSVINDNFVYLDRPTKPGKVKSFLKWF

SEQ ID NO: 3967 - DNA, 690 bp, Staphylococcus aureus
atgacgaatacacgaagaagtacatcaagtttaattgtccatgaacaaccaaagtcacctattagcgagaaatttcgaggcataagatcaaatattatgtttgcaaatcctgacagtgcagttcaaagcattgtaatcacttcagaggcaccaggcgcaggtaagtctacaattgcagcaaatttagcagttgcatatgcgcaagcaggttataaaacactaatcgtagacggggatatgcgtaaacctacgcagcattatatttttaatttgccaaacaatgaaggcctatcaagtttattgctaaattggtcaacttatcaagacagtattatctcaactgaaattcaagatttagacgtcttgacgtctgggccaatcccaccgaatccgtcagagttaattacatcaagggcatttgcaaatttgtatgacacattattgatgaattataactttgtaattatcgatacgccaccagtgaacacagttacagatgcgcaattattttcaaagtttaccggcaatgttgtctacgtagttaattcggaaaataataatagagatgaagttaaaaaaggaaaagaacttattgaagcaacaggtgctaaattattaggtgtagtcttaaatagaatgcctaaagataaaagtgctagttactatgcatattatgggactgatgaatca

SEQ ID NO: 3968 - protein, 230 aa, Staphylococcus aureus
  MISC_FEATURE (1)..(230): capsular polysaccharide
MTNTRRSTSSLIVHEQPKSPISEKFRGIRSNIMFANPDSAVQSIVITSEAPGAGKSTIAANLAVAYAQAGYKTLIVDGDMRKPTQHYIFNLPNNEGLSSLLLNWSTYQDSIISTEIQDLDVLTSGPIPPNPSELITSRAFANLYDTLLMNYNFVIIDTPPVNTVTDAQLFSKFTGNVVYVVNSENNNRDEVKKGKELIEATGAKLLGVVLNRMPKDKSASYYAYYGTDES

SEQ ID NO: 3969 - DNA, 693 bp, Staphylococcus aureus
atgaatacaatgattgattatgtggaggaaaccatgaaagaaaagtttgatttagtaaaactattaaatattctaaagaagaatattaaattattgcttattttaccggcaatatgtcttgtagtaagtgcggcattaaccttttttgttatgcctgacaaatatactgcttctactcaaatattagtgaacatgaaaaagtcctcaagtgatttagctttccaaaatgttcaaagtagtttgcagtctgttaatacatatacggaaattatcaaaagtcctagaattctagataaagtatctagagaatttgatggtcagtattcaacagctgagttgaattcatttttaaaagtaaccaatcaaacaaactctcaaattattactgtatcagttaccactgggaataaatctgaatctgacaaaattgttaataaaatatctaaagtttttgctcatgacatgcctaaaattatgagtgttgataatgttacgatactttcctcagcacatgataatgctgtaaaagtatctccaatagtatctgtcaacttagttatcagcattattgttggtattgttttagcaatattgattattttcttaaaagaattattagataagcgtattaagacagaagaagatgttgaatcgcaactaggattacctattttaggttcaatacaaaaattt

SEQ ID NO: 3970 - protein, 231 aa, Staphylococcus aureus
  MISC_FEATURE (1)..(231): capsular polysaccharide
MNTMIDYVEETMKEKFDLVKLLNILKKNIKLLLILPAICLVVSAALTFFVMPDKYTASTQILVNMKKSSSDLAFQNVQSSLQSVNTYTEIIKSPRILDKVSREFDGQYSTAELNSFLKVTNQTNSQIITVSVTTGNKSESDKIVNKISKVFAHDMPKIMSVDNVTILSSAHDNAVKVSPIVSVNLVISIIVGIVLAILIIFLKELLDKRIKTEEDVESQLGLPILGSIQKF

SEQ ID NO: 3971 - DNA, 558 bp, Staphylococcus aureus
ttgaaggataagattattgataacgcaataaccttattttcagagaaggggtatgacggtacaacacttgatgatatagctaaaagtgtaaatataaagaaagcgagtttatattaccattttgactcgaaaaaaagtatttacgaacaaagtgttaaatgttgttttgattaccttaataatattattatgatgaatcaaaataaatcgaactattcaattgatgctttatatcaattcttatttgagtttattttcgacatcgaagaaaggtatattagaatgtacgttcaattatctaatacgcctgaggaattttctggaaatatttacggacaaatacaagatttaaatcaatcattaagtaaagagatagcaaaattctatgatgaatcaaagataaagatgacaaaagaagactttcagaatttaatattgctgtttcttgaaagttggtatttgaaagcatccttttcgcaaaaatttggagcagtggaagaaagtaaaagtcaattcaaagatgaagtgtattcgctactaaatatatttttgaagaaa

SEQ ID NO: 3972 - protein, 186 aa, Staphylococcus aureus
  MISC_FEATURE (1)..(186): ica operon transcriptional
LKDKIIDNAITLFSEKGYDGTTLDDIAKSVNIKKASLYYHFDSKKSIYEQSVKCCFDYLNNIIMMNQNKSNYSIDALYQFLFEFIFDIEERYIRMYVQLSNTPEEFSGNIYGQIQDLNQSLSKEIAKFYDESKIKMTKEDFQNLILLFLESWYLKASFSQKFGAVEESKSQFKDEVYSLLNIFLKK

SEQ ID NO: 3973 - DNA, 1236 bp, Staphylococcus aureus
ttgcaattttttaactttttgcttttttatcctgtatttatgtctatttactggattgtcggttcaatttatttctattttaccagagaaattagatattcattgaacaagaagcctgacataaatgtggatgaattagaaggcattacatttttacttgcctgttataacgaaagtgaaacgattgaagatacgttgtctaatgttcttgcactcaaatacgagaagaaagaaattattatcattaatgatggaagttcagataatacagcagaactcatctataaaatcaaagaaaataatgactttattttcgtcgatttacaagaaaacagaggtaaagccaacgcactcaatcaaggcattaaacaggcttcatatgattatgtaatgtgcttggatgcagatactatcgttgatcaagatgcaccatattatatgattgagaatttcaaacatgatccaaaacttggtgcagttacaggtaatcctagaattcgaaataagagttctattttaggtaaaattcaaacgatagaatatgcaagtttaattggctgtattaagcgaagtcagacacttgctggcgcagtcaatactatttcgggtgtcttcactctatttaaaaaaagtgcagttgtcgacgttggctactgggatactgatatgattaccgaagatattgcagtttcttggaaattgcatttacgtggatatcgtattaagtatgaaccgcttgccatgtgttggatgttggttccagaaacattgggaggtctttggaagcaacgcgtgagatgggctcaagggggacacgaagtattactacgagacttttttagcacaatgaaaacgaaaaggtttcctttatatattttgatgtttgagcaaatcatctcgattttatgggtatatatagtgcttctatatttaggctatttgttcataacagcaaacttcttagactatacatttatgacatatagtttttcaatatttctactatcatcatttactatgacttttataaacgttattcaatttacagtcgcactctttattgatagtcgctacgagaaaaagaatatggctggactcatatttgtaagttggtatccgacagtatactggattattaacgcagcagtagttcttgtcgcatttccaaaagcattaaaacgtaagaaaggtggttacgcaacatggtcaagcccagacagagggaatacccaacgc

SEQ ID NO: 3974 - protein, 412 aa, Staphylococcus aureus
  MISC_FEATURE (1)..(412): intercellular adhesion
LQFFNFLLFYPVFMSIYWIVGSIYFYFTREIRYSLNKKPDINVDELEGITFLLACYNESETIEDTLSNVLALKYEKKEIIIINDGSSDNTAELIYKIKENNDFIFVDLQENRGKANALNQGIKQASYDYVMCLDADTIVDQDAPYYMIENFKHDPKLGAVTGNPRIRNKSSILGKIQTIEYASLIGCIKRSQTLAGAVNTISGVFTLFKKSAVVDVGYWDTDMITEDIAVSWKLHLRGYRIKYEPLAMCWMLVPETLGGLWKQRVRWAQGGHEVLLRDFFSTMKTKRFPLYILMFEQIISILWVYIVLLYLGYLFITANFLDYTFMTYSFSIFLLSSFTMTFINVIQFTVALFIDSRYEKKNMAGLIFVSWYPTVYWIINAAVVLVAFPKALKRKKGGYATWSSPDRGNTQR

SEQ ID NO: 3975 - DNA, 888 bp, Staphylococcus aureus
ttgaataatttatggggggaaattatgaagattgaagactatcgtttactaataacattagacgaaacgaaaacgttacgtaaagcggctgaaattttatatatatctcaacctgctgttacacaaagactaaaagctattgaaaatgcttttggagtagatatttttatcagaacaaaaaaacaattgattacaacaactgaaggaacaatgattattgagcatgctcgtgacatgttgaaaagagagcgattattttttgacaaaatgcaggcacatattggtgaagtgaatggaacaatatcaatcgggtgttcttctttgattggacaaaccttacttcctgaagttttgagcctatataatgcccaatttcctaatgttgaaatacaagtgcaagttggttcaactgaacaaattaaagcaaatcatagagattatcatgttatgataactcgtggaaataaggtaatgaatttagctaacacacatttatttaatgatgatcattattttatttttccaaaaaatagacgagatgatgttacaaagttaccatttatagagtttcaagctgatccgatttatataaatcaaataaaagaatggtataacgataatttagaacaagattaccatgcaactattacagtggatcaagtagcaacttgcaaagaaatgttgattagtggtgtaggtgttacaatcttgccagaaattatgatgaaaaatatcagcaaagaacaatttgagtttgaaaaagtagaaattgataatgaaccgctgattcgttcgacatttatgagttatgatccgagcatgttgcaattgccacaagttgattcttttgtaaatctcatggcgagctttgttgaacaaccaaaggcg

SEQ ID NO: 3976 - protein, 296 aa, Staphylococcus aureus
  MISC_FEATURE (1)..(296): hypothetical protein
LNNLWGEIMKIEDYRLLITLDETKTLRKAAEILYISQPAVTQRLKAIENAFGVDIFIRTKKQLITTTEGTMIIEHARDMLKRERLFFDKMQAHIGEVNGTISIGCSSLIGQTLLPEVLSLYNAQFPNVEIQVQVGSTEQIKANHRDYHVMITRGNKVMNLANTHLFNDDHYFIFPKNRRDDVTKLPFIEFQADPIYINQIKEWYNDNLEQDYHATITVDQVATCKEMLISGVGVTILPEIMMKNISKEQFEFEKVEIDNEPLIRSTFMSYDPSMLQLPQVDSFVNLMASFVEQPKA

SEQ ID NO: 3977 - DNA, 303 bp, Staphylococcus aureus
atggtcaagcccagacagagggaatacccaacgctaaaatcatcgctaaatattgtaagagaaacagcacttatcgctatatcttgtgtcttttggatatattgtttagttgttctactcgtttatattggtactatatttgaaattcatgacgaaagtatcaatacaatacgtgttgctttaaacattgaaaatactgaaattttagatatatttgaaactatgggcattttcgcgattatcatttttgtattttttacaattagcatattgattcaaaaatggcagagaggaagagaatcg

SEQ ID NO: 3978 - protein, 101 aa, Staphylococcus aureus
  MISC_FEATURE (1)..(101): intercellular adhesion
MVKPRQREYPTLKSSLNIVRETALIAISCVFWIYCLVVLLVYIGTIFEIHDESINTIRVALNIENTEILDIFETMGIFAIIIFVFFTISILIQKWQRGRES

SEQ ID NO: 3979 - DNA, 891 bp, Staphylococcus aureus
atggcagagaggaagagaatcgtgaagtatagaaaatttataattttagtgttgagtatcttgatcatattgcctgtaagcacactggatggtcatcatattgcaaatgcagatgacgattcacctaaaaaactgaaatataaagaaaatagtgctctggcattaaattatcaccgtgtaagaaaagcgaattttctgaataattttatttacttcttttctagtagtaaagaaattaaaaattatagtgttagtcaatcacaatttgaatctcaaataaaatggctaaaatcacatgatgctaaatttttaaccttgaaagaatttttatattacaagaaaaaaggtaagtttccaaaacgaagtgtatggattaactttgatgatatggatgaaactatttatgaaaatgcttatccaatcttaaaaaaatataaaataccggcaactgggtttattatcacaggtcatgttggggaagaaaactttcacaacctcgatatgattagtaaaaaagaactaaaagaaatgtataaaactgggttatgggaatttgaaacacatacccacgatttgcataacttatctaaaaataataagtcaaaattaatgaaagcttctgaagctacaatcataaaagatttaaacaaaagtgaaaaatatctaactaaaaactttaaaaagtcgcagaaaactatagcctatccttatggcttgatgaatgacgataaattaccggtaatcaaaaaagctgggttaaaatacggtttttcattagaggaaaaagcagtcactccgaactccaatgattattacatccctagaatattaattagtgatgatgcttttgagcatttaattaagagatgggacggattccatgaaaaagat

SEQ ID NO: 3980 - protein, 297 aa, Staphylococcus aureus
  MISC_FEATURE (1)..(297): intercellular adhesion
MAERKRIVKYRKFIILVLSILIILPVSTLDGHHIANADDDSPKKLKYKENSALALNYHRVRKANFLNNFIYFFSSSKEIKNYSVSQSQFESQIKWLKSHDAKFLTLKEFLYYKKKGKFPKRSVWINFDDMDETIYENAYPILKKYKIPATGFIITGHVGEENFHNLDMISKKELKEMYKTGLWEFETHTHDLHNLSKNNKSKLMKASEATIIKDLNKSEKYLTKNFKKSQKTIAYPYGLMNDDKLPVIKKAGLKYGFSLEEKAVTPNSNDYYIPRILISDDAFEHLIKRWDGFHEKD

SEQ ID NO: 3981 - DNA, 1050 bp, Staphylococcus aureus
atgaaaaagattagacttgaactcgtatatttacgtgctattatatgtgcaattattattatcacacatttacttacacaaattactttaaaacatgaaaatatggagggtggatccttagtgttacaattttacattcgtaatattgtgatttttggtacaccttgctttattatcttgtcacagttactgacaaccttgaattaccaaaaagtcacctatagatacttaactacacgcgtaaaatatatacttattccttacatattaatgggattgttttacagttatagtgaatcattattaacagattcaagtttcaataaacaattcattgaaaatgtcctattaggtcaatggtatggctattttatcgttgttatcatgcaattctttattttgagttatatcatttttaaaattaactataacctattcaacagtaaaatattattattgttatcttttattttacagcaatcatttttatattactttacgaacaacacagcgtttcacgataccgtgctacactattatccattaagtgaaaatactataatattcggatggattttttatttcttcttaggtgcatatatgggttataactacgaacgtgtattaaatttcttagaacgttatttagttattatgattgtattagctgtagctacttattttgtgtttattgcgttagcaaatggagactattggaacgttaccagcttttcatattcattaacaccatataatagtattatgtttattgttatcttgggtatttgcacgcattttaaaacaatgttatttaatacgattcaaatgattagtgctttctcattctttatttatttattacatccaatcattctagactcattgtttgcatatacaaatatatttgaggataatacaatggtctttctagcgatatcactactattcattttaggattatgtataggtgtcggcatgatattgcgtgaattctatatctttaggtttattattggaaaacaaccatataaattgaacattaatgcttat

SEQ ID NO: 3982 - protein, 350 aa, Staphylococcus aureus
  MISC_FEATURE (1)..(350): intercellular adhesion
MKKIRLELVYLRAIICAIIIITHLLTQITLKHENMEGGSLVLQFYIRNIVIFGTPCFIILSQLLTTLNYQKVTYRYLTTRVKYILIPYILMGLFYSYSESLLTDSSFNKQFIENVLLGQWYGYFIVVIMQFFILSYIIFKINYNLFNSKILLLLSFILQQSFLYYFTNNTAFHDTVLHYYPLSENTIIFGWIFYFFLGAYMGYNYERVLNFLERYLVIMIVLAVATYFVFIALANGDYWNVTSFSYSLTPYNSIMFIVILGICTHFKTMLFNTIQMISAFSFFIYLLHPIILDSLFAYTNIFEDNTMVFLAISLLFILGLCIGVGMILREFYIFRFIIGKQPYKLNINAY

SEQ ID NO: 3983 - DNA, 2052 bp, Staphylococcus aureus
gtgctgacaatgatgaaaagtcaaaataagtatagtattcgtaaatttagtgtaggtgcatcttccattttaatagctacattactatttttaagtggtggacaagcacaagcagctgagaagcaagtgaatatgggaaattcacaggaggatacagttacagcacaatctattggggatcaacaaactagggaaaatgctaattatcaacgtgaaaacggtgttgacgaacagcaacatactgaaaatttaactaagaacttgcataatgataaaacaatatcagaagaaaatcatcgtaaaacagatgatttgaataaagatcaactaaaggatgataaaaaatcatcgcttaataataaaaatattcaacgtgatacaacaaaaaataacaatgctaatcctagcgatgtaaatcaagggttagaacaggctattaatgatggtaaacaaagtaaagtggcgtcacagcaacagtcaaaagaggcagataatagtcaagattcaaacgctaataacaatctaccttcacaaagtcgaataaaggaagcaccatcattaaataagttagatcaaacaagtcaacgagaaattgttaatgagacagaaatagagaaagtacaaccacaacaaaataatcaagcgaatgataaaattactaactacaattttaacaatgaacaagaagtgaaacctcaaaaagacgaaaaaacactatcagtttcagatttaaaaaacaatcaaaaatcaccagtagaaccaacaaaggacaatgacaagaaaaatggattaaatttattaaaaagtagtgcagtagcaacgttaccaaacaaagggacaaaggaacttactgcaaaagcgaaagatgatcaaacgaataaagttgccaaacaagggcagtataaaaatcaggatcctatcgttttagtgcatggtttcaatgggtttacagatgatattaatccttcagtgttagctcattattggggcggtaataaaatgaacattcgccaagatttagaagaaaatggttacaaagcttatgaagcaagtataagtgcttttggaagtaactatgaccgcgcagttgaactttattattatatcaaaggcggtcgtgtagattatggtgcagcacatgcagcaaaatatggacatgaacgttatggaaaaacatacgaaggaatttacaaagactggaaaccaggacagaaggtacacctagttggacatagtatgggcggtcaaacgatacgtcaactagaagaattactgcgtaatggtaatcgtgaagaaatagagtatcaaaagaaacatggtggcgaaatttctccactattcaaaggtaatcatgacaatatgatttcatcaattactactttaggaacaccacataatggtacacacgcatcagatttagctggtaatgaagctttagtgagacaaatcgtatttgatatcggtaaaatgtttggtaataaaaattcaagagtagacttcgggttggctcaatggggtctaaaacagaagccaaatgaatcatatattgattatgtcaaacgcgttaaacaatctaatttatggaaatcaaaagataatggattttacgatctgacgcgtgagggtgcaacagatttaaatcgtaaaacgtcgttgaaccctaacattgtgtataaaacatacactggtgaagcaacgcacaaagcattaaatagcgatagacaaaaagcagacttaaatatgtttttcccatttgtgattactggtaacttaatcggtaaagctactgaaaaagaatggcgagaaaacgatggtttagtatccgttatttcttctcaacatccatttaatcaagcttatacaaaagcgacagataaaattcaaaaaggcatttggcaagtgacgcctacaaaacatgattgggatcatgttgactttgtaggacaagacagttctgatacagtgcgcacaagagaagaattacaagatttttggcatcatttagcagacgatttagtgaaaactgaaaagctgactgatactaagcaagca

SEQ ID NO: 3984 - protein, 684 aa, Staphylococcus aureus
  MISC_FEATURE (1)..(684): triacylglycerol lipase
VLTMMKSQNKYSIRKFSVGASSILIATLLFLSGGQAQAAEKQVNMGNSQEDTVTAQSIGDQQTRENANYQRENGVDEQQHTENLTKNLHNDKTISEENHRKTDDLNKDQLKDDKKSSLNNKNIQRDTTKNNNANPSDVNQGLEQAINDGKQSKVASQQQSKEADNSQDSNANNNLPSQSRIKEAPSLNKLDQTSQREIVNETEIEKVQPQQNNQANDKITNYNFNNEQEVKPQKDEKTLSVSDLKNNQKSPVEPTKDNDKKNGLNLLKSSAVATLPNKGTKELTAKAKDDQTNKVAKQGQYKNQDPIVLVHGFNGFTDDINPSVLAHYWGGNKMNIRQDLEENGYKAYEASISAFGSNYDRAVELYYYIKGGRVDYGAAHAAKYGHERYGKTYEGIYKDWKPGQKVHLVGHSMGGQTIRQLEELLRNGNREEIEYQKKHGGEISPLFKGNHDNMISSITTLGTPHNGTHASDLAGNEALVRQIVFDIGKMFGNKNSRVDFGLAQWGLKQKPNESYIDYVKRVKQSNLWKSKDNGFYDLTREGATDLNRKTSLNPNIVYKTYTGEATHKALNSDRQKADLNMFFPFVITGNLIGKATEKEWRENDGLVSVISSQHPFNQAYTKATDKIQKGIWQVTPTKHDWDHVDFVGQDSSDTVRTREELQDFWHHLADDLVKTEKLTDTKQA

SEQ ID NO: 3985 - DNA, 210 bp, Staphylococcus aureus
gtggataatcacaatacgaaatcaaaaataattataaaaagtaaattgagcaactcaggaatagatgtcactgttaaagatgtcgaaaagtatatgaatcgatataatgaagttatgaagggaaaaaatggcgaaaaagctaaagagttatgtttgtcgttactacctattaatatcatagttgtctttacattctttgtatttatacta

SEQ ID NO: 3986 - protein, 70 aa, Staphylococcus aureus
VDNHNTKSKIIIKSKLSNSGIDVTVKDVEKYMNRYNEVMKGKNGEKAKELCLSLLPINIIVVFTFFVFIL

SEQ ID NO: 3987 - DNA, 1401 bp, Staphylococcus aureus
ttgggaggggctaaaatgattaaaaaacgtatcattccatgtttagatgtcaaagatggtcgtgtcgttaaagggattcaatttaaaggattaagggatattgggaatcctgttgatttagcaatgtattacaatgaagcgggtgctgatgaattagtatttttagacatctctaagacggaagagggtcatagcttaatgctagaagtgattgaacagacagcgtcacgcttgtttatccctcttactgtagggggtgggattcaaagtctcgatgatattacccaattgctaaatcatggtgcagataaagtatcattaaattcaagtgctttaaaaaatccacagctcattaaacaagcgagtgataaattcggtagacaatgcatctgcatagcaattgatagctattatgatcctgaaagaaaagcacattattgttgtacgactggtggtaaaaaaatgacaaatattaaagtatatgactgggtacagcaagtagaacagttaggtgcaggtgagctcctcgttacaagtatgggacatgatggtatgaaacaaggctttgatattgaacacctagcaaatattaagtctcttgtaaatattccaatcattgcttctggtggtggtggcaatgcacaacactttgtagaattatttgatcagacggatgtttctgcaggtttagctgcaagtatattacatgatcgagaaacgacggttcaatctattaaagaagtgatacggcaaggggggtatagcagtaagatgaccaaatataaaattgattttagcaaaggtttagtgccagcaattttacaagataatcaaacaaaacaagtattgatgttgggttatatgaaccaagaagcttttgataaaacgatagaagatggtgtggtatgtttctattcgcggtcgaaacaacggctatggacaaaaggtgaaacatctggtcatacgcaacgtgttaaagatattcatgtagattgcgacaatgacactattttaattgatgtcataccaaatggaccaacatgtcatacaggcagtcaaagttgtttcaacacagaagttccattttcagtgcaaacattagcgcagacagttcaagatagtgcccaatccaataatgaaaagtcatatacaaaatatttattaacagaaggtatagaaaagattacaaaaaaatacggtgaagaagcttttgaagtcgtaattgaagcaattaaaggtgacaaaaaagcatttgtaagtgaagtagcagatgaactttatcatttatttgtcttgatgcatgcgcttggcgtcgatttttcagaaattgaggcggaattagcgcgtagacatcataagcgcaataactttaaaggtgaacgacaaaatatcgaacagtgg

SEQ ID NO: 3988 - protein, 467 aa, Staphylococcus aureus
  MISC_FEATURE (1)..(467): cyclase-like protein hisF
LGGAKMIKKRIIPCLDVKDGRVVKGIQFKGLRDIGNPVDLAMYYNEAGADELVFLDISKTEEGHSLMLEVIEQTASRLFIPLTVGGGIQSLDDITQLLNHGADKVSLNSSALKNPQLIKQASDKFGRQCICIAIDSYYDPERKAHYCCTTGGKKMTNIKVYDWVQQVEQLGAGELLVTSMGHDGMKQGFDIEHLANIKSLVNIPIIASGGGGNAQHFVELFDQTDVSAGLAASILHDRETTVQSIKEVIRQGGYSSKMTKYKIDFSKGLVPAILQDNQTKQVLMLGYMNQEAFDKTIEDGVVCFYSRSKQRLWTKGETSGHTQRVKDIHVDCDNDTILIDVIPNGPTCHTGSQSCFNTEVPFSVQTLAQTVQDSAQSNNEKSYTKYLLTEGIEKITKKYGEEAFEVVIEAIKGDKKAFVSEVADELYHLFVLMHALGVDFSEIEAELARRHHKRNNFKGERQNIEQW

SEQ ID NO: 3989 - DNA, 702 bp, Staphylococcus aureus
atgattgaattatggccagcgattgatttgattgggtcaacaagtgtgaggttaacagagggtaaatatgatagtgaagaaaaaatgtcacgctcggctgaagaaagtattgcttactatagtcaatttgaatgtgtgaatcgtattcatatcgtcgacttgataggtgctaaggcacagcatgcccgagagtttgattatattaagtcattgaggagattaacaaccaaagatattgaagtaggtggtggcattcgtacgaagtcacaaatcatggactactttgccgcagggattaattattgcatagttggaacgaaaggtattcaagatactgattggcttaaagagatggcacatacatttccaggtcgcatttatttatctgttgatgcctatggagaagatattaaagtgaacggatgggaagaggacacagagttaaatttatttagttttgtgagacggttatcggatatacctcttggcggcattatatatactgatattgctaaagatggcaaaatgtccggacctaactttgaattaactggtcaattagtaaaggcaacgacgattcctgtcattgcttccggtggtattagacatcagcaagatattcaacgattagcgtcgctaaatgttcacgctgctattataggaaaggctgcacatcaagcatctttttgggaggggctaaaa

SEQ ID NO: 3990 - protein, 234 aa, Staphylococcus aureus
  MISC_FEATURE (1)..(234): hypothetical protein
MIELWPAIDLIGSTSVRLTEGKYDSEEKMSRSAEESIAYYSQFECVNRIHIVDLIGAKAQHAREFDYIKSLRRLTTKDIEVGGGIRTKSQIMDYFAAGINYCIVGTKGIQDTDWLKEMAHTFPGRIYLSVDAYGEDIKVNGWEEDTELNLFSFVRRLSDIPLGGIIYTDIAKDGKMSGPNFELTGQLVKATTIPVIASGGIRHQQDIQRLASLNVHAAIIGKAAHQASFWEGLK

SEQ ID NO: 3991 - DNA, 576 bp, Staphylococcus aureus
atgattgtcatcgttgattatggattagggaatattagtaatgtaaaacgcgctattgaacatttagggtatgaggtggttgtctcaaatacctcaaaaataatcgatcaagcagaaacaatcatattgcccggtgtcggccattttaaagatgcgatgtcagagataaaacgattaaatctcaatgcaatattggctaagaatactgataagaagatgattggtatttgtttaggcatgcaattaatgtatgagcatagtgatgaaggcgatgcatctggattagggtttatcccaggaaatatttcgcgtatccaaacagaatacccagtgccacacttaggctggaataatttagtgagtaagcaccctatgttaaatcaagatgtttatttcgtacattcttatcaagcgccgatgtcagaaaatgtaattgcatatgcgcagtatggggctgatattccggcaattgttcaatttaacaattatattggtattcaattccatcctgaaaaaagcggtacatatgggttacaaattttgcgtcaggcaatacaagggggatttataaatgat

SEQ ID NO: 3992 - protein, 192 aa, Staphylococcus aureus
  MISC_FEATURE (1)..(192): amidotransferase hisH
MIVIVDYGLGNISNVKRAIEHLGYEVVVSNTSKIIDQAETIILPGVGHFKDAMSEIKRLNLNAILAKNTDKKMIGICLGMQLMYEHSDEGDASGLGFIPGNISRIQTEYPVPHLGWNNLVSKHPMLNQDVYFVHSYQAPMSENVIAYAQYGADIPAIVQFNNYIGIQFHPEKSGTYGLQILRQAIQGGFIND

SEQ ID NO: 3993 - DNA, 600 bp, Staphylococcus aureus
ttgttaaagaatggagtgcaaaatatgatttatcaaaaacaacgaaacacagctgaaacgcaactaaatatttcaatatctgatgatcagtcaccatcgcatattaatacaggtgtgggctttttaaatcatatgttaaccttgtttacatttcatagcggtctgtcattaaacattgaggcacaaggtgatattgacgtagatgatcaccacgtaactgaagatatcggcattgtcattggccaattgttacttgaaatgattaaagataaaaagcatttcgttcgttatggaacgatgtacattccaatggatgaaacattagcacgtgtcgttgtggatataagtgggcgcccatacctatcattcaatgcatcattaagtaaagaaaaagttggtacgtttgatacggagttagtagaagaattttttagagcggtcgtaatcaatgcaagattaacaacgcatattgatttaattcgtggaggtaatacacaccatgaaattgaagctatattcaaagcgttttcccgtgcattaggcatagcgctaactgcaactgatgatcagcgtgtgccgtcatcgaaaggtgtgattgaa

SEQ ID NO: 3994 - protein, 200 aa, Staphylococcus aureus
  MISC_FEATURE (1)..(200): imidazoleglycerol-phosphate
LLKNGVQNMIYQKQRNTAETQLNISISDDQSPSHINTGVGFLNHMLTLFTFHSGLSLNIEAQGDIDVDDHHVTEDIGIVIGQLLLEMIKDKKHFVRYGTMYIPMDETLARVVVDISGRPYLSFNASLSKEKVGTFDTELVEEFFRAVVINARLTTHIDLIRGGNTHHEIEAIFKAFSRALGIALTATDDQRVPSSKGVIE

SEQ ID NO: 3995 - DNA, 651 bp, Staphylococcus aureus
ttggtgactgtgaaagtaaagtatatagataaacgtcactggcgtcgcctaattgatagggaatacacagaggtaaaagttaataataataggtttaagggtattataggcttagtcacgatgaaaaaggttcgtgatcctttagaggtgacggtagttggacaaaatatcattgtcgcagatgacaattataaatggttgcaaatactacctgaaaagaaacgttatagtataactgtaatgtttgataataaaggcaatccattagaatattattttgatataaatatcaaaaatataacgcaaaaaggtaatgcgcgtacagtagatttatgtttagatgttttagcattaccaagtggtgaatatgagttggtagatgaagatgatttaatgtttgcattagaaagtgagcaaattacaaaaaagcaatttcatgaagcatatatgattgcacatcaaattatggcagagttagaaaatgattttaaaggattccaaaagaaaatcatgtactgctttaataaaattaatgcaaaggctcaaaaaaatcatcaaaagccacaaaataaaactaatattgaaaaaagcaaacaaataaagcctaagcaatataatcaaactaaaaatcaccaacaacaaaagaaaaac

SEQ ID NO: 3996 - protein, 217 aa, Staphylococcus aureus
  MISC_FEATURE (1)..(217): conserved hypothetical
LVTVKVKYIDKRHWRRLIDREYTEVKVNNNRFKGIIGLVTMKKVRDPLEVTVVGQNIIVADDNYKWLQILPEKKRYSITVMFDNKGNPLEYYFDINIKNITQKGNARTVDLCLDVLALPSGEYELVDEDDLMFALESEQITKKQFHEAYMIAHQIMAELENDFKGFQKKIMYCFNKINAKAQKNHQKPQNKTNIEKSKQIKPKQYNQTKNHQQQKKN

SEQ ID NO: 3997 - DNA, 1011 bp, Staphylococcus aureus
atgatttatattgataaaaatgaaagtccagttacgccgttggatgaaaaaacaatgacgtctattattagtgcaacgccatataatttatatcctgatgcagcatatgaacaattcaaggaagcttatgctaagttttacggattatcgcctgaacaaattattgcaggaaatggatctgatgaattgattcaaaagttaatgctgatcatgccagaaggtccggcattaacgctaaatcctgatttttttatgtatcaagcatatgcggcacaagtaaatcgtgaaattgcatttgtagatgcaggatcagatttaacgtttgatttggaaaccattttaacgaaaatcgatgaagtacaaccatcattttttattatgagtaatccacataacccttcaggcaagcaatttgatacggcatttttaacagctattgcagataagatgaaagcattaaacggatactttgtcattgatgaagcatatttagattatggtacggcatatgacgtggaactggcaccacacatcttaagaatgcgtacattatcaaaggcgtttggaattgccggcttaagattaggtgtcttaattagtactgctggaacgataaagcatattcaaaaaatagaacatccatatccattaaatgtatttacgctaaatattgcgacttatatttttagacatagagaagagacaagacaatttttaacgatgcaacgacagttagctgagcagttaaaacaaatatttgatacacatgttgcagataaaatgtcagtgttcccatcaaatgctaattttgtacttactaaaggctcagcagcgcaacaattaggacaatacgtatatgaacaaggatttaaacctcgcttttatgatgagccggtgatgaagggctatgtaagatactcaattgcaacagcatcacagttaaagcaattagaagaaattgttaaagaatggagtgcaaaatatgatttatcaaaaacaacgaaacacagc

SEQ ID NO: 3998 - protein, 337 aa, Staphylococcus aureus
  MISC_FEATURE (1)..(337): hypothetical protein
MIYIDKNESPVTPLDEKTMTSIISATPYNLYPDAAYEQFKEAYAKFYGLSPEQIIAGNGSDELIQKLMLIMPEGPALTLNPDFFMYQAYAAQVNREIAFVDAGSDLTFDLETILTKIDEVQPSFFIMSNPHNPSGKQFDTAFLTAIADKMKALNGYFVIDEAYLDYGTAYDVELAPHILRMRTLSKAFGIAGLRLGVLISTAGTIKHIQKIEHPYPLNVFTLNIATYIFRHREETRQFLTMQRQLAEQLKQIFDTHVADKMSVFPSNANFVLTKGSAAQQLGQYVYEQGFKPRFYDEPVMKGYVRYSIATASQLKQLEEIVKEWSAKYDLSKTTKHS

SEQ ID NO: 3999 - DNA, 1254 bp, Staphylococcus aureus
ttgccaatgcttaatgcacaacaatttttaaatcaattttcattagaagcaccattagatgagtcattgtatccaattattcgcgatatttgtcaggaagttaaagttcatggagataaggctttgaaaatgtataatctaacattcgatcatacgaaaacagatcatttagaaattagtcatgaacaaattaaagcagcatttgacacattagatgaaaaaacaaaacaagcattacaacaaagttatgaaagaattaaagcatatcaagaaagtattaaacagacgaatcaacagttagaagaatcagtggagtgttatgaaatataccatccactagaaagtgtcggtatttatgtgcctggtggtaaagcaagttatccttcaacggtattaatgacagcgacgttagcacaagtagcaggtgtggaaaatattgtcgttgtgacaccacctcaacctaatggtgtgtctcaagaagtattagcagcatgctatattacgcaagttgatcaagtatttcaagttggtggtgctcaaagtattgctgcgttaacttatggcacagaaacgatacctaaagttgataagattgtaggtccaggcaatcaatttgttgcatatgccaagaaatatttatttggacaagtaggtattgaccaaatagctggaccaacagaaatagcacttattattgatgaaacagcagatttagatgccatcgtatatgatgtttttgcacaagcagaacatgatgaattagcacgtacatatgccattagtgaagatgcgcaagtccttaaagatttagaatcacgtattgctaaagcattgcctaatgtggacagatacgacattgtttctaaaagtatcgctaatcaacactaccttatccatgctagtaattttgatgaagcatgccatgtcatgaatacaatcgcgcctgaacatgcgtcgattcaaacagtaaatcctcaaccatatattgaaaaagtgaaatatgtgggtgcattgtttattggacattattcgccagaggtcataggagattacgttgcaggtccaagtcatgtattacctacaaatagaacagctagatttaccaatgggttatcggtcaatgatttcttaacacggaacacggtcatccatttatcaaaagatacgtttgaacaaattgctgattcagcacaacatattgctcatgttgaagcattatacaatcaccagcagtctattttaatacgtcagtct

SEQ ID NO: 4000 - protein, 418 aa, Staphylococcus aureus
  MISC_FEATURE (1)..(418): hypothetical protein
LPMLNAQQFLNQFSLEAPLDESLYPIIRDICQEVKVHGDKALKMYNLTFDHTKTDHLEISHEQIKAAFDTLDEKTKQALQQSYERIKAYQESIKQTNQQLEESVECYEIYHPLESVGIYVPGGKASYPSTVLMTATLAQVAGVENIVVVTPPQPNGVSQEVLAACYITQVDQVFQVGGAQSIAALTYGTETIPKVDKIVGPGNQFVAYAKKYLFGQVGIDQIAGPTEIALIIDETADLDAIVYDVFAQAEHDELARTYAISEDAQVLKDLESRIAKALPNVDRYDIVSKSIANQHYLIHASNFDEACHVMNTIAPEHASIQTVNPQPYIEKVKYVGALFIGHYSPEVIGDYVAGPSHVLPTNRTARFTNGLSVNDFLTRNTVIHLSKDTFEQIADSAQHIAHVEALYNHQQSILIRQS

SEQ ID NO: 4001 - DNA, 612 bp, Staphylococcus aureus
atgttaagaatcgccatagccaaaggacgtctaatggatagtttaattaactatttagatgtaattgaatatacgacattatcagaaacattaaaaaatagagaacgccaattattattaagtgtagataatattgaatgcattttagtaaaaggaagtgacgtgccaatctatgtggaacaaggaatggcagacataggcattgttggtagcgacatattagatgagcgccaatataatgttaataatttgttgaatatgccttttggagcatgtcattttgcggttgcagcgaaacctgaaacgaccaattatcgtaaaatcgcaacgagttatgttcatactgctgaaacatattttaaatcaaaaggtattgatgtcgaattgattaaattgaatggctctgttgaattggcctgtgttgtagatatggtagacggaattgtcgacatcgttcaaacaggtactacgctaaaagcgaacggactggttgaaaagcaacatattagtgatatcaatgcaagattaataactaataaagcagcttattttaaaaaatcacaattaatagagcaatttattcgctctttggaggtgtctattgccaatgct

SEQ ID NO: 4002 - protein, 204 aa, Staphylococcus aureus
  MISC_FEATURE (1)..(204): ATP
MLRIAIAKGRLMDSLINYLDVIEYTTLSETLKNRERQLLLSVDNIECILVKGSDVPIYVEQGMADIGIVGSDILDERQYNVNNLLNMPFGACHFAVAAKPETTNYRKIATSYVHTAETYFKSKGIDVELIKLNGSVELACVVDMVDGIVDIVQTGTTLKANGLVEKQHISDINARLITNKAAYFKKSQLIEQFIRSLEVSIANA

SEQ ID NO: 4003 - DNA, 855 bp, Staphylococcus aureus
gtgattttaaatacagtattgaaagtaaagggtggtcgagtgaataattcagaacaattaattgcgttaaaagaatcggaaacagcatttttaaaatattttaataaagcggattatgagttagttgattttagtgtggttgaaaagttggactggaaacaattgaaccatgaggatttgcagcagatgggtgagcgaaatttttggcaacatgagcatcaaatttatgcacttcgaaatgattttacagatcaattattgcgttattactcaatgtatccaactgcagcaacaaaagtggcatacacaggtttaatcattcggaataatgaagcggctgtacaagttggtttggaaaactatgcaccatcattagcgaatgtgcaacagagcttaaagctctttattcagtttattcaacagcagttgagagacaacgtgcattttgttgtattgggacattatcaattgcttgatgccttactcgataaatcgttacaaacaccagacatactatcaatgattgaggaacgtaatttatcgggactggttacatatttgtcgactgaacatccaatcgtgcaaatcttgaaagagaatacgcaacaacaattaaatgtattggaacactatattccaaatgaccatccagcactcgttgaattaaaaatatgggaacgttggttacataaacaaggttacaaagacatccatttagatattactgcgcagccacctagatcctattacacaggtttatttattcaatgtcattttgctgaaaatgaatctcgagttttaacaggtggttattacaaaggaagcatcgaagggtttggattaggattaacactt

SEQ ID NO: 4004 - protein, 285 aa, Staphylococcus aureus
  MISC_FEATURE (1)..(285): hypothetical protein
VILNTVLKVKGGRVNNSEQLIALKESETAFLKYFNKADYELVDFSVVEKLDWKQLNHEDLQQMGERNFWQHEHQIYALRNDFTDQLLRYYSMYPTAATKVAYTGLIIRNNEAAVQVGLENYAPSLANVQQSLKLFIQFIQQQLRDNVHFVVLGHYQLLDALLDKSLQTPDILSMIEERNLSGLVTYLSTEHPIVQILKENTQQQLNVLEHYIPNDHPALVELKIWERWLHKQGYKDIHLDITAQPPRSYYTGLFIQCHFAENESRVLTGGYYKGSIEGFGLGLTL

SEQ ID NO: 4005 - DNA, 1122 bp, Staphylococcus aureus
atgcataaaaaatatttattgctattttttctgttattatcagttgcattgttatatagctgttccaagcaaaatgagaaagctcaaaataaatctgttaatccaaatgagtatgcaaagcataaatcgaaaatggatgaacattgggaaacatatcacggccaagtttatcatgtgttttatcacccattaattacagacccaaaagttgcgtttacaggagatacacaccaagctaagggcaacaatgattggatgattactgtaagtgaatttaaaaaatcattgaacgaattatataaaaataattacatcatcgttaatccacatgatgtatacgacttatcatctcatcatgtaaaagccaaaaaaataaaattgccgaaaggtaaaaagccactaatcatctcaattgatgatatgaattactatagttacatgagacaccatggttatgctgaccgtttagtactcgataaaaataaacatgttgtttctgaaactacagacaaaaaaggccatgctacttattctgatgacaatgatatcgtgccaattttaaataaatttgtaaaagagcatccagatttttctttaaatggtgaaaaaggtgttgttgctttaaccggttatgagggcgtattaggttatcgcacgaatgaattaacgagtaaagattatacaaagaataaaaaggcagctgaggaagttgttcgcgcaatgaaacgggatggatggtcatttgcgagtcattcatatggtcacattaattttgaaaaaacatctttagaaggtattaaacgtgatactaaaagatggaaagatgaagttgaaccaattgtaggtaaaacagatatgtttgtatttccacatggcgcacaggatagacatacacaagcgtatgattatttggtagatgaagcagagtttaagtttattgcaggtgtcggtccaaacaattttacagatatatcagcaacgaacgtttaccaagatagggttgcgattgatggtctaaacttatttgaatttaaatataaactcaaaccgttttttaatcctgaaaatgtatatagtaaacaagatagacgttactttaaagggaatcgggattatgaagaa

SEQ ID NO: 4006 - protein, 374 aa, Staphylococcus aureus
  MISC_FEATURE (1)..(374): hypothetical protein
MHKKYLLLFFLLLSVALLYSCSKQNEKAQNKSVNPNEYAKHKSKMDEHWETYHGQVYHVFYHPLITDPKVAFTGDTHQAKGNNDWMITVSEFKKSLNELYKNNYIIVNPHDVYDLSSHHVKAKKIKLPKGKKPLIISIDDMNYYSYMRHHGYADRLVLDKNKHVVSETTDKKGHATYSDDNDIVPILNKFVKEHPDFSLNGEKGVVALTGYEGVLGYRTNELTSKDYTKNKKAAEEVVRAMKRDGWSFASHSYGHINFEKTSLEGIKRDTKRWKDEVEPIVGKTDMFVFPHGAQDRHTQAYDYLVDEAEFKFIAGVGPNNFTDISATNVYQDRVAIDGLNLFEFKYKLKPFFNPENVYSKQDRRYFKGNRDYEE

SEQ ID NO: 4007 - DNA, 495 bp, Staphylococcus aureus
atgataaatactgaaagattaaatttaatgattccaagttcctcgcatttaattgaactttataatatttgtagtcatccacaagcaaatatatacactcccaaaggtttacataattccaaattagacacacaacggtggattgaaaaatggcgaaaccattggcaacaatatcaatttggttactttgtattggtaaaaaaaatagattgtagtgttattggtatttgtggatatgaatatcgacaattaaagcaagaaacagtattaaatttattttataaattacatccaagttttgaaggacaagggtacgcatgtgaggctattacagcaatcacaaattttgtgaattatatcgatcaagaaacagtaaaagttatcaggacaaataagtgtaaccaacgttcaataaatttagcagaaaggcttaaattcaagcgagacgatactatggacgacattatcaatcaaggagatattgtgttttataaa

SEQ ID NO: 4008 - protein, 165 aa, Staphylococcus aureus
  MISC_FEATURE (1)..(165): conserved hypothetical
MINTERLNLMIPSSSHLIELYNICSHPQANIYTPKGLHNSKLDTQRWIEKWRNHWQQYQFGYFVLVKKIDCSVIGICGYEYRQLKQETVLNLFYKLHPSFEGQGYACEAITAITNFVNYIDQETVKVIRTNKCNQRSINLAERLKFKRDDTMDDIINQGDIVFYK

SEQ ID NO: 4009 - DNA, 831 bp, Staphylococcus aureus
atgaatcaatataatactataggttttcacccgggaaatagtcgtattcatcaattaaatgcgactgttaaacttttattcttattagttgtttctatttctgcaatggtgacttatgacacaagatatttaattttaattagtgcttcatctattttattggtcaaatatgctcatattgaatggaaacaagttcgctttgttgttaaattcattctgtttttcacaatattaaatattattgccgtgtacatatttgaccctgaatatggtgtgaagatttataatcagcgtacagagttagtcaatggtattggtcgatttacgctaacatcacaggaattattctatctttttaatctaatattaaaatatattagtacagttcctttagcgttaatatttttattcacaacgaatccgagtcattttgctgcaagtttaaatcagctaggtgtgaattataaaatcagttacgcagtctcactagcattaaggtatattccagatattcaagaaacatattttaatatttcacaagcgcaacaagcaagaggatatgataattcgaaaaaagcaaaatttactagccgtgttaaaggtatcaaacgcattgtgttacctttaatattttctagtatcgaaagaattgacactattagtactgctatggagttaagacaattcggacagtataaaaggagaacctggtacgtcaaaaaacaattaaaaaaagatgattatgttgttttgtgtttgacgttaatacttctgatgttagtagttacattattctttttaaataatagtcgatatttcaacccgtggcat

SEQ ID NO: 4010 - protein, 277 aa, Staphylococcus aureus
  MISC_FEATURE (1)..(277): conserved hypothetical
MNQYNTIGFHPGNSRIHQLNATVKLLFLLVVSISAMVTYDTRYLILISASSILLVKYAHIEWKQVRFVVKFILFFTILNIIAVYIFDPEYGVKIYNQRTELVNGIGRFTLTSQELFYLFNLILKYISTVPLALIFLFTTNPSHFAASLNQLGVNYKISYAVSLALRYIPDIQETYFNISQAQQARGYDNSKKAKFTSRVKGIKRIVLPLIFSSIERIDTISTAMELRQFGQYKRRTWYVKKQLKKDDYVVLCLTLILLMLVVTLFFLNNSRYFNPWH

SEQ ID NO: 4011 - DNA, 1710 bp, Staphylococcus aureus
atgactgaaccaattatctcgttcaaagactttagttttcaatatcatagtcaagcaacacctacattacagaatataaatgttgatatttatccaggagaaaaagtattagtagttggtgcttcgggtagtggtaaatcgacttttgcaaattgcataaacggattaattccatttaaaactaaaggtaacataactggggaactatatataaataatcaagatgcaaccgttagttgtttacatgatagatctaatgttgttggtacagttttacaagatacagatggacagttcataggcttaacagcagctgaagatatggcctttttattagaaaataattgtgttgaacaagatgatatgaagaaaaatgtaagttattgggctgaaaaagttggcatgatagaacatttaaatcaccgaccgcaagatttatctggaggtcaaaaacaacgcgtttcattaggtggtatattaatccatcgtacgcctattttaatattggatgagccactggccaatttagatcctgcgacaggacatgaaacgctgagattgttaaacaatattcatgaagaaacaaagtcaacgatgattattgtcgaacatcgattagaagaatcattagatgatacgtttgatagagttcttctttttaaagatggaaaaatcatcgctaatacaacgcctagtgatttgctaaaatcatctaagcttaaagaagcaggcatacgtgaaccattatactgtacagcgcttaaatatgcagaagtagatgtcgaatccattgataacttagcgaatttacgtgacgtttgtatgagtgaacatgttaaatttaaagtgaaaaaatggatagatgaaacatctgcaaataatgataataagtacaaatctgaaccgctattagaattaaatgaggtatgtgttcaatatagtgactatagtaatagtgtacttaataatgttcaattaaatgtttatagaaaagaaatgcttagtatagttggtcacaatggtgccggcaaatcaacacttgctaaagcaatttgtggatttttagatataacaggtaatatccaattttgtaataggggatttaatcaattgtcaattagcgaacgatctgaattcgtaggttatgtgatgcaaaatccaaatcatatgatttctgaaaaaatgatttacgatgaagtagcattagggttaagagcacgaggtatgaaagaatcagatataaagatacgagtagagaatgtgctcaaaatatgcggactttatgcatttcggaattggccaattgcagctttaagctatggtcaaaaaaagagggtcactatagcatctgttttagtcttaaatccggaaataatcatattggatgaaccgactgctggtcaagatttctatcattataatgagataatgtcatttttaattgaactaaacagacaggggaagacgattattatgattacgcatgatatgcatttattgtctgagtatagttcaagaacagttgtattatcaaaaggtcaagtcgttgctgataccacgccagtattggttttaaatgataaaaaaatctgtgagattgcatcattgagacaaacatcgctatttgaaatggccgaatatatagggattagcgagccacagaaattagtacaattatttattaaccatgataggaaggtgagacgccaa

SEQ ID NO: 4012 - protein, 570 aa, Staphylococcus aureus
  MISC_FEATURE (1)..(570): hypothetical protein
MTEPIISFKDFSFQYHSQATPTLQNINVDIYPGEKVLVVGASGSGKSTFANCINGLIPFKTKGNITGELYINNQDATVSCLHDRSNVVGTVLQDTDGQFIGLTAAEDMAFLLENNCVEQDDMKKNVSYWAEKVGMIEHLNHRPQDLSGGQKQRVSLGGILIHRTPILILDEPLANLDPATGHETLRLLNNIHEETKSTMIIVEHRLEESLDDTFDRVLLFKDGKIIANTTPSDLLKSSKLKEAGIREPLYCTALKYAEVDVESIDNLANLRDVCMSEHVKFKVKKWIDETSANNDNKYKSEPLLELNEVCVQYSDYSNSVLNNVQLNVYRKEMLSIVGHNGAGKSTLAKAICGFLDITGNIQFCNRGFNQLSISERSEFVGYVMQNPNHMISEKMIYDEVALGLRARGMKESDIKIRVENVLKICGLYAFRNWPIAALSYGQKKRVTIASVLVLNPEIIILDEPTAGQDFYHYNEIMSFLIELNRQGKTIIMITHDMHLLSEYSSRTVVLSKGQVVADTTPVLVLNDKKICEIASLRQTSLFEMAEYIGISEPQKLVQLFINHDRKVRRQ

SEQ ID NO: 4013 - DNA, 558 bp, Staphylococcus aureus
atgaagatgaaaaaacaagatatttcagttaaaactgttgttgcaattggtataggagcagcggtatttgtaattttagggcgttttgttgtaataccaacaggttttcctaatacgaatatagaaacatcatatgcatttttagcattaatatctgcaatatttggaccttttgctggtttaatgactggattagttggacatgctattaaagattttacgacatacggtagtgcctggtggagttgggttatttgctcgggaattataggctgtttatatggctggattggactaaaattaaatctttcttcaggccgattttctaggaaatcgatggtttattttaatatcggtcaaattattgcgaatattatttgctgggcacttattgcaccaacattagatattttgatttataacgaaccagctaacaaggtttatacacaaggtgttatctctgcagtattaaatattatttcagttggcattattgggacaatattattaaaagcatatgcttcatctcaaattaaaaaaggtagtttacgtaaggaa

SEQ ID NO: 4014 - protein, 186 aa, Staphylococcus aureus
  MISC_FEATURE (1)..(186): conserved hypothetical
MKMKKQDISVKTVVAIGIGAAVFVILGRFVVIPTGFPNTNIETSYAFLALISAIFGPFAGLMTGLVGHAIKDFTTYGSAWWSWVICSGIIGCLYGWIGLKLNLSSGRFSRKSMVYFNIGQIIANIICWALIAPTLDILIYNEPANKVYTQGVISAVLNIISVGIIGTILLKAYASSQIKKGSLRKE

SEQ ID NO: 4015 - DNA, 846 bp, Staphylococcus aureus
atgggaaattatttggtattgcaatcagattttggacttagtgatggcgctgtaagtgcaatgtatggagttgcatatactgtaagtgatgatatacgtgttgaaaacttaacgcatgatataccaccgtatgacatttgggtagcgtcatatcgtttatatcaaactgtaaaatactggcctaaaggcacagtttttgtatcagtggtagacccgggtgtaggtagtgataggcggagcattgcttgcttaacatattcaggtcattacattattacacctgataatggttctttaagtcatattaaacattacgaaggtattaaaaaagttatcgaaattgatgaagtgaaaagccgattgcctcattcggaagaaagtcatacttttcatggtagagatgtttatgcatacaatggtgcgagattagctgcaaataagatagcgtttgaacgtctcggtcaggcaattaatgttgatagtattgaggcattagaaataagagaagtgacaaaaaatgaggattctgttacaggaagcattgatattttagatatcagatttgggtcattatggacaaatattccattggcattcttaaaatccttggaaattgttcatggtaataatttggtggtaacaatttatcatcaagataagaaagtctatcaaaatattattaaatttgcgcgatcgtttgcagatgttaatgtgggtgaacctcttgtgtatgttaactcgctagtaaatattggtgtagcagtcaatcaagactcattttcagatttatatcatattggtactggaaatgattggacgattcatttatctaaagcaccatcaata

SEQ ID NO: 4016 - protein, 282 aa, Staphylococcus aureus
  MISC_FEATURE (1)..(282): conserved hypothetical
MGNYLVLQSDFGLSDGAVSAMYGVAYTVSDDIRVENLTHDIPPYDIWVASYRLYQTVKYWPKGTVFVSVVDPGVGSDRRSIACLTYSGHYIITPDNGSLSHIKHYEGIKKVIEIDEVKSRLPHSEESHTFHGRDVYAYNGARLAANKIAFERLGQAINVDSIEALEIREVTKNEDSVTGSIDILDIRFGSLWTNIPLAFLKSLEIVHGNNLVVTIYHQDKKVYQNIIKFARSFADVNVGEPLVYVNSLVNIGVAVNQDSFSDLYHIGTGNDWTIHLSKAPSI

SEQ ID NO: 4017 - DNA, 471 bp, Staphylococcus aureus
atgaaatcagcagaacaatggattgatgaattgcaacttgaatcacatcctgaaggtggtttctatagagagacaattcgagaagtattgaaagatggacgcagagcgccgtttagtagtatttattttttacttacagatgacaatatttcgcattttcatcgaattgatgctgatgaagtatggtactatcatgctggcgattctctaacaattcatatgataaatccggatggggaatatacgactgcaacattgggtactgatatccaaaatggagatgtattgcaatatgtagtgcctaaaggaacaatttttgcttcttcaatcgaaatatcaaatacttttagtttagtaggttgtatgtgtcaaccggcatttgagtttaagcagtttgaattgtttaagcaatctgaattaattacgcaatatccgcatcttaaatcagtaatcgaaaaatatgctttaaaa

SEQ ID NO: 4018 - protein, 157 aa, Staphylococcus aureus
  MISC_FEATURE (1)..(157): conserved hypothetical
MKSAEQWIDELQLESHPEGGFYRETIREVLKDGRRAPFSSIYFLLTDDNISHFHRIDADEVWYYHAGDSLTIHMINPDGEYTTATLGTDIQNGDVLQYVVPKGTIFASSIEISNTFSLVGCMCQPAFEFKQFELFKQSELITQYPHLKSVIEKYALK

SEQ ID NO: 4019 - DNA, 513 bp, Staphylococcus aureus
atgactaactttacttttgatggtgcacacagtagtttagaattccaaattaaacatttaatggtttctaaagtgaaaggttcatttgatcaatttgatgtagctgttgaaggagatattaatgacttcagtactttgaaagctactgcaacaattattccaagctcaattaacactaaaaacgaagcacgtgataaccacttaaaatctggtgatttctttggtactgacgaatttgataaaattacatttgtgacaaaatcagtatctgaaagcaaagttgttggtgatttaacaattaaaggcatcactaacgaagaaacattcgatgttgaattcaacggagtaagtaagaatcctatggatggttctcaagtaacaggtattattgttactggtacaatcaatagagaaaaatatggcattaactttaaccaagcacttgaaactggtggcgtaatgctaggcaaagatgttaaattcgaagcatcagctgaattctcaatctcagaa

SEQ ID NO: 4020 - protein, 171 aa, Staphylococcus aureus
  MISC_FEATURE (1)..(171): conserved hypothetical
MTNFTFDGAHSSLEFQIKHLMVSKVKGSFDQFDVAVEGDINDFSTLKATATIIPSSINTKNEARDNHLKSGDFFGTDEFDKITFVTKSVSESKVVGDLTIKGITNEETFDVEFNGVSKNPMDGSQVTGIIVTGTINREKYGINFNQALETGGVMLGKDVKFEASAEFSISE

SEQ ID NO: 4021 - DNA, 1056 bp, Staphylococcus aureus
atgaaaccgttatcattttatttgatagttatcttgtttaaaataaaattgatagttaaaacgaatgaaatgaaaggaatgatcatgatgtcacaacaagatttacctacattattttatagcgggaagtccaatagtgctgttccaattatatctgaaagtgaattacaaacaattacagctgaaccatggcttgaaatttccaaaaaaggattgcaactagaaggattgaactttgatcggcagggacaactctttttattggatgtattcgaaggcaatattttcaaaatcaatcctgaaacgaaggaaatcaaacgaccttttgtaagtcacaaagcgaatcctgcagcaatcaaaatacataaagatggccgattattcgtttgttatttaggagattttaaatctacaggaggcatttttgcagctacagaaaatggtgacaacttacaagatattattgaagatctttcaacagcatattgtattgatgacatggtatttgattctaaaggtggattttattttacagattttagaggatactctaccaatccactaggaggcgtttattatgtttcgccggactttagaacagtgacgcctatcattcaaaatattagcgtagcaaatggtattgctttaagtacagatgaaaaagtactatgggtaacagaaacaacagccaatcgattacatcgcattgcacttgaagatgatggtgtgacgatacaaccatttggagctaccataccgtactattttacaggtcatgaaggaccagactcatgttgtattgatagtgacgataatttatacgtagcaatgtatggtcaaggtcgagtgttagtttttaataaaaggggttatccaataggacaaatattgataccaggccgagatgaagggcatatgttacgttctactcatccgcaatttatacctggaacaaatcaactcatcatttgttccaatgatatagaaatgggcggaggatctatgctttatacagttaatggctttgcaaaaggtcatcaaagttttcagtttcaa

SEQ ID NO: 4022 - protein, 352 aa, Staphylococcus aureus
  MISC_FEATURE (1)..(352): Drp35 [Staphylococcus
MKPLSFYLIVILFKIKLIVKTNEMKGMIMMSQQDLPTLFYSGKSNSAVPIISESELQTITAEPWLEISKKGLQLEGLNFDRQGQLFLLDVFEGNIFKINPETKEIKRPFVSHKANPAAIKIHKDGRLFVCYLGDFKSTGGIFAATENGDNLQDIIEDLSTAYCIDDMVFDSKGGFYFTDFRGYSTNPLGGVYYVSPDFRTVTPIIQNISVANGIALSTDEKVLWVTETTANRLHRIALEDDGVTIQPFGATIPYYFTGHEGPDSCCIDSDDNLYVAMYGQGRVLVFNKRGYPIGQILIPGRDEGHMLRSTHPQFIPGTNQLIICSNDIEMGGGSMLYTVNGFAKGHQSFQFQ

SEQ ID NO: 4023 - DNA, 954 bp, Staphylococcus aureus
atgaactatcaagttcttttatattataaatatatgacgattgatgaccctgaacagtttgctcaggatcacttagccttttgtaaagcacaccatttaaaaggtagaattcttgtttctacagaaggtattaacggcacattatctggtacaaaagaagaaaccgaacaatatatggcacatatgcatgccgatgaacgattcaaagatatggtgtttaaaattgatgaagctgaaggacatgcttttaagaaaatgcatgtacgtcctcgaaaagaaatcgttgctttagatttagaagatgacgtcgatccaagacacacaactggccaatatttatcacctgtagaatttagaaaagctcttgaagatgatgacacagtcattattgatgcacgtaatgattatgaatttgatttaggtcatttccgaggtgcaattcgtccaaatatcacacgttttagagatttgcctgactggattaaagagaataaagcgttatttgcagataaaaaagtggttacgtactgtactggtggcattcgatgcgaaaaattttctggatggcttttaaaagaaggtttcgaagatgtagctcaacttcatggcggtattgctacatatggtaaagatcctgaaacaaaaggtgaatattgggacggtaaaatgtacgtatttgatgaccgtatcagtgttgatatcaaccaagttgaaaaaacaattattggtaaggattggtttgatggcaaaccatgtgaacgttatattaattgcgctaacccagaatgtaataaacaaatattagtttctgaagaaaacgaaactaaatatttaggtgcatgctcttatgaatgtgctaaacatgagcgtaatcgttatgttcaagcaaataatattagtgataatgagtggcaacaacgtttaacaaactttgatgatttacatcaacatgct

SEQ ID NO: 4024 - protein, 318 aa, Staphylococcus aureus
  MISC_FEATURE (1)..(318): conserved hypothetical
MNYQVLLYYKYMTIDDPEQFAQDHLAFCKAHHLKGRILVSTEGINGTLSGTKEETEQYMAHMHADERFKDMVFKIDEAEGHAFKKMHVRPRKEIVALDLEDDVDPRHTTGQYLSPVEFRKALEDDDTVIIDARNDYEFDLGHFRGAIRPNITRFRDLPDWIKENKALFADKKVVTYCTGGIRCEKFSGWLLKEGFEDVAQLHGGIATYGKDPETKGEYWDGKMYVFDDRISVDINQVEKTIIGKDWFDGKPCERYINCANPECNKQILVSEENETKYLGACSYECAKHERNRYVQANNISDNEWQQRLTNFDDLHQHA

SEQ ID NO: 4025 - DNA, 636 bp, Staphylococcus aureus
atgcacattttagtaacagggtttgcgccttttgacaatcaaaatatcaatccctcatgggaagctgtgactcaactagaagatattattggcacacatacaatcgataaattaaaactaccaacctcttttaagaaagtagataatattataaataaaacgttggcatctaatcattatgatgttgtactagctataggacaagctggtggtagaaatgccattaccccagaacgtgtcgccattaatattgatgatgcacgtattccagataatgatgattttcaacctattgatcaagccattcacttagacggtgcgccagcttatttttcaaatttaccagttaaagcaatgactcaaagtattattaatcaaggacttcctggagcactttcaaatagcgcaggtacatttgtttgtaatcacacactttatcacttaggttatttacaagataagcattaccctcacctacgattcggatttattcatgtgccatacataccagagcaggtcattggtaaacccgatacaccatctatgccattagaaaagatagttgcaggtttgactgcagccattgaagctatttctaatgatgaggatttacacctagccctgggcacaacggaa

SEQ ID NO: 4026 - protein, 212 aa, Staphylococcus aureus
  MISC_FEATURE (1)..(212): pyrrolidone-carboxylate
MHILVTGFAPFDNQNINPSWEAVTQLEDIIGTHTIDKLKLPTSFKKVDNIINKTLASNHYDVVLAIGQAGGRNAITPERVAINIDDARIPDNDDFQPIDQAIHLDGAPAYFSNLPVKAMTQSIINQGLPGALSNSAGTFVCNHTLYHLGYLQDKHYPHLRFGFIHVPYIPEQVIGKPDTPSMPLEKIVAGLTAAIEAISNDEDLHLALGTTE

SEQ ID NO: 4027 - DNA, 780 bp, Staphylococcus aureus
ttggaggggaaaacgatgttaagtaaacaatctcaagattttttagaaaaattacgtgttgaattgttatttagaggtaagactgaagcagaagtagaagagttattggaagagctcgaagatcatttaactatggctgaaaaaaataacgaagatacaagttcaattattaatacaccgattaagtcaatggctgatcaattatcacctgagataagtcttactaccggtttgtataaatatattactttgtacttcgcttttattttagcagtcattataattcctaggtttttagatttgggtacatttgatgtgacaattgcatttttactttatatagctagtatcgttattttaggtgttgtcattggtatgctgattctacgaaatacattagtccgatttggtgaccaaaaaataacgtatgttataaatgtgacttatggaattatcgtatttttatggatgattttaggtggcttgattattaaaaaatatcctatctatagtttctttgagttaagtgacaaacagagtttcatcgttgggttagtacttttaattgcgctcattggaacttgtattttaattaaacagaaaatttatgcgctcatcgtgttggtaatttcattgccaagtttgatagcaaggatagcagctatctttagtaaagaaccagacacttttaatttagtttcagtaagtatactcatcattctaaatatagcatttattatttatacatttgtaaattttaggaagttaaaaaaagaagac

SEQ ID NO: 4028 - protein, 260 aa, Staphylococcus aureus
  MISC_FEATURE (1)..(260): hypothetical protein
LEGKTMLSKQSQDFLEKLRVELLFRGKTEAEVEELLEELEDHLTMAEKNNEDTSSIINTPIKSMADQLSPEISLTTGLYKYITLYFAFILAVIIIPRFLDLGTFDVTIAFLLYIASIVILGVVIGMLILRNTLVRFGDQKITYVINVTYGIIVFLWMILGGLIIKKYPIYSFFELSDKQSFIVGLVLLIALIGTCILIKQKIYALIVLVISLPSLIARIAAIFSKEPDTFNLVSVSILIILNIAFIIYTFVNFRKLKKED

SEQ ID NO: 4029 - DNA, 345 bp, Staphylococcus aureus
gtgattaaaatgtcagtgtcagatcagattatgaaaggtctcttagatggggcgatattaggtctcattgcccaaggcgaaacgtatggatatgaaattatgacgaaacttaagaatcaagagtttccagagataagtgagggtagtatttatccagttttaatgcgtttaaacaaaaaaggatacgttgatacgacaataaaaaaatctagtaatggcggcccgaggcggaaatactatacgattaccgattcaggtttaaaggaactaaaagtatttaaatcgaaatggcaagttttgaataaagggatgattaacttgtttggaggggaaaacgatgttaag

SEQ ID NO: 4030 - protein, 115 aa, Staphylococcus aureus
  MISC_FEATURE (1)..(115): conserved hypothetical
VIKMSVSDQIMKGLLDGAILGLIAQGETYGYEIMTKLKNQEFPEISEGSIYPVLMRLNKKGYVDTTIKKSSNGGPRRKYYTITDSGLKELKVFKSKWQVLNKGMINLFGGENDVK

SEQ ID NO: 4031 - DNA, 480 bp, Staphylococcus aureus
atgggggaggaattaataatgactacaaaaacagtatttgatgtcattgatatggggttaggatatttagtaaatgtgtatgatgcttggaaagttgaaaaggtacttgatgattatcataagcctttttctaataccattcattggcaatttggtcatgtattaacaatttttgaatcggccttagctgttgctggtaaagagaatattgatttaaatatctatagacctttattcggaaatggttcgtctccagatgaatggaaggatgaagtaccgagtattgaaaggattttagaaggtctccaaactttacctgaacgtgcacgaaatctaactgaagatgatttagcaattgaattgaaacagccaattgtcggttgtaataacttagaagagttattagtattaaatgccattcacatcccacttcatgctggtaaaattgaagagatgtctcgtatattaaaaaatttaaaa

SEQ ID NO: 4032 - protein, 160 aa, Staphylococcus aureus
  MISC_FEATURE (1)..(160): hypothetical protein
MGEELIMTTKTVFDVIDMGLGYLVNVYDAWKVEKVLDDYHKPFSNTIHWQFGHVLTIFESALAVAGKENIDLNIYRPLFGNGSSPDEWKDEVPSIERILEGLQTLPERARNLTEDDLAIELKQPIVGCNNLEELLVLNAIHIPLHAGKIEEMSRILKNLK

SEQ ID NO: 4033 - DNA, 1416 bp, Staphylococcus aureus
atggaaaacacggttaaatatcgtaagtttatactccctatcgttgtaggtctccttatttgggcacttacaccttttaaaccggatgctgtggatccaacagcatggtatatgttcgcaatattcgtcgcgacaatcattgcttgtattacacaaccgatgccaattggggccgtctctataattggatttacaatcatggtactcgttggcattgttgacatgaaaacggctgtcgctggttttggtaataatagcatttggttaattgctatggcatttttcatttcgagaggatttgtgaaaacaggtcttggtagacgtatcgcacttcatttcgtcaaattatttggtaaaaaaacattaggattagcatattctatcgtcggtgtagatttaattctagcgcctgctacaccaagtaataccgcgcgtgctggtggaatcatgttcccaattatcaaatcactttctgaatcatttggttcgaaaccgaaagacggatcagcacgcaaaatgggtgcatttcttgttttcacagaattccaaggtaatttaattactgcggctatgtttttaactgcaatggccggtaacccccttgcacaaaatttagcatctagcacatctaatgttcacattacatggatgaattggtttctagctgctttagttcctggacttgtttccttaattgttgtaccttttattatttataaaatttatccaccaactgttaaagaaacaccaaatgctaagagttgggctgaaaatgaattagcgactatgggtaaaatcgctttagctgaaaaatttatgattggtatttttgtcgttgcgttaacactatggattgtcggaagtttcattcatattgatgcaactttaacggcctttattgcgctagcattgttattattgacaggcgtcttaacatggcaagacattttaaacgaaacaggtgcttggaacacattagtatggttctcagtattagtgttaatggccgaccaattaaacaagcttggatttattccttggttaagtaaatccattgctacaagtcttggtggcttaagctggcctatagtcctggtcattttaatattgttctacttctattcacattacttatttgcaagttctacagcacatatcagtgcgatgtatgcagcattactaggcgttgccatcgcagccggtgcaccaccattattcagtgcattaatgttaggtttcttcggtaacctattagcttcaacaacacactatagtagtggtccagcgccgattctattctcttcaggttacgtgactcaaaaacgttggtggacaatgaacttaatattaggtttcgtctactttattatctggattggtttaggatcactttggatgaaagtaattggtatattt

SEQ ID NO: 4034 - protein, 472 aa, Staphylococcus aureus
  MISC_FEATURE (1)..(472): 2-oxoglutarate/malate
MENTVKYRKFILPIVVGLLIWALTPFKPDAVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDGSARKMGAFLVFTEFQGNLITAAMFLTAMAGNPLAQNLASSTSNVHITWMNWFLAALVPGLVSLIVVPFIIYKIYPPTVKETPNAKSWAENELATMGKIALAEKFMIGIFVVALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 4035 - DNA, 714 bp, Staphylococcus aureus
atgggacgtaaatggaataacattaaagaaaaaaaggcccaaaaagataaaaacacaagtagaatatatgcgaaatttggtaaggagatttatgttgcagcaaaatctggtgaacccaatccagaatctaaccaagctttaaggttggtgcttgaacgcgctaagacatattcagtgccgaatcatattattgaaaaagcaatagataaagctaagggtgctggagacgaaaactttgatcacctaagatatgaaggatttggcccaagcggatcaatgctaattgttgatgcgttaacaaataatgtaaatcgtactgcctctgatgtgcgagctgcttttggtaaaaacggcggtaatatgggtgtatctggatcagttgcttatatgtttgatcatgtggcaacatttggtattgaaggaaagtctgttgacgaaatacttgaaacattaatggaacaagatgtagatgtaaatgatgtgattgacgataatggattgacaatagtctatgctgaaccagatcaatttgcagtcgttcaagatgcgcttcgtgcagcaggtgttgaagaatttaaagttgctgaatttgaaatgttacctcaaacagatattgaactttctgaagcggaccaagtaacatttgaaaaattaatcgatgcattagaagatttagaagatgtacaaaacgtattccataatgtggatttgaaa

SEQ ID NO: 4036 - protein, 238 aa, Staphylococcus aureus
  MISC_FEATURE (1)..(238): conserved hypothetical
MGRKWNNIKEKKAQKDKNTSRIYAKFGKEIYVAAKSGEPNPESNQALRLVLERAKTYSVPNHIIEKAIDKAKGAGDENFDHLRYEGFGPSGSMLIVDALTNNVNRTASDVRAAFGKNGGNMGVSGSVAYMFDHVATFGIEGKSVDEILETLMEQDVDVNDVIDDNGLTIVYAEPDQFAVVQDALRAAGVEEFKVAEFEMLPQTDIELSEADQVTFEKLIDALEDLEDVQNVFHNVDLK

SEQ ID NO: 4037 - DNA, 912 bp, Staphylococcus aureus
ttgaaggtgaattcagagtataaaaaaggcatatttttagcactcagtgcatacattctgtggggaatactacctatatattggcagttcgttgatgcaataggcgcatttgaaattttagcctttcgtattatattttcagcaatattcatgattttcatactcgcggttggacaaaaacaacgcaatgcatttcaacgagatatgaatcaattgttaggcaagcccattcagctattagcgattgtcgtagcaggctatgtcattacattaaattggggtacatttatttgggctgtaacgaacggtcacgtcctacaaacaagtttaggttattatataaatccacttgttagcattttgctcgcacttatctttttaaaagaaagattcaataaatttgaatggctagccattttattcgcattcatcggtgtattatatatgacgctcaagattggagaattcccaatcgtctctattatattagcgttatcctttggtacatacggattattgaaaaaagtagtacatattgatgccatcagcagtattacgattgaatgtattgttaccgcacctgctggactaatatacgttatttatttatggcagcaacatcagatgtcatttggattgaacatgtcatcattttggttgttattttctggtgctattacggcaataccactaatcctattctcagccggggcaaaacgtattccactttcgctaataggatttattcaatacgttggaccaacaataatgtttgtactcggcatatttgttttcaaagagccttttagtatagatcaattaattacgtttatatttatttggacaggtattgtgttatatagtctttctcaatacattaaattgaagaaacatccggtcgcaaaaacccta

SEQ ID NO: 4038 - protein, 304 aa, Staphylococcus aureus
  MISC_FEATURE (1)..(304): hypothetical protein
LKVNSEYKKGIFLALSAYILWGILPIYWQFVDAIGAFEILAFRIIFSAIFMIFILAVGQKQRNAFQRDMNQLLGKPIQLLAIVVAGYVITLNWGTFIWAVTNGHVLQTSLGYYINPLVSILLALIFLKERFNKFEWLAILFAFIGVLYMTLKIGEFPIVSIILALSFGTYGLLKKVVHIDAISSITIECIVTAPAGLIYVIYLWQQHQMSFGLNMSSFWLLFSGAITAIPLILFSAGAKRIPLSLIGFIQYVGPTIMFVLGIFVFKEPFSIDQLITFIFIWTGIVLYSLSQYIKLKKHPVAKTL

SEQ ID NO: 4039 - DNA, 573 bp, Staphylococcus aureus
atgactttacctaaaattggaaagcctgcaacacgcgcgctaaattcacaaggtatatacacattagaagcagtatcacaatatacgaagtcatctctaatggagatgcatggcgttggtcctaaagctatatcaatattggaacaagctttatttcagcaccaactacattttaaaacggaagttcagtcatcattaccttttaagttaacaggagatgtgtcatgcaatcatgcgcctaaacgtcaacaaatgatagattttatagttgttacagcagcattagatattgaattattacgttcactggttacaacagaatttatttggtctgtccctggccgctttgacatatacggacctcaaatattaattcaagaactatctaatcattacaatcaggttgctagtctcaatatccattccagcatcacacatgggtgcttaggttccatgcatggtattgaaatattaaaaactggtaaagagattcattttgctcatttttttgaatttgaaaatcataaaaaggatgccaagttaagcaaagtgacatcttacattgttgttggt

SEQ ID NO: 4040 - protein, 191 aa, Staphylococcus aureus
  MISC_FEATURE (1)..(191): hypothetical protein
MTLPKIGKPATRALNSQGIYTLEAVSQYTKSSLMEMHGVGPKAISILEQALFQHQLHFKTEVQSSLPFKLTGDVSCNHAPKRQQMIDFIVVTAALDIELLRSLVTTEFIWSVPGRFDIYGPQILIQELSNHYNQVASLNIHSSITHGCLGSMHGIEILKTGKEIHFAHFFEFENHKKDAKLSKVTSYIVVG

SEQ ID NO: 4041 - DNA, 1050 bp, Staphylococcus aureus
atgattaaatatcatgttatgaaagaaggatatattttgactgtttttaaaaatgagcgcttaagctggttaccatacatagctattgtcattttgttacacgttattgggtttagttttttatggattgctggaaaagaccatcatatcttatttggtatggggattcttgcatatacattaggtttgcgtcatgcatttgatgcagatcacattgctgcaatagataatacggttcgcaaattattacagcaacgcaaagatccatctggtgtgggtttctatttttcaattggacattcatctgtcgtatttttaatggctgtttttttaggggtatctgtaaaatgggctaaagatgaattaccgcatttccaagatattggtggaacgattggtacactagtttcaggtttctttttagtgcttatcggtgtgttgaatctaattattttaatctctttaattaacttgttcgctaaattacgtcgtgaacacattgaagaagctgaagtcgatgcattacttgaatctagaggattggtttctcgatttgtaggaccttatttcaaattaatcacgcgtagttggcacgtattgccacttggctttttatttggacttggttttgatacagctagtgaaattgcgttactcgctctttcttcaggcgcatcacaacaagccatttcatttatcggaatcttatctttaccaattttattcgcatcaggtatgagtttattggatacattagatggtgttgtaatgaagtatgcctataattgggcattcttcaatcctattcgcaaaatctattacaatataacgattactgcgatatcagtcatggcagcattagtgattgggatgattgaattgctacaaattcttgctgataagttagatttacatggtgcgttttgggcattcattggttcgatcgaatttgattatttaggctatattttagttgcattatttttaattacttggcttatttcaagtttaatttggaagtttggtcgcatagaacacaaatggtctaga

SEQ ID NO: 4042 - protein, 350 aa, Staphylococcus aureus
  MISC_FEATURE (1)..(350): hypothetical protein
MIKYHVMKEGYILTVFKNERLSWLPYIAIVILLHVIGFSFLWIAGKDHHILFGMGILAYTLGLRHAFDADHIAAIDNTVRKLLQQRKDPSGVGFYFSIGHSSVVFLMAVFLGVSVKWAKDELPHFQDIGGTIGTLVSGFFLVLIGVLNLIILISLINLFAKLRREHIEEAEVDALLESRGLVSRFVGPYFKLITRSWHVLPLGFLFGLGFDTASEIALLALSSGASQQAISFIGILSLPILFASGMSLLDTLDGVVMKYAYNWAFFNPIRKIYYNITITAISVMAALVIGMIELLQILADKLDLHGAFWAFIGSIEFDYLGYILVALFLITWLISSLIWKFGRIEHKWSR

SEQ ID NO: 4043 - DNA, 798 bp, Staphylococcus aureus
atgcttatgaatattgcgaagttagagaattatttacaaattgattcatctcgttataatcgaccgagtattgaagcattaaattattatgcaacacgttttatgttaactgtaccttttgaaaatattgatgttcaaaatagtaagccgatatctataaatatcgatgcactttttaataaaattgttcatgataaacgtggtggtttttgttatgaattaaatacatttttcaaagcctatttacaacaaaaaggatttaatcctgaattaatgtcagctactattcacacacccggtggcggtcgtagtctgaacggttcacatgcttcacttgttgtttctataaatgatgtattctatgtaactgatgttggctttggagacttacctctacatgccattcctattacttcatctgagcatacacaaccaattactgatatcagtggtacattccgcgctatttttaacaacgaagacaaggatattttctatgttcaaaaattcgaaaatgatcattggcatacaaaatatgaagctgaattcaaacctaaacaaatagaagattttaatagcaacatcgaatataatcaaacgcatccagattcaatatttgtacagcatttattaattacaatgccacaatcatttggccgtgctacaatgtctgaaaatcatttaactttaacaaggaatggtagctcagaaaaatttgatgtcactaaagataactataaacattttttagaaaaatattttggactaaatgtaactattaatcgtattgaaaaacaa

SEQ ID NO: 4044 - protein, 266 aa, Staphylococcus aureus
  MISC_FEATURE (1)..(266): hypothetical protein
MLMNIAKLENYLQIDSSRYNRPSIEALNYYATRFMLTVPFENIDVQNSKPISINIDALFNKIVHDKRGGFCYELNTFFKAYLQQKGFNPELMSATIHTPGGGRSLNGSHASLVVSINDVFYVTDVGFGDLPLHAIPITSSEHTQPITDISGTFRAIFNNEDKDIFYVQKFENDHWHTKYEAEFKPKQIEDFNSNIEYNQTHPDSIFVQHLLITMPQSFGRATMSENHLTLTRNGSSEKFDVTKDNYKHFLEKYFGLNVTINRIEKQ

SEQ ID NO: 4045 - DNA, 519 bp, Staphylococcus aureus
ttgattgttatggaaaaaggaaatcaaggtattaaatggtctagtttaataatgggtgtattattattaatgttggcagtcgttatttttacatttccaattgaaaatttttatgctattacctggttgattggactgtttgtattaattaacggtgtgattcaaatcgtttaccgtagaaaagcaaaagctttagtaggtggtaaccaaaattggattctgtttatggggattgtagatattctatttggtctattagttatttttaatgttggcgcaagttcagcattctttatttatatgtttgctttttggtttatttttagttctatctctggattatttacgttttcgggtagtggtagcttaaaactaatttcagtgatttttaatttattaggtattgttttcggtgtcattttattatttaatccattaatgggtatcgtctttatttcgacgatgattgctattgcatttgtattcgtaggtgtcatttatgttgtagatgcacttgct

SEQ ID NO: 4046 - protein, 173 aa, Staphylococcus aureus
  MISC_FEATURE (1)..(173): conserved hypothetical
LIVMEKGNQGIKWSSLIMGVLLLMLAVVIFTFPIENFYAITWLIGLFVLINGVIQIVYRRKAKALVGGNQNWILFMGIVDILFGLLVIFNVGASSAFFIYMFAFWFIFSSISGLFTFSGSGSLKLISVIFNLLGIVFGVILLFNPLMGIVFISTMIAIAFVFVGVIYVVDALA

SEQ ID NO: 4047 - DNA, 756 bp, Staphylococcus aureus
atgacgatattatcagtgcaacatgtttcaaaaacatacggtaaaaagcacacatttcaagcacttaaagatattaactttgacatacaaaaaggcgaattcgttgcgattatggggccttctggatcaggtaagacaaccttattaaatgtactaagttcaattgaccaaatttctagcggtagcgtgattgctaacggacaagagcttaataaacttaatcaaaaagcacttgccaaattccgcaaagaatcattaggtttcatcttccaagattacagtattctgccgacattaaccgttaaagaaaacattatgttacctttatctgttcaaaaaatgtcgaaggcaacaatggaagaaaattataaagcgatcacgacagcattaggtatttatgacctaggaaataaataccctagcgaattatctggtggtcaacaacaaagaactgcagcagcgagagcatttgttcacaaaccacaaatcatatttgcagatgagccaacaggcgcactcgactcgaaaagtgcaaatgacctattacaacgtttggaagaaatgaataaatcgtttgatacaactattgtcatggttacacatgatccggttgcagcaagttttgcagaacgtgtcatcatgctaaaagatggccaaattcatacacaactttatcaggaaggacgttctaaacaggccttttatgaagacattgtacatcttcaatcagtattaggtggtgtctcaaatgacatt

SEQ ID NO: 4048 - protein, 252 aa, Staphylococcus aureus
  MISC_FEATURE (1)..(252): hypothetical protein
MTILSVQHVSKTYGKKHTFQALKDINFDIQKGEFVAIMGPSGSGKTTLLNVLSSIDQISSGSVIANGQELNKLNQKALAKFRKESLGFIFQDYSILPTLTVKENIMLPLSVQKMSKATMEENYKAITTALGIYDLGNKYPSELSGGQQQRTAAARAFVHKPQIIFADEPTGALDSKSANDLLQRLEEMNKSFDTTIVMVTHDPVAASFAERVIMLKDGQIHTQLYQEGRSKQAFYEDIVHLQSVLGGVSNDI

SEQ ID NO: 4049 - DNA, 1890 bp, Staphylococcus aureus
gtggtgtctcaaatgacatttaaccatatcgttttcaaaaacttacgacaaaacttaaaacattatgcaatgtatttattttcattattttttagcatcgtcttatatttcagttttacaaccttacagtttactaaaggtgtaaataatgacgactcgatggccatcattaagaaaggtgctttagtcggatcaatatttttatttatcattattgtcatctttttaatgtatgccaatcatttattcgtaaaacgccgtacacgtgaatttgcgctatttcagttgattggtttaacacgacaaaacattttgaaaatgttagcacttgaacaaatgatcgtatttttaatcacaggtgttgtcggtgtattatgtggcattgcaggtgcacaattattgctttccatagtatctaaattgatgtcgttatcgattaacttatcgatacatttcgaacctatggcccttgttttaactattttcatgctaattattgcgtatgtactgattttatttcaaagtgctttatttctaaaaagacgtagtatcttatcaatgatgaaagattcaattaaaactgatgccacaactgctaaagtaacgactgcagaggttatttcaggcgtattaggtattgctatgattgcactaggctattatatggcgacagaaatgtttggtacgttcaaagcactaactatggctatgacatcaccgtttatcattttatttttaacggttgtaggcgcctatttattcttcagaagttccgtgtcacttatttttaaaacattgaaaaaatcaaaaaatggacgcgtatctattaccgatgttgtattcacatcgtctattatgtacagaatgaagaaaaatgccatgtctttaactatcattgcaattatttctgcagttacagtaactgtattgtgttttgcggcattatctaaatcaaatacagatcaaacccttacatctatggcaccaaatgaatttaacgtggtcgctactcaagatgctaaacaatttgaaactaaactaagccaacaacaaattacattttctaaaaatgcttacgaaactattactgtagataatgttaatgatcaggttattactttggaaaatggtagtgattcaggtcgcacgaattctattttaagtgcaaataacaagttaacaggcaacaatgccatcattacaaatacaaaatcgctgcctaacattattaatatccatttaaacaaagatttagtagtaaaaggtactaagaatgaaactttccgtgttacacaagaagacaaaggtaaggtttatcctttaaatctaagcttcaactcacctgtcatcgaagtaagtcctgaaaagtatcagcagttgaaaacacaaaataacgttcatactttttatggatatgatattaaacaaacatcacaaaaggaaaaagctcaagcaattgcaaaacagtttggagacaaagtcatcacgtatgatgaaatgaaaaaagaggtcgatgctactaacggtattctaatatttgttacatcatttttaggattagcatttttagtagcagctggatgtattatttatattaaacaaatggatgaaactgaggatgaactaagtaacttcagaatattaaaacgcataggctttacgcatacagatatgcttaagggattattattaaaaattactttcaacttcggtttaccattattgattgctatattacatgcagtattcgccgcaatagcatttatgaaattgatgggtaatatttccttcatgccggttattgtagtaattgttgtatacaccctcatttacattacttttgctttaattgcttttatacattcaaacaaattgattaagaaaaccatt

SEQ ID NO: 4050 - protein, 630 aa, Staphylococcus aureus
  MISC_FEATURE (1)..(630): hypothetical protein
VVSQMTFNHIVFKNLRQNLKHYAMYLFSLFFSIVLYFSFTTLQFTKGVNNDDSMAIIKKGALVGSIFLFIIIVIFLMYANHLFVKRRTREFALFQLIGLTRQNILKMLALEQMIVFLITGVVGVLCGIAGAQLLLSIVSKLMSLSINLSIHFEPMALVLTIFMLIIAYVLILFQSALFLKRRSILSMMKDSIKTDATTAKVTTAEVISGVLGIAMIALGYYMATEMFGTFKALTMAMTSPFIILFLTVVGAYLFFRSSVSLIFKTLKKSKNGRVSITDVVFTSSIMYRMKKNAMSLTIIAIISAVTVTVLCFAALSKSNTDQTLTSMAPNEFNVVATQDAKQFETKLSQQQITFSKNAYETITVDNVNDQVITLENGSDSGRTNSILSANNKLTGNNAIITNTKSLPNIINIHLNKDLVVKGTKNETFRVTQEDKGKVYPLNLSFNSPVIEVSPEKYQQLKTQNNVHTFYGYDIKQTSQKEKAQAIAKQFGDKVITYDEMKKEVDATNGILIFVTSFLGLAFLVAAGCIIYIKQMDETEDELSNFRILKRIGFTHTDMLKGLLLKITFNFGLPLLIAILHAVFAAIAFMKLMGNISFMPVIVVIVVYTLIYITFALIAFIHSNKLIKKTI

SEQ ID NO: 4051 - DNA, 189 bp, Staphylococcus aureus
atgaaatttagagaattagtaaaacaatcatatgaggatttgaaaaatttgactgtaacttggtataacgtcattgctttaacaatacttgttattgtattaagctcattcacaacaccaatgataggcattccagctggtttattaggtggcgcctattatttaaaacgtcgtgaagaaaaaggtaaa

SEQ ID NO: 4052 - protein, 63 aa, Staphylococcus aureus
  MISC_FEATURE (1)..(63): hypothetical protein
MKFRELVKQSYEDLKNLTVTWYNVIALTILVIVLSSFTTPMIGIPAGLLGGAYYLKRREEKGK

SEQ ID NO: 4053 - DNA, 534 bp, Staphylococcus aureus
gtgctaaactcaatatgtatttcctaccaaagaaaacataaggagtttggacatcttgaaggagatactattgttggtcgtcgtcatggtagtgcaatcattactttggtagaaagagtatccaagatgattatcaccttacgacccttaggtcgtaaggcaactgatatagaaaacgctctacactcaatgttttcatctttaccttctcatatatttaaatcaattacttttgattgtggtaaggagttctcaaactggaaaacattatgtaactgtcacgatatatctatattttttgctgatccaggcacgccatcacagcgaggtttaaatgaacattctaacggaatacttagacgcagtggattagataaagaactagatttcaatttagtaacagacgatcatatcatcagtgttgctcaaaaaatcaatcatcgtcctagaaaatctttaggttatagaacaccattggaagtatttatgagtttcatcgaagatgataaacttgtccagcttaatttgacaatc

SEQ ID NO: 4054 - protein, 178 aa, Staphylococcus aureus
VLNSICISYQRKHKEFGHLEGDTIVGRRHGSAIITLVERVSKMIITLRPLGRKATDIENALHSMFSSLPSHIFKSITFDCGKEFSNWKTLCNCHDISIFFADPGTPSQRGLNEHSNGILRRSGLDKELDFNLVTDDHIISVAQKINHRPRKSLGYRTPLEVFMSFIEDDKLVQLNLTI

SEQ ID NO: 4055 - DNA, 495 bp, Staphylococcus aureus
atgattattaaccttgaaacacaacaaatacattttgatttagaacatgaaattccctattttcaagcacctgagaaaaataggatacgcttagatattgatgttctcaataaaaagcaaatttctaatattattaatgttatatttaataaccaatcaaagacgaaatgtacatttttgtctgaatacttatatcctgttaaatttagagaaaaaacaagaattggtcgtttttttaatattactaactggtacgaagaaatccattctaccgatgagaagtatgttattgcaactattaaaaatataaaaaacaaagacttaattgattattctttatatattaaaaaaggtttagtggagccatttattgtattctataatcaagaaaatatattctacattagcaatgctgttatagatatcatcagtgtatccaaagatactcttgattatataaagtcagaattcaatgatcactgtgcttcgccatac

SEQ ID NO: 4056 - protein, 165 aa, Staphylococcus aureus
MIINLETQQIHFDLEHEIPYFQAPEKNRIRLDIDVLNKKQISNIINVIFNNQSKTKCTFLSEYLYPVKFREKTRIGRFFNITNWYEEIHSTDEKYVIATIKNIKNKDLIDYSLYIKKGLVEPFIVFYNQENIFYISNAVIDIISVSKDTLDYIKSEFNDHCASPY

SEQ ID NO: 4057 - DNA, 435 bp, Staphylococcus aureus
atgagaaagacaatggctgaaaaatttaagataataatgacagaagcattgtctttatatatttgggggtgcaacattttgaatactgagaaattagaaacattgcttggcttctataaacaatataaagcattatctgaatatattgataaaaaatataagttgtcgctaaatgatttagcagtcttagatttaacgatgaagcattgcaaagatgaaaaagtacttatgcaatcatttttaaaaactgcaatggatgagctagatttaagtaggacaaaattattagtttctataagaagactaattgaaaaagaaagacttagtaaagttagatcatctaaagatgagcgtaaaatttatatttatttaaataatgatgatatatctaaatttaatgctttatttgaagatgtagaacaatttttaaatatt

SEQ ID NO: 4058 - protein, 145 aa, Staphylococcus aureus
  MISC_FEATURE (1)..(145): hypothetical protein
MRKTMAEKFKIIMTEALSLYIWGCNILNTEKLETLLGFYKQYKALSEYIDKKYKLSLNDLAVLDLTMKHCKDEKVLMQSFLKTAMDELDLSRTKLLVSIRRLIEKERLSKVRSSKDERKIYIYLNNDDISKFNALFEDVEQFLNI

SEQ ID NO: 4059 - DNA, 348 bp, Staphylococcus aureus
ttgcaccttttcattttatcttctcatatatttaaatcaattacttttgattgtggtaaggagttctcaaactggaaaacaatatgtaactgtcacgatatatctatattttttgctgatccaggcacgccatcacagcgaggtttaaatgaacattctaacggaataattagacgcagtggattagataaagaactagatttcaatttagtaacggatgatcatatcatcagtgttgctcaaaaaatcaatcatcatcctagaaaatctttaggttatagaacaccattggaagtatttatgagtttcatcgaagatgataaacttgtccagcttaatttgacaatc

SEQ ID NO: 4060 - protein, 116 aa, Staphylococcus aureus
LHLFILSSHIFKSITFDCGKEFSNWKTICNCHDISIFFADPGTPSQRGLNEHSNGIIRRSGLDKELDFNLVTDDHIISVAQKINHHPRKSLGYRTPLEVFMSFIEDDKLVQLNLTI

SEQ ID NO: 4061 - DNA, 189 bp, Staphylococcus aureus
atgaaatttagagaattagtaaaacaatcatatgaggatttgaaaaatttgactgtaacttggtataacgtcattgctttaacaatacttgttattgtattaagctcattcacaacaccaatgataggcattccagctggtttattaggtggctcttattatttaaaacgtcgtgaagaaaaaggcaag

SEQ ID NO: 4062 - protein, 63 aa, Staphylococcus aureus
  MISC_FEATURE (1)..(63): hypothetical protein
MKFRELVKQSYEDLKNLTVTWYNVIALTILVIVLSSFTTPMIGIPAGLLGGSYYLKRREEKGK

SEQ ID NO: 4063 - DNA, 225 bp, Staphylococcus aureus
gtgcaaaagcacacggaggttttctatatgaataacggtacagtaaaatggtttaacgcagaaaaaggttttggtttcatcgaacaagaaaatggcggagacgtattcgtacatttctcaggtatcgctagcgatggctacaaaactttagaagaaggtcaaaaagttactttcgaaatcactgaaggtcaacgtggagaccaagcagttaacgtacaaactgtt

SEQ ID NO: 4064 - protein, 75 aa, Staphylococcus aureus
  MISC_FEATURE (1)..(75): cold shock protein
VQKHTEVFYMNNGTVKWFNAEKGFGFIEQENGGDVFVHFSGIASDGYKTLEEGQKVTFEITEGQRGDQAVNVQTV

SEQ ID NO: 4065 - DNA, 567 bp, Staphylococcus aureus
ttgaatctgagtaaacaaattaaaaagtatagggaacgagatggttattcacaagaatatcttgctgaaaagttatatgtatctaggcagagtatttctaattgggaaaatgacaaaagcttaccagacatacataacttattaatgatgtgtgaattgttcaatgtaactttagatgatttagtaaaagggaccattccatttgtacctgatattaaagcgcaacgaagtcttaacttatggacatatgtgatgcttattttcatgacattagctgcaattttaatgggacctttagttgtttattggaattggacttggggtgtaacggtggcaatcattttgggaataggtttttatgcatctatgaaaatagaagatttaaaaaaagtgcataaaatggacaactacgatcgaattgttgcttttatgaatggaaaagatcctagtgaagtacaaacgactaaagctagaaatacgatgacaaatgcgctttctattatatcagtaattggtatactcagcctcataattttccttagtgtgtatttggcaaataagttttta

SEQ ID NO: 4066 - protein, 189 aa, Staphylococcus aureus
  MISC_FEATURE (1)..(189): hypothetical protein
LNLSKQIKKYRERDGYSQEYLAEKLYVSRQSISNWENDKSLPDIHNLLMMCELFNVTLDDLVKGTIPFVPDIKAQRSLNLWTYVMLIFMTLAAILMGPLVVYWNWTWGVTVAIILGIGFYASMKIEDLKKVHKMDNYDRIVAFMNGKDPSEVQTTKARNTMTNALSIISVIGILSLIIFLSVYLANKFL

SEQ ID NO: 4067 - DNA, 381 bp, Staphylococcus aureus
atgcttgcaaagttagtcctagttaagagattacgttcacactatttactattcgattttccagctttccaactatgcttttctaatcttttttgtgctataaattctaccgcttcaaaaatacatactgcactgatgaaccagcttaggaaaccaacaacaatgctaatcaaccacatgtgcgtcatatgtaacatcatccatgtaactaaaatacaaactaatacccctgtcataccaaacactgcgccacgacttacatgcacagcgactttatcaccatattgcatacctgtaataaacatagacactaaaaatactgccggaaacgttgcaaatataccgccaaattctttccaaggtagtgttacagatacaata

SEQ ID NO: 4068 - protein, 127 aa, Staphylococcus aureus
MLAKLVLVKRLRSHYLLFDFPAFQLCFSNLFCAINSTASKIHTALMNQLRKPTTMLINHMCVICNIIHVTKIQTNTPVIPNTAPRLTCTATLSPYCIPVINIDTKNTAGNVANIPPNSFQGSVTDTI

SEQ ID NO: 4069 - DNA, 393 bp, Staphylococcus aureus
atgaaattaacattaatgaaattttttgtggggggatttgcagtattattaagttatattgtatctgtaacactaccttggaaagaatttggcggtatatttgcaacgtttccggcagtatttttagtgtctatgtttattacaggtatgcaatatggtgataaagtcgctgtgcatgtaagtcgtggcgcagtgtttggtatgacaggggtattagtttgtattttagttacatggatgatgttacatatgacgcacatgtggttgattagcattgttgttggtttcctaagctggttcatcagtgcagtatgtatttttgaagcggtagaatttatagcacaaaaaagattagaaaagcatagttggaaagctggaaaatcgaatagtaaa

SEQ ID NO: 4070 - protein, 131 aa, Staphylococcus aureus
  MISC_FEATURE (1)..(131): hypothetical protein
MKLTLMKFFVGGFAVLLSYIVSVTLPWKEFGGIFATFPAVFLVSMFITGMQYGDKVAVHVSRGAVFGMTGVLVCILVTWMMLHMTHMWLISIVVGFLSWFISAVCIFEAVEFIAQKRLEKHSWKAGKSNSK

SEQ ID NO: 4071 - DNA, 357 bp, Staphylococcus aureus
ttgaagatgttttcaattggaagtgcaattcttcattttgtcattggtggtatcgctgttgcattagcttcaattattgctgataaggtaggtggtaagttaggaggtattatagctactatgccggcagtctttcttgcggctattatcgcattagctttagatcatcgtggtacgcaattagtggagatgtcgatgaatcttagtactggagcaattgtcggtattctgtcttgtatattaactgtatttttgacatctctctacattaagcataaaggttatcggaaaggcgcaatattcacagttgtttgttggtttgtcatttccctcgcaatattcagtattagacattta

SEQ ID NO: 4072 - protein, 119 aa, Staphylococcus aureus
  MISC_FEATURE (1)..(119): hypothetical protein
LKMFSIGSAILHFVIGGIAVALASIIADKVGGKLGGIIATMPAVFLAAIIALALDHRGTQLVEMSMNLSTGAIVGILSCILTVFLTSLYIKHKGYRKGAIFTVVCWFVISLAIFSIRHL

SEQ ID NO: 4073 - DNA, 837 bp, Staphylococcus aureus
atgaaaaaacctttttcaaaattatttggtttgaaaaacaaagatgacatcattggacatattgaagaagatcgcaatagtaatgttgaatccattcaaattgaacgtatcgttcccaaccgttatcaaccaagacaggtgtttgaaccaaataaaattaaagaacttgctgaatcaatacatgaacatggtttactacaacctattgttgtaagaccgattgaagaagatatgtttgaaattattgctggagagcgccgatttagagcaatacaatcactaaatttacctcaagcagacgttattattcgtgatatggatgatgaagagacggctgttgttgcattaattgagaatattcaaagagaaaatttgtctgttgttgaagaagcggaagcctataagaaattattggaaattggtgatacaacgcaaagtgaattggcaaaaagtttaggtaaaagtcaaagctttattgcaaataagttgcgtttattgaagttggcgccgaaagtactacttcgcttaagagaaggtaaaattactgaacgtcatgcgagagcggtattatcattgtctgatagcgaacaagaagcgttgattgagcaagtcattgcacaaaagctaaatgtgaaacagactgaagatagagtacgccaaaaaacggggcccgaaaaagtcaaagcacaaaaccttcgctttgcacaagatgtcactcaagcacgagatgaggtaggcaaaagtatccaagcgattcaacaaacaggattacatgttgagcataaagacaaagatcatgaagattattatgaaataaaaattcgaatatataaacgt

SEQ ID NO: 4074 - protein, 279 aa, Staphylococcus aureus
  MISC_FEATURE (1)..(279): hypothetical protein
MKKPFSKLFGLKNKDDIIGHIEEDRNSNVESIQIERIVPNRYQPRQVFEPNKIKELAESIHEHGLLQPIVVRPIEEDMFEIIAGERRFRAIQSLNLPQADVIIRDMDDEETAVVALIENIQRENLSVVEEAEAYKKLLEIGDTTQSELAKSLGKSQSFIANKLRLLKLAPKVLLRLREGKITERHARAVLSLSDSEQEALIEQVIAQKLNVKQTEDRVRQKTGPEKVKAQNLRFAQDVTQARDEVGKSIQAIQQTGLHVEHKDKDHEDYYEIKIRIYKR

SEQ ID NO: 4075 - DNA, 717 bp, Staphylococcus aureus
atgactgtagaatggttagcagaacaattaaaagaacataatattcaattaactgagactcaaaaacaacagtttcaaacatattatcgtttacttgttgaatggaatgaaaagatgaatttgacaagtattacagatgaacacgatgtatatttgaaacatttttatgattccattgcacctagtttttattttgattttaatcagcctataagtatatgtgatgtaggcgctggagctggttttccaagtattccgttaaaaataatgtttccgcagttaaaagtgacgattgttgattcattaaataagcgtattcaatttttaaaccatttagcgtcagaattacaattacaggatgtcagctttatacacgatagagcagaaacatttggtaagggtgtctacagggagtcttatgatgttgttactgcaagagcagtagctagattatccgtgttaagtgaattgtgtttaccgctagttaaaaaaggtggacagtttgttgcattaaaatcttcaaaaggtgaagaagaattagaagaagcaaaatttgcaattagtgtgttaggtggtaatgttacagaaacacatacctttgaattgccagaagatgctggagagcgccagatgttcattattgataaaaaaagacagacgccgaaaaagtatccaagaaaaccagggacgcctaataagactcctttacttgaaaaa

SEQ ID NO: 4076 - protein, 239 aa, Staphylococcus aureus
  MISC_FEATURE (1)..(239): glucose inhibited division
MTVEWLAEQLKEHNIQLTETQKQQFQTYYRLLVEWNEKMNLTSITDEHDVYLKHFYDSIAPSFYFDFNQPISICDVGAGAGFPSIPLKIMFPQLKVTIVDSLNKRIQFLNHLASELQLQDVSFIHDRAETFGKGVYRESYDVVTARAVARLSVLSELCLPLVKKGGQFVALKSSKGEEELEEAKFAISVLGGNVTETHTFELPEDAGERQMFIIDKKRQTPKKYPRKPGTPNKTPLLEK

SEQ ID NO: 4077 - DNA, 1875 bp, Staphylococcus aureus
gtggttcaagaatatgatgtaatcgttataggtgcgggacatgcaggtgtagaagcaggtttagcatctgcaagacgtggtgctaaaacattaatgctaacaataaatttagataatattgcatttatgccatgtaacccatctgtaggtggaccagctaaaggtatcgttgttcgtgaaattgatgctttaggtggacaaatggcaaaaacaatcgataaaacacacattcaaatgagaatgttaaatacaggtaaaggacctgctgtaagagcactaagagcgcaagcagataaagtactttatcaacaagaaatgaaacgcgtgattgaagatgaagaaaatttgcatataatgcaaggtatggtagacgaacttattatagaagataatgaagttaaaggtgtacgtacaaatattggtacagagtatttatctaaagcagtaattattacaacgggaacatttttacgtggtgaaatcattttaggtaatatgaagtattcaagtggaccaaatcaccaattaccatcaatcacattatcagacaatttaagagaacttggttttgatattgttcgttttaaaacaggtacaccaccgcgtgtaaattcaaaaacaattgactattcgaagactgaaatacaaccaggtgacgatgtaggtcgtgcattcagctttgaaacaacagaatatatattagatcaattgccatgttggctaacgtatactaatgctgaaacacacaaagttatcgatgataatttacatctatctgcaatgtattcagggatgattaaaggaaccgggccacgttattgcccttcaattgaagataaatttgttcgatttaatgataagccgcgacatcaacttttcttagagcctgaaggtcgtaatacaaatgaagtatatgtgcaaggattgtctacaagtcttcctgaacatgtgcaacgtcaaatgttagagacgataccaggtcttgaaaaagcagatatgatgcgtgccggctacgcaattgaatatgatgcgattgtgccaacgcagttatggcctacacttgaaacgaaaatgattaaaaacttatatactgcaggtcaaattaatggtacatctggttatgaagaagcagcaggacaaggattgatggcaggtattaacgctgcaggtaaagtgttaaacacaggcgaaaagatattaagtcgttcagatgcatatattggtgtcttaatcgatgatcttgtaactaaaggtactaatgaaccttatcgtttactaacatcacgtgcagaatatcgtttgttactacgtcatgataatgctgatttgagattgacggatatgggatatgaacttggtatgatttctgaagaaagatatgcacgttttaatgaaaaacgtcagcaaattgatgcggaaattaagcgtttatcagatattcgtattaaaccaaacgaacatacgcaagcgattattgaacaacatggtggttctcgcttaaaagatggtattttagctatcgatttattacgcagacctgaaatgacttacgatataattttagaacttttagaagaagaacatcaattgaatgcagatgttgaagaacaagtagaaatacaaacaaaatatgaaggttatatcaataaatcactacaacaagttgagaaagttaagcgtatggaagagaagaaaattccagaagacttagattatagtaagattgatagtttggcgactgaagcgcgagaaaaattatcagaagtaaaacctttaaatattgcacaagcttctagaatatcaggggtaaatccagcagacatatctatattattgatttacttagaacaaggtaaactccaaagggtgagtgac

SEQ ID NO: 4078 - protein, 625 aa, Staphylococcus aureus
  MISC_FEATURE (1)..(625): glucose inhibited division
VVQEYDVIVIGAGHAGVEAGLASARRGAKTLMLTINLDNIAFMPCNPSVGGPAKGIVVREIDALGGQMAKTIDKTHIQMRMLNTGKGPAVRALRAQADKVLYQQEMKRVIEDEENLHIMQGMVDELIIEDNEVKGVRTNIGTEYLSKAVIITTGTFLRGEIILGNMKYSSGPNHQLPSITLSDNLRELGFDIVRFKTGTPPRVNSKTIDYSKTEIQPGDDVGRAFSFETTEYILDQLPCWLTYTNAETHKVIDDNLHLSAMYSGMIKGTGPRYCPSIEDKFVRFNDKPRHQLFLEPEGRNTNEVYVQGLSTSLPEHVQRQMLETIPGLEKADMMRAGYAIEYDAIVPTQLWPTLETKMIKNLYTAGQINGTSGYEEAAGQGLMAGINAAGKVLNTGEKILSRSDAYIGVLIDDLVTKGTNEPYRLLTSRAEYRLLLRHDNADLRLTDMGYELGMISEERYARFNEKRQQIDAEIKRLSDIRIKPNEHTQAIIEQHGGSRLKDGILAIDLLRRPEMTYDIILELLEEEHQLNADVEEQVEIQTKYEGYINKSLQQVEKVKRMEEKKIPEDLDYSKIDSLATEAREKLSEVKPLNIAQASRISGVNPADISILLIYLEQGKLQRVSD

SEQ ID NO: 4079 - DNA, 2148 bp, Staphylococcus aureus
atggcaaaatcatgcttgcatatacttactaataatgaatatgcgacaacgcgttgccaagatggcatagtcttattttggccaattgacggggaaatcgaactacaaaaatttcgtaaaagtaaaataattgaagatgatatatatattattaatcatctggatgtatttagtattaagaataataaaaaaacgatcatgttgtatttgagtagcgattggtttgcggaattaggctttactttctttaattaccactatacagcaaagttgattaaatcatcctataatttgaaatgtctactattaaaattgacatatcgataccttgataatcagcctcttaatgacgctgatattagaaaattacaggatattattaaaatcattgcaaaagaagcaagtatggataaaaagattgcacaaaatcaatatcgatatgcgtattatggtgatttgcgtgatgagctcgaatatatttatcaaaatgtaaatcaacgattgacattaaaaagtgtcgctgataaattatttgtctcaaagtcaaatttgtcatcacaattccacttacttatgggcatgggttttaaaaaatatattgatactttgaaaattggtaaatcgattgaaattctacttactactgatagtactattagcaacataagtgaacatttaggttttagtagtagctccacttactctaaaatgtttaaaagttatatggatataacaccgaatgaatatcgtaatttatcaaaatataataaatgtttaatgctaaagccagaaccactagtaggcaaaatggtgcaagaagtaaaagaaatcatattgaattatattgaacattataaaaaccacctaactgatgttatacatattgatgaagacaaatttgaaacacctaaattgtttcaaacggttattcaaataaatacttatacagaaatgaaattagttttcttagaaggaatctttaaaaccttattgaataagaacagtcaagttgtctttttcatcatgccatcgattctaaaaagtaaaaataccatgtccgaagaagaaaaattcacaatcattaaaacaataattgaaagtgatctaaagatagcatttaatataaataatattgaaacaacttattttgttgaagaagcttttatgagtgttttcagacaaatatctccaaacgaattaagtaatcataataattacgaagtgcattttgtttttgatttatcattgatggaaattagaacaatttatcgaatgatattaaaattacataacatcatgttgaatgtgaaattaggattgaacattacctgtttatttgaaaaaccttcagtttttaaatcactagtatcacaaataaagcgacttaaattcgattcgttaataatagataatgcaaatttaagtagcccttatttgatgggggaaagtgatgagttactattgaaaaatattttgcattttaaaaatttaaaacaagtaattaatgaattggatattgaacaagaaaagctgatttttctaaatgttgaaaatcataaactgcttaataataaagaacgagatctaagtaatagtgctccattaatttataagacattaagtgcgctgtatcacaactttgatggctttggattaaacatttttgacaatcatcaagcatttaatgcgatgcatctatatgacaaaaatggatttaaaacaacactaggtcttatattagaaaagtttatcgaatatgtctcgaaaccaaaatacgaaaacagttattattctatttttgatatagagaattattattgtcttgttatttatgattggcgagtgatagagagcgagacaattatgagtaattttgaggatagtcaagtttatataaattttaaaaacaatgttttaaacgataaatatctaattgtaatagaaacattggacgaaaatagtggcaacattaatcatttgatttctaaagaattaagagataaatatgaatggaaccctagtttactatctaaaattgacaactaccttaaaccagcaatagagattaaagagcataattttagtgataattccttgaatattaacgttacttttaatgcgttatacataattaaaataggaaaaaaa

SEQ ID NO: 4080 - protein, 716 aa, Staphylococcus aureus
  MISC_FEATURE (1)..(716): hypothetical protein
MAKSCLHILTNNEYATTRCQDGIVLFWPIDGEIELQKFRKSKIIEDDIYIINHLDVFSIKNNKKTIMLYLSSDWFAELGFTFFNYHYTAKLIKSSYNLKCLLLKLTYRYLDNQPLNDADIRKLQDIIKIIAKEASMDKKIAQNQYRYAYYGDLRDELEYIYQNVNQRLTLKSVADKLFVSKSNLSSQFHLLMGMGFKKYIDTLKIGKSIEILLTTDSTISNISEHLGFSSSSTYSKMFKSYMDITPNEYRNLSKYNKCLMLKPEPLVGKMVQEVKEIILNYIEHYKNHLTDVIHIDEDKFETPKLFQTVIQINTYTEMKLVFLEGIFKTLLNKNSQVVFFIMPSILKSKNTMSEEEKFTIIKTIIESDLKIAFNINNIETTYFVEEAFMSVFRQISPNELSNHNNYEVHFVFDLSLMEIRTIYRMILKLHNIMLNVKLGLNITCLFEKPSVFKSLVSQIKRLKFDSLIIDNANLSSPYLMGESDELLLKNILHFKNLKQVINELDIEQEKLIFLNVENHKLLNNKERDLSNSAPLIYKTLSALYHNFDGFGLNIFDNHQAFNAMHLYDKNGFKTTLGLILEKFIEYVSKPKYENSYYSIFDIENYYCLVIYDWRVIESETIMSNFEDSQVYINFKNNVLNDKYLIVIETLDENSGNINHLISKELRDKYEWNPSLLSKIDNYLKPAIEIKEHNFSDNSLNINVTFNALYIIKIGKK

SEQ ID NO: 4081 - DNA, 1398 bp, Staphylococcus aureus
ttgaaggaggcgagtagcaatatggatttagatacaattacgagtatttcaacaccaatgggtgaaggggcaattggaattgttcgattgtctggaccgcaagccgttgaaattgctgacaaattatataaaggaaaacatcttttaaatgatgttccatcacatacgattaattacggtcatattattgatccagagtctaaagaagtggttgaagaagttatggtgtctgtgttaagagcgccaaaaacatttacacgcgaagatattatagaaattaattgtcatggtggtattttaacgattaatagagtgctggaacttactatgacatatggcgctagaatggctgagccaggtgaatttacaaaacgtgcctttttaaatggtcgtattgatttatctcaagctgaagcagttatggactttattcgctcgaagacagatagagcttctaaagttgcgatgaatcaaattgaaggtcgtctaagtgacttaatcaaaaaacaacgtcaatctatattagagatactcgctcaagtggaagtgaatattgattatcctgaatacgatgatgttgaagatgcgactactgaatttcttttagagcagtctaaagaaatcaaacaggaaattaatcgtttattagataccggtgcgcagggtaaaattatgcgtgaaggtttatctacagttattgttggtaaaccaaacgtaggtaaatcatcgatgttaaataatttaatacaagataataaagcgattgtaactgaggtagcaggtactactagagatgtcttagaagagtacgtcaatgttcgtggcgtgccattaagattagttgatactgctggtatacgtgagacagaagatatagtagagaagattggtgttgaacgctctagaaaggctcttagccaagcagacttaattttatttgtattaaacaataacgaagcattgactcaagaagattacacattatatgaagtggttaaaaatgaagatgtaatcgtaattgttaataaaatggatttagagcaaaacatagatattaatgaagttaaagatatgataggtgatacgccattaattcaaacttcaatgttaaaacaagaaggtattgatgaattagaaatacaaattcgagatttgttctttggtggagaagtacaaaatcaagatatgacttatgtttctaattcaagacatatttcattattaaaacaagcaagacaaacgatacaagatgcgattgatgcagcagaatctggtgtgcctatggatatggtacaaattgatttaactagaacttgggaaatattaggagaaattattggtgagactgcaagtgatgaactcatcgatcagttattcagtcaattctgcttaggtaaa

SEQ ID NO: 4082 - protein, 466 aa, Staphylococcus aureus
  MISC_FEATURE (1)..(466): possible thiophene and
LKEASSNMDLDTITSISTPMGEGAIGIVRLSGPQAVEIADKLYKGKHLLNDVPSHTINYGHIIDPESKEVVEEVMVSVLRAPKTFTREDIIEINCHGGILTINRVLELTMTYGARMAEPGEFTKRAFLNGRIDLSQAEAVMDFIRSKTDRASKVAMNQIEGRLSDLIKKQRQSILEILAQVEVNIDYPEYDDVEDATTEFLLEQSKEIKQEINRLLDTGAQGKIMREGLSTVIVGKPNVGKSSMLNNLIQDNKAIVTEVAGTTRDVLEEYVNVRGVPLRLVDTAGIRETEDIVEKIGVERSRKALSQADLILFVLNNNEALTQEDYTLYEVVKNEDVIVIVNKMDLEQNIDINEVKDMIGDTPLIQTSMLKQEGIDELEIQIRDLFFGGEVQNQDMTYVSNSRHISLLKQARQTIQDAIDAAESGVPMDMVQIDLTRTWEILGEIIGETASDELIDQLFSQFCLGK

SEQ ID NO: 4083 - DNA, 354 bp, Staphylococcus aureus
gtgatgttattggaaaaagcttaccgaattaaaaagaatgcagattttcagagaatatataaaaaaggtcattctgtagccaacagacaatttgttgtatacacttgtaataataaagaaatagaccattttcgcttaggtattagtgtttctaaaaaactaggtaatgcagtgttaagaaacaagattaaaagagcaatacgtgaaaatttcaaagtacataagtcgcatatattggccaaagatattattgtaatagcaagacagccagctaaagatatgacgactttacaaatacagaatagtcttgagcacgtacttaaaattgccaaagtttttaataaaaagattaag

SEQ ID NO: 4084 - protein, 118 aa, Staphylococcus aureus
  MISC_FEATURE (1)..(118): ribonuclease P protein
VMLLEKAYRIKKNADFQRIYKKGHSVANRQFVVYTCNNKEIDHFRLGISVSKKLGNAVLRNKIKRAIRENFKVHKSHILAKDIIVIARQPAKDMTTLQIQNSLEHVLKIAKVFNKKIK

SEQ ID NO: 4085 - DNA, 150 bp, Staphylococcus aureus
atggaggtgttttgcatggtaaaacgtacttatcaaccaaataaacgtaaacatagtaaagttcatggtttcagaaaacgcatgagcacaaaaaatggccgtaaagttttagcgcgccgtcgtcgtaaaggccgtaaagttttatctgca

SEQ ID NO: 4086 - protein, 50 aa, Staphylococcus aureus
  MISC_FEATURE (1)..(50): 50S ribosomal protein L34
MEVFCMVKRTYQPNKRKHSKVHGFRKRMSTKNGRKVLARRRRKGRKVLSA

SEQ ID NO: 4087 - DNA, 1359 bp, Staphylococcus aureus
atgtcggaaaaagaaatttgggaaaaagtgcttgaaattgctcaagaaaaattatcagctgtaagttactcaactttcctaaaagatactgagctttacacgattaaagatggtgaagctatcgtattatcgagtattccttttaatgcaaattggttaaatcaacaatatgctgaaattatccaagcaatcttatttgatgttgtaggctatgaagttaaacctcactttattactactgaagaattagcaaattatagtaataatgaaactgctactccaaaagaaacaacaaaaccttctactgaaacaactgaggataatcatgtgcttggtagagagcaattcaatgcccataacacatttgacacttttgtaatcggacccggtaaccgctttccacatgcagcgagtttagctgtggccgaagcaccagccaaagcgtacaatccattatttatctatggaggtgttggtttaggaaaaacccatttaatgcatgccattggtcatcatgttttagataataatccagatgccaaagtgatttacacatcaagtgaaaaattcacaaatgaatttattaaatcaattcgtgataacgaaggtgaagctttcagagaaagatatcgtaatatcgacgtcttattaatcgatgatattcagttcatacaaaacaaggtacaaacacaagaagaatttttctatacttttaatgaattgcatcagaataacaagcaaatagttatttcgagtgatcgaccaccaaaggaaattgcacaattagaagaccgattacgttcacgctttgaatgggggctaattgttgatattacgccaccagattatgaaactcgaatggcaattttgcagaagaaaattgaagaagaaaaattagatattccaccagaagctttaaattatatagcaaatcaaattcaatctaatattcgtgaattagaaggtgcattaacacgtttacttgcatattcacaattattaggaaaaccaattacaactgaattaactgctgaagctttaaaagatatcattcaagcaccaaaatctaaaaagattaccatccaagatattcaaaaaattgtaggccagtactataatgttagaattgaagatttcagtgcaaaaaaacgtacaaagtcaattgcatatccgcgtcaaatagctatgtacttgtctagagagcttacagatttctcattacctaaaattggtgaagaatttggtgggcgtgatcatacgaccgtcattcatgctcatgaaaaaatatctaaagatttaaaagaagatcctatttttaaacaagaagtagagaatcttgaaaaagaaataagaaatgta

SEQ ID NO: 4088 - protein, 453 aa, Staphylococcus aureus
  MISC_FEATURE (1)..(453): chromosomal replication
MSEKEIWEKVLEIAQEKLSAVSYSTFLKDTELYTIKDGEAIVLSSIPFNANWLNQQYAEIIQAILFDVVGYEVKPHFITTEELANYSNNETATPKETTKPSTETTEDNHVLGREQFNAHNTFDTFVIGPGNRFPHAASLAVAEAPAKAYNPLFIYGGVGLGKTHLMHAIGHHVLDNNPDAKVIYTSSEKFTNEFIKSIRDNEGEAFRERYRNIDVLLIDDIQFIQNKVQTQEEFFYTFNELHQNNKQIVISSDRPPKEIAQLEDRLRSRFEWGLIVDITPPDYETRMAILQKKIEEEKLDIPPEALNYIANQIQSNIRELEGALTRLLAYSQLLGKPITTELTAEALKDIIQAPKSKKITIQDIQKIVGQYYNVRIEDFSAKKRTKSIAYPRQIAMYLSRELTDFSLPKIGEEFGGRDHTTVIHAHEKISKDLKEDPIFKQEVENLEKEIRNV

SEQ ID NO: 4089 - DNA, 1131 bp, Staphylococcus aureus
atgatggaattcactattaaaagagattattttattacacaattaaatgacacattaaaagctatttcaccaagaacaacattacctatattaactggtatcaaaatcgatgcgaaagaacatgaagttatattaactggttcagactctgaaatttcaatagaaatcactattcctaaaactgtagatggcgaagatattgtcaatatttcagaaacaggctcagtagtacttcctggacgattctttgttgatattataaaaaaattacctggtaaagatgttaaattatctacaaatgaacaattccagacattaattacatcaggtcattctgaatttaatttaagtggcttagatccagatcaatatcctttattacctcaagtttctagagatgacgcaattcaattgtcggtaaaagtgcttaaaaacgtgattgcacaaacaaattttgcagtgtccacctcagaaacacgcccagtactaactggtgtgaactggcttatacaagaaaatgaattaatatgcacagcgactgactcacaccgcttggctgtaagaaagttgcagttagaagatgtttctgaaaacaaaaatgtcatcattccaggtaaggctttagctgaattaaataaaattatgtctgacaatgaagaagacattgatatcttctttgcttcaaaccaagttttatttaaagttggaaatgtgaactttatttctcgattattagaaggacattatcctgatacaacacgtttattccctgaaaactatgaaattaaattaagtatagacaatggggagttttatcatgcgattgatcgtgcctctttattagcgcgtgaaggtggtaataacgttattaaattaagtacaggtgatgacgttgttgaattgtcttctacatcaccagaaattggtactgtaaaagaagaagttgatgcaaacgatgttgaaggtggtagcctgaaaatttcattcaactctaaatatatgatggatgctttaaaagcaatcgataatgatgaggttgaagttgaattcttcggtacaatgaaaccatttattctaaaaccaaaaggtgacgactcggtaacgcaattaattttaccaatcagaacttac

SEQ ID NO: 4090 - protein, 377 aa, Staphylococcus aureus
  MISC_FEATURE (1)..(377): DNA polymerase III beta
MMEFTIKRDYFITQLNDTLKAISPRTTLPILTGIKIDAKEHEVILTGSDSEISIEITIPKTVDGEDIVNISETGSVVLPGRFFVDIIKKLPGKDVKLSTNEQFQTLITSGHSEFNLSGLDPDQYPLLPQVSRDDAIQLSVKVLKNVIAQTNFAVSTSETRPVLTGVNWLIQENELICTATDSHRLAVRKLQLEDVSENKNVIIPGKALAELNKIMSDNEEDIDIFFASNQVLFKVGNVNFISRLLEGHYPDTTRLFPENYEIKLSIDNGEFYHAIDRASLLAREGGNNVIKLSTGDDVVELSSTSPEIGTVKEEVDANDVEGGSLKISFNSKYMMDALKAIDNDEVEVEFFGTMKPFILKPKGDDSVTQLILPIRTY

SEQ ID NO: 4091 - DNA, 243 bp, Staphylococcus aureus
gtgattattttggttcaagaagttgtagtagaaggagacattaatttaggtcaatttctaaaaacagaagggattattgaatctggtggtcaagcaaaatggttcttgcaagacgttgaagtattaattaatggagtgcgtgaaacacgtcgcggtaaaaagttagaacatcaagatcgtatagatatcccagaattacctgaagatgctggttctttcttaatcattcatcaaggtgaacaa

SEQ ID NO: 4092 - protein, 81 aa, Staphylococcus aureus
  MISC_FEATURE (1)..(81): conserved hypothetical
VIILVQEVVVEGDINLGQFLKTEGIIESGGQAKWFLQDVEVLINGVRETRRGKKLEHQDRIDIPELPEDAGSFLIIHQGEQ

SEQ ID NO: 4093 - DNA, 1110 bp, Staphylococcus aureus
atgaagttaaatacactccaattagaaaattatcgtaactatgatgaggttacgttgaaatgtcatcctgacgtgaatatcctcattggagaaaatgcacaaggaaagacaaatttacttgaatcaatttataccttagctttagcaaaaagtcatagaacgagtaatgataaggaactcatacgttttaatgctgattatgctaaaatagaaggtgagcttagttatagacacggcacgatgccattaacaatgtttataactaaaaaaggtaaacaagtcaaagtgaatcacttagagcaaagtcgtctaactcaatatattggacacctcaatgtggttctatttgcgccagaagatttgaatattgtaaaaggctctcctcaaataagacgacgctttatagatatggagttgggccaaatttctgctgtttacttaaatgatttagctcaataccaacgtattttaaagcaaaagaataattacttaaagcagttacaattaggccaaaaaaaggacttaacaatgttggaagtattaaatcagcagtttgctgaatatgcaatgaaagtaactgataaacgtgcacattttattcaagagctagagtcgttagctaaaccgattcatgctggtatcacaaatgataaagaagcgttgtcgctgaattatttacctagtcttaaatttgattatgctcaaaatgaagcggcacgacttgaagaaattatgtctattcttagcgataatatgcaaagagaaaaagaacgaggcattagcttattcggaccacatcgagatgatataagttttgatgtgaatggcatggatgctcaaacatatggttctcaaggacagcaacgtacaacggctttgtccattaaattagctgaaattgagttaatgaatatcgaagttggggaatatcccatcttattattagacgatgtactcagtgaattagatgattcgcgtcaaacgcatttattaagtacgattcagcataaagtacaaacatttgtcactacgacatctgtagatggtattgatcatgaaatcatgaataacgctaaattgtatcgtattaatcaaggtgaaattataaag

SEQ ID NO: 4094 - protein, 370 aa, Staphylococcus aureus
  MISC_FEATURE (1)..(370): DNA repair and genetic
MKLNTLQLENYRNYDEVTLKCHPDVNILIGENAQGKTNLLESIYTLALAKSHRTSNDKELIRFNADYAKIEGELSYRHGTMPLTMFITKKGKQVKVNHLEQSRLTQYIGHLNVVLFAPEDLNIVKGSPQIRRRFIDMELGQISAVYLNDLAQYQRILKQKNNYLKQLQLGQKKDLTMLEVLNQQFAEYAMKVTDKRAHFIQELESLAKPIHAGITNDKEALSLNYLPSLKFDYAQNEAARLEEIMSILSDNMQREKERGISLFGPHRDDISFDVNGMDAQTYGSQGQQRTTALSIKLAEIELMNIEVGEYPILLLDDVLSELDDSRQTHLLSTIQHKVQTFVTTTSVDGIDHEIMNNAKLYRINQGEIIK

SEQ ID NO: 4095 - DNA, 1932 bp, Staphylococcus aureus
atggtgactgcattgtcagatgtaaacaacacggataattatggtgctgggcaaatacaagtattagaaggtttagaagcagtacgtaaaagaccaggtatgtatataggatcgacttcagagagaggtttgcaccatttagtgtgggaaattgtcgataatagtatcgatgaagcattagctggttatgcaaatcaaattgaagttgttattgaaaaagataactggattaaagtaacggataacggacgtggtatcccagttgatattcaagaaaaaatgggacgtccagctgtcgaagttattttaactgttttacatgctggtggtaaatttggcggtggcggatacaaagtatctggtggtttacatggtgttggttcatcagttgtaaacgcattgtcacaagacttagaagtatatgtacacagaaatgagactatatatcatcaagcatataaaaaaggtgtacctcaatttgacttaaaagaagttggcacaactgataagacaggtactgtcattcgttttaaagcagatggagaaatcttcacagagacaactgtatacaactatgaaacattacagcagcgtattagagagcttgctttcttaaacaaaggaattcaaatcacattaagagatgaacgtgatgaagaaaacgttagagaagactcctatcactatgagggcggtattaaatcgtacgttgagttattgaacgaaaataaagaacctattcatgatgagccaatttatattcatcaatctaaagatgatattgaagtagaaattgcgattcaatataactcaggatatgccacaaatcttttaacttacgcaaataacattcatacgtatgaaggtggtacgcatgaagacggattcaaacgtgcattaacgcgtgtcttaaatagttatggtttaagtagcaagattatgaaagaagaaaaagatagactttctggtgaagatacacgtgaaggtatgacagcaattatatctatcaaacatggtgatcctcaattcgaaggtcaaacgaagacaaaattaggtaattctgaagtgcgtcaagttgtagataaattattctcagagcactttgaacgatttttatatgaaaatccacaagtcgcacgtacagtggttgaaaaaggtattatggcggcacgtgcacgtgttgctgcgaaaaaagcgcgtgaagtaacacgtcgtaaatcagcgttagatgtagcaagccttccaggtaaattagccgattgctctagtaaaagtcctgaagaatgtgagattttcttagtcgaaggggactctgccggggggtctacaaaatctggtcgtgactctagaacgcaggcgattttaccattacgaggtaagatattaaatgttgaaaaagcacgattagatagaattttgaataacaatgaaattcgtcaaatgatcacagcatttggtacaggaatcggtggcgactttgatctagcgaaagcaagatatcacaaaatcgtcattatgactgatgccgatgtggatggagcgcatattagaacattgttattaacattcttctatcgatttatgagaccgttaattgaagcaggctatgtgtatattgcacagccaccgttgtataaactgacacaaggtaaacaaaagtattatgtatacaatgatagggaacttgataaacttaaatctgaattgaatccaacaccaaaatggtctattgcacgatacaaaggtcttggagaaatgaatgcagatcaattatgggaaacaacaatgaaccctgagcaccgcgctcttttacaagtaaaacttgaagatgcgattgaagcggaccaaacatttgaaatgttaatgggtgacgttgtagaaaaccgtagacaatttatagaagataatgcagtttatgcaaacttagacttc

SEQ ID NO: 4096 - protein, 644 aa, Staphylococcus aureus
  MISC_FEATURE (1)..(644): DNA gyrase subunit B
MVTALSDVNNTDNYGAGQIQVLEGLEAVRKRPGMYIGSTSERGLHHLVWEIVDNSIDEALAGYANQIEVVIEKDNWIKVTDNGRGIPVDIQEKMGRPAVEVILTVLHAGGKFGGGGYKVSGGLHGVGSSVVNALSQDLEVYVHRNETIYHQAYKKGVPQFDLKEVGTTDKTGTVIRFKADGEIFTETTVYNYETLQQRIRELAFLNKGIQITLRDERDEENVREDSYHYEGGIKSYVELLNENKEPIHDEPIYIHQSKDDIEVEIAIQYNSGYATNLLTYANNIHTYEGGTHEDGFKRALTRVLNSYGLSSKIMKEEKDRLSGEDTREGMTAIISIKHGDPQFEGQTKTKLGNSEVRQVVDKLFSEHFERFLYENPQVARTVVEKGIMAARARVAAKKAREVTRRKSALDVASLPGKLADCSSKSPEECEIFLVEGDSAGGSTKSGRDSRTQAILPLRGKILNVEKARLDRILNNNEIRQMITAFGTGIGGDFDLAKARYHKIVIMTDADVDGAHIRTLLLTFFYRFMRPLIEAGYVYIAQPPLYKLTQGKQKYYVYNDRELDKLKSELNPTPKWSIARYKGLGEMNADQLWETTMNPEHRALLQVKLEDAIEADQTFEMLMGDVVENRRQFIEDNAVYANLDF

SEQ ID NO: 4097 - DNA, 2679 bp, Staphylococcus aureus
ttgaaggaggaactcttgatggctgaattacctcaatcaagaataaatgaacgaaatattaccagtgaaatgcgtgaatcatttttagattatgcgatgagtgttatcgttgctcgtgcattgccagatgttcgtgacggtttaaaaccagtacatcgtcgtatactatatggattaaatgaacaaggtatgacaccggataaatcatataaaaaatcagcacgtatcgttggtgacgtaatgggtaaatatcaccctcatggtgactcatctatttatgaagcaatggtacgtatggctcaagatttcagttatcgttatccgcttgttgatggccaaggtaactttggttcaatggatggagatggcgcagcagcaatgcgttatactgaagcgcgtatgactaaaatcacacttgaactgttacgtgatattaataaagatacaatagattttatcgataactatgatggtaatgaaagagagccgtcagtcttacctgctcgattccctaacttattagccaatggtgcatcaggtatcgcggtaggtatggcaacgaatattccaccacataacttaacagaattaatcaatggtgtacttagcttaagtaagaaccctgatatttcaattgctgagttaatggaggatattgaaggtcctgatttcccaactgctggacttattttaggtaagagtggtattagacgtgcatatgaaacaggtcgtggttcaattcaaatgcgttctcgtgcagttattgaagaacgtggaggcggacgtcaacgtattgttgtcactgaaattcctttccaagtgaataaggctcgtatgattgaaaaaattgcagagctcgttcgtgacaagaaaattgacggtatcactgatttacgtgatgaaacaagtttacgtactggtgtgcgtgtcgttattgatgtgcgtaaggatgcaaatgctagtgtcattttaaataacttatacaaacaaacacctcttcaaacatcatttggtgtgaatatgattgcacttgtaaatggtagaccgaagcttattaatttaaaagaagcgttggtacattatttagagcatcaaaagacagttgttagaagacgtacgcaatacaacttacgtaaagctaaagatcgtgcccacattttagaaggattacgtatcgcacttgaccatatcgatgaaattatttcaacgattcgtgagtcagatacagataaagttgcaatggaaagcttgcaacaacgcttcaaactttctgaaaaacaagctcaagctattttagacatgcgtttaagacgtctaacaggtttagagagagacaaaattgaagctgaatataatgagttattaaattatattagtgaattagaagcaatcttagctgatgaagaagtgttattacagttagttagagatgaattgactgaaattagagatcgtttcggtgatgatcgtcgtacagaaattcaattaggtggatttgaagacttagaggacgaagacttaattccagaagaacaaatagtaattacactaagccataataactacattaaacgtttgccggtatctacatatcgtgctcaaaaccgtggtggtcgtggtgttcaaggtatgaatacattggaagaagattttgtcagtcaattggtaactttaagtacacatgaccatgtattgttctttactaacaaaggtcgtgtatacaaacttaaaggttacgaagtgcctgagttatcaagacagtctaaaggtattcctgtagtgaatgctattgaacttgaaaatgatgaagtcattagtacaatgattgctgttaaagaccttgaaagtgaagacaacttcttagtgtttgcaactaaacgtggtgtcgttaaacgttcagcattaagtaacttctcaagaataaatagaaatggtaagattgcgatttcgttcagagaagatgatgagttaattgcagttcgcttaacaagtggtcaagaagatatcttgattggtacatcacatgcatcattaattcgattccctgaatcaacattacgtcctttaggccgtacagcaacgggtgtgaaaggtattacacttcgtgaaggtgacgaagttgtagggcttgatgtagctcatgcaaacagtgttgatgaagtattagtagttactgaaaatggttatggtaaacgtacgccagttaatgactatcgcttatcaaatcgtggtggtaaaggtattaaaacagctacgattactgagcgtaatggtaatgttgtatgtatcactacagtaactggtgaagaagatttaatgattgttactaatgcaggtgtcattattcgactagatgttgcagatatttctcaaaatggtcgtgcagcacaaggtgttcgcttaattcgcttaggtgatgatcaatttgtttcaacggttgctaaagtaaaagaagatgcagaagatgaaacgaatgaagatgagcaatctacttcaactgtatctgaagatggtactgaacaacaacgtgaagcggttgtaaatgatgaaacaccaggaaatgcaattcatactgaagtgattgattcagaagaaaatgatgaagatggacgtattgaagtaagacaagatttcatggatcgtgttgaagaagatatacaacaatcatcagatgaagaa

SEQ ID NO: 4098 - protein, 893 aa, Staphylococcus aureus
  MISC_FEATURE (1)..(893): DNA gyrase subunit A
LKEELLMAELPQSRINERNITSEMRESFLDYAMSVIVARALPDVRDGLKPVHRRILYGLNEQGMTPDKSYKKSARIVGDVMGKYHPHGDSSIYEAMVRMAQDFSYRYPLVDGQGNFGSMDGDGAAAMRYTEARMTKITLELLRDINKDTIDFIDNYDGNEREPSVLPARFPNLLANGASGIAVGMATNIPPHNLTELINGVLSLSKNPDISIAELMEDIEGPDFPTAGLILGKSGIRRAYETGRGSIQMRSRAVIEERGGGRQRIVVTEIPFQVNKARMIEKIAELVRDKKIDGITDLRDETSLRTGVRVVIDVRKDANASVILNNLYKQTPLQTSFGVNMIALVNGRPKLINLKEALVHYLEHQKTVVRRRTQYNLRKAKDRAHILEGLRIALDHIDEIISTIRESDTDKVAMESLQQRFKLSEKQAQAILDMRLRRLTGLERDKIEAEYNELLNYISELEAILADEEVLLQLVRDELTEIRDRFGDDRRTEIQLGGFEDLEDEDLIPEEQIVITLSHNNYIKRLPVSTYRAQNRGGRGVQGMNTLEEDFVSQLVTLSTHDHVLFFTNKGRVYKLKGYEVPELSRQSKGIPVVNAIELENDEVISTMIAVKDLESEDNFLVFATKRGVVKRSALSNFSRINRNGKIAISFREDDELIAVRLTSGQEDILIGTSHASLIRFPESTLRPLGRTATGVKGITLREGDEVVGLDVAHANSVDEVLVVTENGYGKRTPVNDYRLSNRGGKGIKTATITERNGNVVCITTVTGEEDLMIVTNAGVIIRLDVADISQNGRAAQGVRLIRLGDDQFVSTVAKVKEDAEDETNEDEQSTSTVSEDGTEQQREAVVNDETPGNAIHTEVIDSEENDEDGRIEVRQDFMDRVEEDIQQSSDEE

SEQ ID NO: 4099 - DNA, 855 bp, Staphylococcus aureus
ttgaataaattcggaaaaggcttttacatgggaggttatatcactatggaaacgttaaattctattaacattcctaagcgtaaagaagattcacataaaggtgattatggcaaaattttattaattggtggatctgctaacttaggtggtgccattatgttagcggctcgtgcatgtgtatttagcggtagtggtttaatcactgtagctacacatccaacaaatcattcagcattacattctcgttgcccagaagcgatggttattgatattaatgatacgaaaatgttgacgaaaatgattgaaatgactgacagtatactaattggtccaggtcttggcgttgatttcaaaggaaataatgccattacattcctactacaaaatatacaaccgcatcaaaatttaatcgtagacggcgatgcgattacaatctttagtaaactgaaaccgcaattacctacatgtcgtgtgatctttacaccacacctcaaagaatgggaacgattaagtggtattcctattgaggaacagacatatgagcgtaatcgtgaagcagttgatcgtttaggtgcaactgttgtacttaaaaaacatggtactgaaattttctttaaagatgaagactttaaattgacaatcggtagcccagcaatggcgactggtggtatgggcgatacacttgctggtatgattacaagctttgtcggtcaatttgataacttaaaagaagcggttatgagtgccacatatacacatagttttattggcgaaaaccttgcaaaagatatgtatgtggtgccaccatcaagacttatcaatgaaataccttacgcaatgaaacaattagaaagt

SEQ ID NO: 4100 - protein, 285 aa, Staphylococcus aureus
  MISC_FEATURE (1)..(285): conserved hypothetical
LNKFGKGFYMGGYITMETLNSINIPKRKEDSHKGDYGKILLIGGSANLGGAIMLAARACVFSGSGLITVATHPTNHSALHSRCPEAMVIDINDTKMLTKMIEMTDSILIGPGLGVDFKGNNAITFLLQNIQPHQNLIVDGDAITIFSKLKPQLPTCRVIFTPHLKEWERLSGIPIEEQTYERNREAVDRLGATVVLKKHGTEIFFKDEDFKLTIGSPAMATGGMGDTLAGMITSFVGQFDNLKEAVMSATYTHSFIGENLAKDMYVVPPSRLINEIPYAMKQLES

SEQ ID NO: 4101 - DNA, 678 bp, Staphylococcus aureus
ttgacgcataaaacgacggtagaaggaggaattattttgtcgcaaaatacaaatcattcatattatcatcaaaaccagcatgctcaatcaataagtaaagtgtggctttattttatgtattattggattatatttggcataggatgctatctaggtcagtttttaccattaagttggcgacaacccttgtcatttggattactgattattattttagcaacacttgtttttgaaagagcgagacggttcggtttaattatttcacatatttacgctgtagtgattggcttattgtcatacgcaacgtttaccacgtatttacaaaatttaggaccagatattttctataaaaatatcgcattagcaatttttgcatttatagcatttggtattattggttatttcttcgttggagatgcatcgagtataggcaaatatttattcgttacattaataacattaattattgcgagtctaattggtatttttcttcaaaatcctattttttacactattattaccgtcgttagtctgttgttatttctactttatactttgtatgattttaatcgtttaaaaagaggtgactattcaccaagagaaatgggatttaatctatttattaatttgttgaatattattaaggatatactttaccttgctaatatgttcagaaga

SEQ ID NO: 4102 - protein, 226 aa, Staphylococcus aureus
  MISC_FEATURE (1)..(226): conserved hypothetical
LTHKTTVEGGIILSQNTNHSYYHQNQHAQSISKVWLYFMYYWIIFGIGCYLGQFLPLSWRQPLSFGLLIIILATLVFERARRFGLIISHIYAVVIGLLSYATFTTYLQNLGPDIFYKNIALAIFAFIAFGIIGYFFVGDASSIGKYLFVTLITLIIASLIGIFLQNPIFYTIITVVSLLLFLLYTLYDFNRLKRGDYSPREMGFNLFINLLNIIKDILYLANMFRR

SEQ ID NO: 4103 - DNA, 795 bp, Staphylococcus aureus
ttgaaaaaattagcatttgcaataacagcaacatctggtgcagctgcatttttaacgcatcatgatgcacaagcttctacacaacatacagtacaatctggtgaatcattatggagtattgctcaaaaatacaacacttcagtagagagtattaaacaaaataaccaattagataacaacttggtattccctggtcaagttatctcagtaggtggaagtgatgcacaaaatacgtcaaacacttctccacaagctggttcagcatcatctcatactgtacaagctggtgaatcattaaatatcattgctagcagatatggtgtttcagttgatcaattaatggcagccaataacttacgtggttatttaattatgcctaaccaaacattacaaattcctaatggtggatcaggtggtacaacaccaacagctacaacaggtagcaatggcaatgcatcatcttttaatcaccaaaatttatacactgctggtcaatgtacatggtacgtatttgaccgtcgtgctcaagctggtagtccaattagcacatattggtcagacgctaagtattgggctggtaacgcagctaatgatggttaccaagtaaacaacacaccatcagttggttcaattatgcaaagcacacctggtccatatggtcatgttgcttatgttgaacgtgtcaatggtgatggtagtatcttgatttctgaaatgaattacacatatggtccatacaatatgaactaccgtacaattccagcttcagaagtttctagctatgcattcatccat

SEQ ID NO: 4104 - protein, 265 aa, Staphylococcus aureus
  MISC_FEATURE (1)..(265): secretory antigen SsaA
LKKLAFAITATSGAAAFLTHHDAQASTQHTVQSGESLWSIAQKYNTSVESIKQNNQLDNNLVFPGQVISVGGSDAQNTSNTSPQAGSASSHTVQAGESLNIIASRYGVSVDQLMAANNLRGYLIMPNQTLQIPNGGSGGTTPTATTGSNGNASSFNHQNLYTAGQCTWYVFDRRAQAGSPISTYWSDAKYWAGNAANDGYQVNNTPSVGSIMQSTPGPYGHVAYVERVNGDGSILISEMNYTYGPYNMNYRTIPASEVSSYAFIH

SEQ ID NO: 4105 - DNA, 1512 bp, Staphylococcus aureus
atgactttatatttagatggtgaaacactaacaattgaggatattaaatcatttttacaacaacaatcaaagattgaaattattgatgatgcgttagaacgtgtcaaaaaaagtagagcggtagttgaacgtattattgaaaatgaggaaacggtttacggtattactacaggttttgggttatttagtgatgtacgtatagacccgacgcaatataatgaattacaagtgaatctgatacgctcacatgcctgtggactaggtgagccattttcaaaagaagtagcattagtcatgatgattttacgattgaatacattattaaaaggtcattcaggtgccactttagaattagtgagacaattacaattttttataaatgaacgtattataccgataatcccacagcaaggctctctcggtgcatcaggagatttagcgccattatcacatttagcattagcattaattggtgaagggaaagtattgtacagaggggaagaaaaggatagtgacgatgtattaagagaattaaatagacaacctttgaaccttcaggctaaagaaggtttagcattgattaatggtacgcaagctatgacagctcaaggtgtcattagttatatagaagcagaagatttaggttaccaatctgaatggattgctgcattaacgcatcagtctcttaatggcattatagatgcatatcgacatgatgtgcacgcagttcgtaattttcaagaacagattaatgtggcagcgcgtatgcgtgattggttagaaggatcaacattaacgacgcgacaatcagaaatacgtgtacaagatgcatatacgttgcgttgtataccacaaatccatggcgcgagttttcaagtattcaattatgttaaacagcaattagaatttgaaatgaatgcggctaatgataatccacttatatttgaggaagcaaatgaaacgtttgttatttcaggtggtaacttccatggacaacctattgcttttgcattagatcatcttaaattaggtgtaagtgaattagcaaacgtatcggaacgtcgtctagagcgactagtaaatcctcaattaaatggtgatttaccagcatttcttagtccagagccaggattgcaaagtggcgcgatgattatgcaatatgctgctgcaagtctcgtttctgaaaataaaactttagcgcatccagcgagtgttgattctatcacttcatctgcgaaccaagaagatcacgtatctatgggaactacagctgctagacatggttatcaaattattgaaaatgcaagacgtgtgctggcaatcgaatgtgttattgcattacaagcagcagagttaaaaggtgttgaaggattatcaccaaaaacacgtcgcaagtatgatgagtttcgaagtatcgtgccatccattacacatgatcgtcaatttcataaagatattgaagcggttgcacagtatttaaagcaatcaatttatcaaacgactgcatgtcac

SEQ ID NO: 4106 - protein, 504 aa, Staphylococcus aureus
  MISC_FEATURE (1)..(504): histidine ammonia-lyase
MTLYLDGETLTIEDIKSFLQQQSKIEIIDDALERVKKSRAVVERIIENEETVYGITTGFGLFSDVRIDPTQYNELQVNLIRSHACGLGEPFSKEVALVMMILRLNTLLKGHSGATLELVRQLQFFINERIIPIIPQQGSLGASGDLAPLSHLALALIGEGKVLYRGEEKDSDDVLRELNRQPLNLQAKEGLALINGTQAMTAQGVISYIEAEDLGYQSEWIAALTHQSLNGIIDAYRHDVHAVRNFQEQINVAARMRDWLEGSTLTTRQSEIRVQDAYTLRCIPQIHGASFQVFNYVKQQLEFEMNAANDNPLIFEEANETFVISGGNFHGQPIAFALDHLKLGVSELANVSERRLERLVNPQLNGDLPAFLSPEPGLQSGAMIMQYAAASLVSENKTLAHPASVDSITSSANQEDHVSMGTTAARHGYQIIENARRVLAIECVIALQAAELKGVEGLSPKTRRKYDEFRSIVPSITHDRQFHKDIEAVAQYLKQSIYQTTACH

SEQ ID NO: 4107 - DNA, 1284 bp, Staphylococcus aureus
atgttagacattagattattcagaaatgagcctgacacagttaagagcaaaattgaattacgtggagatgatccaaaagttgtagatgaaattttagaattggatgagcaacgacgtaaattaattagtgcaacagaagaaatgaaagcacgtcgtaataaagtaagcgaagaaatcgcattaaaaaaacgtaataaagaaaatgctgatgatgtgattgctgaaatgcgcacattaggtgacgatattaaagaaaaagatagtcaattaaatgaaattgataataaaatgacaggtatcctttgtcgtattccaaatttaataagtgatgatgtacctcaaggtgaatctgatgaagataacgttgaagttaaaaagtggggtacaccacgtgagttttcatttgaacccaaagcacattgggatattgtagaagaattgaaaatggctgattttgatcgtgcagcaaaagtttcaggtgcgcgttttgtatatttaacaaatgaaggtgcgcaattagagcgtgctttaatgaactatatgattacaaaacatacaacacaacatggttatacagaaatgatggtaccacagcttgtgaacgcagatacaatgtatggtacaggtcaattacctaaatttgaagaagatttatttaaagtagaaaaagaaggattatatacaattccaactgctgaagtaccattaacgaatttctaccgtaatgaaattattcaaccaggtgtacttcctgaaaaattcactggtcaatctgcatgtttccgtagtgaagcaggatcagcaggtagagatacaagaggattaattcgtttacatcaattcgataaagtggaaatggtacgttttgaacaacctgaagattcatggaatgctttagaagaaatgacaacaaacgcagaagcaattctagaagagttaggtttaccataccgtcgtgttattttatgtacaggtgatattggatttagtgcaagcaaaacatatgatttagaagtttggttaccaagctacaatgattataaagaaattagttcatgctcaaactgtacggatttccaagcgcgtcgtgctaacatccgcttcaagcgtgacaaagcagctaaaccagaattagcacatacattaaatggtagtggtttagcagttggacgtacatttgctgctattgttgaaaattaccaaaatgaagatggaacagtaacaattccagaagcattagtaccatttatgggtggtaaaacacaaatttcaaaaccagttaaa

SEQ ID NO: 4108 - protein, 428 aa, Staphylococcus aureus
  MISC_FEATURE (1)..(428): seryl-tRNA synthetase
MLDIRLFRNEPDTVKSKIELRGDDPKVVDEILELDEQRRKLISATEEMKARRNKVSEEIALKKRNKENADDVIAEMRTLGDDIKEKDSQLNEIDNKMTGILCRIPNLISDDVPQGESDEDNVEVKKWGTPREFSFEPKAHWDIVEELKMADFDRAAKVSGARFVYLTNEGAQLERALMNYMITKHTTQHGYTEMMVPQLVNADTMYGTGQLPKFEEDLFKVEKEGLYTIPTAEVPLTNFYRNEIIQPGVLPEKFTGQSACFRSEAGSAGRDTRGLIRLHQFDKVEMVRFEQPEDSWNALEEMTTNAEAILEELGLPYRRVILCTGDIGFSASKTYDLEVWLPSYNDYKEISSCSNCTDFQARRANIRFKRDKAAKPELAHTLNGSGLAVGRTFAAIVENYQNEDGTVTIPEALVPFMGGKTQISKPVK

SEQ ID NO: 4109 - DNA, 714 bp, Staphylococcus aureus
gtggcaaaggaggtaattgagatgacaacacatttaagttttagacaaggcgtgcaagagtgtatcccaacattattgggttatgccggtgttggtatttcatttggtattgtggcttcgtctcaaaactttagtattttagaaattgtcttgttatgtcttgttatatatgccggtgctgcgcaatttattatgtgcgcgttgtttatagcaggtacacctatatcagcgattgtactaactgtatttatcgtaaattcaagaatgttccttttaagtatgtcgcttgcaccaaacttcaagacatatgggttttggaaccgtgttggattaggttcattagtaactgacgaaacgtttggcgtcgccattacaccttatttaaaaggagaagctatcaatgatcgttggatgcatggtcttaacatcacagcatatttattttgggcaatttcatgtgtagctggggctttatttggcgaatatatctcaaatccgcaaacgctagggttagattttgctatcacggctatgtttatctttttggccattgcgcaatttgaatcaattactaaatcgcgattaagaatttacatagtactcattattgccgtcatagtaatgatgttatcgctaagtatgtttatgccttcatatctagcaatattaattgcagccacaatttcagcagcgttaggagtgatgatggaacaa

SEQ ID NO: 4110 - protein, 238 aa, Staphylococcus aureus
  MISC_FEATURE (1)..(238): hypothetical protein
VAKEVIEMTTHLSFRQGVQECIPTLLGYAGVGISFGIVASSQNFSILEIVLLCLVIYAGAAQFIMCALFIAGTPISAIVLTVFIVNSRMFLLSMSLAPNFKTYGFWNRVGLGSLVTDETFGVAITPYLKGEAINDRWMHGLNITAYLFWAISCVAGALFGEYISNPQTLGLDFAITAMFIFLAIAQFESITKSRLRIYIVLIIAVIVMMLSLSMFMPSYLAILIAATISAALGVMMEQ

SEQ ID NO: 4111 - DNA, 327 bp, Staphylococcus aureus
atgataactcatatgaacatgttaatacttattttattgtgtggtatcgtaacgctattaattcgaattataccttttatcatgatttcaaaagtgcaattgcctgatgtcgtggttcgatggctatcatttatcccaatcacactatttacggcacttgtcattgacagcattattcaacagacgcctcatggtgaggggtatacattaaacatcccttacattatcgcgctcattccgacggttattttatctataatcacgcgtagtttaactattacaattattagtgggattgttatcatggcagcattacgatttttcttt

SEQ ID NO: 4112 - protein, 109 aa, Staphylococcus aureus
  MISC_FEATURE (1)..(109): Conserved hypothetical
MITHMNMLILILLCGIVTLLIRIIPFIMISKVQLPDVVVRWLSFIPITLFTALVIDSIIQQTPHGEGYTLNIPYIIALIPTVILSIITRSLTITIISGIVIMAALRFFF

SEQ ID NO: 4113 - DNA, 987 bp, Staphylococcus aureus
ttgtttaaggaggaaagaacaatgacaaattacacagtagatactttaaatttaggggaatttattacagaatctggggaagtcatagataacttgcgtttgagatatgagcatgtcggttatcatggacaaccattagttgtagtttgtcatgcattaactggcaatcatttaacatatggaacagatgattatccgggttggtggcgagaaattattgatgggggatatatacccattcacgattatcaatttttaacatttgatgttattggtagtcctttcggttcaagttcacctttaaacgaccctcattttcctaaaaaattaacattaagagatatagtcagagcgaatgaacgaggtatacaagcccttggttatgataagattaatattttaatagggggaagtcttggaggtatgcaagcaatggaactactctacaatcaacagtttgaagtagataaagccattatccttgctgcaacaagtcgaacatcatcttatagtagagctttcaatgaaattgcaaggcaagccattcatcttggtggtaaggaaggtctaagtattgcacgccaattaggttttttgacatatcgatcatcaaaaagttatgatgaacgttttacgccggatgaagtagtcgcataccaacaacatcaaggtaataaatttaaagaacattttgatttgaattgttatctgacactgctagatgtattggatagtcacaacattgaccgaggtcgcacagacgtaacgcatgtttttaaaaatttagaaacaaaagtgttaacgatggggttcatagatgatttgctatatccggatgatcaagttcgtgcattaggtgaacgttttaaatatcatcgtcatttcttcgtgcctgataatgttgggcatgatggattcctactaaactttagtacctgggcacctaacttatatcatttcttaaatttaaagcattttaagcgtaag

SEQ ID NO: 4114 - protein, 329 aa, Staphylococcus aureus
  MISC_FEATURE (1)..(329): hypothetical protein
LFKEERTMTNYTVDTLNLGEFITESGEVIDNLRLRYEHVGYHGQPLVVVCHALTGNHLTYGTDDYPGWWREIIDGGYIPIHDYQFLTFDVIGSPFGSSSPLNDPHFPKKLTLRDIVRANERGIQALGYDKINILIGGSLGGMQAMELLYNQQFEVDKAIILAATSRTSSYSRAFNEIARQAIHLGGKEGLSIARQLGFLTYRSSKSYDERFTPDEVVAYQQHQGNKFKEHFDLNCYLTLLDVLDSHNIDRGRTDVTHVFKNLETKVLTMGFIDDLLYPDDQVRALGERFKYHRHFFVPDNVGHDGFLLNFSTWAPNLYHFLNLKHFKRK

SEQ ID NO: 4115 - DNA, 984 bp, Staphylococcus aureus
ttgttaattttcattaaagaggttaaaataatagctatagttaaaaatatgggagtggcttatgtgttttcaaaaatacaacctaaagcaacaataattgcaacgattgcgttggtatttgtcgctttagctttatatctagtgcctggtttaggactaatatttgcattatttgcaaccataccaggtatcgttttatggaataaatcaatacaatctttcgggattagtgcacttattacagtaattataacaactgttttaggtaatactttcgttttaagtgccatcatattagtcttaattgcaagtttaattattggtcaattgctcaaagaaagaacgtctaaagaaagaatattatacgtaacaacagtagcgatgagcttaatttcattaatcgcttttatgttactacaaacattcggaaggattccaccatcagcgagcatagtaaaacctttcaagcaaacattacatgaagcgattacgatgagcggtgccgatgcgaatatgacccaaatattagaagaagggtttagacaagcgaccgttcaattaccaggtttcatcattatcattacatttttaatcgtcttaattaacttaatcgttacatttccgattttacgaaaatttaaaatcgctacacctgtatttaagccacttttcgcgtggcaaatgagcggtattttattatggatatacattattgttatcatatgtttattatttacaggtcaaccgagtgtgttccagagcattcttttaaacttccaacttgtgttatcattagtaatgtatattcaaggtttaagtgttattcatttctttggtaaagcgaaaggtttgccgaatgcagtaacgattttactattggttatcggtacaatactgacacctacgacacatattgtaggactacttggtgttatcgatttaagtttgaatttgaagcgaatcatgaaaaataattctaaaaag

SEQ ID NO: 4116 - protein, 328 aa, Staphylococcus aureus
  MISC_FEATURE (1)..(328): conserved hypothetical
LLIFIKEVKIIAIVKNMGVAYVFSKIQPKATIIATIALVFVALALYLVPGLGLIFALFATIPGIVLWNKSIQSFGISALITVIITTVLGNTFVLSAIILVLIASLIIGQLLKERTSKERILYVTTVAMSLISLIAFMLLQTFGRIPPSASIVKPFKQTLHEAITMSGADANMTQILEEGFRQATVQLPGFIIIITFLIVLINLIVTFPILRKFKIATPVFKPLFAWQMSGILLWIYIIVIICLLFTGQPSVFQSILLNFQLVLSLVMYIQGLSVIHFFGKAKGLPNAVTILLLVIGTILTPTTHIVGLLGVIDLSLNLKRIMKNNSKK

SEQ ID NO: 4117 - DNA, 1983 bp, Staphylococcus aureus
gtgaatagaggtggaataatgaatcggcagtccactaagaaagctttactaataccatttgtcatcatgatcatcacagcaattgttttaatgggtgtatggtttatctttaatagtcttatagcactaattgcatctatcgttcttgtcgtgatgattattgttagcatcattttattcagacaagctttaatgaaaatggatagttatgtagatggtttgagtgctcaaatttcaacaacaaataataaagcaatcaaacatttaccaattggtatcattgttttagatgaaaatgatcacatcgaatgggttaaccaatttatgacagatcatatggaagcgaatgtcatttctgaatctgtaaatgaagtatttccaaacattttaaagcaattagatagagtgaaatccgttgaaatagaatataatcagtatcatttccaagtacgttattctgagaatgatcactgcctctatttctttgatataactgaacaagtacaaacaaatgaactatatgaaaattctaaaccaatcattgcgacattatttttagataactacgatgagattacgcaaaatatgaatgatacgcagcgttcggaaatcaactcaatggtaacgcgtgtcattagtcgatgggcaactgagtataatatatttttcaaaagatacagttccgatcaattcgtagcctatttaaatcaaaaaatattagctgacttagaagaatctaaatttgatatcttgagtcaattacgtgaaaaaagtgttggttatcgtgcccaattaacattaagtatcggtgttggtgaaggtactgaaaatttaatcgacttaggtgaattatcacaatcaggcctagacttagcattaggacgcggtggcgaccaagttgcaattaaaagtattaatggtaatgtgcgtttctatggcggtaagactgacccgatggagaaacgtactcgtgtaagagcacgtgtgatctcacatgcgttaaaagatatccttgcagagggtgacaaagtcattatcatgggacataaacgtcctgacttagatgcaattggtgcagcaatcggtgtgtctagatttgcaatgatgaataatttagaagcatacatcgtattaaatgagactgacattgatccaacattacgacgcgtgatgaacgaaatagataaaaagccagagttaagagagcgatttattacatcagatgatgcttgggatatgatgacatctaagacaaccgtagtgattgttgatacgcataaaccggaactggttttagatgaaaatgtcttaaataaagcaaaccgtaaagttgttatcgatcatcatagacgtggtgaaagcttcatctctaatccattgttgatatatatggaaccatacgcaagttcgacagctgaattggtaacagagttactggaatatcaaccaacagaacaacgtttaacacgtcttgaatcaacagtgatgtatgcaggtattattgtagatacaagaaactttacattacgaacaggatcaagaacattcgatgcagcgagttatttacgtgcacatggtgcagatacgattttaacgcaacatttcttaaaagatgatgtggatacttacattaatcgatctgaattaattcgaactgtaaaagttgaagataatggcatagccattgcgcatggttcagacgataaaatttatcatccagtaacagttgcacaagcagcagatgaactgttaagtttagaaggtattgaagcatcatatgttgttgcgagacgtgaagataatctgattggtatatctgcgcgttcactcggttcagtaaatgtccagttaacaatggaagcacttggtggcggtggacatttaaccaatgcggcaacacaacttaaaggtgtgacagtcgaagaggcgatagcacaattacaacaagcaattacagaacaattaagtaggagtgaagatgca

SEQ ID NO: 4118 - protein, 661 aa, Staphylococcus aureus
  MISC_FEATURE (1)..(661): conserved hypothetical
VNRGGIMNRQSTKKALLIPFVIMIITAIVLMGVWFIFNSLIALIASIVLVVMIIVSIILFRQALMKMDSYVDGLSAQISTTNNKAIKHLPIGIIVLDENDHIEWVNQFMTDHMEANVISESVNEVFPNILKQLDRVKSVEIEYNQYHFQVRYSENDHCLYFFDITEQVQTNELYENSKPIIATLFLDNYDEITQNMNDTQRSEINSMVTRVISRWATEYNIFFKRYSSDQFVAYLNQKILADLEESKFDILSQLREKSVGYRAQLTLSIGVGEGTENLIDLGELSQSGLDLALGRGGDQVAIKSINGNVRFYGGKTDPMEKRTRVRARVISHALKDILAEGDKVIIMGHKRPDLDAIGAAIGVSRFAMMNNLEAYIVLNETDIDPTLRRVMNEIDKKPELRERFITSDDAWDMMTSKTTVVIVDTHKPELVLDENVLNKANRKVVIDHHRRGESFISNPLLIYMEPYASSTAELVTELLEYQPTEQRLTRLESTVMYAGIIVDTRNFTLRTGSRTFDAASYLRAHGADTILTQHFLKDDVDTYINRSELIRTVKVEDNGIAIAHGSDDKIYHPVTVAQAADELLSLEGIEASYVVARREDNLIGISARSLGSVNVQLTMEALGGGGHLTNAATQLKGVTVEEAIAQLQQAITEQLSRSEDA

SEQ ID NO: 4119 - DNA, 450 bp, Staphylococcus aureus
atgaaagtaatttttacacaagatgttaaaggtaaaggtaaaggtaaaaaaggtgaagttaaagaagtaccagtaggttatgcaaataacttcttattgaaaaagaattatgctgtagaagcaacaccaggtaaccttaaacaattagagttacagaaaaaacgtgcaaaacaagaacgccaacaagaaattgaagatgctaaagcattaaaagaaacgttatcaaacattgaagttgaagtatcagcaaaaactggtgaaggtggtaaattgtttgggtcagtaagtacaaaacaaattgccgaagcactaaaagcacaacatgatattaaaattgataaacgtaaaatggatttaccaaatggaattcattccctaggatatacgaatgtacctgttaaattagataaagaagttgaaggtacaattcgcgtacacacagttgaacaa

SEQ ID NO: 4120 - protein, 150 aa, Staphylococcus aureus
  MISC_FEATURE (1)..(150): 50S ribosomal protein L9
MKVIFTQDVKGKGKGKKGEVKEVPVGYANNFLLKKNYAVEATPGNLKQLELQKKRAKQERQQEIEDAKALKETLSNIEVEVSAKTGEGGKLFGSVSTKQIAEALKAQHDIKIDKRKMDLPNGIHSLGYTNVPVKLDKEVEGTIRVHTVEQ

SEQ ID NO: 4121 - DNA, 1398 bp, Staphylococcus aureus
atggatagaatgtatgagcaaaatcaaatgccgcataacaatgaagctgaacagtctgtcttaggttcaattattatagatccagaattgattaatactactcaggaagttttgcttcctgagtcgttttataggggtgcccatcaacatattttccgtgcaatgatgcacttaaatgaagataataaagaaattgatgttgtaacattgatggatcaattatcgacggaaggtacgttgaatgaagcgggtggcccgcaatatcttgcagagttatctacaaatgtaccaacgacgcgaaatgttcagtattatactgatatcgtttctaagcatgcattaaaacgtagattgattcaaactgcagatagtattgccaatgatggatataatgatgaacttgaactagatgcgattttaagtgatgcagaacgtcgaattttagagctatcatcttctcgtgaaagcgatggctttaaagacattcgagacgtcttaggacaagtgtatgaaacagctgaagagcttgatcaaaatagtggtcaaacaccaggtatacctacaggatatcgagatttagaccaaatgacagcagggttcaaccgaaatgatttaattatccttgcagcgcgtccatctgtaggtaagactgcgttcgcacttaatattgcacaaaaagttgcaacgcatgaagatatgtatacagttggtattttctcgctagagatgggtgctgatcagttagccacacgtatgatttgtagttctggaaatgttgactcaaaccgcttaagaacgggtactatgactgaggaagattggagtcgttttactatagcggtaggtaaattatcacgtacgaagatttttattgatgatacaccgggtattcgaattaatgatttacgttctaaatgtcgtcgattaaagcaagaacatggcttagacatgattgtgattgactacttacagttgattcaaggtagtggttcacgtgcgtccgataacagacaacaggaagtttctgaaatctctcgtacattaaaagcattagcccgtgaattaaaatgtccagttatcgcattaagtcagttatctcgtggtgttgaacaacgacaagataaacgtccaatgatgagtgatattcgtgaatctggttcgattgagcaagatgccgatatcgttgcattcttataccgtgatgattactataaccgtggcggcgatgaagatgatgacgatgatggtggtttcgagccacaaacgaatgatgaaaacggtgaaattgaaattatcattgctaagcaacgtaacggtccaacaggcacagttaagttacattttatgaaacaatataataaatttaccgatatcgattatgcacatgcagatatgatg

SEQ ID NO: 4122 - protein, 466 aa, Staphylococcus aureus
  MISC_FEATURE (1)..(466): replicative DNA helicase
MDRMYEQNQMPHNNEAEQSVLGSIIIDPELINTTQEVLLPESFYRGAHQHIFRAMMHLNEDNKEIDVVTLMDQLSTEGTLNEAGGPQYLAELSTNVPTTRNVQYYTDIVSKHALKRRLIQTADSIANDGYNDELELDAILSDAERRILELSSSRESDGFKDIRDVLGQVYETAEELDQNSGQTPGIPTGYRDLDQMTAGFNRNDLIILAARPSVGKTAFALNIAQKVATHEDMYTVGIFSLEMGADQLATRMICSSGNVDSNRLRTGTMTEEDWSRFTIAVGKLSRTKIFIDDTPGIRINDLRSKCRRLKQEHGLDMIVIDYLQLIQGSGSRASDNRQQEVSEISRTLKALARELKCPVIALSQLSRGVEQRQDKRPMMSDIRESGSIEQDADIVAFLYRDDYYNRGGDEDDDDDGGFEPQTNDENGEIEIIIAKQRNGPTGTVKLHFMKQYNKFTDIDYAHADMM

SEQ ID NO: 4123 - DNA, 1281 bp, Staphylococcus aureus
atgtcatcaatcgtagtagttgggacacaatggggagacgaaggaaaaggaaaaataacggatttcttggcagaacagtcagatgttatcgcgcgtttttcaggtggtaataatgcaggccataccattcaatttggcggagaaacatataaattacatttagtaccatctggtatcttttacaaagacaaattagcggtaatcggtaacggagtcgttgttgatccagttgcactattgaaagaattagacggattaaatgaacgtggcattcctacaagtaatttacgtatatctaatcgtgcgcaagtgattttaccatatcacttagcacaagatgaatatgaagaacgtttacgtggtgacaataagattggtacaactaaaaaaggtatcggtccagcatatgtagacaaagttcaacgtatcggtattcgtatggcagatttacttgaaaaagaaacattcgaaagattattaaaatcaaacattgaatataaacaagcatatttcaaaggtatgtttaacgaaacatgtccatcatttgatgatatctttgaagaatattatgcagcaggtcaacgtctaaaagaatttgtaacagacacatcaaaaatcttagacgatgcatttgtagcagatgaaaaggtacttttcgaaggtgcgcaaggtgtaatgttagatatcgaccatggtacatatccattcgttacatcaagtaatccaattgcaggtaacgttactgttggtacaggtgtaggtcctacattcgtttcaaaggtaattggtgtatgtaaagcttatacatcacgtgttggtgatggtccattccctactgaattattcgatgaagatggacatcatattagagaggttggtcgtgaatacggtacaacaacaggacgtccacgtcgtgtaggttggtttgattcagttgtattacgtcactctcgtcgtgtaagtggtattacagatttatctattaactcaatcgatgttttaacaggcctagacacagtgaaaatctgtacagcttatgaattagacggtaaagaaattactgagtacccagcaaacttagatcaattaaaacgttgtaaaccaatctttgaagagttaccaggttggacagaagacgtaacaaatgtgcgtactttagaagaattacctgaaaatgcacgtaaatatttagagcgtatttcagaattatgtaatgtacaaatttctatcttctcagttggtccagatagagaacaaacaaacctattaaaagaattgtgg

SEQ ID NO: 4124 - protein, 427 aa, Staphylococcus aureus
  MISC_FEATURE (1)..(427): adenylosuccinate synthase
MSSIVVVGTQWGDEGKGKITDFLAEQSDVIARFSGGNNAGHTIQFGGETYKLHLVPSGIFYKDKLAVIGNGVVVDPVALLKELDGLNERGIPTSNLRISNRAQVILPYHLAQDEYEERLRGDNKIGTTKKGIGPAYVDKVQRIGIRMADLLEKETFERLLKSNIEYKQAYFKGMFNETCPSFDDIFEEYYAAGQRLKEFVTDTSKILDDAFVADEKVLFEGAQGVMLDIDHGTYPFVTSSNPIAGNVTVGTGVGPTFVSKVIGVCKAYTSRVGDGPFPTELFDEDGHHIREVGREYGTTTGRPRRVGWFDSVVLRHSRRVSGITDLSINSIDVLTGLDTVKICTAYELDGKEITEYPANLDQLKRCKPIFEELPGWTEDVTNVRTLEELPENARKYLERISELCNVQISIFSVGPDREQTNLLKELW

SEQ ID NO: 4125 - DNA, 705 bp, Staphylococcus aureus
atgcaaatggctagaaaagttgttgtagttgatgatgaaaaaccgattgctgatattttagaatttaacttaaaaaaagaaggatacgatgtgtactgtgcatacgatggtaatgatgcagtcgacttaatttatgaagaagaaccagacatcgtattactagatatcatgttacctggtcgtgatggtatggaagtatgtcgtgaagtgcgcaaaaaatacgaaatgccaataataatgcttactgctaaagattcagaaattgataaagtgcttggtttagaactaggtgcagatgactatgtaacgaaaccgtttagtacgcgtgaattaatcgcacgtgtgaaagcgaacttacgtcgtcattactcacaaccagcacaagacactggaaatgtaacgaatgaaatcacaattaaagatattgtgatttatccagacgcatattctattaaaaaacgtggcgaagatattgaattaacacatcgtgaatttgaattgttccattatttatcaaaacatatgggacaagtaatgacacgtgaacatttattacaaacagtatggggctatgattactttggcgatgtacgtacggtcgatgtaacgattcgtcgtttacgtgaaaagattgaagatgatccgtcacatcctgaatatattgtgacgcgtagaggcgttggatatttcctccaacaacatgag

SEQ ID NO: 4126 - protein, 235 aa, Staphylococcus aureus
  MISC_FEATURE (1)..(235): response regulator
MQMARKVVVVDDEKPIADILEFNLKKEGYDVYCAYDGNDAVDLIYEEEPDIVLLDIMLPGRDGMEVCREVRKKYEMPIIMLTAKDSEIDKVLGLELGADDYVTKPFSTRELIARVKANLRRHYSQPAQDTGNVTNEITIKDIVIYPDAYSIKKRGEDIELTHREFELFHYLSKHMGQVMTREHLLQTVWGYDYFGDVRTVDVTIRRLREKIEDDPSHPEYIVTRRGVGYFLQQHE

SEQ ID NO: 4127 - DNA, 1824 bp, Staphylococcus aureus
atgaagtggctaaaacaactacaatcccttcatactaaacttgtaattgtttatgtattactgattatcattggtatgcaaattatcgggttatattttacaaataaccttgaaaaagagctgcttgataattttaagaagaatattacgcagtacgcgaaacaattagaaattagtattgaaaaagtatatgacgaaaagggctccgtaaatgcacaaaaagatattcaaaatttattaagtgagtatgccaaccgtcaagaaattggagaaattcgttttatagataaagaccaaattattattgcgacgacgaagcagtctaaccgtagtctaatcaatcaaaaagcgaatgatagttctgtccaaaaagcactatcactaggacaatcaaacgatcatttaattttaaaagattatggcggtggtaaggaccgtgtctgggtatataatatcccagttaaagtcgataaaaaggtaattggtaatatttatatcgaatcaaaaattaatgacgtttataaccaattaaataatataaatcaaatattcattgttggtacagctatttcattattaatcacagtcatcctaggattctttatagcgcgaacgattaccaaaccaatcaccgatatgcgtaaccagacggtcgaaatgtccagaggtaactatacgcaacgtgtgaagatttatggtaatgatgaaattggcgaattagctttagcatttaataacttgtctaaacgtgtacaagaagcgcaggctaatactgaaagtgagaaacgtagactggactcagttatcacccatatgagtgatggtattattgcaacagaccgccgtggacgtattcgtatcgtcaatgatatggcactcaagatgcttggtatggcgaaagaagacatcatcggatattacatgttaagtgtattaagtcttgaagatgaatttaaactggaagaaattcaagagaataatgatagtttcttattagatttaaatgaagaagaaggtctaatcgcacgtgttaactttagtacgattgtgcaggaaacaggatttgtaactggttatatcgctgtgttacatgacgtaactgaacaacaacaagttgaacgtgagcgtcgtgaatttgttgccaatgtatcacatgagttacgtacacctttaacttctatgaatagttacattgaagcacttgaagaaggtgcatggaaagatgaggaacttgcgccacaatttttatctgttacccgtgaagaaacagaacgaatgattcgactggtcaatgacttgctacagttatctaaaatggataatgagtctgatcaaatcaacaaagaaattatcgactttaacatgttcattaataaaattattaatcgacatgaaatgtctgcgaaagatacaacatttattcgagatattccgaaaaagacgattttcacagaatttgatcctgataaaatgacgcaagtatttgataatgtcattacaaatgcgatgaaatattctagaggcgataaacgtgtcgagttccacgtgaaacaaaatccactttataatcgaatgacgattcgtattaaagataatggcattggtattcctatcaataaagtcgataagatattcgaccgattctatcgtgtagataaggcacgtacgcgtaaaatgggtggtactggattaggactagccatttcgaaagagattgtggaagcgcacaatggtcgtatttgggcaaacagtgtagaaggtcaaggtacatctatctttatcacacttccatgtgaagtcattgaagacggtgattgggatgaa

SEQ ID NO: 4128 - protein, 608 aa, Staphylococcus aureus
  MISC_FEATURE (1)..(608): two-component sensor
MKWLKQLQSLHTKLVIVYVLLIIIGMQIIGLYFTNNLEKELLDNFKKNITQYAKQLEISIEKVYDEKGSVNAQKDIQNLLSEYANRQEIGEIRFIDKDQIIIATTKQSNRSLINQKANDSSVQKALSLGQSNDHLILKDYGGGKDRVWVYNIPVKVDKKVIGNIYIESKINDVYNQLNNINQIFIVGTAISLLITVILGFFIARTITKPITDMRNQTVEMSRGNYTQRVKIYGNDEIGELALAFNNLSKRVQEAQANTESEKRRLDSVITHMSDGIIATDRRGRIRIVNDMALKMLGMAKEDIIGYYMLSVLSLEDEFKLEEIQENNDSFLLDLNEEEGLIARVNFSTIVQETGFVTGYIAVLHDVTEQQQVERERREFVANVSHELRTPLTSMNSYIEALEEGAWKDEELAPQFLSVTREETERMIRLVNDLLQLSKMDNESDQINKEIIDFNMFINKIINRHEMSAKDTTFIRDIPKKTIFTEFDPDKMTQVFDNVITNAMKYSRGDKRVEFHVKQNPLYNRMTIRIKDNGIGIPINKVDKIFDRFYRVDKARTRKMGGTGLGLAISKEIVEAHNGRIWANSVEGQGTSIFITLPCEVIEDGDWDE

SEQ ID NO: 4129 - DNA, 1341 bp, Staphylococcus aureus
gtgattgggatgaataataaggagcatattaaatctgtcattttagcactactcgtcttgatgagtgtcgtattgacatatatggtatggaacttttctcctgatattgcaaatgtcgacaatacagatagtaagaagagtgaaacgaaacctttaacgacacctatgacagccaaaatggatacaactattacgccatttcagattattcattcgaaaaatgatcatccagaaggaacgattgcgacggtatctaatgtgaataaactgacgaaacctttgaaaaataaagaagtgaagtccgtggaacatgttcgtcgtgatcataacttgatgattcctgatttgaacagtgattttatattattcgattttacgtatgatttaccgttatcaacatatcttggtcaagtactgaacatgaatgcgaaagtaccaaatcatttcaatttcaatcgtttggtcatagatcatgatgctgatgataatatcgtgctttatgctataagcaaagatcgccacgattacgtaaaattaacaactacaacgaaaaatgatcattttttagatgcattagcagcagtgaaaaaagatatgcaaccatacacagatatcatcacaaacaaagatacaattgatcgtacgacgcatgtttttgcaccaagtaaacctgaaaagttaaaaacatatcgcatggtatttaacacgattagtgttgagaaaatgaatgctatactatttgacgattcaaccatcgttcgtagttcaaagagtggtgttacaacctacaacaataatacaggtgtcgcaaactataacgataaaaatgaaaaatatcattataaaaacctgtccgaagatgaagcgagttccagcaaaatggaagaaacgattccaggaacctttgattttattaatggtcatggtggtttcttaaacgaagactttagattgtttagtacgaataatcagtcaggcgagttaacatatcaacgtttccttaatggttatccaacgtttaataaagaaggttctaatcaaattcaagtcacttggggtgaaaaaggcgtctttgactatcgtcgttcgttattacgcaccgacgttgttttaaatagtgaggataataaatcgttgccgaaattagagtctgtacgttcaagcttagcgaacaatagtgatattaattttgaaaaagtaacaaacatcgctatcggttacgaaatgcaggataattcagatcataatcacattgaagtgcagattaacagtgaactcgtaccgcgttggtatgtagaatatgatggcgaatggtatgtttataacgatgggaggcttgaa

SEQ ID NO: 4130 - protein, 447 aa, Staphylococcus aureus
  MISC_FEATURE (1)..(447): conserved hypothetical
VIGMNNKEHIKSVILALLVLMSVVLTYMVWNFSPDIANVDNTDSKKSETKPLTTPMTAKMDTTITPFQIIHSKNDHPEGTIATVSNVNKLTKPLKNKEVKSVEHVRRDHNLMIPDLNSDFILFDFTYDLPLSTYLGQVLNMNAKVPNHFNFNRLVIDHDADDNIVLYAISKDRHDYVKLTTTTKNDHFLDALAAVKKDMQPYTDIITNKDTIDRTTHVFAPSKPEKLKTYRMVFNTISVEKMNAILFDDSTIVRSSKSGVTTYNNNTGVANYNDKNEKYHYKNLSEDEASSSKMEETIPGTFDFINGHGGFLNEDFRLFSTNNQSGELTYQRFLNGYPTFNKEGSNQIQVTWGEKGVFDYRRSLLRTDVVLNSEDNKSLPKLESVRSSLANNSDINFEKVTNIAIGYEMQDNSDHNHIEVQINSELVPRWYVEYDGEWYVYNDGRLE

SEQ ID NO: 4131 - DNA, 786 bp, Staphylococcus aureus
atgaactggaaactgacaaagacacttttcattttcgtgtttattcttgtcaacatcgtgttagtatcgatttatgttaataaagtcaatcgctcacacattaatgaagtcgagagtaacaatgaagttaattttcagcaagaagaaattaaagtaccgactagtatattgaataaatcagttaaaggtataaaattagagcaaattacagggcgatcaaaagactttagttctaaagctaaaggcgattcggatttgaccacatcagatggtggaaaattattgaatgcgaacattagtcaatcggtaaaggtcagtgacaataacttaaaagatttgaaagattatgttaacaagcgcgtatttaaaggtgctgaatatcaattaagcgagattagttcagattctgtaaaatatgaacaaacgtatgatgattttccgattttaaataacagtaaagcgatgttaaactttaatatagaagataacaaagcgactagttataaacaatcaatgatggatgacattaagcccacagatggtgcagataagaagcatcaagtgattggtgtgagaaaagcaatcgaggcattatattataatcgttacttgaaaaaaggtgatgaagtcattaatgctagactcggttactactcagtcgtgaatgaaacgaatgttcaattgttacaaccaaactgggaaattaaagtgaagcatgacggtaaggataaaacgaatacttactatgtcgaagcgacaaataataaccctaaaattattaatcat

SEQ ID NO: 4132 - protein, 262 aa, Staphylococcus aureus
  MISC_FEATURE (1)..(262): conserved hypothetical
MNWKLTKTLFIFVFILVNIVLVSIYVNKVNRSHINEVESNNEVNFQQEEIKVPTSILNKSVKGIKLEQITGRSKDFSSKAKGDSDLTTSDGGKLLNANISQSVKVSDNNLKDLKDYVNKRVFKGAEYQLSEISSDSVKYEQTYDDFPILNNSKAMLNFNIEDNKATSYKQSMMDDIKPTDGADKKHQVIGVRKAIEALYYNRYLKKGDEVINARLGYYSVVNETNVQLLQPNWEIKVKHDGKDKTNTYYVEATNNNPKIINH

SEQ ID NO: 4133 - DNA, 798 bp, Staphylococcus aureus
atgagccgcttgatacgcatgagtgtattagcaagtggtagtacaggtaacgccacttttgtagaaaatgaaaaaggtagtctattagttgatgttggtttgactggaaagaaaatggaagaattgtttagtcaaattgaccgtaatattcaagatttaaatggtattttagtaacccatgaacatattgatcatattaaaggattaggtgttttggcgcgtaaatatcaattgccaatttatgcgaatgaaaaaacttggcaggcaattgaaaagaaagatagtcgcatccctatggatcagaaattcatttttaatccttatgaaacaaaatctattgcaggtttcgatgttgaatcgtttaacgtgtcacatgatgcaatagatccgcaattttatattttccataataactataagaagtttacgattttaacggatacgggttacgtgtctgatcgtatgaaaggtatgatacgtggcagcgatgcgtttatttttgagagtaatcatgacgtcgatatgttgagaatgtgtcgttatccatggaagacgaaacaacgtattttaggcgatatgggtcatgtatctaatgaggatgcggctcatgcaatgacagacgtgattacaggtaacacgaaacgtatttacctatcgcatttatcacaagacaataacatgaaagatttggcgcgtatgagtgttggccaagtattgaacgaacacgatattgatacggaaaaagaagtattgctatgtgatacggataaagctattccaacgccaatatatacaata

SEQ ID NO: 4134 - protein, 266 aa, Staphylococcus aureus
  MISC_FEATURE (1)..(266): conserved hypothetical
MSRLIRMSVLASGSTGNATFVENEKGSLLVDVGLTGKKMEELFSQIDRNIQDLNGILVTHEHIDHIKGLGVLARKYQLPIYANEKTWQAIEKKDSRIPMDQKFIFNPYETKSIAGFDVESFNVSHDAIDPQFYIFHNNYKKFTILTDTGYVSDRMKGMIRGSDAFIFESNHDVDMLRMCRYPWKTKQRILGDMGHVSNEDAAHAMTDVITGNTKRIYLSHLSQDNNMKDLARMSVGQVLNEHDIDTEKEVLLCDTDKAIPTPIYTI

SEQ ID NO: 4135 - DNA, 1005 bp, Staphylococcus aureus
atgtcatatataatcatcgtcactatagctgtagttattttctcgctgatatttgactttatcaatggattccatgatacagccaatgcagtagctactgctgtatctactagagcgttaacgcctaaaacggcaattttaatggcagcagtgatgaactttataggtgctttaacatttacgggcgttgcaggcaccattactaaagacattgtcgatccatttaaattggaaaatggattagttgttgtgttagctgcaatacttgcggctattatttggaatttagctacttggttttacggaattccaagttcgtcttcacatgcacttataggttcaattgcgggtgcagcaatcgcatctgaaggctcatttggagtgttacattaccaaggtttcacaaaaattattattgtattaatcgtttcaccgattatcgcattttgtgttggtttcttgatgtattcaatttttaaagttatctttaaaaatgcaaatttaacaagagcgaatcgtaactttagatttttccaaattttcacagcagcgttacaatcattctctcacggtacgaatgatgcgcaaaaatcaatgggtattattacgttggcattgattgtcgctaatgtacagaatgatggcagtgttgaaccacagttatgggtaaaatttgcctgtgcgacagcaatggggcttggtactgcaattggtggctggaaaattatcaaaactgtaggtggtaatattatgaaaatacgtccagcaaatggtgctgcggccgatttatcatctgcattaacaatttttgttgcatcatcgctacatttcccattatcaacaactcacgttgtgtcatcatcaatcttaggtgttggtgcttctaaccgagctaaaggtgtaaaatggagcactgcgcaacgaatgatcattacatgggtgattacattacctatttcagcattgttagcaggtttactattctatatacttaacttatttttc

SEQ ID NO: 4136 - protein, 335 aa, Staphylococcus aureus
  MISC_FEATURE (1)..(335): hypothetical protein
MSYIIIVTIAVVIFSLIFDFINGFHDTANAVATAVSTRALTPKTAILMAAVMNFIGALTFTGVAGTITKDIVDPFKLENGLVVVLAAILAAIIWNLATWFYGIPSSSSHALIGSIAGAAIASEGSFGVLHYQGFTKIIIVLIVSPIIAFCVGFLMYSIFKVIFKNANLTRANRNFRFFQIFTAALQSFSHGTNDAQKSMGIITLALIVANVQNDGSVEPQLWVKFACATAMGLGTAIGGWKIIKTVGGNIMKIRPANGAAADLSSALTIFVASSLHFPLSTTHVVSSSILGVGASNRAKGVKWSTAQRMIITWVITLPISALLAGLLFYILNLFF

SEQ ID NO: 4137 - DNA, 615 bp, Staphylococcus aureus
atgtttagtaagaaaaaagataagtttatggttcaattagaagagatggttttcaatctggatcgtgctgctattgaattcggtaaaatggatttcaatacacatttagatttaaaagcatactcagacaacattaaaacttatgagtcacatggtgacgaattagtacatcaagtaattactgatttaaatcaaacatttatcacaccaattgaacgtgaagatattttatcattatgtgatgcaattgatgatgttttagatgcaattgaagaaacggcagctatgtttgaaatgtattcaatcgaatacacagatgaatatatggctgagtttgttgataacattcaaaaagcagttgcagaaatgaaacttgctgtcggcttattagtcgataaaaaattatcacatatgcgtattcattcaattaatattaaagaatttgaaacaaactgtgatggtattttaagacagtcaattaaacatattttcaatagcgaaacagatccaatcactttaattaaaataaaagatatttatgaaagcatggaagaaatcgctgataaatgtcaaatcgtagcaaataattttgaaactattattatgaaaaatagc

SEQ ID NO: 4138 - protein, 205 aa, Staphylococcus aureus
  MISC_FEATURE (1)..(205): conserved hypothetical
MFSKKKDKFMVQLEEMVFNLDRAAIEFGKMDFNTHLDLKAYSDNIKTYESHGDELVHQVITDLNQTFITPIEREDILSLCDAIDDVLDAIEETAAMFEMYSIEYTDEYMAEFVDNIQKAVAEMKLAVGLLVDKKLSHMRIHSINIKEFETNCDGILRQSIKHIFNSETDPITLIKIKDIYESMEEIADKCQIVANNFETIIMKNS

SEQ ID NO: 4139 - DNA, 1899 bp, Staphylococcus aureus
gtggcgttaattatgacctttaacgagataatatttaaaaatttccgtcaaaatttatcacattatgccatctatcttttttcgttaattacgagtgtagtattgtattttagctttgtagcattaaaatacgctcataaactaaacatgacagagtcatatccaattataaaggaaggctcacaagtcggaagctactttctatttttcatcataattgcatttttgttatatgccaatgtgttatttattaaacgacgaagttatgagcttgcattatatcaaacattaggtttatctaaattcaacattatttatatactaatgctcgaacaattactaatatttataattacggcaatattaggtattattattggtatttttggttcgaaactgttattaatgattgtctttacattattaggaattaaagaaaaggttccaattatttttagtttgagggcggtatttgaaacattaatgttaatcggtgtcgcttattttttaacatctgctcaaaattttatattagtgttcaaacaatctatttcacagatgtcaaagaataaccaggttaaagaaacaaatcataataaaattacatttgaagaggttgttttaggcatcttaggtatagtattgattaccacaggatactatctatctttgaacattgttcaatattatgattctatcggtacacttatgtttattttattgtcaactgtgattggggcatacttattttttaaaagctctgtttctctagtttttaaaatggtgaagaagtttagaaaaggtgttataagtgtaaatgatgtcatgttctcatcatctattatgtatcgtattaagaaaaatgctttttcacttacggtcatggcaatcatttcagcgattactgtttcagttctttgctttgctgctataagtagagcgtccttatcaagtgaaataaaatatactgcaccacacgacgttacaattaaagaccaacaaaaagctaatcaattagcaagtgaattaaacaatcaaaaaattcctcatttttataattataaagaagtaattcatacgaaattgtataaagataatttatttgatgtaaaagcgaaagaaccatacaatgtaacaattactagtgataaatacatccctaatactgatttgaaacgtgggcaagctgatttatttgtagcggaaggttctatcaaagatttagtgaaacataagaagcatggtaaggcaattataggaacgaaaaaacatcatgttaatattaagttacgtaaagatattaataaaatctattttatgacagatgttgatttaggtggaccaacgtttgtcttaaatgacaaagactatcaagaaataagaaagtatacaaaggcaaagcatatcgtctctcaatttggattcgatttgaaacataaaaaagatgctttagcattagaaaaagcgaaaaataaagttgataaatctattgaaacaagaagtgaagcgataagctcaatatcaagtttaaccggaatattattatttgtaacatcatttttaggtattacattcttgattgctgtatgttgcattatatacataaagcaaatagatgaaaccgaagatgagttagagaattatagtattttgagaaagcttggatttacacaaaaagatatggcaaggggactaaagtttaaaattatgtttaattttgggttacctttagttattgcactatcacatgcatattttacatcattagcatatatgaaattaatgggtacaacgaatcaaataccggttttcatagtaatgggattatacatttgtatgtatgctgtttttgcagtgacggcttataatcattccaagcgaacaattagacattccata

SEQ ID NO: 4140 - protein, 633 aa, Staphylococcus aureus
  MISC_FEATURE (1)..(633): ABC transporter permease
VALIMTFNEIIFKNFRQNLSHYAIYLFSLITSVVLYFSFVALKYAHKLNMTESYPIIKEGSQVGSYFLFFIIIAFLLYANVLFIKRRSYELALYQTLGLSKFNIIYILMLEQLLIFIITAILGIIIGIFGSKLLLMIVFTLLGIKEKVPIIFSLRAVFETLMLIGVAYFLTSAQNFILVFKQSISQMSKNNQVKETNHNKITFEEVVLGILGIVLITTGYYLSLNIVQYYDSIGTLMFILLSTVIGAYLFFKSSVSLVFKMVKKFRKGVISVNDVMFSSSIMYRIKKNAFSLTVMAIISAITVSVLCFAAISRASLSSEIKYTAPHDVTIKDQQKANQLASELNNQKIPHFYNYKEVIHTKLYKDNLFDVKAKEPYNVTITSDKYIPNTDLKRGQADLFVAEGSIKDLVKHKKHGKAIIGTKKHHVNIKLRKDINKIYFMTDVDLGGPTFVLNDKDYQEIRKYTKAKHIVSQFGFDLKHKKDALALEKAKNKVDKSIETRSEAISSISSLTGILLFVTSFLGITFLIAVCCIIYIKQIDETEDELENYSILRKLGFTQKDMARGLKFKIMFNFGLPLVIALSHAYFTSLAYMKLMGTTNQIPVFIVMGLYICMYAVFAVTAYNHSKRTIRHSI

SEQ ID NO: 4141 - DNA, 822 bp, Staphylococcus aureus
ttgaagatacaagtgccaaagcctaaaggaaatgaagttaagataaattataggagtgttaaagtggcaattttagaagtaaaacaattaacaaaaatatatggaactaaaaaaatggcacaagaagtgttgcgagatatcaatatgtctattgaagaaggcgagtttattgctattatgggtccctctggatctgggaaaacgacattattaaatgttttaagttcaattgattatatttcacaaggttctattacattaaaaggaaaaaaattagaaaagctttcaaacaaggaattatctgatatacgcaagcatgatattggttttatttttcaagagtataatttactgcatacattgactgttaaagaaaacataatgttaccactaacggtacagaagttagataaagaacatatgttaaatcgttatgaaaaagtagcagaagcattaaatatattggatattagtgataaatatccctctgaattgtctggtggacaaaggcaacgaacatcagctgccagagcatttataacattgccttctattatatttgctgacgaaccaacaggtgcactggattctaaaagtactcaagatttattaaaacgattaacaagaatgaatgaagcatttaagtctacaattattatggtaacgcatgatcctgttgcagcaagctatgcaaatcgagtagtgatgctaaaagatggtcaaattttcactgaattataccaaggggatgacgataaacatacctttttcaaagaaataatacgtgtacaaagtgttttaggtggcgttaattatgacctt

SEQ ID NO: 4142 - protein, 274 aa, Staphylococcus aureus
  MISC_FEATURE (1)..(274): ABC transporter ATP-binding
LKIQVPKPKGNEVKINYRSVKVAILEVKQLTKIYGTKKMAQEVLRDINMSIEEGEFIAIMGPSGSGKTTLLNVLSSIDYISQGSITLKGKKLEKLSNKELSDIRKHDIGFIFQEYNLLHTLTVKENIMLPLTVQKLDKEHMLNRYEKVAEALNILDISDKYPSELSGGQRQRTSAARAFITLPSIIFADEPTGALDSKSTQDLLKRLTRMNEAFKSTIIMVTHDPVAASYANRVVMLKDGQIFTELYQGDDDKHTFFKEIIRVQSVLGGVNYDL

SEQ ID NO: 4143 - DNA, 1038 bp, Staphylococcus aureus
atgaataatttgaaatgggtagcttattttttgaaatctcgcatgaactggatattttggatattgtttttaaacttccttatgttaggcattagtctaatcgattatgattttccaatagacagtttattttatattgtttctttgaatttaagtttaacaatgatttttcttttattgacatattttaaagaagtaaaattatataagcattttgacaaagataaagaaatagaagaaattaaacataaagatttagcggaaacgccatttcaacgtcatacagttgattatttatatcgtcaaatctcagcgcacaaagaaaaggttgttgagcaacagttgcaattgaacatgcatgaacaaaccattacagaatttgtgcacgacataaaaacacctgtgacagctatgaaattattaattgatcaagaaaaaaatcaagaaagaaaacaagcattactatatgaatggtctcgtataaactcgatgctagatacacagctgtatattactagattagaatctcaacgtaaagatatgtattttgattacgtgtcacttaaacgcatggtcattgatgaaatacaattaacaagacatattagtcaggttaaaggtattggttttgatgttgactttaaagtggatgattatgtttatacagatataaaatggtgtcgtatgattattagacaaattttgtcaaacgcattgaaatatagtgagaattttaatattgaaattgggacagaattaaatgatcaacatgtttcgttatatattaaagactatggcagaggtattagtaaaaaagatatgccgcgaatatttgaacgaggatttacgtcaacggctaacagaaatgaaacgacgtcttcaggtatgggtctatatttagtaaatagtgtaaaggatcaattaggtattcacctgcaagtcacgtcgactgttggtaaggggacaactgtcagattgattttcccattacaaaatgaaattgttgaacgcatgtcggaagtgacaaatttgtcattt

SEQ ID NO: 4144 - protein, 346 aa, Staphylococcus aureus
  MISC_FEATURE (1)..(346): hypothetical protein
MNNLKWVAYFLKSRMNWIFWILFLNFLMLGISLIDYDFPIDSLFYIVSLNLSLTMIFLLLTYFKEVKLYKHFDKDKEIEEIKHKDLAETPFQRHTVDYLYRQISAHKEKVVEQQLQLNMHEQTITEFVHDIKTPVTAMKLLIDQEKNQERKQALLYEWSRINSMLDTQLYITRLESQRKDMYFDYVSLKRMVIDEIQLTRHISQVKGIGFDVDFKVDDYVYTDIKWCRMIIRQILSNALKYSENFNIEIGTELNDQHVSLYIKDYGRGISKKDMPRIFERGFTSTANRNETTSSGMGLYLVNSVKDQLGIHLQVTSTVGKGTTVRLIFPLQNEIVERMSEVTNLSF

SEQ ID NO: 4145 - DNA, 681 bp, Staphylococcus aureus
gtgatatggatgcaaatactactagtagaagatgacaatactttgtttcaagaattgaaaaaagaattagaacaatgggattttaatgttgctggtattgaagatttcggcaaagtaatggatacatttgaaagttttaatcctgaaattgttatattggatgttcaattacctaaatatgatgggttttattggtgcagaaaaatgagagaagtttccaacgtaccaatattatttttatcatctcgtgataatccaatggatcaagtgatgagtatggaacttggcgcagatgattatatgcaaaaaccgttctataccaatgtattaattgctaaattacaagcgatttatcgtcgtgtctatgagtttacagctgaagaaaaacgtacattgacttggcaagatgctgtcgttgatctatcaaaagatagtatacaaaaaggtgatcagacgattttcctgtccaaaacagaaatgattatattagaaattcttattaccaaaaaaaatcaaatcgtttcgagagatacaattatcactgcattatgggatgatgaagcatttgttagtgataatacgttaacagtaaatgtgaatcgtttacgaaaaaaattatctgaaattagtatggatagtgcaatcgaaacaaaagtaggaaaaggatatatggctcatgaa

SEQ ID NO: 4146 - protein, 227 aa, Staphylococcus aureus
  MISC_FEATURE (1)..(227): hypothetical protein
VIWMQILLVEDDNTLFQELKKELEQWDFNVAGIEDFGKVMDTFESFNPEIVILDVQLPKYDGFYWCRKMREVSNVPILFLSSRDNPMDQVMSMELGADDYMQKPFYTNVLIAKLQAIYRRVYEFTAEEKRTLTWQDAVVDLSKDSIQKGDQTIFLSKTEMIILEILITKKNQIVSRDTIITALWDDEAFVSDNTLTVNVNRLRKKLSEISMDSAIETKVGKGYMAHE

SEQ ID NO: 4147 - DNA, 273 bp, Staphylococcus aureus
atggaagcaagagatattcttaagcgccccgtaatcactgagaaatcttctgaagcaatggctgaagacaaatacactttcgacgttgatactcgtgttaacaaaacacaagtaaaaatggcagttgaagaaatcttcaacgtaaaagttgcaagtgttaatatcatgaattacaaacctaagaaaaaacgtatgggccgttaccaaggctatacaaacaaaagaagaaaagcgattgtaactcttaaagaaggatcaatcgacttatttaac

SEQ ID NO: 4148 - protein, 91 aa, Staphylococcus aureus
  MISC_FEATURE (1)..(91): 50S ribosomal protein L23
MEARDILKRPVITEKSSEAMAEDKYTFDVDTRVNKTQVKMAVEEIFNVKVASVNIMNYKPKKKRMGRYQGYTNKRRKAIVTLKEGSIDLFN

SEQ ID NO: 4149 - DNA, 282 bp, Staphylococcus aureus
atgactttcgaagaaaaattaagtgaaatgtatagcgagattgcgaataagattagcagcatgataccggtagagtgggaaaaggtatatgcaatggcatatatagatgacggaggaggagaagtgttctactattacacagaacctggaagtaatgaattatactactatactagtgtattaaataaatatgatatatcggaatcggaatttatggattcagtgtatgagttgtataaacaatttcaaaatttaaggaatttatttataagaagaaggaca

SEQ ID NO: 4150 - protein, 94 aa, Staphylococcus aureus
  MISC_FEATURE (1)..(94): conserved hypothetical
MTFEEKLSEMYSEIANKISSMIPVEWEKVYAMAYIDDGGGEVFYYYTEPGSNELYYYTSVLNKYDISESEFMDSVYELYKQFQNLRNLFIRRRT

SEQ ID NO: 4151 - DNA, 921 bp, Staphylococcus aureus
atgaaacctaaagttttattagcaggtggaacaggatatattggtaagtatttaagtgaagtgattgaaaatgatgctgaactttttgctatatcaaaatatccagacaataaaaaaacagatgatgttgaaatgacttggattcagtgtgatatatttcattacgaacaggttgttgcagcaatgaatcaaatagatattgctgtattctttatcgacccaacaaagaattctgccaaaataacacaatcatcagcaagagatttaacattaatcgcagcagataattttggtcgagcagcggctatcaatcaagtaaaaaaagtaatctacatacctgggagtcgttatgataatgaaacaattgaacgcctaggtgcatatggtacacctgtagaaacaacaaatttagtttttaaacgttctttagttaatgtagaattacaagtttcaaagtatgatgatgttagatcaacgatgaaggtagttttaccaaagggatggacattaaagaacgttgtaaaccattttattgcatggatgggttacactaaaggaacttttgtgaaaacagaaaaatcacatgatcaatttaagatatatattaagaataaggtgcgaccgctcgcagtatttaaaatagaagaaacagctgatggaataataactttaattttattgagtggaagtttagtgaaaaaatatacagttaatcaagggaagttagaatttagattaatcaaagagtcggcagtcgtttatatacatctatacgattatatccctcgattattttggccgatttattactttatacaagcaccaatgcaaaaaatgatgattcatggctttgaagttgactgccggattaaagattttcaaagtcgattaaaatcaggagaaaatatgaaatatactaaa

SEQ ID NO: 4152 - protein, 307 aa, Staphylococcus aureus
  MISC_FEATURE (1)..(307): hypothetical protein
MKPKVLLAGGTGYIGKYLSEVIENDAELFAISKYPDNKKTDDVEMTWIQCDIFHYEQVVAAMNQIDIAVFFIDPTKNSAKITQSSARDLTLIAADNFGRAAAINQVKKVIYIPGSRYDNETIERLGAYGTPVETTNLVFKRSLVNVELQVSKYDDVRSTMKVVLPKGWTLKNVVNHFIAWMGYTKGTFVKTEKSHDQFKIYIKNKVRPLAVFKIEETADGIITLILLSGSLVKKYTVNQGKLEFRLIKESAVVYIHLYDYIPRLFWPIYYFIQAPMQKMMIHGFEVDCRIKDFQSRLKSGENMKYTK

SEQ ID NO: 4153 - DNA, 504 bp, Staphylococcus aureus
atggcccatattatacgtagagttagtatcaaagatgtagaaaatttcatttcaatgttagcgaacatatacgacgaatctccgtatatgttctacacaccaggagaatatgatcctagcgtcacatcggctagtaaacaattagaagaatatatcacttctccgcataaagtcatcttcgttgctgaaagtgatgaacaactcgttggctttgcctttgttaatacgacaccatttcaacgcattaaacatgttgctaaaattgatttaggtgtaaagaaattatatcaacatcgtggaattggccaagcacttcttgatgccattatggcttggtgtttaaacaatcaaatacaccgaattgaagcaaatgtaccactcaataaccaacctgccctcgagctttttaaaagtgccgattttcaaatcgaaggcgttttaaaagataagttatttatcgatggtaaatattatgatgactatatgatggctaaaattcttaat

SEQ ID NO: 4154 - protein, 168 aa, Staphylococcus aureus
  MISC_FEATURE (1)..(168): conserved hypothetical
MAHIIRRVSIKDVENFISMLANIYDESPYMFYTPGEYDPSVTSASKQLEEYITSPHKVIFVAESDEQLVGFAFVNTTPFQRIKHVAKIDLGVKKLYQHRGIGQALLDAIMAWCLNNQIHRIEANVPLNNQPALELFKSADFQIEGVLKDKLFIDGKYYDDYMMAKILN

SEQ ID NO: 4155 - DNA, 426 bp, Staphylococcus aureus
atgacaaggtcagcattaaaaccatttaaaaataaacgcgttatggttactggacgtatacaacgtgttttgtttaaaaattatttagatagacatagcacatttaagccgaatgtaaggatattattaaaagatgtatttgtttcaggtgtatcaatagatcatttatggttatatgagacaaataaatactatgcattggcaatggaacttattcatcaacgagtaaaatttagtgcgaatgttgtaccgtattacaaaataaatagaaataataatttattcgtacaagattatggaattaagcgtaaaggtaggttaattactgaagaagcttacaatcaaaacaatcagtatcaggataagatatatgaaaaattaccggatatagattttagactcgaagatttttatagtaaggaaaac

SEQ ID NO: 4156 - protein, 142 aa, Staphylococcus aureus
  MISC_FEATURE (1)..(142): hypothetical protein
MTRSALKPFKNKRVMVTGRIQRVLFKNYLDRHSTFKPNVRILLKDVFVSGVSIDHLWLYETNKYYALAMELIHQRVKFSANVVPYYKINRNNNLFVQDYGIKRKGRLITEEAYNQNNQYQDKIYEKLPDIDFRLEDFYSKEN

SEQ ID NO: 4157 - DNA, 1041 bp, Staphylococcus aureus
atgaataaagataataaatggacgatgataactgcgctttttataactgtaatcagtgtattgttagcatttcatctgaaacaacattatgaccaaattacaaatgagaaccatgctaataaagacaaaattaatattaaaaataaaaatgtgcgcatttatcaaaaccttacatacaatagagttttccctaacagtaaattagatattattacacctgttgatatgtcttctaatgccaaactgccagttattttttggatgcacggtggtggttatattgcgggtgataagcagtataaaaacccattattagcgaaaattgctgaacaagggtacattgttgtgaatgtaaattatgcattggcgccacaatataaatatcccacaccattaattcaaatgaatcaagcaactcaattcattaaagaaaataaaatgaatttacctattgattttaatcaagtaattattggcggtgattctgcaggtgctcaattagctagccaatttacggcaatacagacgaatgatcgcttaagagaagccatgaaatttgatcagtcattcaaaccatcgcaaattaaaggtgctatactatttggtggtttttataatatgcaaacagttagagaaactgagtttccaagaatacagttatttatgaaaagttatactggcgaagaagattgggaaaagagttttaaaaacatttcacaaatgtcgacagtaaaacaatcgacaaaaaattatccaccaacatttttatctgttggagatagcgatccattcgaaagtcaaaatatagaattcagtaagaaattacaagaattgaatgtaccagtagatactttgttttatgatggtacgcatcatttacatcatcagtatcaatttcaccttaataaacctgaatcgatagataatatcaaaaaagtgttacttttcttaagtcgtaatacatcctctagtggtattcaaactgaagagaaaccacaaatagaaaatccgagtaatgaattaccgttaaatcctttaaac

SEQ ID NO: 4158 - protein, 347 aa, Staphylococcus aureus
  MISC_FEATURE (1)..(347): hypothetical protein
MNKDNKWTMITALFITVISVLLAFHLKQHYDQITNENHANKDKINIKNKNVRIYQNLTYNRVFPNSKLDIITPVDMSSNAKLPVIFWMHGGGYIAGDKQYKNPLLAKIAEQGYIVVNVNYALAPQYKYPTPLIQMNQATQFIKENKMNLPIDFNQVIIGGDSAGAQLASQFTAIQTNDRLREAMKFDQSFKPSQIKGAILFGGFYNMQTVRETEFPRIQLFMKSYTGEEDWEKSFKNISQMSTVKQSTKNYPPTFLSVGDSDPFESQNIEFSKKLQELNVPVDTLFYDGTHHLHHQYQFHLNKPESIDNIKKVLLFLSRNTSSSGIQTEEKPQIENPSNELPLNPLN

SEQ ID NO: 4159 - DNA, 1065 bp, Staphylococcus aureus
atgatgatgaataaagaagcaacaaaaattggatttgcctacgtcggcattgtagtgggcgcaggattttcaactggacaagaagttatgcaatttttcactaaatatggcttgtgggcttatttaggtgttattatatctggttttattttagcttttattgggcgccaagtagcaaaaattggtactgcctttgaagcgacaaatcatgaatcaacattacaatacgtattcggtgaaaagtttagtaaagtctttgattatattttaatcttcttcttatttggtatagctgtaaccatgatagctggtgcaggcgcaacatttgaagaaagttataacatacctacatggctaggtgctttaattatgacattagcgatttatattacgttgctattagactttaataaaatagtacgtgcactaggtatcgttacaccatttttaattgttttagttgtattaatcgctggcgtttatttatttaaaggtcatgtttcattagcagaagttaaccaagtagtgcctgaagcaagtatttggaagggaatctggtttggtacaatatatggtggattagctttttctgtaggttttagtaccatcgtagcaatcggtggggatactgaaaagcgtacagtgtcaggtgcaggcgcgatgtatggtggtattatctatactgtattactagcattgatcaactttgcattgcaaagtgaatatccaactattaaaaatgcctcaattcctacattgacgttagcaaataatatccatcctttaatagcaacagtgttatctgttattatgctggcggttatgtataatactattctaggactaatgtattcatttgcagcacgttttacagaaccatacagtaaaaattatcatatctttattattataatgatggtagcaggttatttattaagtttcgtaggatttgctgaattaattaataagttatatacaattatgggatatgtaggcttatttattgtagtagctgtaattattaaatatttcaaacgtaaaaatgcggataaaaaacatattgct

SEQ ID NO: 4160 - protein, 355 aa, Staphylococcus aureus
  MISC_FEATURE (1)..(355): conserved hypothetical
MMMNKEATKIGFAYVGIVVGAGFSTGQEVMQFFTKYGLWAYLGVIISGFILAFIGRQVAKIGTAFEATNHESTLQYVFGEKFSKVFDYILIFFLFGIAVTMIAGAGATFEESYNIPTWLGALIMTLAIYITLLLDFNKIVRALGIVTPFLIVLVVLIAGVYLFKGHVSLAEVNQVVPEASIWKGIWFGTIYGGLAFSVGFSTIVAIGGDTEKRTVSGAGAMYGGIIYTVLLALINFALQSEYPTIKNASIPTLTLANNIHPLIATVLSVIMLAVMYNTILGLMYSFAARFTEPYSKNYHIFIIIMMVAGYLLSFVGFAELINKLYTIMGYVGLFIVVAVIIKYFKRKNADKKHIA

SEQ ID NO: 4161 - DNA, 495 bp, Staphylococcus aureus
atgcaacaccttataaaaaaacatgtattgaatggcgagtttgatttagtacgacaattgatgtccgaaacagattttatggaatttgaagaagcatatatttcaagtgcgcatgaagtagaaagtatgatgttttatacatgtattttagatatgattaagtacgaagaatcatctgaaatgcatgacttagcatttttattgcttgtgtatccactaagtgaatatgaaggtgctttggattctgcttattatcatgcagacgcttccataaaacttactgacggcaaagaagttaaaagtttgttacaaatgttattattgcatgcgataccaacacctgttatttcagataagaaggcttttgatatcgccaagcaaattttaaaattagatcctaataataatgttgctcgtaacgtcttaaaagacactgccaaacgtatggacaacgttgttgttgatataaatgaattacaccaacgtaatgcacgt

SEQ ID NO: 4162 - protein, 165 aa, Staphylococcus aureus
  MISC_FEATURE (1)..(165): hypothetical protein
MQHLIKKHVLNGEFDLVRQLMSETDFMEFEEAYISSAHEVESMMFYTCILDMIKYEESSEMHDLAFLLLVYPLSEYEGALDSAYYHADASIKLTDGKEVKSLLQMLLLHAIPTPVISDKKAFDIAKQILKLDPNNNVARNVLKDTAKRMDNVVVDINELHQRNAR

SEQ ID NO: 4163 - DNA, 375 bp, Staphylococcus aureus
ttggagatgaagataatgcctaaaattatacttgttagccacagtaaagaaattgcaagtggtacaaaatctttgttaaagcaaatggcaggtgacgttgatattataccaatcgggggattaccagatggttcaattggaacttcatttgatatcatccaagaagttttgactaaattagaggatgatgcattgtgtttttacgatattggatcttcagaaatgaatgtagatatggcaattgaaatgtatgatggtaatcatcgtgtgttaaaagttgatgcaccaattgttgaaggcagttttatcgcagcagtaaagctatcaatcggcggttcaattgatgatgcattagcagaaatcaaacaatcattt

SEQ ID NO: 4164 - protein, 125 aa, Staphylococcus aureus
  MISC_FEATURE (1)..(125): conserved hypothetical
LEMKIMPKIILVSHSKEIASGTKSLLKQMAGDVDIIPIGGLPDGSIGTSFDIIQEVLTKLEDDALCFYDIGSSEMNVDMAIEMYDGNHRVLKVDAPIVEGSFIAAVKLSIGGSIDDALAEIKQSF

SEQ ID NO: 4165 - DNA, 591 bp, Staphylococcus aureus
gtggcacaaatgaaagtgaatgatatgaaagcacgtttattaaatttagaagaaacgtttaaaaaacatgaatctgaattaactgaattagatcgagcaattggtgatggtgaccacggggttaacatggttcgtgggtttagtagtcttaaagacaaacttgatgatagctcaatgcaatcattgttcaaatcaactggtatggcattgatgtcaaatgttgggggtgcatcaggaccactgtatggctttagctttgttaaaatgtctgcagtcaccaaagatgatatggataatcaagatttcattacactaattcaggcatttgccgaagcggttgaatcacgtggtaaagttactttaaatgaaaagacaatgtatgatgtagtagcgcgagcagcagagaagcttaaaaatggtgaaactttaacattcaatgatttacagcaattagcagataatacaaaagatatggtagcaacgaaaggtagagctgcatattttggagaagaatcaaaaggttatattgatccaggtgctcaaagtatggtttatattttaaacgctttgattggagatgaagataatgcc

SEQ ID NO: 4166 - protein, 197 aa, Staphylococcus aureus
  MISC_FEATURE (1)..(197): conserved hypothetical
VAQMKVNDMKARLLNLEETFKKHESELTELDRAIGDGDHGVNMVRGFSSLKDKLDDSSMQSLFKSTGMALMSNVGGASGPLYGFSFVKMSAVTKDDMDNQDFITLIQAFAEAVESRGKVTLNEKTMYDVVARAAEKLKNGETLTFNDLQQLADNTKDMVATKGRAAYFGEESKGYIDPGAQSMVYILNALIGDEDNA

SEQ ID NO: 4167 - DNA, 966 bp, Staphylococcus aureus
atgatgaaaaagttaatcaataaaaaagaaacatttttaactgatatgcttgaaggattgttaattgcgcacccagagttagatctgattgctaatacagttattgtaaaaaaagctaagaaagaacatggtgtagcaatagtctctggaggtggaagcggacatgaacctgcgcatgccggttttgttgcagaaggtatgctagatgcagcggtttgtggcgaagtatttacatcacctacacctgataaaatattagaagctattaaagcagtagatactggtgatggtgtattactagttgtaaaaaactatgcaggtgacgtgatgaatttcgaaatggcacaagagcttgcagaaatggaaggtataaatgttcaaactgttattgttcgtgacgacattgctgtgacaaacgaagtacaacgtcgtggtgttgcaggaacagtgtttgttcataagcttgccggttatcttgctgaaaaaggttattcattaacagagataaaatcgcgtgtagaagcgttgttacctgaaattaaaagtattggtatggcaattgagccaccgcttgttccaactactggaaaatatggctttgatattgaagacgacaaaatggaaatcggtattggtatacatggtgaaaaaggtattcatagggaagaagtaaaggatattgatcatattgttggaacattgttagacgaattgtataaagaagttactgccaatgatgtcatattaatggtaaatggtatgggtggtacgccgttatctgaattaaatatcgtaactaaatatattcaacaaaatttagctgcaagaacggttaatgttgctaaatggtttgttggtgattatatgacatctttagacatgcaaggtttttctataactatcgtgcctaataaaccagaatatttggaagcatttttagcaccaacaacaagtcaatactttaaa

SEQ ID NO: 4168 - protein, 322 aa, Staphylococcus aureus
  MISC_FEATURE (1)..(322): hypothetical protein
MMKKLINKKETFLTDMLEGLLIAHPELDLIANTVIVKKAKKEHGVAIVSGGGSGHEPAHAGFVAEGMLDAAVCGEVFTSPTPDKILEAIKAVDTGDGVLLVVKNYAGDVMNFEMAQELAEMEGINVQTVIVRDDIAVTNEVQRRGVAGTVFVHKLAGYLAEKGYSLTEIKSRVEALLPEIKSIGMAIEPPLVPTTGKYGFDIEDDKMEIGIGIHGEKGIHREEVKDIDHIVGTLLDELYKEVTANDVILMVNGMGGTPLSELNIVTKYIQQNLAARTVNVAKWFVGDYMTSLDMQGFSITIVPNKPEYLEAFLAPTTSQYFK

SEQ ID NO: 4169 - DNA, 537 bp, Staphylococcus aureus
ttggaattttaccagaaacggaatatgaaattaataaagttaaagaaatcgagcaatatattaaagagcaagatgaagctgaactataggggcgataatatgactttcgaagaaaaattaagtgaaatgtatagcgagattgcgaataagattattagcatgataccggtagagtgggaaaaagtatatgcaatggcatatatcgatgaagaatgtggagaagtgttttacaattatactgaaccaagcagtgatgaattattttactatacaagtgtgataaagaagtataatttattgaaatcaagctttatggattcagtatatgagttgcatgatcaatttgaggaactaagagaagtatttatagaagaaggtcttgaaccatggacatcatgcgaatttgattttacaaaagaagataaattaaaagtttcatttgattatattgattggataaatacagagtttgatcaattaggccgtgaaaattattatatgtacaaaaaatttggtgttttaccagaaacggaatat

SEQ ID NO: 4170 - protein, 179 aa, Staphylococcus aureus
  MISC_FEATURE (1)..(179): conserved hypothetical
LEFYQKRNMKLIKLKKSSNILKSKMKLNYRGDNMTFEEKLSEMYSEIANKIISMIPVEWEKVYAMAYIDEECGEVFYNYTEPSSDELFYYTSVIKKYNLLKSSFMDSVYELHDQFEELREVFIEEGLEPWTSCEFDFTKEDKLKVSFDYIDWINTEFDQLGRENYYMYKKFGVLPETEY

SEQ ID NO: 4171 - DNA, 1014 bp, Staphylococcus aureus
atgattagttcaaataataaacgcagacaattgatagcactggctgtttttagcattctactatttctaggttgtacttggagtattacctcaggtgaatacaacatacctgttgaaagatttttcaaaactttaattggacaaggtgatgccattgatgagttaatcttattagatttcaggttacctcggatgatgattactattttggctggcgcagcgcttagtattagtggtgcaatagtgcaaagtgtcacaaaaaatccaatagctgaaccaggtatattaggtattaacgcaggtggcggatttgcaatcgcattatttattgcaattggtaaaattaatgctgacaactttgtttatgtactgccgttaataagtatactaggtggtatcaccactgcattgattatttttattttcagttttaataaaaatgaaggtgttacacctgcgagtatggtattaataggtgtaggtttacaaacagcattatatggtggctcaattacaattatgtcaaaatttgatgataagcaatctgatttcatcgctgcttggtttgcaggtaatatttggggtgacgaatggccatttgtcattgcatttttaccgtgggtgttgattattattccttacttactatttaaatcgaatacactaaatattattcatacgggtgataatattgcacgaggtctaggtgtaaggttaagcagagaacgtttaatattattctttatcgcagtgatgttatcatctgctgctgtagcagtagcaggttcaatttcgtttatcggattaatgggtccgcatattgccaaacgtatcgttggaccacgtcaccagttgtttttaccaattgccattttagtaggggcatgtttacttgttatagctgatacaattggcaaaattgtattacaaccaggtggggttccagcaggtattgtcgtagcaattattggtgcaccgtatttcttatatttaatgtacaaaacgaaaaatgta

SEQ ID NO: 4172 - protein, 338 aa, Staphylococcus aureus
  MISC_FEATURE (1)..(338): ferrichrome transport
MISSNNKRRQLIALAVFSILLFLGCTWSITSGEYNIPVERFFKTLIGQGDAIDELILLDFRLPRMMITILAGAALSISGAIVQSVTKNPIAEPGILGINAGGGFAIALFIAIGKINADNFVYVLPLISILGGITTALIIFIFSFNKNEGVTPASMVLIGVGLQTALYGGSITIMSKFDDKQSDFIAAWFAGNIWGDEWPFVIAFLPWVLIIIPYLLFKSNTLNIIHTGDNIARGLGVRLSRERLILFFIAVMLSSAAVAVAGSISFIGLMGPHIAKRIVGPRHQLFLPIAILVGACLLVIADTIGKIVLQPGGVPAGIVVAIIGAPYFLYLMYKTKNV

SEQ ID NO: 4173 - DNA, 1023 bp, Staphylococcus aureus
atgataaaaaggacaattaacatgacaaatagagagaacccaacgccattgaagtttttatcctatattataggtttaagtatgatactactaatcacactatttatttctacattaataggtgacgccaaaattcaagcctctacaattatagaggctatttttaattataatcctagcaatcaacagcaaaacatcatcaatgagattaggattcccagaaatatagcagcagtaattgtaggtatggcgcttgcagtttctggtgcgattatacaaggtgttactcgtaatggtcttgctgatccggcgctcataggtttaaattcaggtgcttcatttgctttagcattaacatatgcagttttaccaaacacttcatttttaatattgatgtttgctggatttttaggtgctattctaggaggtgctattgtattaatgataggccgatctagacgtgatggatttaatccgatgcgtattattttagcgggtgcagcagtaagtgctatgttaacagcgctaagtcaaggtattgcattagcttttagactaaatcaaacagtaacattttggactgctggaggcgtttcaggcacaacatggtcacaccttaagtgggcaattccattaattggtattgcgttattcattatattaacaattagtaaacaacttaccattttaaatcttggtgaatcattagctaaaggtttaggtcaaaatgtaacaatgatcagaggcatatgtttaattattgctatgattctagcaggtattgcagttgctatcgctggacaagttgcatttgtaggtttgatggtacctcatatagcaagatttttaattggaactgattatgctaaaattctaccattaacagccttgttaggtgggatactcgtgcttgttgccgatgtgatagcacgatatttaggagaagcgcctgttggtgcaatcatttcatttatcggtgttccttactttttatatttagttaaaaaaggaggacgctcaata

SEQ ID NO: 4174 - protein, 341 aa, Staphylococcus aureus
  MISC_FEATURE (1)..(341): ferrichrome transport
MIKRTINMTNRENPTPLKFLSYIIGLSMILLITLFISTLIGDAKIQASTIIEAIFNYNPSNQQQNIINEIRIPRNIAAVIVGMALAVSGAIIQGVTRNGLADPALIGLNSGASFALALTYAVLPNTSFLILMFAGFLGAILGGAIVLMIGRSRRDGFNPMRIILAGAAVSAMLTALSQGIALAFRLNQTVTFWTAGGVSGTTWSHLKWAIPLIGIALFIILTISKQLTILNLGESLAKGLGQNVTMIRGICLIIAMILAGIAVAIAGQVAFVGLMVPHIARFLIGTDYAKILPLTALLGGILVLVADVIARYLGEAPVGAIISFIGVPYFLYLVKKGGRSI

SEQ ID NO: 4175 - DNA, 795 bp, Staphylococcus aureus
atgaatcgtttgcatggacaacaagttaaaattggttacggggataacacgattataaataaattagatgttgaaataccagatggcaaagtgacgtcaatcattggtcctaacggctgcgggaaatctactttgctaaaggcattgtcacgtttattggcagttaaagaaggcgaagtatttttagatggtgaaaatattcatacacaatctacgaaagagattgcaaaaaaaatagccattttacctcaatcacctgaagtagcagatggcttaactgttggggaattagtttcatatggtcgttttccacatcaaaaaggatttggtagattaactgctgaggataagaaagaaattgattgggcaatggaagttacaggaactgatacattccgacaccgttcaatcaatgatttaagtggtggtcaaagacaacgtgtttggattgcaatggcattagcacaaagaactgatattatctttttagacgaaccaacaacatatttagatatctgtcatcaattagaaatactagaattagttcagaagctaaatcaggaacaaggttgtacaattgtcatggttcttcatgatatcaaccaagcgattcgtttctcagatcatcttattgcgatgaaagaaggggatatcatcgctacaggttcaacagaagacgtattaacacaggaaatattagaaaaagtttttaatattgatgttgttttaagtaaagatcctaaaactggaaaacctttactggtaacttatgacttatgtcgcagagcttattct

SEQ ID NO: 4176 - protein, 265 aa, Staphylococcus aureus
  MISC_FEATURE (1)..(265): ferrichrome transport
MNRLHGQQVKIGYGDNTIINKLDVEIPDGKVTSIIGPNGCGKSTLLKALSRLLAVKEGEVFLDGENIHTQSTKEIAKKIAILPQSPEVADGLTVGELVSYGRFPHQKGFGRLTAEDKKEIDWAMEVTGTDTFRHRSINDLSGGQRQRVWIAMALAQRTDIIFLDEPTTYLDICHQLEILELVQKLNQEQGCTIVMVLHDINQAIRFSDHLIAMKEGDIIATGSTEDVLTQEILEKVFNIDVVLSKDPKTGKPLLVTYDLCRRAYS

SEQ ID NO: 4177 - DNA, 831 bp, Staphylococcus aureus
gtgaataaaacggttaaagatttaatactagttgtcttaggttcatttatctttgctgcaggtgtaaatgcatttattatttctggtaacttaggtgaaggcggggttacaggtttagcaattattttatattatgcgtttcatatttcaccagccatcactaacttcttggtcaacgcagtattgattgccataggttataaatttttgagtaagagaagtatgtacttaactattcttgtaacaattcttatttcaatatttttgagtttaacagaatcatggcaagtagaaactggaaacagcattgtgaatgccatttttggtggtgtaagcgttggactaggaatcggagtaattatccttgcaggcggtacaacagcaggtacaacaattttggcgagaattgcaacgaaatacctcgatgtaagcacgccatatgctttgcttttcttcgatatgatcgttgttgcaatttcacttacagttattccacttgataaagtattagtaacagtaatatcactttatataggaacaaaagtgatggaatatgtcatagaaggtttaaacactaaaaaagctatgacgattatttcaactaatcccgacaaacttgccaaagcaatagacgagcaaattggaagaggtttaaccattttaaacggacatggctattatacgcgtgaagaaaaagatgtcttatacgttgttatttctaaaacacaagtttcaaaagcaaagcgattaattaaacaaatcgataaagatgcattcctcgtaattcatgatgtaagagatgtctatggtaatggctttcttgcagatgaa

SEQ ID NO: 4178 - protein, 277 aa, Staphylococcus aureus
  MISC_FEATURE (1)..(277): conserved hypothetical
VNKTVKDLILVVLGSFIFAAGVNAFIISGNLGEGGVTGLAIILYYAFHISPAITNFLVNAVLIAIGYKFLSKRSMYLTILVTILISIFLSLTESWQVETGNSIVNAIFGGVSVGLGIGVIILAGGTTAGTTILARIATKYLDVSTPYALLFFDMIVVAISLTVIPLDKVLVTVISLYIGTKVMEYVIEGLNTKKAMTIISTNPDKLAKAIDEQIGRGLTILNGHGYYTREEKDVLYVVISKTQVSKAKRLIKQIDKDAFLVIHDVRDVYGNGFLADE

SEQ ID NO: 4179 - DNA, 90 bp, Staphylococcus aureus
ttgttttgttattataaacaacacaaaggagataacttctctattgaagaagttaaaaacattatagcagacaatgaaatgaaagtaaat

SEQ ID NO: 4180 - protein, 30 aa, Staphylococcus aureus
LFCYYKQHKGDNFSIEEVKNIIADNEMKVN

SEQ ID NO: 4181 - DNA, 1227 bp, Staphylococcus aureus
atgtttttattaatcaacattattggtctaattgtatttcttggtattgcggtattattttcaagagatcgcaaaaatatccaatggcaatcaattgggatcttagttgttttaaacctgtttttagcatggttctttatttattttgattggggtcaaaaagcagtaagaggagcagccaatggtatcgcttgggtagttcagtcagcgcatgctggtacaggttttgcatttgcaagtttgacaaatgttaaaatgatggatatggctgttgcagccttattcccaatattattaatagtgccattatttgatatcttaatgtactttaatattttaccgaaaattattggaggtattggttggttactagctaaagtaacaagacaacctaaattcgagtcattctttgggatagaaatgatgttcttaggaaatactgaagcattagccgtatcaagtgagcaactaaaacgtatgaatgaaatgcgtgtattaacaatcgcaatgatgtcaatgagctctgtatcgggagctattgtaggtgcgtatgtacaaatggtaccaggagaactggtactaacggcaattccactaaatatcgttaacgcgattattgtgtcatgcttgttgaatccagtaagtgttgaagagaaagaagatattatttacagtcttaaaaacaatgaagttgaacgtcaaccattcttctcattccttggagattctgtattagcagcaggtaaattagtattaatcatcatcgcatttgttattagttttgtagcgttagctgatctatttgatcgttttatcaatttgattacaggattgatagcaggatggataggcataaaaggtagtttcggtttaaaccaaattttaggtgtgtttatgtatccatttgcgctattactcggtttaccttatgatgaagcgtggttggtagcacaacaaatggctaagaaaattgttacaaatgaatttgttgttatgggtgaaatttctaaagatattgcatcttatacaccacaccatcgtgcggttattacaacattcttaatttcatttgcaaacttctcaacgattggtatgattatcggtacattgaaaggcattgttgataaaaagacatcagactttgtatctaaatatgtacctatgatgctattatcaggtatcctagtttcattattaacagcagctttcgttggtttatttgcatgg

SEQ ID NO: 4182 - protein, 409 aa, Staphylococcus aureus
  MISC_FEATURE (1)..(409): hypothetical protein
MFLLINIIGLIVFLGIAVLFSRDRKNIQWQSIGILVVLNLFLAWFFIYFDWGQKAVRGAANGIAWVVQSAHAGTGFAFASLTNVKMMDMAVAALFPILLIVPLFDILMYFNILPKIIGGIGWLLAKVTRQPKFESFFGIEMMFLGNTEALAVSSEQLKRMNEMRVLTIAMMSMSSVSGAIVGAYVQMVPGELVLTAIPLNIVNAIIVSCLLNPVSVEEKEDIIYSLKNNEVERQPFFSFLGDSVLAAGKLVLIIIAFVISFVALADLFDRFINLITGLIAGWIGIKGSFGLNQILGVFMYPFALLLGLPYDEAWLVAQQMAKKIVTNEFVVMGEISKDIASYTPHHRAVITTFLISFANFSTIGMIIGTLKGIVDKKTSDFVSKYVPMMLLSGILVSLLTAAFVGLFAW

SEQ ID NO: 4183 - DNA, 495 bp, Staphylococcus aureus
atgggatatgttatgcaatcaatttcgatgatgagtggtacaattagagacaatattttatacggaattaatcgtcatgtttcagatgaagaacttattaattatgctaaattagcgaactgtcatgattttatcatgcaatttgatgaaggatatgacacgcttgtaggtgaacgaggattgaaactgtctggcggacaacgtcaacgtattgatattgctagaagttttgttaaaaatcctgatattttgttacttgatgaagcaacagctaatctcgatagtgaaagtgaattgaaaattcaagaagctttagaaacattgatggaaggtagaacaacgattgtcattgcgcatcgtttgtctacaattaaaaaagccggtcaaattatattcttagacaaaggacaggtaacaggtaaaggtacgcattcagaactgatggcatcacatgcgaagtataaaaactttgtagtgtctcaaaaattaacagat

SEQ ID NO: 4184 - protein, 165 aa, Staphylococcus aureus
  MISC_FEATURE (1)..(165): ATP-binding cassette
MGYVMQSISMMSGTIRDNILYGINRHVSDEELINYAKLANCHDFIMQFDEGYDTLVGERGLKLSGGQRQRIDIARSFVKNPDILLLDEATANLDSESELKIQEALETLMEGRTTIVIAHRLSTIKKAGQIIFLDKGQVTGKGTHSELMASHAKYKNFVVSQKLTD

SEQ ID NO: 4185 - DNA, 204 bp, Staphylococcus aureus
  MISC_FEATURE (1)..(204): n = g, a, t, or c
ttgcagattatgaaacaagggacagttaaatgggttaacgctgaaaagggttctgctttatcgaaggtgaaggagaaaatgacgtattcgtacatttttcagcaattaaccaanaggttacaaatcattagaagaagtcaagctgttgagtttgaagtagttgaaggcgaccgcggtccacaagctgcaaacgttgttaaacta

SEQ ID NO: 4186 - protein, 68 aa, Staphylococcus aureus
  MISC_FEATURE (1)..(68): Xaa = any amino acid
  MISC_FEATURE (1)..(68): major cold shock protein
LQIMKQGTVKWVNAEKGSALSKVKEKMTYSYIFQQLTXRLQIIRRSQAVEFEVVEGDRGPQAANVVKL

SEQ ID NO: 4187 - DNA, 309 bp, Staphylococcus aureus
atgatgattgtattagtgattccgataatgatttctgggatactatttttcaaaactaatattgataaaacatacatattttttaacatcatatttatcgacttttattactatatttacaatgtacatttaatgactttgccaaagtttaataattatattaaagcagagatgatggaattagaagatattgatgtattaattacaagtaaagattttggatttgatgaaattctgttttatacattatatttgttgttaattcttatcgttttatattatttgaaaaagcaagtaaagcataaaatc

SEQ ID NO: 4188 - protein, 103 aa, Staphylococcus aureus
  MISC_FEATURE (1)..(103): hypothetical protein
MMIVLVIPIMISGILFFKTNIDKTYIFFNIIFIDFYYYIYNVHLMTLPKFNNYIKAEMMELEDIDVLITSKDFGFDEILFYTLYLLLILIVLYYLKKQVKHKI

SEQ ID NO: 4189 - DNA, 975 bp, Staphylococcus aureus
ttgtttggaggtaaatgtgtgaataggaatatcgttaaactagttgtgttcatgctaattttagttgtagcagtagcgggttgtggtcaaaaagatactgaagagaaaactgaaatgacgacaataaaagatgaattaggaactgaaaaaattaagaaaaatcctaaacgtgttgttgtattagaatatagttttgctgattatttagcagcattagatatgaaacctgttggtattgcagatgatggcagcactaaaaatataacaaagtcagtaagagataagattggggcatatgaatcggttggatctagaccgcaaccgaatatggaagtgataagtaaattaaaaccggatttgatcattgcagatgttagcagacataagaaaatcaaatcagaattgagcaaaattgctccgacaatcatgttagttagcggtacgggagattataatgcaaatattgaagcatttaaaacagtcgctaaagcagtaggcaaagagaaagaaggcgagaagcgtctggaaaagcatgataaaatattagcggagattagaaagaaaattgaacagagtacgttaaaatctgcatttgcattcggtatctcaagagcaggtatgtttattaataatgaagatacatttatgggacaattcttaattaaaatgggtattcaacctgaagtcacaaaagacaaaactacgcatgttggtgaacgcaagggtggtccttatatatatttaaataatgaagaacttgccaatatcaatccaaaagttatgattttagccactgacggaaaaacggacaaaaatagaacgaaattcattgatcctgcagtttggaaatcattaaaagctgtgaaagataacaaagtttatgacgttgaccgaaataagtggttgaaatcaagggggattatcgcaagtgaaagtatggcagaagatttagaaaaaattgcagaaaaagcaaaa

SEQ ID NO: 4190 - protein, 325 aa, Staphylococcus aureus
  MISC_FEATURE (1)..(325): hypothetical protein
LFGGKCVNRNIVKLVVFMLILVVAVAGCGQKDTEEKTEMTTIKDELGTEKIKKNPKRVVVLEYSFADYLAALDMKPVGIADDGSTKNITKSVRDKIGAYESVGSRPQPNMEVISKLKPDLIIADVSRHKKIKSELSKIAPTIMLVSGTGDYNANIEAFKTVAKAVGKEKEGEKRLEKHDKILAEIRKKIEQSTLKSAFAFGISRAGMFINNEDTFMGQFLIKMGIQPEVTKDKTTHVGERKGGPYIYLNNEELANINPKVMILATDGKTDKNRTKFIDPAVWKSLKAVKDNKVYDVDRNKWLKSRGIIASESMAEDLEKIAEKAK

SEQ ID NO: 4191 - DNA, 1263 bp, Staphylococcus aureus
atgactgttaaatataatcaaaatggcgaattaacaatggatggtattagtttaaaaacgattgcacaaagctttggtacacctaccattgtttatgatgaactacaaattagagaacagatgcgccgttaccatcgcgcatttaaagatagtggattaaaatacaatatttcatacgcctcaaaggcatttacttgcattcaaatggtcaaacttgtagctgaggaagatttacagttagatgttgtttctgaaggtgaattatatacagctttagaagcaggttttgaaccgagtcgcatccatttccatggtaacaataaaacgaaacatgaaattaggtatgctttagaaaataatatcggttattttgttatagattcattagaagaaattgaattaatagaccgctatgctaatgatacggttcaagttgtattacgagttaatccaggtgttgaagcacatacacacgaatttattcaaactgggcaagaagatagtaagtttggattatcaattcaatatggcttagctaaaaaagcaattgacaaagtccaacaatctaaacacttaaaattaaaaggtgtacattgtcatattggttcacagattgaaggtacagaagcatttattgaaactgctaaaattgttttacgttggcttaaagagcaaggcattcaagttgaattattaaaccttggtggtggctttggtattaaatatgttgaaggtgacgaaagtttccctatcgaaagtggtattaaagatattacagacgcaataaaatccgaaattaaagttctaggtatagatgcaccagaaataggtattgaaccgggacgatcaattgtaggtgaagctggcgttactttatatgaagttggaaccattaaagaaattccagagattaataaatatgtttcaatcgatggcggtatgagtgatcatatcagaactgcactttatgacgcaaagtatcaagcattgcttgttaatagaaatgaagaagcagatgacagtgtaactatagctggaaaattatgtgagtctggtgatatcattattaaagacgctaaattaccttcatcagtcaaacgtggagactatcttgctatattatcaactggtgcatatcattactctatggcatccaattacaatcaaatgcaaaagccttctgtgtttttcttaaaagatggcaaagcacgtgaagttataaagcgacaatcgttaagacaactcattattaatgatacaaaa

SEQ ID NO: 4192 - protein, 421 aa, Staphylococcus aureus
  MISC_FEATURE (1)..(421): diaminopimelate
MTVKYNQNGELTMDGISLKTIAQSFGTPTIVYDELQIREQMRRYHRAFKDSGLKYNISYASKAFTCIQMVKLVAEEDLQLDVVSEGELYTALEAGFEPSRIHFHGNNKTKHEIRYALENNIGYFVIDSLEEIELIDRYANDTVQVVLRVNPGVEAHTHEFIQTGQEDSKFGLSIQYGLAKKAIDKVQQSKHLKLKGVHCHIGSQIEGTEAFIETAKIVLRWLKEQGIQVELLNLGGGFGIKYVEGDESFPIESGIKDITDAIKSEIKVLGIDAPEIGIEPGRSIVGEAGVTLYEVGTIKEIPEINKYVSIDGGMSDHIRTALYDAKYQALLVNRNEEADDSVTIAGKLCESGDIIIKDAKLPSSVKRGDYLAILSTGAYHYSMASNYNQMQKPSVFFLKDGKAREVIKRQSLRQLIINDTK

SEQ ID NO: 4193 - DNA, 1083 bp, Staphylococcus aureus
ttgacagcaacatggtctgtaaataagaaaatatttttacaaaatgcaatcacagtcaaaaacaatcagccattaatggcagttgttaaaaataatgcatatcactatgacctagaatttgctgtaactcagtttatccatgcaggtatagatacatttagcacaacatcactacgagaagcaattcaaattagacaacttgctccagatgcaacaatctttttaatgaatgcagtttacgagtttgatttagtccgtgaacatcaaatacacatgactttgccgtcgttgacatattactataaccataaaaatgatttagctggtattcatgttcacttagaatttgaaaatttattacatcggtctggatttaaagatttaaacgaaattaaagaagtattgaaagatcaccatcataatcaaaatgcaaaaatgattattagtggtttatggacccattttggatatgctgatgaattcgatgtgtcagattataatgttgaacgttcacaatggatggaaattgttgaagcacttttatctgaaggttatcagttcgacctaatccatgctcaaaatagtgcgagtttttatcgggaaggacaaatattactaccccaccatacacatgcgcgtgtaggtattgcgttatacggttcaagaccatatagttcactgaatcaacatgatatagttcagtcattaactttaaaagcacatgttattcaagtgcgcgaagtacaagctggtgattattgcggttatagctttgcctttgaagtgactaaaaacaatacaaaattagctgtagttgatatcggttatggcgatggaattttaagaactcgtgctaaacatgaagcacttatcaatggtaaacgctacccgatacgtgcattaatgatgagccatatgtttgttgaagtagatggcaatgtacatgcacaagatgaagttattctttataataatgatatccgcatcgatgaatatacctttaaaggtgttggtgcaaattctgaacaattaagtgctatgaatcatgattctttaaaaaaggagtacatttcaaatgactgt

SEQ ID NO: 4194 - protein, 361 aa, Staphylococcus aureus
  MISC_FEATURE (1)..(361): hypothetical protein
LTATWSVNKKIFLQNAITVKNNQPLMAVVKNNAYHYDLEFAVTQFIHAGIDTFSTTSLREAIQIRQLAPDATIFLMNAVYEFDLVREHQIHMTLPSLTYYYNHKNDLAGIHVHLEFENLLHRSGFKDLNEIKEVLKDHHHNQNAKMIISGLWTHFGYADEFDVSDYNVERSQWMEIVEALLSEGYQFDLIHAQNSASFYREGQILLPHHTHARVGIALYGSRPYSSLNQHDIVQSLTLKAHVIQVREVQAGDYCGYSFAFEVTKNNTKLAVVDIGYGDGILRTRAKHEALINGKRYPIRALMMSHMFVEVDGNVHAQDEVILYNNDIRIDEYTFKGVGANSEQLSAMNHDSLKKEYISNDC

SEQ ID NO: 4195 - DNA, 1158 bp, Staphylococcus aureus
ttgataattatgaatgaattagaatttgttacgaaacatcgccgtcatttacatcaacatcctgaattaagcttacatgaatttgaaacaactgcttatattaaagcgtttttagatagtttaaatattaaatacgattgcccattggaaactggcgtcattgcatacttagaaggtaatggctcacatacgatagcgtatagagctgatattgatgcgttacctattttagaggaaaatgatgtgccttatcgcagtcaatctgatcatgtgatgcatgcttgtggacatgatggtcatacaactgcattaatgctttttgtacaacgttgcaaagacatgcaagatgcaggtcaattaccgcaaaatgtcgttttcattttccaacctgcagaagaaactggtggcggtgcaaatcgattaataaaagccggtgcctttgataagtatccaattgaagcggtatttggtattcatgttaacccatttgctgatgaaggcattgcagtgataagagatgaagaaattacggccagcgcaacagagtatcgctttttcttaacaggcctgtcaagtcatgttgctgataaagaacaaggtcattcttgtggtgaagcattacaacatgtattaactcaaatatcacaaattcaacaatttcaccttaacggtttgaaacgaaatattgttcatattggtcattttaaagctggtgaagcgattaacactgtaccaagtaatggctatttagaaggtactattcgtacatatgatattgatgatttaacaatcgttaaaaatcaaatgcacaagatagcagaaagtgtcaagcttctgtttaatgtagattgtgaagttaaatttgcagaaggttatccccctacaatcaatagtccgaaattacgtactcaaatagaggacgccttaataaaagctgatttaaatgtctatgacaaaccaacgccattcttatttggggaagattttagtttttatggtcaacaactagctccagcttactttgtttttataggaacacgaaatgaagataaaggttttgtaactggtttgcacacatcacatttaaattttgatgaaaaagtgttaataaacgtggttaatttttacgaaaatttattaaataattacaaagaggtg

SEQ ID NO: 4196 - protein, 386 aa, Staphylococcus aureus
  MISC_FEATURE (1)..(386): hippurate hydrolase
LIIMNELEFVTKHRRHLHQHPELSLHEFETTAYIKAFLDSLNIKYDCPLETGVIAYLEGNGSHTIAYRADIDALPILEENDVPYRSQSDHVMHACGHDGHTTALMLFVQRCKDMQDAGQLPQNVVFIFQPAEETGGGANRLIKAGAFDKYPIEAVFGIHVNPFADEGIAVIRDEEITASATEYRFFLTGLSSHVADKEQGHSCGEALQHVLTQISQIQQFHLNGLKRNIVHIGHFKAGEAINTVPSNGYLEGTIRTYDIDDLTIVKNQMHKIAESVKLLFNVDCEVKFAEGYPPTINSPKLRTQIEDALIKADLNVYDKPTPFLFGEDFSFYGQQLAPAYFVFIGTRNEDKGFVTGLHTSHLNFDEKVLINVVNFYENLLNNYKEV

SEQ ID NO: 4197 - DNA, 717 bp, Staphylococcus aureus
atggtacaacatttaacagctgaagaaattattcaatatataagtgatgctaaaaagtctacaccaataaaagtatatttaaatggtaattttgaaggcatcacatatccagaaagttttaaagtatttggttcagaacaatctaaagtaatcttttgtgaagcggatgattggaaacctttttacgaagcatatggtagtcaattcgaagatatagaaattgaaatggatcgtcgcaattctgctattccattaaaagacttaacaaatacgaatgcacgaattgaaccaggtgcgtttattagagaacaagccattattgaagatggtgctgtcgttatgatgggcgcaacaattaatattggcgcagtcgttggcgaaggtacaatgattgatatgaatgctactctcggtggtcgtgctacaactggtaaaaatgtacatgtaggggctggcgcagtattagcaggtgtgattgaaccccctagtgcttcaccggttataatcgaggatgatgtattaatcggtgcaaatgcagttattttagaaggtgtacgtgttggtaaaggtgctattgttgcagctggcgcgattgtgacacaagatgtaccagctggtgcagttgttgctggtacacctgcaaaagtgattaagcaagcttctgaagtacaagatactaaaaaagagattgtagcagcattaagaaaactgaatgac

SEQ ID NO: 4198 - protein, 239 aa, Staphylococcus aureus
  MISC_FEATURE (1)..(239): tetrahydrodipicolinate
MVQHLTAEEIIQYISDAKKSTPIKVYLNGNFEGITYPESFKVFGSEQSKVIFCEADDWKPFYEAYGSQFEDIEIEMDRRNSAIPLKDLTNTNARIEPGAFIREQAIIEDGAVVMMGATINIGAVVGEGTMIDMNATLGGRATTGKNVHVGAGAVLAGVIEPPSASPVIIEDDVLIGANAVILEGVRVGKGAIVAAGAIVTQDVPAGAVVAGTPAKVIKQASEVQDTKKEIVAALRKLND

SEQ ID NO: 4199 - DNA, 720 bp, Staphylococcus aureus
gtgaaaatattactaattggctatggcgcaatgaatcaacgcgttgctagattagcagaagaaaaaggacatgaaatcgttggggtcattgaaaatacaccgaaagcaacaacgccatatcaacaatatcaacatattgcagatgttaaaggtgccgatgttgcaatagatttttcaaatccaaatctgcttttccctttattagatgaagattttcatttgccattagttgtggcaacaactggcgagaaagaaaaactacttaataagttagatgaattgagtcaaaatatgcctgtgtttttcagcgcgaacatgagttatggcgttcatgcattgactaaaattttagcagctgctgttcccctacttgatgatttcgacatcgaattgactgaggcacatcataataaaaaagtagatgcaccaagtggtacgttagaaaaattgtatgatgtgatcgtatctttgaaagaaaatgtaacacctgtgtatgatagacatgaattaaatgaaaaacgccagccacaagatattggtatacattctattcgtggaggtacgattgtcggtgaacatgaagttctatttgctggcactgatgaaacgattcaaatcacgcatcgtgcacaatcaaaagatatttttgcgaatggtgcaatacaagcagcagaacgcttagttaataaaccaaacggcttttatacgtttgacaactta

SEQ ID NO: 4200 - protein, 240 aa, Staphylococcus aureus
  MISC_FEATURE (1)..(240): dihydrodipicolinate
VKILLIGYGAMNQRVARLAEEKGHEIVGVIENTPKATTPYQQYQHIADVKGADVAIDFSNPNLLFPLLDEDFHLPLVVATTGEKEKLLNKLDELSQNMPVFFSANMSYGVHALTKILAAAVPLLDDFDIELTEAHHNKKVDAPSGTLEKLYDVIVSLKENVTPVYDRHELNEKRQPQDIGIHSIRGGTIVGEHEVLFAGTDETIQITHRAQSKDIFANGAIQAAERLVNKPNGFYTFDNL

SEQ ID NO: 4201 - DNA, 885 bp, Staphylococcus aureus
atgacacatttatttgagggtgttggcgttgcacttacaaccccttttacaaataacaaagttaatattgaagctttgaaaacacacgttaattttttactagaaaataatgcccaagcaatcatcgttaatggaactactgctgagagccctactttaacaacagatgaaaaagaacgcattctaaaaacagttattgatcttgtagataaacgtgttcctgtcatagcaggaactggcactaatgatactgaaaagtcaatccaagcttcaatccaagctaaagccttaggggctgatgcaattatgttaattacgccctactacaacaaaacgaaccaacgtggtttagtcaaacactttgaagcgattgcagatgctgtgaaattaccagtcgtgctgtacaatgttccttcaagaacgaacatgacaattgaaccagaaactgtagaaatattaagtcaacatccttatatagttgctttaaaagatgctacgaatgattttgagtatttagaagaagtgaaaaagcgcattgatacaaattcatttgcattatatagtggcaatgatgacaacgtcgtcgaatactatcaacgtggcggtcaaggggttatctctgttattgccaatgtcattcctaaagaatttcaagcgttatacgatgctcaacaaagtggattagatattcaagatcaatttaaaccaatcggcacactgttatcagctttatcagttgatattaacccaattcctattaaagctctaacaagttatttaggatttggaaattatgaattacgtctaccattggttagcctagaagatacagatactaaagtgcttcgtgaaacatatgacacatttaaagcgggtgaaaatgag

SEQ ID NO: 4202 - protein, 295 aa, Staphylococcus aureus
  MISC_FEATURE (1)..(295): dihydrodipicolinate
MTHLFEGVGVALTTPFTNNKVNIEALKTHVNFLLENNAQAIIVNGTTAESPTLTTDEKERILKTVIDLVDKRVPVIAGTGTNDTEKSIQASIQAKALGADAIMLITPYYNKTNQRGLVKHFEAIADAVKLPVVLYNVPSRTNMTIEPETVEILSQHPYIVALKDATNDFEYLEEVKKRIDTNSFALYSGNDDNVVEYYQRGGQGVISVIANVIPKEFQALYDAQQSGLDIQDQFKPIGTLLSALSVDINPIPIKALTSYLGFGNYELRLPLVSLEDTDTKVLRETYDTFKAGENE

SEQ ID NO: 4203 - DNA, 987 bp, Staphylococcus aureus
atgacaaagttagcagttgtgggtgcaacaggattagtaggtacaaaaatgttggagacattaaatcgtaaaaatattcctttcgatgaattagtattattttcatcagcacgttctgcagggcaagaagttgaatttcaaggaaaaacatatacagttcaagaattaactgatgctcgtgcaagtgaacatttcgattatgtattaatgagtgctggtggcggtacaagcgaacactttgccccactttttgaaaaagctggtgcaatcgttatagacaattcaagtcaatggcgtatggcagaagatattgatttaatcgttccggaagtcaatgaacctacatttacaagaggtatcattgccaatccaaactgctctacgattcaatctgttgtacctctaaaagtattgcaagatgcttatggtttaaaacgagtggcatatacaacatatcaagctgtatcaggttcagggatgaaaggtaagaaagatttagctgaaggtgtaaatggtaaagcaccagaagcatatccacatccaatttataataatgtgttaccgcatattgatgtgtttttagaaaacggatatacaaaagaagaacaaaaaatgattgatgagacgagaaaaattttaaatgcgccagacttaaaagtaacagcaacatgcgcacgtgtgcctgttcaagatagtcatagtgttgaaattgatgtaacgcttgacaaagaaacaacagcagaagatattaaagcgttatttgatcaagatgaccgcgttgttttagtagacaatccagagaacaatgaatatccaatggcaatcaattctactaataaagatgaagtgtttgttggccgtatacgtagagatgattcattagaaaatactttccatgtatggtgtacatcagacaatttattaaaaggtgctgcattaaatgctgtacaagtattggaacaagttatgcgtttaaaaggagcgaat

SEQ ID NO: 4204 - protein, 329 aa, Staphylococcus aureus
  MISC_FEATURE (1)..(329): aspartate semialdehyde
MTKLAVVGATGLVGTKMLETLNRKNIPFDELVLFSSARSAGQEVEFQGKTYTVQELTDARASEHFDYVLMSAGGGTSEHFAPLFEKAGAIVIDNSSQWRMAEDIDLIVPEVNEPTFTRGIIANPNCSTIQSVVPLKVLQDAYGLKRVAYTTYQAVSGSGMKGKKDLAEGVNGKAPEAYPHPIYNNVLPHIDVFLENGYTKEEQKMIDETRKILNAPDLKVTATCARVPVQDSHSVEIDVTLDKETTAEDIKALFDQDDRVVLVDNPENNEYPMAINSTNKDEVFVGRIRRDDSLENTFHVWCTSDNLLKGAALNAVQVLEQVMRLKGAN

SEQ ID NO: 4205 - DNA, 1203 bp, Staphylococcus aureus
atggtaacaagaagtgtgttgaaatttggcggatcatccgtcagtgattttacaaaaataaaaaggatcgctgaaatgttaaaggagcgagtcaatcaagatgaacaattaattgtcgttgtaagtgctatgggtaacacaacagatcaattaatgacgaatgtatcaaccttgactaaagcaccaaaacaacaagaactggcattattattgacaaccggagagcaacaaactgtatcttatttatcaatggtattaaatgatatcggtatgaatgccaaagcaatgactggctatcaagcgggtattaaaaccattggccatcatttaaaaagtaaaattgctcaaattaatcctcaaacatttgaacaagcctttcaagaaaacgatattttagtagttgctggatttcaaggcatcaatgaacatcaggaattaacaactttaggcagaggtggttctgatacgaccgctgtggcacttgctgttagtaatcaaataccttgtgaaatttataccgacgttgatggtgtgtatgccactgacccaagacttttaccaaaggctaaacgactagacatcgtctcatatgaagaaatgatggaaatgagcgctttaggtgctggtgtacttgaaacaagaagtgttgaattagctaaaaactataatatccctttatatttaggaaaaactttatcgaacgtgaaaggaacatggattatgtcaaatgaagaaatattagagaaaaaagcagttactggtgtggctttggataaacatatgatgcatgtaacaattagttatcccctacctgacaatcagctacttacccaactatttacggaacttgaagaaggtgctgtaaatgttgatatgatttcacaaatcgtcaacttggatgggctacaactatccttcacgattaaagatagtgattttcatcaaatttctatgattcttgaaacattaaagaatcaatatgaagcattagcttataaaatcaatgagcattatgtcaaaatttcattaattggctcaggcatgcgtgatatgtcaggtgtggcatcaaaagcatttttgacattaattgaaaataatatacctttctaccaaacaacaacatctgaaataagtatttcatacgtcattgatgattttaatgggcaacaagcggtagaaaaactatatgacgcatttaacatt

SEQ ID NO: 4206 - protein, 401 aa, Staphylococcus aureus
  MISC_FEATURE (1)..(401): aspartokinase II
MVTRSVLKFGGSSVSDFTKIKRIAEMLKERVNQDEQLIVVVSAMGNTTDQLMTNVSTLTKAPKQQELALLLTTGEQQTVSYLSMVLNDIGMNAKAMTGYQAGIKTIGHHLKSKIAQINPQTFEQAFQENDILVVAGFQGINEHQELTTLGRGGSDTTAVALAVSNQIPCEIYTDVDGVYATDPRLLPKAKRLDIVSYEEMMEMSALGAGVLETRSVELAKNYNIPLYLGKTLSNVKGTWIMSNEEILEKKAVTGVALDKHMMHVTISYPLPDNQLLTQLFTELEEGAVNVDMISQIVNLDGLQLSFTIKDSDFHQISMILETLKNQYEALAYKINEHYVKISLIGSGMRDMSGVASKAFLTLIENNIPFYQTTTSEISISYVIDDFNGQQAVEKLYDAFNI

SEQ ID NO: 4207 - DNA, 1620 bp, Staphylococcus aureus
atgaaaaaaaggagaaaatgcatgttacaagtaactgatgtgagtttacgttttggagatcgtaaactatttgaagatgtaaatattaaatttacagaaggtaattgttatggattaattggtgcgaatggtgcaggtaaatcaacattcttaaaaatattatctggtgaattagattctcaaacaggacatgtttcattagggaaaaatgaacgtctagctgttttaaaacaggaccactatgcttatgaagatgaacgcgtgcttgatgttgtaattaaaggtcacgaacgtctttatgaggttatgaaagaaaaagatgaaatctatatgaagccagatttcagtgatgaagatggtatccgtgctgctgaacttgaaggtgaatttgcagaaatgaatggttggaatgctgaagctgatgctgctaaccttttatctggtttaggtatcgatccaactttacacgataaaaaaatggctgaattagaaaacaaccaaaaaattaaagtattattagcgcaaagtttattcggtgaaccagacgtactattactggatgagcctactaacggtctcgatattccagcaatcagttggttagaagatttcttaattaactttgataatactgttatcgtagtatcgcatgaccgtcatttcttaaataatgtatgtactcatatcgctgatttagacttcggtaaaattaaagtttatgttggtaactatgatttttggtatcaatctagtcagttagctcaaaagatggctcaagaacaaaacaagaaaaaagaagaaaaaatgaaagagttacaggactttattgctcgtttctcagctaacgcttctaaatctaaacaagcaacaagtcgtaaaaaacaactcgagaaaattgaattagatgatattcaaccatcatcaagaagatatcctttcgttaaattcacacctgagcgcgaaatcggtaatgacttactaatcgttcaaaatctatctaaaacgattgacggtgaaaaagtattagataatatttcattcacaatgaatccaaatgataaagcaattttaattggggatagtgaaattgcgaaaaccacattgcttaaaatattagccggtgaaatggaaccagacgaaggttcatataaatggggtgtaacaacgtcattaagttacttccctaaagataactcagaattctttgagggcgttaatatgaaccttgtagattggttaagacaatacgcaccagaagatgagcaaactgaaacatttttacgcggcttcttaggccgtatgctatttagtggagaagaagttaagaaaaaagctagtgtactttcaggtggagaaaaagtacgttgtatgctaagtaaaatgatgttatcaagtgcaaacgttcttttacttgatgaaccaacaaaccacttagacttagaaagtattactgctgttaatgatggacttaaatcattcaaaggttctattatctttacttcatatgactttgaatttatcaatacaatcgcaaaccgtgttatcgatttaaataaacaaggtggcgtttcaaaagaaattccatatgaagaatatttacaagaaatcggcgttttaaaa

SEQ ID NO: 4208 - protein, 540 aa, Staphylococcus aureus
  MISC_FEATURE (1)..(540): ABC transporter homolog
MKKRRKCMLQVTDVSLRFGDRKLFEDVNIKFTEGNCYGLIGANGAGKSTFLKILSGELDSQTGHVSLGKNERLAVLKQDHYAYEDERVLDVVIKGHERLYEVMKEKDEIYMKPDFSDEDGIRAAELEGEFAEMNGWNAEADAANLLSGLGIDPTLHDKKMAELENNQKIKVLLAQSLFGEPDVLLLDEPTNGLDIPAISWLEDFLINFDNTVIVVSHDRHFLNNVCTHIADLDFGKIKVYVGNYDFWYQSSQLAQKMAQEQNKKKEEKMKELQDFIARFSANASKSKQATSRKKQLEKIELDDIQPSSRRYPFVKFTPEREIGNDLLIVQNLSKTIDGEKVLDNISFTMNPNDKAILIGDSEIAKTTLLKILAGEMEPDEGSYKWGVTTSLSYFPKDNSEFFEGVNMNLVDWLRQYAPEDEQTETFLRGFLGRMLFSGEEVKKKASVLSGGEKVRCMLSKMMLSSANVLLLDEPTNHLDLESITAVNDGLKSFKGSIIFTSYDFEFINTIANRVIDLNKQGGVSKEIPYEEYLQEIGVLK

SEQ ID NO: 4209 - DNA, 900 bp, Staphylococcus aureus
atggcattagacaaagatatagtaggttctatagaattccttgaagtagtagggttacaaggttcaacttaccttttaaaaggaccaaacggtgaaaacgtaaagttaaaccaatcagaaatgaacgatgatgatgaattagaagtaggtgaagaatatagtttcttcatttatccaaaccgttcaggtgaattatttgcaactcaaaatatgcctgatattacgaaagataaatatgactttgctaaagtacttaaaacggatcgcgatggggcacgtatagatgttggattaccccgtgaagtgttagtaccatgggaagatttaccaaaagtgaaatcactatggccacaacctggtgattatttgctagttacattacgaattgaccgtgagaatcatatgtatggacgtttagcgagtgaatctgttgtagaaaatatgtttacacctgtacacgacgataatttaaaaaacgaagtcattgaagccaaaccttaccgcgtattacgaattggtagctttttattaagcgaatcaggttacaaaattttcgtacatgaatcagaacgtaaagctgaaccaagattaggtgaatctgttcaagttagaattatcgggcataatgataaaggtgagttaaatggttcatttttaccacttgcacatgaacgtttagacgatgacggccaagtcatctttgatttactagttgaatatgatggtgaattaccattctgggacaaatcaagccctgaagcgattaaagaagtattcaatatgagtaaaggttcattcaaacgtgcaatcggtcacttatataaacagaagattattaatatagaaacaggtaaaatcgctttaactaaaaaaggttggagtcgaatggactcaaaagaa

SEQ ID NO: 4210 - protein, 300 aa, Staphylococcus aureus
  MISC_FEATURE (1)..(300): conserved hypothetical
MALDKDIVGSIEFLEVVGLQGSTYLLKGPNGENVKLNQSEMNDDDELEVGEEYSFFIYPNRSGELFATQNMPDITKDKYDFAKVLKTDRDGARIDVGLPREVLVPWEDLPKVKSLWPQPGDYLLVTLRIDRENHMYGRLASESVVENMFTPVHDDNLKNEVIEAKPYRVLRIGSFLLSESGYKIFVHESERKAEPRLGESVQVRIIGHNDKGELNGSFLPLAHERLDDDGQVIFDLLVEYDGELPFWDKSSPEAIKEVFNMSKGSFKRAIGHLYKQKIINIETGKIALTKKGWSRMDSKE

SEQ ID NO: 4211 - DNA, 180 bp, Staphylococcus aureus
ttgggtttcactcgaatgtcagttcgaggaataaataaagttaaacgagagctaggttttgtattaatggcacttaatataaggaaaatagcagctcaacgagctgtacattataaaatacatatcaaaaaagctgatttccatcaaataattaatagaaatcagcttttttacattgcc

SEQ ID NO: 4212 - protein, 60 aa, Staphylococcus aureus
  MISC_FEATURE (1)..(60): truncated transposase
LGFTRMSVRGINKVKRELGFVLMALNIRKIAAQRAVHYKIHIKKADFHQIINRNQLFYIA

SEQ ID NO: 4213 - DNA, 981 bp, Staphylococcus aureus
atgaaaaaatggcaatttgttggtactacagctttaggtgcaacactattattaggtgcttgtggtggcggtaatggtggcagtggtaatagtgatttaaaaggggaagctaaaggtgatggctcatcaacagtagcaccaattgtggagaaattaaatgaaaaatgggctcaagatcactcggatgctaaaatctcagcaggacaagctggtacaggtgctggtttccaaaaattcattgcaggagatatcgacttcgctgatgcttctagaccaattaaagatgaagagaagcaaaaattacaagataagaatatcaaatacaaagaattcaaaattgcgcaagatggtgtaacggttgctgtaaataaagaaaatgattttgtagatgaattagacaaacagcaattaaaagcaatttattctggaaaagctaaaacatggaaagatgttaatagtaaatggccagataaaaaaataaatgctgtatcaccaaactcaagtcatggtacttatgacttctttgaaaatgaagtaatgaataaagaagatattaaagcagaaaaaaatgctgatacaaatgctatcgtttcttctgtaacgaaaaacaaagagggaatcggatactttggatataacttctacgtacaaaataaagataaattaaaagaagttaaaatcaaagatgaaaatggtaaagcaacagagcctacgaaaaaaacaattcaagataactcttatgcattaagtagaccattattcatttatgtaaatgaaaaagcattgaaagataataaagtaatgtcagaatttatcaaattcgtcttagaagataaaggtaaagcagctgaagaagctggatatgtagcagcaccagagaaaacatacaaatcacaattagatgatttaaaagcatttattgataaaaatcaaaaatcagacgacaagaaatctgatgataaaaagtctgaagacaaaaaa

SEQ ID NO: 4214 - protein, 327 aa, Staphylococcus aureus
  MISC_FEATURE (1)..(327): thioredoxine reductase
MKKWQFVGTTALGATLLLGACGGGNGGSGNSDLKGEAKGDGSSTVAPIVEKLNEKWAQDHSDAKISAGQAGTGAGFQKFIAGDIDFADASRPIKDEEKQKLQDKNIKYKEFKIAQDGVTVAVNKENDFVDELDKQQLKAIYSGKAKTWKDVNSKWPDKKINAVSPNSSHGTYDFFENEVMNKEDIKAEKNADTNAIVSSVTKNKEGIGYFGYNFYVQNKDKLKEVKIKDENGKATEPTKKTIQDNSYALSRPLFIYVNEKALKDNKVMSEFIKFVLEDKGKAAEEAGYVAAPEKTYKSQLDDLKAFIDKNQKSDDKKSDDKKSEDKK

SEQ ID NO: 4215 - DNA, 105 bp, Staphylococcus aureus
ttgaaacatgattttgatggtgaatcattatttagagtacaaagcttgatttatcgagacgctgattttgacattcagttagtctacaagcttatcaacttaaaa

SEQ ID NO: 4216 - protein, 35 aa, Staphylococcus aureus
LKHDFDGESLFRVQSLIYRDADFDIQLVYKLINLK

SEQ ID NO: 4217 - DNA, 984 bp, Staphylococcus aureus
gtggttcatcattattttacaaatctaattattttgggagtaatagaaagaggtttgattatgacttcatctactaatgttaaagctttaatcgaaaaaaataataataaaaaaggaaagcataatgacaaaattataccagttattttagccgcaatttcagcgatttccattttaacaacactaggtatattaatcacattgcttttagaaaccatcacttttttcaccagaattccaataactgaatttctattttctactacttggaatcctaccggttcagaccctaagtttggtatctgggcattgataatagggactttaaaaatcacagttattgcgactatatttgcagttccagtcgggcttggtgcagcaatttatttaagtgaatatgcaagtgaccgtgcacgacgcataattaaaccgatattagaaattttagcaggaataccaacaattgtgtttggtttctttgcattaacctttgttacaccagtattaagatctttcataccaggtcttggagagtttaatgctataagtcccggcttagttgtcggtattatgattgtccctctcatcacaagtttgagtgaggatgcaatggcatctgtaccaaataaaattcgagaaggtgcctatggacttggagcaactaaattagaagtagcaactaaagtcgtacttcccgcagcaacatcaggtattgtagcttcaatcgttctcgcgatttcaagagcaattggagaaacgatgattgtatcattagcggcaggtagttcgccaacagcttcattaagtttaacaagttcgattcaaacaatgactggatatattgttgagatagcgacaggtgatgcaacatttggatcaaatatttattacagtatttatgctgtagggttcacactatttatctttaccttaatcatgaatttactttctcagtggatttctaagcgttttagggaggagtat

SEQ ID NO: 4218 - protein, 328 aa, Staphylococcus aureus
  MISC_FEATURE (1)..(328): hypothetical protein
VVHHYFTNLIILGVIERGLIMTSSTNVKALIEKNNNKKGKHNDKIIPVILAAISAISILTTLGILITLLLETITFFTRIPITEFLFSTTWNPTGSDPKFGIWALIIGTLKITVIATIFAVPVGLGAAIYLSEYASDRARRIIKPILEILAGIPTIVFGFFALTFVTPVLRSFIPGLGEFNAISPGLVVGIMIVPLITSLSEDAMASVPNKIREGAYGLGATKLEVATKVVLPAATSGIVASIVLAISRAIGETMIVSLAAGSSPTASLSLTSSIQTMTGYIVEIATGDATFGSNIYYSIYAVGFTLFIFTLIMNLLSQWISKRFREEY

SEQ ID NO: 4219 - DNA, 915 bp, Staphylococcus aureus
atggaaacgacagataataatagacaatcactcgtcgatcaacaacttgtccaaaaacatttatcatccagaacggttaaaaataaagtgttcaaactcatatttttagcatgtacattattaggacttgtcgtacttattgcgttgttaactcaaacattgattaaaggggtaagtcatttaaatttacagtttttcactaatttttcttcttcaacaccatctatggctggcgttaaaggcgcgttaatcggttcactttggttaatgttaagtatcattccattatcaatcatcctaggaataggtacagctatatacttagaagaatatgcgaaaaacaacaaatttactcagtttgttaaaatcagtatttccaatttagctggtgtaccatcagttgtatttgggttattaggttatactttgttcgttggtggtgcagggattgaagccttgaaaatgggtaacagtatattggcagcagcgctaacaatgaccttactgatattaccaattattattgtttcaagtcaggaagcaattagagctgtacctaactcagtacgcgaagcttcttacggcttaggtgctaataaatggcaaacgataagacgtgttgtcttaccagcagcgttacctggtattttaactggattcattttgtctctttcaagagcactgggagaaacagcgccacttgtgctaatcggtataccgactatattattggcaacacctagaagtatattggatcaattttcagcattacctatccaaatatttacttgggcgaaaatgcctcaagaagaattccagaatgttgcatcggcaggcattatcgttttactagttatcttaatcttaatgaatggcgttgcgattattttacgtaacaaatttagtaaaaaattc

SEQ ID NO: 4220 - protein, 305 aa, Staphylococcus aureus
  MISC_FEATURE (1)..(305): hypothetical protein
METTDNNRQSLVDQQLVQKHLSSRTVKNKVFKLIFLACTLLGLVVLIALLTQTLIKGVSHLNLQFFTNFSSSTPSMAGVKGALIGSLWLMLSIIPLSIILGIGTAIYLEEYAKNNKFTQFVKISISNLAGVPSVVFGLLGYTLFVGGAGIEALKMGNSILAAALTMTLLILPIIIVSSQEAIRAVPNSVREASYGLGANKWQTIRRVVLPAALPGILTGFILSLSRALGETAPLVLIGIPTILLATPRSILDQFSALPIQIFTWAKMPQEEFQNVASAGIIVLLVILILMNGVAIILRNKFSKKF

SEQ ID NO: 4221 - DNA, 849 bp, Staphylococcus aureus
atggcgcaaacacttgcacaaactaaacaaatatctcaaagtcatacgtttgatgtctcacaaagtcatcataaaacaccagatgatacaaactcacattctgttatatattcaacacaaaatttagacttatggtatggcgaaaatcatgcattacaaaatattaatttagatatttatgaaaaccaaattactgccattataggtccatctggttgtggcaaatcaacatatattaaaactttgaatcgaatggttgagttagtaccttctgtgaaaacagctggtaaaatattatatcgagatcaagacatttttgatcaaaaatattctaaagaacaattacgtacaaatgtgggcatggtctttcaacaacctaatccatttccaaaatcaatatacgataatattacttacggtccaaagattcacggtattaaaaataaaaaagttcttgatgaaatcgttgagaaatcattacgtggcgctgcaatttgggatgaattaaaggataggttgcacacaaatgcatatagtttatccggtgggcaacaacaacgtgtttgtatcgcgcgttgtttagcaattgaacctgaagtcattttaatggatgaaccgacatcagcattagatccaatctcaacattaagagtagaagagttggttcaagaactaaaagaaaagtatacaattattatggttacacataatatgcaacaagcagctcgtgtatcagataaaactgcatttttcttaaatggttatgtcaatgaatatgatgatactgataaaattttctctaacccatcaaacaagaaaacagaagattatatttcaggaaggtttggt

SEQ ID NO: 4222 - protein, 283 aa, Staphylococcus aureus
  MISC_FEATURE (1)..(283): phosphate ABC transporter
MAQTLAQTKQISQSHTFDVSQSHHKTPDDTNSHSVIYSTQNLDLWYGENHALQNINLDIYENQITAIIGPSGCGKSTYIKTLNRMVELVPSVKTAGKILYRDQDIFDQKYSKEQLRTNVGMVFQQPNPFPKSIYDNITYGPKIHGIKNKKVLDEIVEKSLRGAAIWDELKDRLHTNAYSLSGGQQQRVCIARCLAIEPEVILMDEPTSALDPISTLRVEELVQELKEKYTIIMVTHNMQQAARVSDKTAFFLNGYVNEYDDTDKIFSNPSNKKTEDYISGRFG

SEQ ID NO: 4223 - DNA, 639 bp, Staphylococcus aureus
atggcaataattagacaacgatatcaggagcaacttgatgatttaataaaagaattacgtcggttaggtgcaaatgtctatgtgagtattgaaaatggtataaaatcattaagtattgacgatagaggctttgcacgacaaacagttaaaaacgataaacatatcaatcaattaaattatgatattaatgagcgagttatcatgttaattacaaagcaacagcccattgcgagtgatttgcgtatgatgatttcttcattaaaaatcgcctccgatttagaaagaataggagataatgcctcgagtattgccaatattcgattgcgtacaaagattacagatgattatgtgttaacccgtttaaagacaatgggtaaattagctatgttaatgttaaaggacttagatcaagcatttaaaaagaaagataccgtattaataagagaaataattgagcgtgatgaagatatcgatgacttatatagtcatattattaacgcaacgtatcttattgataacgatccatttgtcgctgcacaagctcatttagcagcaagacatttagaacgtattggtgatcatattattaacatcgctgaaagtgtttatttttatttaacaggtacacattacgaacaa

SEQ ID NO: 4224 - protein, 213 aa, Staphylococcus aureus
  MISC_FEATURE (1)..(213): hypothetical protein
MAIIRQRYQEQLDDLIKELRRLGANVYVSIENGIKSLSIDDRGFARQTVKNDKHINQLNYDINERVIMLITKQQPIASDLRMMISSLKIASDLERIGDNASSIANIRLRTKITDDYVLTRLKTMGKLAMLMLKDLDQAFKKKDTVLIREIIERDEDIDDLYSHIINATYLIDNDPFVAAQAHLAARHLERIGDHIINIAESVYFYLTGTHYEQ

SEQ ID NO: 4225 - DNA, 1842 bp, Staphylococcus aureus
atgaatgtattataccaaaggagtgattatatgtctcaaggtttacctttaagagaagatgttcctgtttcagaaacatgggatttagtagacttatttaaagatgatcaacaatattatgaaagtattgacgctctagtacaacaagcaaatcaatttcatcatacatatgcaacaacattaaattcaatcgaacaaattaatactgctttagctgaattagaaaatattttaattgccttagatcgcttaagtaattatgcagaactacgtttaagtgtagatactagtaatatcgaggcacaagtattgagcgctaaattatctactacatacggtaaaattgttagccaattatcatttgtagagtcagaaatacttgaattaccagaagaaatacttcaacaattagaagaatcatgtccatatcaacactatattaaacagttaataaaacaaaagccattccaattatctgcgtcggtagaacaagtattagcaactttatcacctacgctaaacagtccttacgatttatacggcacgacaaaaatgctagatattacattcgattcatttgaacatgatggtacaacgtaccctgtcgactatgctacgtttgaaaatgattatgaagataataaagatcctgagtttagacgtaaaagtttcaaatcgtttagcgatgggattcgaaaatatcagcatactaccgcggctacatataatatgcaagtacaacaagaaaaaattgaagctgatttacgtggatttgaatcagtcatcgattatttattacatagtcaagaagtaacgcgtgatatgtttgaccgtcaaatcgatatgattatgcgtgacttggcaccagttatgcagaaatatgctaaacttttacaacgtattcacggattagataacatgcgttttgaagacttgaagatttctgtagaccctgattatgaaccagagatttcaattgaagactcaaaaaattatattttcggtgcgttaagtgttttaggtgatgactatacaaacatgttacgtgaagcatacgatcagcgatggattgattttgcacaaaataaaggtaaagatacaggcgcattttgtgcaagtccatactttacacattcatatgtgtttatttcttggactggtaaaatggctgaagcatttgtcttagcacatgaattaggtcatgcaggtcattttacattagctcaaaaacatcaaccatatcttgaatcagaagcatcaatgtactttgttgaagccccttctacaatgaatgaaatgttgatggccaattatttatttaacacaagtgataatccaagatttaagcgttgggttattggctcaattttatctagaacatattatcataatatggttacccatttattagaagctgcttatcaacgtgaagtgtatcacaaagtagatcaaggtgaatctttaaatgcgccgacattaaatgaaataatgctaaatgtttataaacaattttttggagatgcagtagacatgactgagggtgctgaattaacatggatgcgtcaacctcattactatatgggattatattcgtatacgtattctgctggcttaacaatcggaactgtcgtttctcaaaagattaaaaatgaaggccaaccagctgttgatgcttggttagaaacattgaaaaaaggtggtagtgtatcacctgtcgaacttgcaaacattgcaggtgtagacattactacagaacagccacttaaatctacaattcaatatatttctgatttagtcgatgaagttgaaaaattaacagatgaaattgagcaagcaaataac

SEQ ID NO: 4226 - protein, 614 aa, Staphylococcus aureus
  MISC_FEATURE (1)..(614): hypothetical protein
MNVLYQRSDYMSQGLPLREDVPVSETWDLVDLFKDDQQYYESIDALVQQANQFHHTYATTLNSIEQINTALAELENILIALDRLSNYAELRLSVDTSNIEAQVLSAKLSTTYGKIVSQLSFVESEILELPEEILQQLEESCPYQHYIKQLIKQKPFQLSASVEQVLATLSPTLNSPYDLYGTTKMLDITFDSFEHDGTTYPVDYATFENDYEDNKDPEFRRKSFKSFSDGIRKYQHTTAATYNMQVQQEKIEADLRGFESVIDYLLHSQEVTRDMFDRQIDMIMRDLAPVMQKYAKLLQRIHGLDNMRFEDLKISVDPDYEPEISIEDSKNYIFGALSVLGDDYTNMLREAYDQRWIDFAQNKGKDTGAFCASPYFTHSYVFISWTGKMAEAFVLAHELGHAGHFTLAQKHQPYLESEASMYFVEAPSTMNEMLMANYLFNTSDNPRFKRWVIGSILSRTYYHNMVTHLLEAAYQREVYHKVDQGESLNAPTLNEIMLNVYKQFFGDAVDMTEGAELTWMRQPHYYMGLYSYTYSAGLTIGTVVSQKIKNEGQPAVDAWLETLKKGGSVSPVELANIAGVDITTEQPLKSTIQYISDLVDEVEKLTDEIEQANN

SEQ ID NO: 4227 - DNA, 348 bp, Staphylococcus aureus
atgaatatgacattattcgatatgcctaattatttatggatcacaacattaataatgattttattaacaatattctgttgcttagttttaaataaatggtttgtatctgcagtaattacatttgttatattaggtgtgcttgcattttttattccaaattttcaagatataaaatatcaaccattattaggatacgctgcatttttagcgattatgagtttattaattagttttctattatggtattttactagaaattggcgtaaagaaagaaaagcgcgtaaattagaaaagcaaattgaaaaatacggctatgagggcgctgaacttcgccgtaaagataaaaaa

SEQ ID NO: 4228 - protein, 116 aa, Staphylococcus aureus
  MISC_FEATURE (1)..(116): hypothetical protein
MNMTLFDMPNYLWITTLIMILLTIFCCLVLNKWFVSAVITFVILGVLAFFIPNFQDIKYQPLLGYAAFLAIMSLLISFLLWYFTRNWRKERKARKLEKQIEKYGYEGAELRRKDKK

SEQ ID NO: 4229 - DNA, 129 bp, Staphylococcus aureus
atgaggtatgtaacgatgcgccaattcattaaaagaactgttaaaacaatccttgtcggttatgtaattaaatttattcgaaataaactttcaggtaaatcatcacatccgacagataataaacataat

SEQ ID NO: 4230 - protein, 43 aa, Staphylococcus aureus
MRYVTMRQFIKRTVKTILVGYVIKFIRNKLSGKSSHPTDNKHN

SEQ ID NO: 4231 - DNA, 1053 bp, Staphylococcus aureus
ttgcatatacatgcgccattctcatgtaaaaagaaagtgttagtaacttacacaaggagggggactattatgttcataataaagtctatgttgtatagactgatgcaaatgatagttgttttatttgttatttctacacttacattcattttaatgaaattatcaccaggcaatcctgttgataaaatattacatcttgatgtagcacaagtgtcgacggaacaaataaatgcaaccaaagataaattgggattaaatgattctttattggtacagtggtggcattggatgaatcatttattacattttaatttaggaaaaagttttgaatcaaaagaaccggtaacacagatattattcaactatgcacccataacattactcatatcattttcaacattagtagtgtcgttatgcatatctataccgctcggcattatagcagccaaacgatttcataagtggacggataaagtgattagagtgatctcaacactatcgattagtttaccagcgttctttatcggtattattttattatttattgtcacaaatttaatgaatatagatagcgttatactaagtcagtttatattacctgtaatcacgctatctttaggtatgtgtgcatacatcattcgtttagtgcgttctaatttattgatgttattgcaaagtaatatcgtacaagcatcaagattacgcggtatgaatgaacgttatattttaattcatgatttactaaaaccaacaattttgccgattatcccattactagggatttcacttggcagtctaataggtggtactgtagtgattgaaaatttatttgatatacctggtattggttatctattaatggatagtattaaatctcgagattatcctgttattcaaggatgcgtgttatttattggcttcttcgttgttattatcaatacgattgctgatttattaacgttattacttgatccgaagcagcgtttacaattaggaaatccaaaaatcaaaaccaatacaccattgatatcagaaagtagtgaccgtcatgca

SEQ ID NO: 4232 - protein, 351 aa, Staphylococcus aureus
  MISC_FEATURE (1)..(351): oligopeptide transporter
LHIHAPFSCKKKVLVTYTRRGTIMFIIKSMLYRLMQMIVVLFVISTLTFILMKLSPGNPVDKILHLDVAQVSTEQINATKDKLGLNDSLLVQWWHWMNHLLHFNLGKSFESKEPVTQILFNYAPITLLISFSTLVVSLCISIPLGIIAAKRFHKWTDKVIRVISTLSISLPAFFIGIILLFIVTNLMNIDSVILSQFILPVITLSLGMCAYIIRLVRSNLLMLLQSNIVQASRLRGMNERYILIHDLLKPTILPIIPLLGISLGSLIGGTVVIENLFDIPGIGYLLMDSIKSRDYPVIQGCVLFIGFFVVIINTIADLLTLLLDPKQRLQLGNPKIKTNTPLISESSDRHA

SEQ ID NO: 4233 - DNA, 837 bp, Staphylococcus aureus
gtgaccgtcatgcataaaatattttcaaagaataacctgatattttttgtattcgttgcatttatttttgtggtaattgtactgcaattctttgtcagtagtgaaaatgcaaccaaagtcaatttatcacaaacttttgaacctattagttggttgcatttattaggaactgatgattatgggagagatttatttacccgaattattatcggtgcacgttcaacattgtttgttactgttttaacattaatagctatcgttgtcataggtgttacactaggtctatttgccggatacaaaaaagggtggattgaacgattagtgttaaggtttattgatgttggtctaagtattccagaatttatcatcatgattgctttagcaagtttttttcaaccatctttatggaatttagttatctcaattacattaataaaatggatgaattacacaaggttgactagaagtatagttaatagcgaaatgaataagccttatataaaaatggcacaattatttcatgtaccaacaagaacaatattaatacgtcatttaacacctaaaattataccggctattatcgttttgatggtcgttgatttcggtaaaatcattctatatataagttcactatcatttattgggttaggtgcacaaccgccaacaccagagtggggcgctatgttgcaacaaggtcgtgattttatttcgtctcatccaattatgttgattgcacctgcttcagtcattgctataactattttaatttttaatttaaccggtgatgcactaagagatagattgctgaaacaacggggtgaatatgatgagtctcat

SEQ ID NO: 4234 - protein, 279 aa, Staphylococcus aureus
  MISC_FEATURE (1)..(279): oligopeptide transporter
VTVMHKIFSKNNLIFFVFVAFIFVVIVLQFFVSSENATKVNLSQTFEPISWLHLLGTDDYGRDLFTRIIIGARSTLFVTVLTLIAIVVIGVTLGLFAGYKKGWIERLVLRFIDVGLSIPEFIIMIALASFFQPSLWNLVISITLIKWMNYTRLTRSIVNSEMNKPYIKMAQLFHVPTRTILIRHLTPKIIPAIIVLMVVDFGKIILYISSLSFIGLGAQPPTPEWGAMLQQGRDFISSHPIMLIAPASVIAITILIFNLTGDALRDRLLKQRGEYDESH

SEQ ID NO: 4235 - DNA, 780 bp, Staphylococcus aureus
gtgaatatgatgagtctcattgatatacaaaatttaacaataaagaatactagtgagaaatctcttattaaagggattgatttgaaaatttttagtcaacagattaatgccttgattggagagagcggcgctggaaaaagtttgattgctaaagctttacttgaatatttaccatttgatttaagctgcacgtatgattcgtaccaatttgatggggaaaatgttagtagattgagtcaatattatggtcatacaattggctatatttctcaaaattatgcagaaagttttaacgaccatactaaattaggtaaacagttaactgcgatttatcgtaagcattataaaggtagtaaagaagaggctttgtccaaagttgataaggctttgtcgtgggttaatttacaaagcaaagatatattaaataaatatagtttccaactttctgggggccaacttgaacgcgtatacatagcaagcgttctcatgttggagcctaaattaatcattgcagacgaaccagttgcatcattggatgctttgaacggtaatcaagtgatggatttattacagcatattgtattagaacatggtcaaacattatttattatcacacataacttaagtcatgtattgaaatattgtcagtacatttatgttttaaaagaaggtcaaatcattgaacgaggtaatattaatcatttcaagtatgagcatttgcatccgtatactgaacgtctaattaaatatagaacacaattaaagagggattactatgat

SEQ ID NO: 4236 - protein, 260 aa, Staphylococcus aureus
  MISC_FEATURE (1)..(260): oligopeptide transport
VNMMSLIDIQNLTIKNTSEKSLIKGIDLKIFSQQINALIGESGAGKSLIAKALLEYLPFDLSCTYDSYQFDGENVSRLSQYYGHTIGYISQNYAESFNDHTKLGKQLTAIYRKHYKGSKEEALSKVDKALSWVNLQSKDILNKYSFQLSGGQLERVYIASVLMLEPKLIIADEPVASLDALNGNQVMDLLQHIVLEHGQTLFIITHNLSHVLKYCQYIYVLKEGQIIERGNINHFKYEHLHPYTERLIKYRTQLKRDYYD

SEQ ID NO: 4237 - DNA, 699 bp, Staphylococcus aureus
atgattgagttaaaacatgtgacttttggttataataaaaagcagatggtgctacaagatatcaatattactatacctgatggagaaaatgttggtattttaggcgaaagtggctgtggtaaaagtacgctcgcttcattggttcttggcttgtttaaacctgttaaaggagagatttacttaagtgacaatgctgtgttaccgattttccaacaccctttaactagctttaaccctgattggacgattgagacctcattaaaagaagcgttatattattacagaggtctaactgataatactgctcaggatcaattattattacaacatttatctacttttgagttaaacgcgcaattattgactaaattaccaagcgaagtgagtggcggacaattacaaagatttaatgtcatgcgttcgttattagcacagcctcgcgttttaatatgtgatgagataacttcaaatttagatgttatagctgaacaaaatgtaatcaatatattaaaagcgcaaacgattacgaacttaaatcattttatcgttatttctcatgatttatccgtgttacaacgcttagttaatagaattatcgttcttaaggatggcatgatagtcgatgattttgcaatagaggaattatttaatgttgatagacacccttatacaaaagaattagtgcaagcattttcatat

SEQ ID NO: 4238 - protein, 233 aa, Staphylococcus aureus
  MISC_FEATURE (1)..(233): oligopeptide transporter
MIELKHVTFGYNKKQMVLQDINITIPDGENVGILGESGCGKSTLASLVLGLFKPVKGEIYLSDNAVLPIFQHPLTSFNPDWTIETSLKEALYYYRGLTDNTAQDQLLLQHLSTFELNAQLLTKLPSEVSGGQLQRFNVMRSLLAQPRVLICDEITSNLDVIAEQNVINILKAQTITNLNHFIVISHDLSVLQRLVNRIIVLKDGMIVDDFAIEELFNVDRHPYTKELVQAFSY

SEQ ID NO: 4239 - DNA, 471 bp, Staphylococcus aureus
atgggattacttgatattgcaagtattcgttctatagaaagaggctttaattattatcaaagtgaatgcgtcattaacttaaaatcattttcagaaacgcagcatgaggctgaagtaaagggcagtggcaacaaagtatatcgttgttatattgatatggaacatcctagaaaatccatatgtaattgtcctcatgctgatggaagacgagtgatatgtaaacatatgattgcattactctttacagctagtccagaagcagcaaataaacatataatgatgttaaacgaagttgaagaagactatcaattacgcagaaatatgtggattgatagtcttaaagaaatgattaatgatatgagtgaagaagaactccgcgatgcatatttaaacatgttaattgaacatggagaaatggcagaattatttggattagatgaagaggaagaaatgttcgaggacgaattttat

SEQ ID NO: 4240 - protein, 157 aa, Staphylococcus aureus
  MISC_FEATURE (1)..(157): hypothetical protein
MGLLDIASIRSIERGFNYYQSECVINLKSFSETQHEAEVKGSGNKVYRCYIDMEHPRKSICNCPHADGRRVICKHMIALLFTASPEAANKHIMMLNEVEEDYQLRRNMWIDSLKEMINDMSEEELRDAYLNMLIEHGEMAELFGLDEEEEMFEDEFY

SEQ ID NO: 4241 - DNA, 768 bp, Staphylococcus aureus
ttgatgagatttgtctttgatattgatggtacgctttgttttgacggccgattaattgaccagactattattgatacattgttacaattacaacatgatggtcatgaacttatatttgcatcagcacgtccgattcgtgatttgttgccagttttaccatcagtatttcatcagcacacattaattggcgcaaatggtgctatgatttcacagcaatcaaagatttctgttatcaaaccaattcatactgatacatatcatcatatcttcaaaataattcaaaagtatgagttagattatattattgatgatgattggaattatgctgcacaacttgacgctgagaacgcgatttttgagcgtttagatccacataagctggccagttgtattgatgttgcaaatatcgacacgccaatcaagattattttattaaatatagacccggcacaaattacaactatattagacgagctagataaataccatcaagaattggaaatgattcaccattcaaatgagtataacattgatataacagcgcaaaatattaacaaatatactgcattacaatatatatttgatgcagatgttaaatatatagcatttggtaatgaccacaatgatattgtcatgttacaacatgctagtagtggctatattataggaccatcagaagcatacacacacgcaatattgaaacttgataaaatcaaacacatcaataataatgcacaagctatttgcaaagtcttaaaatcatataaa

SEQ ID NO: 4242 - protein, 256 aa, Staphylococcus aureus
  MISC_FEATURE (1)..(256): conserved hypothetical
LMRFVFDIDGTLCFDGRLIDQTIIDTLLQLQHDGHELIFASARPIRDLLPVLPSVFHQHTLIGANGAMISQQSKISVIKPIHTDTYHHIFKIIQKYELDYIIDDDWNYAAQLDAENAIFERLDPHKLASCIDVANIDTPIKIILLNIDPAQITTILDELDKYHQELEMIHHSNEYNIDITAQNINKYTALQYIFDADVKYIAFGNDHNDIVMLQHASSGYIIGPSEAYTHAILKLDKIKHINNNAQAICKVLKSYK

SEQ ID NO: 4243 - DNA, 1257 bp, Staphylococcus aureus
atgaaatttacagagttaactgttaccgaatttgacaactttgtacaaaatccatcattggaaagtcattatttccaagtaaaagaaaatatagttacccgtgagaatgatggctttgaagtagttttattaggtattaaagacgacaataacaaagtaattgcagcaagccttttctctaaaattcctactatgggaagttatgtttactattcgaatcgtggtccagtaatggatttttcagatttaggattagttgattattatttaaaagagttagataaatatttacagcaacatcaatgtttatatgttaaattagatccgtattggttatatcatctatatgataaagatatcgtgccatttgaaggtcgcgagaaaaatgatgccctagtaaacttgtttaaatcacatggttacgagcatcatggctttacaactgagtatgatacatcgagccaagtacgatggatgggcgtattaaaccttgaaggtaaaacacccgaaacattgaaaaagacatttgatagtcaacgtaaacgtaatattaataaagcgataaactatggtgttaaagtcagattccttgaacgtgatgagttcaatcttttcttagatttatatcgtgaaactgaagagcgtgctggatttgtatcaaaaacagatgattatttttataactttattgacacatatggagataaagtattagtaccattagcatatattgaccttgatgaatatgtgttaaagttgcaacaggaattgaatgacaaagaaaatcgtcgtgatcaaatgatggcgaaagaaaacaaatcagataagcaaatgaagaaaattgcagaattagataagcaaattgatcatgatcagcatgaattattgaatgcaagtgaattgagcaaaacggacggcccaattctaaaccttgcttctggcgtttattttgcaaatgcatatgaagtgaattatttctctggtggttcatcagaaaaatataatcaatttatgggaccatacatgatgcattggtttatgattaactattgcttcgataatggctatgatcgttataatttctatggtttatcaggtgattttacggaaaacagtgaagattatggcgtataccgctttaaacgtggatttaatgtacaaatcgaagaattaataggggatttctataaaccaattcataaagtgaaatattggttgttcacaacattggataaattacgtaaaaaattaaagaaa

SEQ ID NO: 4244 - protein, 419 aa, Staphylococcus aureus
  MISC_FEATURE (1)..(419): FemB protein
MKFTELTVTEFDNFVQNPSLESHYFQVKENIVTRENDGFEVVLLGIKDDNNKVIAASLFSKIPTMGSYVYYSNRGPVMDFSDLGLVDYYLKELDKYLQQHQCLYVKLDPYWLYHLYDKDIVPFEGREKNDALVNLFKSHGYEHHGFTTEYDTSSQVRWMGVLNLEGKTPETLKKTFDSQRKRNINKAINYGVKVRFLERDEFNLFLDLYRETEERAGFVSKTDDYFYNFIDTYGDKVLVPLAYIDLDEYVLKLQQELNDKENRRDQMMAKENKSDKQMKKIAELDKQIDHDQHELLNASELSKTDGPILNLASGVYFANAYEVNYFSGGSSEKYNQFMGPYMMHWFMINYCFDNGYDRYNFYGLSGDFTENSEDYGVYRFKRGFNVQIEELIGDFYKPIHKVKYWLFTTLDKLRKKLKK

SEQ ID NO: 4245 - DNA, 1335 bp, Staphylococcus aureus
ttgcagaggggaaatagaaaaactgcaaatacggaaatgaaattaattaacgagagacaaataggagtaatgataatgaagtttacaaatttaacagctaaagagtttggtgcctttacagatagcatgccatacagtcatttcacgcaaactgttggccactatgagttaaagcttgctgaaggttatgaaacacatttagtgggaataaaaaacaataataacgaggtcattgcagcttgcttacttactgctgtacctgttatgaaagtgttcaagtatttttattcaaatcgcggtccagtgattgattatgaaaatcaagaactcgtacactttttctttaatgaattatcaaaatatgttaaaaaacatcgttgtctatacctacatatcgatccatatttaccatatcaatacttgaatcatgatggcgagattacaggtaatgctggtaatgattggttctttgataaaatgagtaacttaggatttgaacatactggattccataaaggatttgatcctgtgctacaaattcgttatcactcagtgttagatttaaaagataaaacagcagatgacatcattaaaaatatggatggacttagaaaaagaaacacgaaaaaagttaaaaagaatggtgttaaagtaagatttttatctgaagaagaactaccaatttttagatcatttatggaagatacgtcagaatcaaaagcttttgctgatcgtgatgacaaattttactacaatcgcttaaaatattacaaagaccgtgtgttagtacctttagcgtatatcaactttgatgaatatattaaagaactaaacgaagagcgtgatattttaaataaagatttaaataaagcgttaaaggatattgaaaaacgtcctgaaaataaaaaagcacataacaagcgagataacttacaacaacaacttgatgcaaatgagcaaaagattgaagaaggtaaacgtctacaagaagaacatggtaatgaattacctatctctgctggtttcttctttatcaatccatttgaagttgtttattatgctggtggtacatcaaatgcattccgtcattttgccggaagttatgcagtgcaatgggaaatgattaattatgcattaaatcatggcattgaccgttataatttctatggtgttagtggtaaatttacagaagatgctgaagatgctggtgtagttaaattcaaaaaaggttacaatgctgaaattattgaatatgttggtgactttattaaaccaattaataaacctgtttacgcagcatataccgcacttaaaaaagttaaagacagaattttt

SEQ ID NO: 4246 - protein, 445 aa, Staphylococcus aureus
  MISC_FEATURE (1)..(445): factor essential for
LQRGNRKTANTEMKLINERQIGVMIMKFTNLTAKEFGAFTDSMPYSHFTQTVGHYELKLAEGYETHLVGIKNNNNEVIAACLLTAVPVMKVFKYFYSNRGPVIDYENQELVHFFFNELSKYVKKHRCLYLHIDPYLPYQYLNHDGEITGNAGNDWFFDKMSNLGFEHTGFHKGFDPVLQIRYHSVLDLKDKTADDIIKNMDGLRKRNTKKVKKNGVKVRFLSEEELPIFRSFMEDTSESKAFADRDDKFYYNRLKYYKDRVLVPLAYINFDEYIKELNEERDILNKDLNKALKDIEKRPENKKAHNKRDNLQQQLDANEQKIEEGKRLQEEHGNELPISAGFFFINPFEVVYYAGGTSNAFRHFAGSYAVQWEMINYALNHGIDRYNFYGVSGKFTEDAEDAGVVKFKKGYNAEIIEYVGDFIKPINKPVYAAYTALKKVKDRIF

SEQ ID NO: 4247 - DNA, 732 bp, Staphylococcus aureus
ttgcaaatgactaaattatttataccttatattatgggcaataaagatttgattgaaaatgcaacattgttgagtgaaaatggtgcagatataattgaaattggagtacctttctctgatccggttgctgatggtccagttatcatggaagcaggtcaacaagcgattaaacaaggcatcacgatagattatattttcaatcaattagaaaaacatggtgatcaaattaagtgtaactatgtattaatgacgtattataatattatttgtcattatggagaacaagcgttttttgaaaaatgtcgagatactggtgtctacggcttaattattcctgatttaccatatgaattatcgcagcgtttaaaacaacaatttagtcactatggcgtcaaaatcatatcgttagttgcgatgactactgatgacaaacgtataaaagatatcgtatcccatgcggaaggctttatttatactgtgacgatgaatgcgacaacagggcaaaacggtgcgtttcatccagaattaaaacgaaaaattgagtcaattaaagcgatagccaatgtgccagttgtcgcaggatttggtataagaacaccacaacatgttgcagatataaaagaggttgcagatggcattgtcattggtagcgaaatcgttaagcgatttaaatctaacacgcgtgaggaaatcattaaatatttacaatctatccaacaaacattgaataat

SEQ ID NO: 4248 - protein, 244 aa, Staphylococcus aureus
  MISC_FEATURE (1)..(244): tryptophan synthase alpha
LQMTKLFIPYIMGNKDLIENATLLSENGADIIEIGVPFSDPVADGPVIMEAGQQAIKQGITIDYIFNQLEKHGDQIKCNYVLMTYYNIICHYGEQAFFEKCRDTGVYGLIIPDLPYELSQRLKQQFSHYGVKIISLVAMTTDDKRIKDIVSHAEGFIYTVTMNATTGQNGAFHPELKRKIESIKAIANVPVVAGFGIRTPQHVADIKEVADGIVIGSEIVKRFKSNTREEIIKYLQSIQQTLNN

SEQ ID NO: 4249 - DNA, 288 bp, Staphylococcus aureus
ttgaaaattctaaagttagaaatattggttttcacaacgaatttaagtagaattatagttaaggaggatttacaaatgaaagtcaataaagccatttatgttattgttgcattatttcttggaggtttaggtattcataaattttatgctgataaatttggacaaggtctttttcacttattatttttctggacaggtatccctaccatcatctcaataatacatgcaatttttgtcatttttactaaaaaagcagataaagatggttatattatattccctaaaaat

SEQ ID NO: 4250 - protein, 96 aa, Staphylococcus aureus
  MISC_FEATURE (1)..(96): hypothetical protein
LKILKLEILVFTTNLSRIIVKEDLQMKVNKAIYVIVALFLGGLGIHKFYADKFGQGLFHLLFFWTGIPTIISIIHAIFVIFTKKADKDGYIIFPKN

SEQ ID NO: 4251 - DNA, 549 bp, Staphylococcus aureus
gtgatacgtcaagcacgtccagaggaccgatttgatattgcgaagttagtttatatggtttgggatgatatggaattagaattggtaaagcatctacctaaagacatggtattagatgcaattgaaaaaagctgtgttgatgcaacatatcgaactttttatcagcatattttagtttatgaagtagaaaataaagtagcaggttgtattattagctatagtggtgaaaatgaattgaaatacgaaaaagcatgggaactacttgacttgccagaaaaaataaaacaatatggcacgccattacctgtaaaagaagctaaagacgatgagtattatatagaaacaattgcgacatttgcagcatatagaggtagaggcatcgcgacaaagttattaacgtcattacttgaatcaaatacacatgttaaatggagtttgaattgcgatattaataatgaagcagcattaaagttatataaaaaagtaggctttatatctgatggacagattgaattatacaagcacatgtatcatcatttaattgttaaa

SEQ ID NO: 4252 - protein, 183 aa, Staphylococcus aureus
  MISC_FEATURE (1)..(183): conserved hypothetical
VIRQARPEDRFDIAKLVYMVWDDMELELVKHLPKDMVLDAIEKSCVDATYRTFYQHILVYEVENKVAGCIISYSGENELKYEKAWELLDLPEKIKQYGTPLPVKEAKDDEYYIETIATFAAYRGRGIATKLLTSLLESNTHVKWSLNCDINNEAALKLYKKVGFISDGQIELYKHMYHHLIVK

SEQ ID NO: 4253 - DNA, 1212 bp, Staphylococcus aureus
atgaataaacaaatacaaacagaagcagatgaattaggtttctttggtgaatatggagggcaatatgttccagaaacattaatgccagcaattattgagttgaaaaaagcttataaagaggcaaaagcagacccagagtttcaaagagaactggaatactatttatcagagtatgtaggacgcgcgacaccacttacatatgctgcatcatatactgaaagcctaggtggcgctaaaatatatttgaaacgagaggatctaaatcatacaggcgcccataaaattaataatgcgttaggtcaagcgttgcttgctaaaagaatgggcaagaagaagcttgttgctgaaactggtgcgggtcaacatggtgtagctagtgctacggttgctgcattatttgatatggaacttgttgtctttatgggaagtgaagatattaaaagacaacaacttaatgtatttagaatggaattacttggtgcaaaggttgtggcagttgaagatggtcaagggactttatcggatgcagttaataaagcattgcaatattgggtaagtcatgtagatgatacacattatttattaggttctgcattaggtccagacccgttcccaacgattgttagagattttcagagtgtgattggtaaagaaataaaatcacagatattgaagaaagaaggtcgacttccggatgcaattgtagcatgtatcggtggtggctcaaatgcaatcggtacattttatccatttattaaagatgatgttgcattatacggtgttgaagccgcaggtcaaggcgatgatactgataaacatgcacttgcaattggcaaaggatcacctggcgtattacatggtactaaaatgtatttaattcaagatgaagatgggcaagtgcaactagcacattctatttcagcaggacttgattatcctggtattggaccagaacattcttattaccacgacattggtagagtaacttttgaaaatgctagtgatacacaagcaatgaatgctttaatcaactttacaaaacatgaaggtattatacctgcaattgaaagtgcacatgcactgagttatgttgaaagactagcgcctacgatgtcgaaagaagatattattgtagtaactatttctggacgtggcgataaagatatggaaacaattagacaatatatggtagagcgaggtcttgcaaatgac

SEQ ID NO: 4254 - protein, 404 aa, Staphylococcus aureus
  MISC_FEATURE (1)..(404): tryptophan synthase beta
MNKQIQTEADELGFFGEYGGQYVPETLMPAIIELKKAYKEAKADPEFQRELEYYLSEYVGRATPLTYAASYTESLGGAKIYLKREDLNHTGAHKINNALGQALLAKRMGKKKLVAETGAGQHGVASATVAALFDMELVVFMGSEDIKRQQLNVFRMELLGAKVVAVEDGQGTLSDAVNKALQYWVSHVDDTHYLLGSALGPDPFPTIVRDFQSVIGKEIKSQILKKEGRLPDAIVACIGGGSNAIGTFYPFIKDDVALYGVEAAGQGDDTDKHALAIGKGSPGVLHGTKMYLIQDEDGQVQLAHSISAGLDYPGIGPEHSYYHDIGRVTFENASDTQAMNALINFTKHEGIIPAIESAHALSYVERLAPTMSKEDIIVVTISGRGDKDMETIRQYMVERGLAND

SEQ ID NO: 4255 - DNA, 633 bp, Staphylococcus aureus
atgatgaaattgaaattttgtggctttacatcaataaaggatgttacagcggccagtcaattacctattgatgcgataggtttcatccattatgaaaaaagtaaaaggcatcaaacaattacccaaataaaaaagttagcgtctgctgttccaaatcatatcgataaagtatgtgtcatggtaaatcctgatttaacaacaattgaacacgtattaagcaatacgtcaattaacacaatacagttacacggcacagaatctattgattttatacaggaaattaaaaagaaatattcaagcattaaaatcactaaagctttagctgcagatgaaaacataatccaaaacataaataaatataaagggttcgtagatttatttattatcgacacaccctcagtgtcgtatggtggtaccggtcaaacatatgactggactattttgaagcacataaaagacataccttatttgatagcaggaggcattaactctgaaaatattcaaacagttaatcaacttaaattatcacatcaaggttatgatcttgcatcaggtatagaagtaaatgggcgaaaagatatagaaaaaatgacagcaattgtaaatattgtgaaaggagatagagacaatgaa

SEQ ID NO: 4256 - protein, 211 aa, Staphylococcus aureus
  MISC_FEATURE (1)..(211): phosphoriborylanthranilate
MMKLKFCGFTSIKDVTAASQLPIDAIGFIHYEKSKRHQTITQIKKLASAVPNHIDKVCVMVNPDLTTIEHVLSNTSINTIQLHGTESIDFIQEIKKKYSSIKITKALAADENIIQNINKYKGFVDLFIIDTPSVSYGGTGQTYDWTILKHIKDIPYLIAGGINSENIQTVNQLKLSHQGYDLASGIEVNGRKDIEKMTAIVNIVKGDRDNE

SEQ ID NO: 4257 - DNA, 789 bp, Staphylococcus aureus
gtgaataatatgacgattttatcagaaattgttaaatataaacagtcacttttacaaaatggctattatcaagacaaacttaataccttgaaaagtgtgaagattcagaataaaaaatcttttataaacgcaattgagaaagaaccaaagctagcaattattgcagaaattaaatcgaagagtcctacagttaatgacttacctgaacgagatttatcgcaacaaatctcagattatgaccaatatggtgcaaatgccgtgtccattttaactgatgaaaagtactttggtggtagttttgaaagattacaagcattgacgacaaaaacaacattacccgtattatgcaaagactttattatagacccgcttcaaattgatgttgctaaacaagctggtgcatctatgattttattgatcgttaacatcttatctgataaacaattgaaagatttatataactacgctatatcgcaaaatctagaagtgttagttgaagtacatgatcgccatgaattagaacgtgcctataaggttaatgctaaattgattggtgtaaataacagggacttaaaacgatttgttacaaatgtggaacatacaaatactattttagaaaataaaaaaacaaatcattattatatttctgaaagtggtattcacgatgcatctgatgtaagaaaaatcttgcatagtggtatcgatggcttactaataggtgaggcgcttatgcgttgtgacaatctatctgaatttttaccacaactgaaaatgcaaaaggtgaagtca

SEQ ID NO: 4258 - protein, 263 aa, Staphylococcus aureus
  MISC_FEATURE (1)..(263): indole-3-glycerol phosphate
VNNMTILSEIVKYKQSLLQNGYYQDKLNTLKSVKIQNKKSFINAIEKEPKLAIIAEIKSKSPTVNDLPERDLSQQISDYDQYGANAVSILTDEKYFGGSFERLQALTTKTTLPVLCKDFIIDPLQIDVAKQAGASMILLIVNILSDKQLKDLYNYAISQNLEVLVEVHDRHELERAYKVNAKLIGVNNRDLKRFVTNVEHTNTILENKKTNHYYISESGIHDASDVRKILHSGIDGLLIGEALMRCDNLSEFLPQLKMQKVKS

SEQ ID NO: 4259 - DNA, 1005 bp, Staphylococcus aureus
atgaaaaccatgacattactaacaagaataaaaactgaaactatattacttgaaagcgacattaaagagctaatcgatatacttatttctcctagtattggaactgatattaaatatgaattacttagttcctattcggagcgagaaatccaacaacaagaattaacatatattgtacgtagcttaattaatacaatgtatccacatcaaccatgttatgaaggggctatgtgtgtgtgcggcacaggtggtgacaagtcaaatagtttcaacatttcaacgactgttgcttttgttgtagcaagtgctggcgtaaaagttataaaacatggtaataaaagtattacctcaaattcaggtagtacggatttgttaaatcaaatgaacatacaaacaacaactgttgatgatacacctaaccaattaaatgaaaaagaccttgtattcattggtgcaactgaatcatatccaatcatgaagtatatgcaaccagttagaaaaatgattggaaagcctacaatattaaaccttgtgggtccattaattaatccatatcacttaacgtatcaaatggtaggcgtctttgatcctacaaagttaaagttagttgctaaaacgattaaagatttaggtagaaaacgtgcaatcgttttacatggtgcaaatggtatggatgaagcaacactatctggtgataatttgatatatgaattgactgaagatggagaaatcaaaaattacacattaaatgcgactgattatggtttgaaacatgcgccgaatagtgattttaaaggcggttcacctgaagaaaatttagcaatctcccttaatatcttgaatggtaaagatcagtcaagtcgacgtgatgttgtcttactaaatgcgggtttaagcctttatgttgcagagaaagtggataccatcgcagaaggcatagaacttgcaactacattgattgataatggtgaagcattggaaaaataccatcaaatgagaggtgaa

SEQ ID NO: 4260 - protein, 335 aa, Staphylococcus aureus
  MISC_FEATURE (1)..(335): anthranilate
MKTMTLLTRIKTETILLESDIKELIDILISPSIGTDIKYELLSSYSEREIQQQELTYIVRSLINTMYPHQPCYEGAMCVCGTGGDKSNSFNISTTVAFVVASAGVKVIKHGNKSITSNSGSTDLLNQMNIQTTTVDDTPNQLNEKDLVFIGATESYPIMKYMQPVRKMIGKPTILNLVGPLINPYHLTYQMVGVFDPTKLKLVAKTIKDLGRKRAIVLHGANGMDEATLSGDNLIYELTEDGEIKNYTLNATDYGLKHAPNSDFKGGSPEENLAISLNILNGKDQSSRRDVVLLNAGLSLYVAEKVDTIAEGIELATTLIDNGEALEKYHQMRGE

SEQ ID NO: 4261 - DNA, 564 bp, Staphylococcus aureus
atgatcttagttgtagataattatgattcctttacatataacctagtggatattgttgctcaacatactgacgtcattgttcaataccctgatgatgataatgtgctgaatcaatcggtggacgctgttattatatctcctggtccagggcatccattagacgatcaacagttaatgaaaatcatatcaacctatcaacacaaacccattttaggtatttgtttaggggctcaggcactgacttgttactacggtggagaagtcattaaaggcgacaaggttatgcacggcaaagttgatacactaaaggttatatcgcatcatcaacatctgttatatcaagatataccagaacagttttcaattatgagatatcattcattaataagtaaccctgacaattttccagaagaattgaaaattactggacgtaccaaagattgtatacagtcattcgagcataaagaaagaccgcattatggtattcagtaccatcctgaatcatttgctacagactatggtgtcaaaataattacaaatttcattaatctagtgaaggaagga

SEQ ID NO: 4262 - protein, 188 aa, Staphylococcus aureus
  MISC_FEATURE (1)..(188): anthranilate synthase
MILVVDNYDSFTYNLVDIVAQHTDVIVQYPDDDNVLNQSVDAVIISPGPGHPLDDQQLMKIISTYQHKPILGICLGAQALTCYYGGEVIKGDKVMHGKVDTLKVISHHQHLLYQDIPEQFSIMRYHSLISNPDNFPEELKITGRTKDCIQSFEHKERPHYGIQYHPESFATDYGVKIITNFINLVKEG

SEQ ID NO: 4263 - DNA, 1473 bp, Staphylococcus aureus
gtggtaccacgcgtcagcgtcctttatattgataaggatgctggcgcttttttgaaaggagcgtatagaatggatatattttataaaaaaataaaagcaaatgtaacgcccgaagttttagcacaacttcattccaagaagatcattttggaaagtacaaatcaacaacaaactaaaggtcgctattcagttgttatttttgatatttatggcactttaactttagataatgatgtattatcagtaagtactttaaaagaatcgtatcaaatcactgaaagaccgtaccattatttaacgactaaaataaatgaagactaccataatattcaagatgagcaacttaagtcattaccatttatatctggatatgttgggacgtgtagctttgatttagtaagacatgaatttcctaaattgcaatcaatacaattagaagatcacaagcagcacgatgtaaggttatatatggttgaacaagtttatgtatttgaccattacaaagatgagttatatatcatcgcgacgaatcaattttcaaattcaacaaaatcagatcttgagaatcgagttattaagtctatcgaagacttaactaaaatccaaccattcatgcctacacaagattttgattttaaaactaaagaaattcaatcaaacatttctgaagaaagatttatcgaaatgattcagtatttcaaagagaaaataacagaaggggatatgttccaagttgtgccatcaagaatttacaaatatgcgcatcatgctagtcagcatttaaatcaactttcgtttcaactgtatcaaaatttaaaacgacaaaacccaagtccatatatgtattatcttaatatcgatcaaccatatattgtcggtagttctcccgaaagtttcgtaagtgtcaaagatcaaattgtaacaactaatcctattgcaggtacgattcaacgtggtgagacgacacaaatagataatgagaatatgaaacaactacttaatgatccaaaagaatgcagcgaacatcgtatgctagttgatttaggacgtaatgatattcatagagtaagtaaaatcggtacctcaaaaattactaaattaatggttattgaaaaatatgaacatgttatgcatatcgtaagtgaagtcacaggtaaaataaatcaaaatttatcgccaatgacagttattgcgaatttattaccaacaggtaccgtttcaggtgcaccaaaattacgtgcaattgaaagaatatatgaacaatatccacataaacggggcgtttatagtggtggtgttggatacataaattgtaatcataacttagattttgcattagcaattcgaacgatgatgatagatgagcagtatatcaacgtagaagctggttgtggcgttgtatatgattctattcctgaaaaagaactgaatgaaacgaaattgaaagctaaaagcttattggaggtgagccca

SEQ ID NO: 4264 - protein, 491 aa, Staphylococcus aureus
  MISC_FEATURE (1)..(491): hypothetical protein
VVPRVSVLYIDKDAGAFLKGAYRMDIFYKKIKANVTPEVLAQLHSKKIILESTNQQQTKGRYSVVIFDIYGTLTLDNDVLSVSTLKESYQITERPYHYLTTKINEDYHNIQDEQLKSLPFISGYVGTCSFDLVRHEFPKLQSIQLEDHKQHDVRLYMVEQVYVFDHYKDELYIIATNQFSNSTKSDLENRVIKSIEDLTKIQPFMPTQDFDFKTKEIQSNISEERFIEMIQYFKEKITEGDMFQVVPSRIYKYAHHASQHLNQLSFQLYQNLKRQNPSPYMYYLNIDQPYIVGSSPESFVSVKDQIVTTNPIAGTIQRGETTQIDNENMKQLLNDPKECSEHRMLVDLGRNDIHRVSKIGTSKITKLMVIEKYEHVMHIVSEVTGKINQNLSPMTVIANLLPTGTVSGAPKLRAIERIYEQYPHKRGVYSGGVGYINCNHNLDFALAIRTMMIDEQYINVEAGCGVVYDSIPEKELNETKLKAKSLLEVSP

SEQ ID NO: 4265 - DNA, 1029 bp, Staphylococcus aureus
atggaaccaatattagaaatgattaaaacattaacaggtattaatagtccttcaggagacacagaagaagcaattcaatttgtcgaaaaatatgcaaaagacttgggttatcaaacaacactaacaaataaaggtgcgttattaataacagtgccaggcaaaaatgatgaagtacaacgctgtattactgctcatgttgatactttaggtgcaatggttaaagaaattaaagaagatggtcgcttagcaatagaattaattggaggattcacgtataacgcgattgagggtgaatattgccaaattaaaactgatgctggtcaaatatatacaggaacaatttgtctgcatgaaacaagtgttcatgtatatagaaataatcatgaaatacctagagatcaaaagcatatggaaataagaattgatgaagtaactacatcagaagaagatacaaagagtttaggtatttcagtaggtgattttgttagctttgatccacgtacagttatcacgtcatcaggttttattaaatctcgtcatttagatgataaagctagcgtagcgatgatactacaattactaaagaaattaaaagaagagcaaataatattaccacatacaacgcaattttatatttctaataacgaagaaataggttacggtgcaaatgcatcaattgattcgaaaatcaaagaatatattgcattagatatgggcgcgttgggagacggtcaagcatcggatgaatatacagtttctatttgtgccaaagatgcttcaggtccatatcataagcaattgaaatcgcacctagttaatctttgcaaaataaataacattccatataaagtagacatatatccatattatggttcagatgcttcagcagctttacatgctggtgcggatatcagacatggtttatttggcgctggcattgaatcatctcatgcaatggaacgaacacatattgattctattaaagcgacagagaaattactatatgcatattgcttatcaccaattgag

SEQ ID NO: 4266 - protein, 343 aa, Staphylococcus aureus
  MISC_FEATURE (1)..(343): hypothetical protein
MEPILEMIKTLTGINSPSGDTEEAIQFVEKYAKDLGYQTTLTNKGALLITVPGKNDEVQRCITAHVDTLGAMVKEIKEDGRLAIELIGGFTYNAIEGEYCQIKTDAGQIYTGTICLHETSVHVYRNNHEIPRDQKHMEIRIDEVTTSEEDTKSLGISVGDFVSFDPRTVITSSGFIKSRHLDDKASVAMILQLLKKLKEEQIILPHTTQFYISNNEEIGYGANASIDSKIKEYIALDMGALGDGQASDEYTVSICAKDASGPYHKQLKSHLVNLCKINNIPYKVDIYPYYGSDASAALHAGADIRHGLFGAGIESSHAMERTHIDSIKATEKLLYAYCLSPIE

SEQ ID NO: 4267 - DNA, 1098 bp, Staphylococcus aureus
gtgatttatatgacaacagttttatttgttgggcttggattaattggtggaagtcttgctagcaatataaaataccataaccctaatactaatattattgcatacgatgcagatatttctcagttagataaagctaaatcaatcggcattattaatgaaaaatgtttaaattatagtgaagctattaaaaaagccgatgtaattatttatgcaacacctgttgctatcacaaataaatatcttagcgagcttatagatatgccaactaaacctggtgttattgtttctgatactggtagtactaaagcaatgatacagcaacacgaatgcaatttattaaagcataatattcatttagtcagtggtcatccaatggctggtagtcataaatctggtgtactaaatgctaaaaagcacttatttgaaaacgcttattatattttagtctacaatgagccaagaaatgagcaagcagcaaacacgttaaaagaactgttatcacctactcttgctaaatttattgtaactactgctgaagaacacgactacgtaacaagcgtcgtaagtcatttacctcatatcgttgcatctagtttagttcatgttagtcaaaagaacggtcaagaacatcatttagttaataaacttgcagctggtggttttcgtgatatcactcgtatagctagtagtaatgcacaaatgtggaaagatatcaccttgagtaataaaacgtatattttagaaatgattcgacagctaaaaagtcagtttcaagatttagaaagactaattgaaagcaatgattctgaaaaattgttatcattttttgcccaagctaaatcgtatcgcgacgcactacccgctaaacaactaggtggactaaatactgcgtatgatctatatgtagacattccggatgaatcaggtatgataagtaaagtgacttatatcctgagtttacataacatatctataagcaacttaagaatcttagaagtacgcgaagatatatacggtgctttaaaaattagtttcaaaaaccctactgaccgagaacgcggtatgcaagcattgagtgattttgattgttatatccaa

SEQ ID NO: 4268 - protein, 366 aa, Staphylococcus aureus
  MISC_FEATURE (1)..(366): prephenate dehydrogenase
VIYMTTVLFVGLGLIGGSLASNIKYHNPNTNIIAYDADISQLDKAKSIGIINEKCLNYSEAIKKADVIIYATPVAITNKYLSELIDMPTKPGVIVSDTGSTKAMIQQHECNLLKHNIHLVSGHPMAGSHKSGVLNAKKHLFENAYYILVYNEPRNEQAANTLKELLSPTLAKFIVTTAEEHDYVTSVVSHLPHIVASSLVHVSQKNGQEHHLVNKLAAGGFRDITRIASSNAQMWKDITLSNKTYILEMIRQLKSQFQDLERLIESNDSEKLLSFFAQAKSYRDALPAKQLGGLNTAYDLYVDIPDESGMISKVTYILSLHNISISNLRILEVREDIYGALKISFKNPTDRERGMQALSDFDCYIQ

SEQ ID NO: 4269 - DNA, 1260 bp, Staphylococcus aureus
gtgtataattatcatttattagaagatagggatgttctatgtattgaccaaaaaagtttttttgcgagtgtttcttgtattgaaaaggggctagatccattagaaacaaagctagctgttgttgcagatactaagcgtcagggttctgtaatattggctgcgacacctaaattaaaagaattaggcatcaagacagggtcgcgattgtttgaaataccacatagaaatgatatttacattatcaatccaagtatgcgtaaatatcttaatgtttcagttgctatttctaagattgcattgcgttatattccacctgaagatttacaccaatatagtattgacgaattttttatggatgttactgatagctatcatagatttagttctacagtacatgcattttgcgaaagacttaaacgtgaaatttatgaagaaacaggcatttattgtactgtgggcattggttctaatatgttattaagtaaaattgctatggatgttgaagcgaagcatagtcaaaatggtatagctgaatggcgatatcaagatgtaccaacgaaattatggccaattcagcccttgcgagatttttggggtattaatcgtcgaacagaagccaaattgaataaaagaggaatttttactataggagatttagcgaaatatccatataaatttttaaaaaaagagttcggtattttaggtgttgatatgcatctacatgcgaatgggatagatcagagtaaagtacgtgaaaagcacaagatcagcaatccatcgatatgcaaaagtcaaatattaatgagagattatcattttgatgaagcaaaagtagtaatgcaagagttaattgaagatgttgctagcagagttcgagcaagaaaaaaagtggcaagaacgatacattttgcctttggctatagtgatgaaggcggtgtacataagcaatatactttgaaagatccaacaaacttagaaaaagatatttataaagtagtaatgcatttcgcagataaattatgtaataaacaagcactatatcgtacgctaagtatatctttgagtcaatttattaatgaggatgagcgacagttaagtctgtttgaagatgaataccaacgcaaacgtgacgaatgtctagctaaaacgatagaccaattacatttgaaatacggcaaaggtattgtgtccaaagcagtatcgtttacagaagcaggtacaaaacacggcagattaggtttaatggctggacataaaatg

SEQ ID NO: 4270 - protein, 420 aa, Staphylococcus aureus
  MISC_FEATURE (1)..(420): hypothetical protein
VYNYHLLEDRDVLCIDQKSFFASVSCIEKGLDPLETKLAVVADTKRQGSVILAATPKLKELGIKTGSRLFEIPHRNDIYIINPSMRKYLNVSVAISKIALRYIPPEDLHQYSIDEFFMDVTDSYHRFSSTVHAFCERLKREIYEETGIYCTVGIGSNMLLSKIAMDVEAKHSQNGIAEWRYQDVPTKLWPIQPLRDFWGINRRTEAKLNKRGIFTIGDLAKYPYKFLKKEFGILGVDMHLHANGIDQSKVREKHKISNPSICKSQILMRDYHFDEAKVVMQELIEDVASRVRARKKVARTIHFAFGYSDEGGVHKQYTLKDPTNLEKDIYKVVMHFADKLCNKQALYRTLSISLSQFINEDERQLSLFEDEYQRKRDECLAKTIDQLHLKYGKGIVSKAVSFTEAGTKHGRLGLMAGHKM

SEQ ID NO: 4271 - DNA, 186 bp, Staphylococcus aureus
atgatgccaatcgtcaatgtaaaattattagaaggtcgttcggatgaacaattaaaaaatttagttagcgaagtaactgacgccgtagaaaaaacaacgggggcaaatagacaagcaattcacgttgttatagaagaaatgaaaccaaaccattatggtgtggctggcgtaagaaagtcagatcaa

SEQ ID NO: 4272 - protein, 62 aa, Staphylococcus aureus
  MISC_FEATURE (1)..(62): 4-oxalocrotonate
MMPIVNVKLLEGRSDEQLKNLVSEVTDAVEKTTGANRQAIHVVIEEMKPNHYGVAGVRKSDQ

SEQ ID NO: 4273 - DNA, 102 bp, Staphylococcus aureus
atgaagattaaaaataaacaaggcgatttctatcatactcagatagaagtcgccttgttcgttttcaaagaattaattggcatgcatcttatgaagaattat

SEQ ID NO: 4274 - protein, 34 aa, Staphylococcus aureus
MKIKNKQGDFYHTQIEVALFVFKELIGMHLMKNY

SEQ ID NO: 4275 - DNA, 981 bp, Staphylococcus aureus
atggataaagaaactaatgacaacgaatatagacgtcaaagtgaacatcgcacttcggcgcctaagcgaaaaaagaagaagaaaattaggaaattacctatcattcttctgattgttgtaattttacttatcgcattagttgtatatattgtacatagttacaatagcggtgtagaatatgccaagaaacatgcgaaagatgttaaagtacatcaatttaatggaccagtaaaaaatgatggtaaaatttctattcttgtactcggtgcagataaagcacaaggtggacaatcaagaacagattctatcatggttgttcaatatgactttatcaataaaaagatgaaaatgatgtctgtcatgcgtgatatttatgcagatattccaggatatggaaaacacaaaattaattcagcatacgctttaggtggtccagagctacttagaaaaacacttgataaaaatttaggaattaatcctgaatattatgcagtagttgattttactggatttgagaaaatgattgatgaattaatgcctgaaggtgtaccaattaatgtcgaaaaagatatgtcgaaaaatattggtgtatctttgaaaaagggtaaccataggttgaatggtaaagaattacttggttatgcaagattccgtcacgaccctgaaggtgacttcggacgcgtgcgacgtcagcaacaagtgatgcaaacattgaaaaaagaaatggttaattttagaacagttgttaaattaccaaaagttgcaggtattttaagaggctatgtgaatacaaacattcctgattcagggattttccaaacaggtttgagttttggtatccgaggtgaaaaagatgttaagtcattgactgtgccaatcaagaactcatacgaagatgtcaatacaaatactgatggtagtgcattacagattaataaaaacacaaataaacaagctattaaagactttttagatgaagat

SEQ ID NO: 4276 - protein, 327 aa, Staphylococcus aureus
  MISC_FEATURE (1)..(327): peptide methionine
MDKETNDNEYRRQSEHRTSAPKRKKKKKIRKLPIILLIVVILLIALVVYIVHSYNSGVEYAKKHAKDVKVHQFNGPVKNDGKISILVLGADKAQGGQSRTDSIMVVQYDFINKKMKMMSVMRDIYADIPGYGKHKINSAYALGGPELLRKTLDKNLGINPEYYAVVDFTGFEKMIDELMPEGVPINVEKDMSKNIGVSLKKGNHRLNGKELLGYARFRHDPEGDFGRVRRQQQVMQTLKKEMVNFRTVVKLPKVAGILRGYVNTNIPDSGIFQTGLSFGIRGEKDVKSLTVPIKNSYEDVNTNTDGSALQINKNTNKQAIKDFLDED

SEQ ID NO: 4277 - DNA, 516 bp, Staphylococcus aureus
atgtcaaaaatgaatattaatacagcttattttgccggaggttgcttttggtgtatgacgaaaccatttgacacctttgacggcatagaaaaagtaacttctggatatatgggcggacatattgaaaatcctacttacgaacaagtaaaatcaggtacgagtggtcatttagaaactgttgaaattcaatatgatgttgcattattctcatacaataagttattagaaatatttttctcagtcattgacccattagatacaggtggtcaatatcaagaccgtggtcctcaatatcaaacagctattttctacactaatgatcatcaaaaagaactcgctgagacttatatcgagcagcttaaaaatacgattaatgctgataaggcaattgcaacaaaaatattaccagcgtcacaattttacaaagccgaagactatcaccaagatttttataagaaaaatccagagcgctatgcagaagaacaaaaaatacgccaagaatacaaaaataagcaa

SEQ ID NO: 4278 - protein, 172 aa, Staphylococcus aureus
  MISC_FEATURE (1)..(172): peptide methionine
MSKMNINTAYFAGGCFWCMTKPFDTFDGIEKVTSGYMGGHIENPTYEQVKSGTSGHLETVEIQYDVALFSYNKLLEIFFSVIDPLDTGGQYQDRGPQYQTAIFYTNDHQKELAETYIEQLKNTINADKAIATKILPASQFYKAEDYHQDFYKKNPERYAEEQKIRQEYKNKQ

SEQ ID NO: 4279 - DNA, 2520 bp, Staphylococcus aureus
atgaatcaggaagttaaaaacaaaatattttcaatcttaaaaattacgtttgctacagctttatttatttttgtagcaatcacattgtatcgggagttatctggtattaactttaaagatacgttggttgaatttagtaagattaaccgtatgtccttagtgttactatttattggtggtggggcatcgcttgttattctatcaatgtatgatgtgattttatctagagctttaaaaatggatatatccttaggcaaagttttaagagtaagttatatcatcaatgcattgaatgcgattgtaggtttcggtggctttattggtgcaggcgttagagcaatggtttataaaaactatacgcatgataaaaagaaattagttcactttatatccttaatacttatttcaatgttgacaggtttaagcttattatcattgctaattgtattccatgttttcgatgcatctttaatcttagataagattacatgggtaagatgggtattatatgtagtgtcatttttcttaccattattcattatttattcaatggttagaccacccgataaaaacaatcgttttgtaggattgtactgcactttagtgtcgtgtgttgaatggttagcagctgcagttgtattatatttctgtggtgtaattgttgacgctcatgtatcattcatgtcctttattgcaatatttatcattgctgcattatcaggtttagtcagctttattcctggtggtttcggcgctttcgatttagttgtattactaggatttaaaactttaggtgtccctgaggaaaaagtattattaatgctacttctatatcgttttgcgtactattttgtaccggtaattattgcattaattttatcatcatttgaatttggtacatcagctaagaagtacattgagggatctaaatactttattcctgctaaagatgttacgtcatttttaatgtcttatcaaaaggatattattgctaaaattccatcattatcattagcaattttagtattctttacaagtatgatcttttttgtaaataacttaacgattgtttacgatgctttatatgatggaaatcacttaacgtattatattctattggcaattcatactagtgcttgtttattacttttactgaatgtagttggtatttataagcaaagtagacgtgccattatctttgctatgatttcaattttattaatcacagtggcgacattcttcacttacgcttcatatattttaataacatggttagctattatttttgttctgcttattgtagctttccgtagagcacgtaggttgaaacgcccagtaagaatgagaaatatagttgcaatgcttttattcagtttatttattttatatgttaaccatatatttattgctggaacgttatatgcattagatatttatacgattgaaatgcatacatctgtattgcgctattacttctggcttacgattttaatcatcgctatcatcataggtatgattgcatggttgtttgattatcaatttagcaaagtacgtatttcttctaaaattgaagattgcgaggagattattaatcagtacggcggtaattatttgagtcacttgatatatagtggtgacaagcagtttttcactaatgaaaataaaacagcatttttaatgtatcgttataaagcaagttcattagtggttcttggagatccgttaggtgatgaaaatgcctttgatgaattgttagaagcattctataattacgctgagtatttaggctatgatgttatattctatcaagttacagatcaacacatgcctttatatcataatttcggtaaccaatttttcaaattaggtgaagaagcaattattgatttaacgcaattttcaacttcaggtaaaaaacgccgtggatttagagcgactttaaataaattcgatgaacttaatatttcgttcgaaattattgaaccaccgttttcaactgaatttataaatgaacttcaacatgtaagtgatttatggctagataatcgtcaggaaatgcatttctctgttggtgaatttaatgaagaatacttatctaaagcgccaattggtgtaatgcgaaatgaagaaaatgaagtaattgcattttgtagtttaatgccaacatactttaatgatgccatttcagtcgatttaattagatggttgccagagttagatttaccattaatggatggtctatacttgcatatgttactttggagtaaagaacaaggttatacaaaatttaatatgggtatggcaacgttatcgaacgttggtcaattgcattattcatatttaagagaacgacttgcaggccgtgtctttgaacatttcaacggtctatatcgtttccaaggattacgtcgttataaatctaaatataatccgaattgggaaccacgctttttagtttatcgtaaagataattcgctttgggaatcactttctaaagtaatgcgtgtaatacgtcacaaa

SEQ ID NO: 4280 - protein, 840 aa, Staphylococcus aureus
  MISC_FEATURE (1)..(840): oxacillin
MNQEVKNKIFSILKITFATALFIFVAITLYRELSGINFKDTLVEFSKINRMSLVLLFIGGGASLVILSMYDVILSRALKMDISLGKVLRVSYIINALNAIVGFGGFIGAGVRAMVYKNYTHDKKKLVHFISLILISMLTGLSLLSLLIVFHVFDASLILDKITWVRWVLYVVSFFLPLFIIYSMVRPPDKNNRFVGLYCTLVSCVEWLAAAVVLYFCGVIVDAHVSFMSFIAIFIIAALSGLVSFIPGGFGAFDLVVLLGFKTLGVPEEKVLLMLLLYRFAYYFVPVIIALILSSFEFGTSAKKYIEGSKYFIPAKDVTSFLMSYQKDIIAKIPSLSLAILVFFTSMIFFVNNLTIVYDALYDGNHLTYYILLAIHTSACLLLLLNVVGIYKQSRRAIIFAMISILLITVATFFTYASYILITWLAIIFVLLIVAFRRARRLKRPVRMRNIVAMLLFSLFILYVNHIFIAGTLYALDIYTIEMHTSVLRYYFWLTILIIAIIIGMIAWLFDYQFSKVRISSKIEDCEEIINQYGGNYLSHLIYSGDKQFFTNENKTAFLMYRYKASSLVVLGDPLGDENAFDELLEAFYNYAEYLGYDVIFYQVTDQHMPLYHNFGNQFFKLGEEAIIDLTQFSTSGKKRRGFRATLNKFDELNISFEIIEPPFSTEFINELQHVSDLWLDNRQEMHFSVGEFNEEYLSKAPIGVMRNEENEVIAFCSLMPTYFNDAISVDLIRWLPELDLPLMDGLYLHMLLWSKEQGYTKFNMGMATLSNVGQLHYSYLRERLAGRVFEHFNGLYRFQGLRRYKSKYNPNWEPRFLVYRKDNSLWESLSKVMRVIRHK

(The sequence listing continues in the following parts.)

The invention claimed is:

1. An isolated protein comprising the amino acid sequence of SEQ ID NO:1168.

2. An isolated hybrid protein represented by the formula NH$_2$—A—[—X—L—]$_n$—B—COOH, wherein X is the amino acid sequence of SEQ ID NO: 1168, L is an optional linker amino acid sequence, A is an optional N-terminal amino acid sequence, B is an optional C-terminal amino acid sequence, and n is an integer greater than 1.

3. A composition comprising the isolated protein of claim 1.

4. A composition according to claim 3 being a immunogenic composition or a diagnostic composition.

5. A composition according to claim 3 or claim 4 further comprising a pharmaceutically acceptable carrier.

6. The composition of claim 3 further comprising one or more of the following antigens:
a protein antigen from *Helicobacter pylori;*
a protein antigen from *N.meningitidis* serogroup B;
an outer-membrane vesicle (OMV) preparation from *N meningitidis;*
a saccharide antigen from *N.meningitidis* serogroup A, C, W135 and/or Y;
a saccharide antigen from *Streptococcus pneumoniae;*
an antigen from hepatitis A virus;
an antigen from hepatitis B virus;
an antigen from hepatitis C virus;
an antigen from *Bordetella pertussis;*
a diphtheria antigen;
a tetanus antigen;
a saccharide antigen from *Haemophilus influenzae* B.;
an antigen from *N gonorrhoeae;*
an antigen from *Chlamydia pneumoniae;*
an antigen from *Streptococcus agalactiae;*
an antigen from *Streptococcus pyogenes;*
an antigen from *Chlamydia trachomatis;*
an antigen from *Porphyromonas gingivalis;*
polio antigen(s);
rabies antigen(s);
measles, mumps and/or rubella antigens;
influenza antigen(s); or
an antigen from *Moraxella catarrhalis.*

7. A composition according to claim 3, further comprising one or more isolated proteins comprising an amino acid sequence selected from the group consisting of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1290, 1292, 1294, 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2446, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, 2594, 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, 2646, 2648, 2650, 2652, 2654, 2656, 2658, 2660, 2662, 2664, 2666, 2668, 2670, 2672, 2674, 2676, 2678, 2680, 2682, 2684, 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, 2774, 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, 2882, 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, 3016, 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094, 3096, 3098, 3100, 3102, 3104, 3106, 3108, 3110, 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, 3180, 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398, 3400, 3402, 3404, 3406, 3408, 3410, 3412, 3414, 3416, 3418, 3420, 3422, 3424, 3426, 3428, 3430, 3432, 3434, 3436, 3438, 3440, 3442, 3444, 3446, 3448, 3450, 3452, 3454, 3456, 3458, 3460, 3462, 3464, 3466, 3468, 3470, 3472, 3474, 3476, 3478, 3480, 3482, 3484, 3486, 3488, 3490, 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554, 3556, 3558, 3560, 3562; 3564, 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, 3652, 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3760, 3762, 3764, 3766, 3768, 3770, 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, 3850, 3852, 3854, 3856, 3858, 3860, 3862, 3864, 3866, 3868, 3870, 3872, 3874, 3876, 3878, 3880, 3882, 3884, 3886, 3888, 3890, 3892, 3894, 3896, 3898, 3900, 3902, 3904, 3906, 3908, 3910, 3912, 3914, 3916, 3918, 3920; 3922, 3924, 3926, 3928, 3930, 3932, 3934, 3936, 3938, 3940, 3942, 3944, 3946, 3948, 3950, 3952, 3954, 3956, 3958, 3960, 3962, 3964, 3966, 3968, 3970, 3972, 3974, 3976, 3978, 3980, 3982, 3984, 3986, 3988, 3990, 3992, 3994, 3996, 3998, 4000, 4002, 4004, 4006, 4008, 4010, 4012, 4014, 4016, 4018, 4020, 4022, 4024, 4026, 4028, 4030, 4032, 4034, 4036, 4038, 4040, 4042, 4044, 4046, 4048, 4050, 4052, 4054, 4056, 4058, 4060, 4062, 4064, 4066, 4068, 4070, 4072, 4074, 4076, 4078, 4080, 4082, 4084, 4086, 4088, 4090, 4092, 4094, 4096, 4098, 4100, 4102, 4104, 4106, 4108, 4110, 4112, 4114, 4116, 4118, 4120, 4122, 4124, 4126, 4128, 4130, 4132, 4134, 4136, 4138, 4140, 4142, 4144, 4146, 4148, 4150, 4152, 4154, 4156, 4158, 4160, 4162, 4164, 4166, 4168, 4170, 4172, 4174, 4176, 4178, 4180, 4182, 4184, 4186, 4188, 4190, 4192, 4194, 4196, 4198, 4200, 4202, 4204, 4206, 4208, 4210, 4212, 4214, 4216, 4218, 4220, 4222, 4224, 4226, 4228, 4230, 4232, 4234, 4236, 4238, 4240, 4242, 4244, 4246, 4248, 4250, 4252, 4254, 4256, 4258, 4260, 4262, 4264, 4266, 4268, 4270, 4272, 4274, 4276, 4278, 4280, 4282, 4284, 4286, 4288, 4290, 4292, 4294, 4296, 4298, 4300, 4302, 4304, 4306, 4308, 4310, 4312, 4314, 4316, 4318, 4320, 4322, 4324, 4326, 4328, 4330, 4332, 4334, 4336, 4338, 4340, 4342, 4344, 4346, 4348, 4350, 4352, 4354, 4356, 4358, 4360, 4362, 4364, 4366, 4368, 4370, 4372, 4374, 4376, 4378, 4380, 4382, 4384, 4386, 4388, 4390, 4392, 4394, 4396, 4398, 4400, 4402, 4404, 4406, 4408, 4410, 4412, 4414, 4416, 4418, 4420, 4422, 4424, 4426, 4428, 4430, 4432, 4434, 4436, 4438, 4440, 4442, 4444, 4446, 4448, 4450, 4452, 4454, 4456, 4458, 4460, 4462, 4464, 4466, 4468, 4470, 4472, 4474, 4476, 4478, 4480, 4482, 4484, 4486, 4488, 4490, 4492, 4494, 4496, 4498, 4500, 4502, 4504, 4506, 4508, 4510, 4512, 4514, 4516, 4518, 4520, 4522, 4524, 4526, 4528, 4530, 4532, 4534, 4536, 4538, 4540, 4542, 4544, 4546, 4548, 4550, 4552, 4554, 4556, 4558, 4560, 4562, 4564, 4566, 4568, 4570, 4572, 4574, 4576, 4578, 4580, 4582, 4584, 4586, 4588, 4590, 4592, 4594, 4596, 4598, 4600, 4602, 4604, 4606, 4608, 4610, 4612, 4614, 4616, 4618, 4620, 4622, 4624, 4626, 4628, 4630, 4632, 4634, 4636, 4638, 4646, 4642, 4644, 4646, 4648, 4650, 4652, 4654, 4656, 4658, 4660, 4662, 4664, 4666, 4668, 4670, 4672, 4674, 4676, 4678, 4680, 4682, 4684, 4686, 4688, 4690, 4692, 4694, 4696, 4698, 4700, 4702, 4704, 4706, 4708, 4710, 4712, 4714, 4716, 4718, 4720, 4722, 4724, 4726, 4728, 4730, 4732, 4734, 4736, 4738, 4740, 4742, 4744, 4746, 4748, 4750, 4752, 4754, 4756, 4758, 4760, 4762, 4764, 4766, 4768, 4770, 4772, 4774, 4776, 4778, 4780, 4782, 4784, 4786, 4788, 4790, 4792, 4794, 4796, 4798, 4800, 4802, 4804, 4806, 4808, 4810, 4812, 4814, 4816, 4818, 4820, 4822, 4824, 4826, 4828, 4830, 4832, 4834, 4836, 4838, 4840, 4842, 4844, 4846, 4848, 4850, 4852, 4854, 4856, 4858, 4860, 4862, 4864, 4866, 4868, 4870, 4872, 4874, 4876, 4878, 4880, 4882, 4884, 4886, 4888, 4890, 4892, 4894, 4896, 4898, 4900, 4902, 4904, 4906, 4908, 4910, 4912, 4914, 4916, 4918, 4920, 4922, 4924, 4926, 4928, 4930, 4932, 4934, 4936, 4938, 4940, 4942, 4944, 4946, 4948, 4950, 4952, 4954, 4956, 4958, 4960, 4962, 4964, 4966, 4968, 4970, 4972, 4974, 4976, 4978, 4980, 4982, 4984, 4986, 4988, 4990, 4992, 4994, 4996, 4998, 5000, 5002, 5004, 5006, 5008, 5010, 5012, 5014, 5016, 5018, 5020, 5022, 5024, 5026, 5028, 5030, 5032, 5034, 5036, 5038, 5040, 5042, 5044, 5046, 5048, 5050, 5052, 5054, 5056, 5058, 5060, 5062, 5064, 5066, 5068, 5070, 5072, 5074, 5076, 5078, 5080, 5082, 5084, 5086, 5088, 5090, 5092, 5094, 5096, 5098, 5100, 5102, 5104, 5106, 5108, 5110, 5112, 5114, 5116, 5118, 5120, 5122, 5124, 5126, 5128, 5130, 5132, 5134, 5136, 5138, 5140, 5142, 5144, 5146, 5148, 5150, 5152, 5154, 5156, 5158, 5160, 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212, 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, 5260, 5262, 5264, 5266, 5268, 5270, 5272, 5274, 5276, 5278, 5280, 5282, 5284, 5286, 5288, 5290, 5292, 5294, 5296, 5298, 5300, 5302, 5304, 5306, 5308, 5310, 5312, 5314, 5316, 5318, 5320, 5322, 5324, 5326, 5328, 5330, 5332, 5334, 5336, 5338, 5340, 5342, 5344, 5346, 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, 5420, 5422, 5424, 5426, 5428, 5430, 5432, 5434, 5436, 5438, 5440, 5442, 5444, 5446, 5448, 5450, 5452, 5454, 5456, 5458, 5460, 5462, 5464, 5466, 5468, 5470, 5472, 5474, 5476, 5478, 5480, 5482, 5484, 5486, 5488, 5490, 5492, 5494, 5496, 5498, 5500, 5502, 5504, 5506, 5508, 5510, 5512, 5514, 5516, 5518, 5520, 5522, 5524, 5526, 5528, 5530, 5532, 5534, 5536, 5538, 5540, 5542, 5544, 5546, 5548, 5550, 5552, 5554, 5556, 5558, 5560, 5562, 5564, 5566, 5568, 5570, 5572, 5574, 5576, 5578, 5580, 5582, 5584, 5586, 5588, 5590, 5592, 5594, 5596, 5598, 5600, 5602, 5604, 5606, 5608, 5610, 5612, 5614, 5616, 5618, 5620, 5622, 5624, 5626, 5628, 5630, 5632, 5634, 5636, 5638, 5640, and 5642.

\* \* \* \* \*

UNITED STATES PATENT AND TRADEMARK OFFICE
CERTIFICATE OF CORRECTION

PATENT NO.       : 7,608,276 B2
APPLICATION NO. : 10/471571
DATED            : October 27, 2009
INVENTOR(S)      : Masignani et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1074 days.

Signed and Sealed this

Twelfth Day of October, 2010

David J. Kappos
*Director of the United States Patent and Trademark Office*